United States Patent
Cao et al.

(10) Patent No.: US 7,314,974 B2
(45) Date of Patent: Jan. 1, 2008

(54) EXPRESSION OF MICROBIAL PROTEINS IN PLANTS FOR PRODUCTION OF PLANTS WITH IMPROVED PROPERTIES

(75) Inventors: Yongwei Cao, Chesterfield, MO (US); Gregory J. Hinkle, Plymouth, MA (US); Steven C. Slater, Middleton, WI (US); Xianfeng Chen, Wildwood, MO (US); Barry S. Goldman, St. Louis, MO (US)

(73) Assignee: Monsanto Technology, LLC, St. Louis, MO (US)

( * ) Notice: Subject to any disclaimer, the term of this patent is extended or adjusted under 35 U.S.C. 154(b) by 422 days.

(21) Appl. No.: 10/369,493

(22) Filed: Feb. 20, 2003

(65) Prior Publication Data

US 2003/0233675 A1 Dec. 18, 2003

Related U.S. Application Data

(60) Provisional application No. 60/360,039, filed on Feb. 21, 2002.

(51) Int. Cl.
*C12N 15/82* (2006.01)
*A01H 5/00* (2006.01)

(52) U.S. Cl. .......................... 800/289; 800/288; 800/290; 800/298; 800/312; 800/320.1

(58) Field of Classification Search ................. 435/419, 435/320.1; 536/23.74; 800/298, 312, 320.1
See application file for complete search history.

(56) References Cited

OTHER PUBLICATIONS

Dietrich F.S. et al. Uniprot Accession P39954, Feb. 1, 1995, Adenosylhomocysteinase (S-adenosyl-L-homocysteine hydrolase) (AdoHcyase), from *Saccharomyces cereviseae*, amino acid sequence from Nucleotide Sequence [Large Scale Genomic DNA].*
Bell M.H. et al. Tobacco plants transformed with cdc25, a mitotic inducer gene from fission yeast. Plant Mol Biol. Nov. 1993; 23(3):445-51.*
Kawalleck P. et al. Induction by fungal elicitor of S-adenosyl-L-methionine synthetase and S-adenosyl-L-homocysteine hydrolase mRNAs in cultured cells and leaves of *Petroselinum crispum*. Proc Natl Acad Sci U S A. May 15, 1992;89(10):4713-7.*
Bell M.H. et al. Tobacco plants transformed with cdc25, a mitotic inducer gene from fission yeast. Plant Mol Biol. Nov. 1993; 23(3):445-51.*
Kawalleck P. et al. Induction by fungal elicitor of S-adenosyl-L-methionine synthetase and S-adenosyl-L-homocysteine hydrolase mRNAs in cultured cells and leaves of *Petroselinum crispum*. Proc Natl Acad Sci U S A. May 15, 1992;89(10):4713-7.*
Dietrich F.S. et al.Uniprot Accession P39954, Feb. 1, 1995, Adenosylhomocysteinase (S-adenosyl-L-homocysteine hydrolase) (AdoHcyase), from *Saccharomyces cereviseae*, amino acid sequence from Nucleotide Sequence [Large Scale Genomic DNA].*

* cited by examiner

*Primary Examiner*—Cynthia Collins
(74) *Attorney, Agent, or Firm*—Donna E. Scherer; Thomas E. Kelley

(57) ABSTRACT

Recombinant constructs and methods useful for improvement of plants are provided. In particular, recombinant constructs comprising promoters functional in plant cells positioned for expression of polynucleotides encoding polypeptides from microbial sources are provided. The disclosed constructs and methods find use in production of transgenic plants to provide plants, particularly crop plants, having improved properties.

8 Claims, No Drawings

EXPRESSION OF MICROBIAL PROTEINS IN PLANTS FOR PRODUCTION OF PLANTS WITH IMPROVED PROPERTIES

CROSS-REFERENCE TO RELATED APPLICATIONS

This application claims priority under 35 U.S.C. § 119 (e) of U.S. Provisional Application No. 60/360,039 filed Feb. 21, 2002, the disclosure of which application is incorporated herein by reference in its entirety.

INCORPORATION OF SEQUENCE LISTING

Two copies of the sequence listing (Copy 1 and Copy 2) and a computer readable form (CRF) of the sequence listing, all on CD-ROMs, each containing the file named pa_00433.rpt, which is 136,695,099 bytes (measured in MS-WINDOWS) and was created on Feb. 7, 2003, are herein incorporated by reference.

INCORPORATION OF TABLES

Two copies of Tables 1 and 2 on CD-ROMs, each containing the file named pa_00420.txt, which is 28,959,455 bytes (measured in MS-WINDOWS) and was created on Feb. 18, 2002, are herein incorporated by reference.

FIELD OF THE INVENTION

Disclosed herein are inventions in the field of plant biochemistry and genetics. More specifically methods of producing transgenic plants having improved properties as the result of expression of microbial polypeptides are provided.

BACKGROUND OF THE INVENTION

The ability to develop transgenic plants with improved traits depends in part on the identification of genes that are useful for production of transformed plants for expression of novel polypeptides. Microbial genes are of interest for expression in transgenic plants for a number of reasons. Bacteria and fungi have been well characterized as model organisms. Therefore there is a wide array of knowledge about the biochemical properties of the genes and pathways in these organisms that allows selection of target genes for expression in plants to produce specific effects on pathways of interest and generate transgenic plants having improved phenotypic properties. In addition, there is a great diversity of genes from which to choose in microorganisms. Of particular interest is the ability to express genes in plants that encode proteins that are not subject to the same types of enzymatic feedback as the native plant genes.

SUMMARY OF THE INVENTION

This invention provides recombinant DNA constructs which provide for expression in plant cells of polypeptides encoded by microbial genes. Expression of such polypeptides in transgenic plants leads to plants having improved phenotypic properties and/or improved response to stressful environmental conditions. Of particular interest are recombinant DNA constructs, wherein said constructs comprise a promoter functional in a plant cell, wherein said promoter is positioned to provide for expression of a polynucleotide encoding a polypeptide from a microbial source, wherein said polynucleotide is selected from the group consisting of:

(a) a polynucleotide comprising a nucleic acid sequence selected from the group consisting of SEQ ID NO:1 through SEQ ID NO:23687;
(b) a polynucleotide encoding a polypeptide having an amino acid sequence selected from the group consisting of SEQ ID NO:23688 through SEQ ID NO:47374;
(c) a polynucleotide having at least 70% sequence identity to a polynucleotide of (a) or (b);
(d) a polynucleotide encoding a polypeptide having at least 80% sequence identity to a polypeptide having an amino acid sequence selected from the group consisting of SEQ ID NO:23688 through SEQ ID NO:47374, wherein said encoded polypeptide is a functional homolog of said polypeptide having an amino acid sequence selected from the group consisting of SEQ ID NO:23688 through SEQ ID NO:47374.

Such constructs are useful for production of transgenic plants having at least one improved biological property as the result of expression of a polypeptide using a construct of this invention. Improved properties of interest include yield, disease resistance, growth rate, stress tolerance and others as set forth in more detail herein.

The present invention also provides a method of improving a biological property of a plant by inserting into cells of said plant a recombinant DNA construct of the present invention.

This invention also provides transformed plants, preferably transformed crop plants, comprising a recombinant DNA construct of the present invention, and having an improved biological property as the result of the expression of a microbial polypeptide from said recombinant DNA construct.

DETAILED DESCRIPTION OF THE INVENTION

The present invention provides recombinant DNA constructs, wherein said constructs comprise a promoter functional in a plant cell, positioned to provide for expression of a polynucleotide encoding a polypeptide from a microbial source. Microbial polypeptides of interest for expression from such constructs are provided herein and are selected for their ability to impart improved properties to transformed plants as the result of modification of any one or more of a variety of plant phenotypes.

The constructs of the present invention find use in generation of transgenic plants to provide for expression of polypeptides encoded by polynucleotides, including the native microbial polynucleotides described herein. As a result of such biotechnological applications, plants, particularly crop plants, having improved properties are obtained. Crop plants of interest in the present invention include, but are not limited to soy, cotton, canola, maize, wheat, sunflower, sorghum, alfalfa, barley, millet, rice, tobacco, fruit and vegetable crops, and turf grass. Of particular interest are expression of the disclosed polypeptides to provide plants having improved yield resulting from improved utilization of key biochemical compounds, such as nitrogen, phosphorous or carbohydrate, or resulting from improved responses to environmental stresses, such as cold, heat, drought or salt, or improved response to attack by pests or pathogens. Constructs of the present invention may also be used to provide plants having improved growth and development, and ultimately increased yield, as the result of modified expression of growth regulators or modification of cell cycle or photosynthesis pathways. Other traits of interest that may be modified in plants using constructs of the present invention include seed oil and protein quantity and quality, herbicide tolerance and rate of homologous recombination.

The polynucleotides or polypeptides from a microbial source as used in this invention may be isolated from the source organism or may be obtained in some other manner, for example by de novo synthesis of polynucleotides. Thus, as used herein, the term "microbial source" indicates that the molecule was identified as naturally existing in a microbe, but does not necessarily indicate the molecule itself was specifically isolated from the source organism.

As used herein a "transgenic" organism is one whose genome has been altered by the incorporation of foreign genetic material or additional copies of native genetic material, e.g. by transformation or recombination.

It is understood that the molecules of the invention may be labeled with reagents that facilitate detection of the molecule. As used herein, a label can be any reagent that facilitates detection, including fluorescent labels (Prober, et al., *Science* 238:336-340 (1987); Albarella et al., EP 144914), chemical labels (Sheldon et al., U.S. Pat. No. 4,582,789; Albarella et al., U.S. Pat. No. 4,563,417), or modified bases (Miyoshi et al., EP 119448), including nucleotides with radioactive elements, e.g. $^{32}P$, $^{33}P$, $^{35}S$ or $^{125}I$ such as $^{32}P$ deoxycytidine-5'-triphosphate ($^{32}PdCTP$).

Polynucleotides are capable of specifically hybridizing to other polynucleotides under certain circumstances. As used herein, two polynucleotides are said to be capable of specifically hybridizing to one another if the two molecules are capable of forming an anti-parallel, double-stranded nucleic acid structure. A nucleic acid molecule is said to be the "complement" of another nucleic acid molecule if the molecules exhibit complete complementarity. As used herein, molecules are said to exhibit "complete complementarity" when every nucleotide in each of the molecules is complementary to the corresponding nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook et al., *Molecular Cloning, A Laboratory Manual*, 2nd Ed., Cold Spring Harbor Press, Cold Spring Harbor, N.Y. (1989), and by Haynes et al., *Nucleic Acid Hybridization, A Practical Approach*, IRL Press, Washington, D.C. (1985).

Departures from complete complementarity are therefore permissible, as long as such departures do not completely preclude the capacity of the molecules to form a double-stranded structure. Thus, in order for a nucleic acid molecule to serve as a primer or probe it need only be sufficiently complementary in sequence to be able to form a stable double-stranded structure under the particular solvent and salt concentrations employed. Appropriate stringency conditions which promote DNA hybridization are, for example, 6.0× sodium chloride/sodium citrate (SSC) at about 45° C., followed by a wash of 2.0×SSC at 50° C. Such conditions are known to those skilled in the art and can be found, for example in *Current Protocols in Molecular Biology*, John Wiley & Sons, N.Y. (1989), 6.3.1-6.3.6. Salt concentration and temperature in the wash step can be adjusted to alter hybridization stringency. For example, conditions may vary from low stringency of about 2.0×SSC at 40° C. to moderately stringent conditions of about 2.0×SSC at 50° C. to high stringency conditions of about 0.2×SSC at 50° C.

As used herein "sequence identity" refers to the extent to which two optimally aligned polynucleotide or peptide sequences are invariant throughout a window of alignment of components, e.g. nucleotides or amino acids. An "identity fraction" for aligned segments of a test sequence and a reference sequence is the number of identical components which are shared by the two aligned sequences divided by the total number of components in the reference sequence segment, i.e. the entire reference sequence or a smaller defined part of the reference sequence. "Percent identity" is the identity fraction times 100. Comparison of sequences to determine percent identity can be accomplished by a number of well-known methods, including for example by using mathematical algorithms, such as those in the BLAST suite of sequence analysis programs.

Polynucleotides—This invention utilizes polynucleotides that encode polypeptides identified from a microbial source. The encoded polypeptides may be the complete protein encoded by an identified microbial gene, or may be fragments of the encoded protein. Preferably, polynucleotides utilized herein encode polypeptides constituting a substantial portion of the complete protein, and more preferentially, constituting a sufficient portion of the complete protein to provide the relevant biological activity.

Of particular interest are polynucleotides that encode polypeptides involved in one or more important biological functions that are common between microbes and plants. Such polynucleotides may be expressed in transgenic plants to produce plants having improved phenotypic properties and/or improved response to stressful environmental conditions. See, for example, Tables 3-21 for a list of improved plant properties and responses and the SEQ ID NOs representing exemplary polynucleotides that may be expressed in transgenic plants to impart such improvements.

Polynucleotides of the present invention are generally used to impart such biological properties by providing for enhanced protein activity in a transgenic organism, preferably a transgenic plant. Enhanced protein activity is evaluated by reference to a wild type cell or organism and can be determined by direct or indirect measurement. Direct measurement of protein activity might include an analytical assay for the protein, per se, or enzymatic product of protein activity. Indirect assay might include measurement of a property affected by the protein.

The polynucleotides that find use in this invention represent genes from a variety of bacterial and fungal sources as shown in Table 1. Nucleic acid sequences of polynucleotides for use in the constructs of the present invention are exemplified herein by the native microbial polynucleotide sequences provided as SEQ ID NO: 1 through SEQ ID NO: 23687.

Also of interest for use in the constructs of the present invention are variants of the polynucleotides provided herein. Such variants may be naturally occurring, including homologous polynucleotides from the same or a different species, or may be non-natural variants, for example polynucleotides synthesized using chemical synthesis methods, or generated using recombinant DNA techniques. Degeneracy of the genetic code provides the possibility to substitute at least one base of the protein encoding sequence of a gene with a different base without causing the amino acid sequence of the polypeptide produced from the gene to be changed. Hence, the DNA utilized in the present invention may also have any base sequence that has been changed from SEQ ID NO: 1 through SEQ ID NO: 23687 by substitution in accordance with degeneracy of the genetic code.

Also of interest regarding variant sequences for expression of microbial polypeptides in plants is the use of polynucleotides optimized for efficient expression of the encoded polypeptide in plants. For example, the encoding polynucleotides can be synthesized or modified using plant preferred codons for improved expression. It is recognized that all or any part of the encoding sequence may be optimized by synthesis or modification, and that partially optimized polynucleotides are also of interest for expression of microbial polypeptides for modification of plant properties. Codon usage tables may be used to identify plant preferred codons, for example by identifying the codons of highest frequency in the proteins expressed in the largest amount in the particular plant species of interest, and to avoid the use of codons that are rarely found in plants. References describing codon usage include: U.S. Pat. No. 5,500,365, Nakamura et al. (2000) *Nucl. Acids Res.* 28:292, Perlak et al. (1991) *Proc. Natl. Acad. Sci. USA* 88:3324-3328, Carels et al. (1998) *J. Mol. Evol.* 46: 45 and Fennoy et al. (993) *Nucl. Acids Res.* 21(23):5294. Codon usage tables for a number of plant species are also available from the Department of Plant Gene Research at the Kazusa DNA Research Institute, Japan, for example at www.kazusa.or.jp/codon/.

Additional sequence modifications are known to enhance gene expression in plant hosts. These include elimination of sequences encoding spurious polyadenylation signals, exon-intron splice site signals, transposon-like repeats, hairpin secondary mRNA structures and other such well-characterized sequences which may be deleterious to gene expression. The G–C content of the sequence may also be adjusted to levels generally used by the target plant host. For example, some microbial genes are very rich (>60%) in adenine (A) and thymine (T) while plant genes are on the order of 45-55% A+T. It is also preferred that regions comprising many consecutive A+T bases or G+C bases are disrupted since these regions are predicted to have a higher likelihood to form hairpin structure due to self-complementarity. Therefore, insertion of heterogeneous base pairs would reduce the likelihood of self-complementary secondary structure formation which are known to inhibit transcription and/or translation in some organisms. In most cases, the adverse effects may be minimized by using sequences which do not contain more than five consecutive A+T or G+C.

As discussed above, modification of the DNA sequences of wild-type genes and construction of t a completely synthetic gene for a given amino acid sequence are both desirable methods for increasing the expression level of non-plant genes in plant cells. In general, regions with multiple consecutive A+T or G+C nucleotides should be avoided. Codons should be selected avoiding the TA and CG doublets where possible. Codon usage can be normalized against a plant preferred codon usage table and the G+C content preferably adjusted to about 50%. The resulting sequence should also be examined to ensure that there are minimal putative plant polyadenylation signals and ATTTA sequences.

Polynucleotides for use in constructs of the present invention that are variants of the polynucleotides described herein will generally demonstrate significant identity with the polynucleotides provided herein. Of particular interest are polynucleotide homologs having at least about 60% sequence identity, at least about 70% sequence identity, at least about 80% sequence identity, at least about 85% sequence identity, and more preferably at least about 90%, 95% or even greater, such as 98% or 99% sequence identity with polynucleotide sequences described herein.

Protein and Polypeptide Molecules—This invention encompasses recombinant DNA expression constructs that provide for production of polypeptides from microbial sources in plants and/or plant cells. Amino acid sequences of the polypeptides of interest for expression using constructs of the present invention are provided herein as SEQ ID NO:23688 through SEQ ID NO:47374.

As used herein, the term "polypeptide" means an unbranched chain of amino acid residues that are covalently linked by an amide linkage between the carboxyl group of one amino acid and the amino group of another. The term polypeptide can encompass whole proteins (i.e. a functional protein encoded by a particular gene), as well as fragments of proteins. Of particular interest are polypeptides which represent whole proteins or a sufficient portion of the entire protein to impart the relevant biological activity of the protein. The term "protein" also includes molecules consisting of one or more polypeptide chains. Thus, a polypeptide for use in constructs of the present invention may also constitute an entire gene product, but only a portion of a functional oligomeric protein having multiple polypeptide chains.

Of particular interest for expression from constructs of the present invention are polypeptides involved in one or more important biological properties in plants. Such polypeptides may be produced in transgenic plants to provide plants having improved phenotypic properties and/or improved response to stressful environmental conditions. See, Tables 3-21 for improved plant properties and responses and the SEQ ID NOs for the polypeptides whose expression in transgenic plants is of interest to impart such improvements. A summary of such improved properties and polypeptides of interest is provided below.

Yield/Nitrogen: Yield improvement by improved nitrogen flow, sensing, uptake, storage and/or transport. Polypeptides useful for imparting such properties include those involved in aspartate and glutamate biosynthesis, polypeptides involved in aspartate and glutamate transport, polypeptides associated with the TOR (Target of Rapamycin) pathway, nitrate transporters, ammonium transporters, chlorate transporters and polypeptides involved in tetrapyrrole biosynthesis.

Yield/Carbohydrate: Yield improvement by effects on carbohydrate metabolism, for example by increased sucrose production and/or transport. Polypeptides useful for improved yield by effects on carbohydrate metabolism include polypeptides involved in sucrose or starch metabolism, carbon assimilation or carbohydrate transport, including, for example sucrose transporters or glucose/hexose transporters, enzymes involved in glycolysis/gluconeogenesis, the pentose phosphate cycle, or raffinose biosynthesis, and polypeptides involved in glucose signaling, such as SNF1 complex proteins.

Yield/Photosynthesis: Yield improvement resulting from increased photosynthesis. Polypeptides useful for increasing the rate of photosynthesis include phytochrome, photosystem I and II proteins, electron carriers, ATP synthase, NADH dehydrogenase and cytochrome oxidase.

Yield/Phosphorus: Yield improvement resulting from increased phosphorus uptake, transport or utilization. Polypeptides useful for improving yield in this manner include phosphatases and phosphate transporters.

Yield/Stress tolerance: Yield improvement resulting from improved plant growth and development by helping plants to tolerate stressful growth conditions. Polypeptides useful for improved stress tolerance under a variety of stress conditions include polypeptides involved in gene regulation, such as serine/threonine-protein kinases, MAP kinases, MAP kinase kinases, and MAP kinase kinase kinases; polypeptides that act as receptors for signal transduction and regulation, such as receptor protein kinases; intracellular signaling proteins, such as protein phosphatases, GTP binding proteins, and phospholipid signaling proteins; polypeptides involved in arginine biosynthesis; polypeptides involved in ATP metabolism, including for example ATPase, adenylate transporters, and polypeptides involved in ATP synthesis and transport; polypeptides involved in glycine betaine, jasmonic acid, flavonoid or steroid biosynthesis; and homoglobin. Enhanced activity of such polypeptides in transgenic plants will provide changes in the ability of a plant to respond to a variety of environmental stresses, such as chemical stress, drought stress and pest stress.

Cold tolerance: Polypeptides of interest for improving plant tolerance to cold or freezing temperatures include polypeptides involved in biosynthesis of trehalose or raffinose, polypeptides encoded by cold induced genes, fatty acyl desaturases and other polypeptides involved in glycerolipid or membrane lipid biosynthesis, which find use in modification of membrane fatty acid composition, alternative oxidase, calcium-dependent protein kinases, LEA proteins and uncoupling protein.

Heat tolerance: Polypeptides of interest for improving plant tolerance to heat include polypeptides involved in biosynthesis of trehalose, polypeptides involved in glycerolipid biosynthesis or membrane lipid metabolism (for altering membrane fatty acid composition), heat shock proteins and mitochondrial NDK.

Osmotic tolerance: Polypeptides of interest for improving plant tolerance to extreme osmotic conditions include polypeptides involved in proline biosynthesis.

Drought tolerance: Polypeptides of interest for improving plant tolerance to drought conditions include aquaporins, polypeptides involved in biosynthesis of trehalose or wax, LEA proteins and invertase.

Pathogen or pest tolerance: Polypeptides of interest for improving plant tolerance to effects of plant pests or pathogens include proteases, polypeptides involved in anthocyanin biosynthesis, polypeptides involved in cell wall metabolism, including cellulases, glucosidases, pectin methylesterase, pectinase, polygalacturonase, chitinase, chitosanase, and cellulose synthase, and polypeptides involved in biosynthesis of terpenoids or indole for production of bioactive metabolites to provide defense against herbivorous insects.

Cell cycle modification: Polypeptides encoding cell cycle enzymes and regulators of the cell cycle pathway are useful for manipulating growth rate in plants to provide early vigor and accelerated maturation leading to improved yield. Improvements in quality traits, such as seed oil content, may also be obtained by expression of cell cycle enzymes and cell cycle regulators. Polypeptides of interest for modification of cell cycle pathway include cyclins and EIF5alpha pathway proteins, polypeptides involved in polyamine metabolism, polypeptides which act as regulators of the cell cycle pathway, including cyclin-dependent kinases (CDKs), CDK-activating kinases, CDK-inhibitors, Rb and Rb-binding proteins, and transcription factors that activate genes involved in cell proliferation and division, such as the E2F family of transcription factors, proteins involved in degradation of cyclins, such as cullins, and plant homologs of tumor suppressor polypeptides.

Seed protein yield/content: Polypeptides useful for providing increased seed protein quantity and/or quality include polypeptides involved in the metabolism of amino acids in plants, particularly polypeptides involved in biosynthesis of methionine/cystein and lysine, amino acid transporters, amino acid efflux carriers, seed storage proteins, proteases, and polypeptides involved in phytic acid metabolism.

Seed oil yield/content: Polypeptides useful for providing increased seed oil quantity and/or quality include polypeptides involved in fatty acid and glycerolipid biosynthesis, beta-oxidation enzymes, enzymes involved in biosynthesis of nutritional compounds, such as carotenoids and tocopherols, and polypeptides that increase embryo size or number or thickness of aleurone.

Disease response in plants: Polypeptides useful for imparting improved disease responses to plants include polypeptides encoded by cercosporin induced genes, antifungal proteins and proteins encoded by R-genes or SAR genes. Expression of such polypeptides in transgenic plants will provide an increase in disease resistance ability of plants.

Galactomannanan biosynthesis: Polypeptides involved in production of galactomannans are of interest for providing plants having increased and/or modified reserve polysaccharides for use in food, pharmaceutical, cosmetic, paper and paint industries.

Flavonoid/isoflavonoid metabolism in plants: Polypeptides of interest for modification of flavonoid/isoflavonoid metabolism in plants include cinnamate-4-hydroxylase, chalcone synthase and flavonol synthase. Enhanced activity of such polypeptides in transgenic plants will provide changes in the quantity and/or speed of flavonoid metabolism in plants and may improve disease resistance by enhancing synthesis of protective secondary metabolites or improving signaling pathways governing disease resistance.

Growth regulators: Polypeptides involved in production of substances that regulate the growth of various plant tissues are of interest in the present invention and may be used to provide transgenic plants having altered morphologies and improved plant growth and development profiles leading to improvements in yield and stress response. Of particular interest are polypeptides involved in the biosynthesis of plant growth hormones, such as gibberellins, cytokinins, auxins, ethylene and abscisic acid, and other proteins involved in the activity and/or transport of such polypeptides, including for example, cytokinin oxidase, cytokinin/purine permeases, F-box proteins, G-protiens and phytosulfokines.

Herbicide tolerance: Polypeptides of interest for producing plants having tolerance to plant herbicides include polypeptides involved in the shikimate pathway, which are of interest for providing glyphosate tolerant plants. Such polypeptides include polypeptides involved in biosynthesis of chorismate, phenylalanine, tyrosine and tryptophan.

Homologous recombination: Increasing the rate of homologous recombination in plants is useful for accelerating the introgression of transgenes into breeding varieties by backcrossing, and to enhance the conventional breeding process by allowing rare recombinants between closely linked genes in phase repulsion to be identified more easily. Polypeptides useful for expression in plants to provide increased homologous recombination include polypeptides involved in mitosis and/or meiosis, including for example, resolvases and polypeptide members of the RAD52 epistasis group.

Lignin biosynthesis: Polypeptides involved in lignin biosynthesis are of interest for increasing plants' resistance to lodging and for increasing the usefulness of plant materials as biofuels.

The function of polypeptides used in constructs of the present invention may be known from previous experimental evidence, or may be determined by comparison of the amino acid sequence of the polypeptides to amino acid sequences of other polypeptides for which a function is known. A variety of homology based search algorithms are available to compare a query sequence to a protein database, including for example, BLAST, FASTA, and Smith-Waterman. In the present application, BLASTX and BLASTP algorithms are used to provide protein function information. A number of values are examined in order to assess the confidence of the function assignment. Useful measurements include "E-value" (also shown as "hit_p"), "percent identity", "percent query coverage", and "percent hit coverage".

In BLAST, E-value, or expectation value, represents the number of different alignments with scores equivalent to or better than the raw alignment score, S, that are expected to occur in a database search by chance. The lower the E value, the more significant the match. Because database size is an element in E-value calculations, E-values obtained by BLASTing against public databases, such as GenBank, have generally increased over time for any given query/entry match. In setting criteria for confidence of polypeptide function prediction, a "high" BLAST match is considered herein as having an E-value for the top BLAST hit provided in Table 1 of less than 1E-30; a medium BLASTX E-value is 1E-30 to 1E-8; and a low BLASTX E-value is greater than 1E-8.

Percent identity refers to the percentage of identically matched amino acid residues that exist along the length of that portion of the sequences which is aligned by the BLAST algorithm. In setting criteria for confidence of polypeptide function prediction, a "high" BLAST match is considered herein as having percent identity for the top BLAST hit provided in Table 1 of at least 70%; a medium percent identity value is 35% to 70%; and a low percent identity is less than 35%.

Of particular interest in protein function assignment in the present invention is the use of combinations of E-values, percent identity, query coverage and hit coverage. Query coverage refers to the percent of the query sequence that is represented in the BLAST alignment. Hit coverage refers to the percent of the database entry that is represented in the BLAST alignment. In the present invention, function of a query polypeptide is inferred from function of a protein homolog where either (1) (hit_p<1e-30 or % identity>35%) AND query_coverage>50% AND hit_coverage>50%, or (2) hit_p<1e-8 AND query_coverage>70% AND hit_coverage>70%.

Functional homologs which differ in one or more amino acids from those of a polypeptide described herein as the result of one or more conservative amino acid substitutions are also of interest for expression in plants using the constructs of the present invention. It is well known in the art that one or more amino acids in a native sequence can be substituted with at least one other amino acid, the charge and polarity of which are similar to that of the native amino acid, resulting in a silent change. For instance, valine is a conservative substitute for alanine and threonine is a conservative substitute for serine. Conservative substitutions for an amino acid within the native polypeptide sequence can be selected from other members of the class to which the naturally occurring amino acid belongs. Amino acids can be divided into the following four groups: (1) acidic amino acids, (2) basic amino acids, (3) neutral polar amino acids, and (4) neutral nonpolar amino acids. Representative amino acids within these various groups include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a native amino acid sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Naturally conservative amino acids substitution groups are: valine-leucine, valine-isoleucine, phenylalanine-tyrosine, lysine-arginine, alanine-valine, aspartic acid-glutamic acid, and asparagine-glutamine. Also of interest for expression in transgenic plants using constructs as described herein are polypeptides which differ in one or more amino acids from those of a microbial polypeptide described herein as the result of deletion or insertion of one or more amino acids in a native sequence.

Also of interest for use in constructs of the present invention are functional homologs of the polypeptides described herein which have the same function as a microbial polypeptide provided herein, but with increased or decreased activity or altered specificity. Such variations in protein activity may exist naturally in polypeptides encoded by related genes, for example in a related polypeptide encoded by a different allele or in a different species, or can be achieved by mutagenesis. Naturally occurring variant polypeptides may be obtained by well known nucleic acid or protein screening methods using DNA or antibody probes, for example by screening libraries for genes encoding related polypeptides, or in the case of expression libraries, by screening directly for variant polypeptides. Screening methods for obtaining a modified protein or enzymatic activity of interest by mutagenesis are disclosed in U.S. Pat. No. 5,939,250. An alternative approach to the generation of variants uses random recombination techniques such as "DNA shuffling" as disclosed in U.S. Pat. Nos. 5,605,793; 5,811,238; 5,830,721 and 5,837,458; and International Applications WO 98/31837 and WO 99/65927, all of which are incorporated herein by reference. An alternative method of molecular evolution involves a staggered extension process (StEP) for in vitro mutagenesis and recombination of nucleic acid molecule sequences, as disclosed in U.S. Pat. No. 5,965,408 and International Application WO 98/42832, both of which are incorporated herein by reference.

Polypeptide variants useful for expression in transgenic plants will generally demonstrate significant identity with the polypeptides described herein. Of particular interest are polypeptides having at least about 35% sequence identity, at least about 50% sequence identity, at least about 60% sequence identity, at least about 70% sequence identity, at least about 80% sequence identity, and more preferably at least about 85%, 90%, 95% or even greater, sequence identity with polypeptide sequences described herein. Of particular interest in the present invention are polypeptides having amino acid sequences provided herein (reference polypeptides) and functional homologs of such reference polypeptides, wherein such functional homologs comprises at least 50 consecutive amino acids having at least 80% identity to a 50 amino acid polypeptide fragment of said reference polypeptide.

Recombinant DNA Constructs—The present invention encompasses the use of polynucleotides described herein in recombinant constructs, i.e. constructs comprising polynucleotides that are constructed or modified outside of cells and that join nucleic acids that are not found joined in nature. Using methods known to those of ordinary skill in the art, polypeptide encoding sequences of this invention can be inserted into recombinant DNA constructs that can be introduced into a host cell of choice for expression of the encoded protein. Of particular interest in the present invention is the use of the polynucleotides of the present invention for preparation of constructs for use in plant transformation.

In plant transformation, exogenous genetic material is transferred into a plant cell. By "exogenous" it is meant that a nucleic acid molecule, for example a recombinant DNA construct comprising a polynucleotide of the present invention, is produced outside the organism, e.g. plant, into which it is introduced. An exogenous nucleic acid molecule can have a naturally occurring or non-naturally occurring nucleotide sequence. One skilled in the art recognizes that an exogenous nucleic acid molecule can be derived from the same species into which it is introduced or from a different species. Such exogenous genetic material may be transferred into either monocot or dicot plants including, but not limited to, soy, cotton, canola, maize, teosinte, wheat, rice and *Arabidopsis* plants. Transformed plant cells comprising such exogenous genetic material may be regenerated to produce whole transformed plants.

Exogenous genetic material may be transferred into a plant cell by the use of a DNA vector or construct designed for such a purpose. A construct can comprise a number of sequence elements, including promoters, encoding regions, and selectable markers. Vectors are available which have been designed to replicate in both *E. coli* and *A. tumefaciens* and have all of the features required for transferring large inserts of DNA into plant chromosomes. Design of such vectors is generally within the skill of the art. See, for example, *Plant Molecular Biology: A Laboratory Manual*, Clark (ed.), Springier, New York (1997).

A construct will generally include a plant promoter to direct transcription of the protein encoding region of choice. Numerous promoters that are active in plant cells have been described in the literature. These include the nopaline synthase (NOS) promoter and octopine synthase (OCS) promoters carried on tumor-inducing plasmids of *Agrobacterium tumefaciens*, caulimovirus promoters such as the cauliflower mosaic virus (CaMV) 19S promoter (Lawton et al., *Plant Mol. Biol.* 9:315-324 (1987) and 35S promoter (Odell et al., *Nature* 313:810-812 (1985), CaMV enhanced 35s promoter and the figwort mosaic virus 35S-promoter. Other desirable promoters include the light-inducible promoter from the small subunit of ribulose-1,5-bis-phosphate carboxylase (ssRUBISCO), the actin 1 promoter from rice (McElroy et al. (1991) *Mol. Gen. Genet.* 231:150-160) or maize (Wang et al. (1992) *Molecular and Cellular Biology* 12:3399-3406), the Adh promoter (Walker et al., *Proc. Natl. Acad. Sci. (U.S.A.)* 84:6624-6628 (1987), the sucrose synthase promoter (Yang et al. (1990) *Proc. Natl. Acad. Sci. (U.S.A.)* 87:4144-4148), the R gene complex promoter (Chandler et al. (1989) *The Plant Cell* 1:1175-1183), and the chlorophyll a/b binding protein gene promoter. These promoters and numerous others have been used to create DNA constructs for expression in plants. See, for example, PCT publication WO 84/02913. Any promoter known or found to cause transcription of DNA in plant cells can be used in the invention. Other useful promoters are described, for example, in U.S. Pat. Nos. 5,378,619; 5,391,725; 5,428,147; 5,447,858; 5,608,144; 5,608,144; 5,614,399; 5,633,441; 5,633,435; and 4,633,436, all of which are incorporated herein by reference.

In addition, promoter enhancers, such as the CaMV 35S enhancer (Kay et al. (1987) *Science* 236:1299-1302) or a tissue specific enhancer (Fromm et al. (1989) *The Plant Cell* 1:977-984), may be used to enhance gene transcription levels. Enhancers often are found 5' to the start of transcription in a promoter that functions in eukaryotic cells, but can often be inserted in the forward or reverse orientation 5' or 3' to the coding sequence. In some instances, these 5' enhancing elements are introns. Deemed to be particularly useful as enhancers are the 5' introns of the rice actin 1 and rice actin 2 genes. Examples of other enhancers which can be used in accordance with the invention include elements from octopine synthase genes (Ellis et al. (1987) *EMBO Journal* 6:3203-3208), the maize alcohol dehydrogenase gene intron 1 (Callis et al. (1987) *Genes and Develop.* 1:1183-1200), elements from the maize shrunken 1 gene, the sucrose synthase intron (Vasil et al. (1989) *Plant Physiol.* 91:1575-1579) and the TMV omega element (Gallie et al. (1989) *The Plant Cell* 1:301-311), and promoters from non-plant eukaryotes (e.g., yeast; Ruden et al. (1988) *Proc Natl. Acad. Sci.* 85:4262-4266). DNA constructs can also contain one or more 5' non-translated leader sequences which serve to enhance polypeptide production from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al. (1996) *Plant Mol. Biol.* 32:393-405).

Constructs and vectors may also include, with the coding region of interest, a nucleic acid sequence that acts, in whole or in part, to terminate transcription of that region. One type of 3' untranslated sequence which may be used is a 3' UTR from the nopaline synthase gene (nos 3') of *Agrobacterium tumefaciens* (Bevan et al. (1983) *Nucleic Acids Res.* 11:369-385). Other 3' termination regions of interest include those from a gene encoding the small subunit of a ribulose-1,5-bisphosphate carboxylase-oxygenase (rbcS), and more specifically, from a rice rbcS gene (PCT Publication WO 00/70066), the 3' UTR for the T7 transcript of *Agrobacterium tumefaciens* (Dhaese et al. (1983) *EMBO J* 2:419-426), the 3' end of the protease inhibitor I or II genes from potato (An et al. (1989) *Plant Cell* 1:115-122) or tomato (Pearce et al. (1991) *Science* 253:895-898), and the 3' region isolated from Cauliflower Mosaic Virus (Timmermans et al. (1990) *J Biotechnol* 14:333-344). Alternatively, one also can use a gamma coixin, oleosin 3 or other 3' UTRs from the genus *Coix* (PCT Publication WO 99/58659).

Constructs and vectors may also include a selectable marker. Selectable markers may be used to select for plants or plant cells that contain the exogenous genetic material. Examples of such include, but are not limited to, a nptII gene (Potrykus et al. (1985) *Mol. Gen. Genet.* 199:183-188)

which codes for kanamycin resistance and can be selected for using kanamycin, G418, etc.; a bar gene which codes for bialaphos resistance; a mutant EPSP synthase gene (Hinchee et al. (1988) *Bio/Technology* 6:915-922) which encodes glyphosate resistance; a nitrilase gene which confers resistance to bromoxynil (Stalker et al. (1988) *J. Biol. Chem.* 263:6310-6314); a mutant acetolactate synthase gene (ALS) which confers imidazolinone or sulphonylurea resistance (European Patent Application 154,204 (Sep. 11, 1985)); and a methotrexate resistant DHFR gene (Thillet et al. (1988) *J. Biol. Chem.* 263:12500-12508.

Constructs and vectors may also include a screenable marker. Screenable markers may be used to monitor transformation. Exemplary screenable markers include a β-glucuronidase or uidA gene (GUS) which encodes an enzyme for which various chromogenic substrates are known (Jefferson (1987) *Plant Mol. Biol, Rep.* 5:387-405); Jefferson et al. (1987) *EMBO J.* 6:3901-3907); an R-locus gene, which encodes a product that regulates the production of anthocyanin pigments (red color) in plant tissues (Dellaporta et al. (1988) *Stadler Symposium* 11:263-282); Other possible selectable and/or screenable marker genes will be apparent to those of skill in the art.

Constructs and vectors may also include a transit peptide for targeting of a gene target to a plant organelle, particularly to a chloroplast, leucoplast or other plastid organelle (European Patent Application Publication Number 0218571).

For use in *Agrobacterium* mediated transformation methods, constructs of the present invention will also include T-DNA border regions flanking the DNA to be inserted into the plant genome to provide for transfer of the DNA into the plant host chromosome as discussed in more detail below. An exemplary plasmid that finds use in such transformation methods is pCGN8640, a T-DNA vector that can be used to clone exogenous genes and transfer them into plants using *Agrobacterium*-mediated transformation. pCGN8640 has the restriction sites BamH1, Not1, HindIII, PstI, and SacI positioned between a 35S promoter element and a transcription terminator. Flanking this DNA are the left border and right border sequences necessary for *Agrobacterium* transformation. The plasmid also has origins of replication for maintaining the plasmid in both *E. coli* and *Agrobacterium tumefaciens* strains. A spectinomycin resistance gene on the plasmid can be used to select for the presence of the plasmid in both *E. coli* and *Agrobacterium tumefaciens*.

A candidate gene is prepared for insertion into the T-DNA vector, for example using well-known gene cloning techniques such as PCR. Restriction sites may be introduced onto each end of the gene to facilitate cloning. For example, candidate genes may be amplified by PCR techniques using a set of primers. Both the amplified DNA and the cloning vector are cut with the same restriction enzymes, for example, NotI and PstI. The resulting fragments are gel-purified, ligated together, and transformed into *E. coli*. Plasmid DNA containing the vector with inserted gene may be isolated from *E. coli* cells selected for spectinomycin resistance, and the presence to the desired insert in pCGN8640 verified by digestion with the appropriate restriction enzymes. Undigested plasmid may then be transformed into *Agrobacterium tumefaciens* using techniques well known to those in the art, and transformed *Agrobacterium* cells containing the vector of interest selected based on spectinomycin resistance. These and other similar constructs useful for plant transformation may be readily prepared by one skilled in the art.

Transformation Methods and Transgenic Plants—Methods and compositions for transforming bacteria and other microorganisms are known in the art. See for example Sambrook et al. (1989) *Molecular Cloning: A Laboratory Manual*, Second Edition, Cold Spring Harbor Laboratory Press, Cold Spring Harbor, N.Y.).

Technology for introduction of DNA into cells is well known to those of skill in the art. Known methods for delivering a gene into cells include: (a) chemical methods (Graham and van der Eb (1973) *Virology* 54:536-539); (b) physical methods such as microinjection (Capecchi (1980) *Cell* 22:479-488), electroporation (Wong and Neumann (1982) *Biochem. Biophys. Res. Commun.* 107:584-587); Fromm et al. (1985) *Proc. Natl. Acad. Sci. (U.S.A.)* 82:5824-5828); U.S. Pat. No. 5,384,253); the gene gun (Johnston and Tang (1994) *Methods Cell Biol.* 43:353-365); (c) viral vectors (Clapp (1993) *Clin. Perinatol.* 20:155-168); Lu et al. (1993) *J. Exp. Med.* 178:2089-2096); Eglitis and Anderson (1988) *Biotechniques* 6:608-614); (d) receptor-mediated mechanisms (Curiel et al. (1992) *Hum. Gen. Ther.* 3:147-154), Wagner et al. (1992) *Proc. Natl. Acad. Sci. (USA)* 89:6099-6103); and (e) *Agrobacterium tumefaciens*-mediated transformation of plants (Fraley et al., *Bio/Technology* 3:629-635 (1985); and Rogers et al. (1987) *Methods Enzymol.* 153:253-277). In addition, DNA constructs and methods for stably transforming plant plastids have been described; see, for example U.S. Pat. No. 5,877,402, incorporated herein by reference.

After transformation, the transformed plant cells or tissues may be grown in an appropriate medium to promote cell proliferation and regeneration. In the case of protoplasts the cell wall will first be allowed to reform under appropriate osmotic conditions, and the resulting callus introduced into a nutrient regeneration medium to promote the formation of shoots and roots. For gene gun transformation of wheat and maize see U.S. Pat. Nos. 6,153,812 and 6,160,208, both of which are incorporated herein by reference. See also, Chistou (1996) *Particle Bombardment for Genetic Engineering of Plants*, Biotechnology Intelligence Unit, Academic Press, San Diego, Calif.), and in particular, pp. 63-69 (maize), and pp50-60 (rice).

The use of *Agrobacterium*-mediated plant integrating vectors to introduce DNA into plant cells for production of stably transformed whole plants is well known in the art. The region of DNA to be transferred into the host genome is defined by the tDNA border sequences in *Agrobacterium*-mediated plant integrating vectors and intervening DNA is usually inserted into the plant genome as described (Spielmann et al. (1986) *Mol. Gen. Genet.* 205:34). See also U.S. Pat. Nos. 5,416,011; 5,463,174; and 5,959,179 for *Agrobacterium* mediated transformation of soy; U.S. Pat. Nos. 5,591,616 and 5,731,179 for *Agrobacterium* mediated transformation of monocots such as maize; and U.S. Pat. No. 6,037,527 for *Agrobacterium* mediated transformation of cotton, all of which are incorporated herein by reference. Modern *Agrobacterium* transformation vectors are capable of replication in *E. coli* as well as *Agrobacterium*, allowing for convenient manipulations (Klee et al. (1985) In: *Plant DNA Infectious Agents*, Hohn and Schell (eds.), Springer-Verlag, New York, pp. 179-203).

Microprojectile bombardment techniques are also widely applicable, and may be used to transform virtually any plant species. Examples of species which have been transformed by microprojectile bombardment include monocot species such as maize (PCT Publication WO 95/06128), barley, wheat (U.S. Pat. No. 5,563,055), rice, oats, rye, sugarcane, and sorghum, and dicot species including tobacco, soybean (U.S. Pat. No. 5,322,783), sunflower, cotton, tomato, and legumes in general (U.S. Pat. No. 5,563,055).

Any of the constructs of the present invention may be introduced into a plant cell in a permanent or transient manner in combination with other genetic elements such as vectors, promoters enhancers etc. Further any of the constructs of the present invention may be introduced into a plant cell in a manner that allows for production in the plant cell of one or more polypeptides encoded by microbial polynucleotides in the construct.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and out-crossing with a non-transgenic plant are also contemplated, as is vegetative propagation.

Expression of microbial polynucleotides using constructs of the present invention and the concomitant production of polypeptides encoded by the polynucleotides is of interest for production of transgenic plants having improved properties, particularly, improved properties which result in crop plant yield improvement. Expression of polypeptides in plant cells may be evaluated by specifically identifying the protein products of the introduced genes or evaluating the phenotypic changes brought about by their expression.

Assays for the production and identification of specific proteins make use of various physical-chemical, structural, functional, or other properties of the proteins. Unique physical-chemical or structural properties allow the proteins to be separated and identified by electrophoretic procedures, such as native or denaturing gel electrophoresis or isoelectric focusing, or by chromatographic techniques such as ion exchange or gel exclusion chromatography. The unique structures of individual proteins offer opportunities for use of specific antibodies to detect their presence in formats such as an ELISA assay. Combinations of approaches may be employed with even greater specificity such as western blotting in which antibodies are used to locate individual gene products that have been separated by electrophoretic techniques. Additional techniques may be employed to absolutely confirm the identity of the product of interest such as evaluation by amino acid sequencing following purification. Although these are among the most commonly employed, other procedures may be additionally used.

Assay procedures may also be used to identify the expression of proteins by their functionality, particularly where the expressed protein is an enzyme capable of catalyzing chemical reactions involving specific substrates and products. These reactions may be measured, for example in plant extracts, by providing and quantifying the loss of substrates or the generation of products of the reactions by physical and/or chemical procedures.

In many cases, the expression of a gene product is determined by evaluating the phenotypic results of its expression. Such evaluations may be simply as visual observations, or may involve assays. Such assays may take many forms including but not limited to analyzing changes in the chemical composition, morphology, or physiological properties of the plant. Chemical composition may be altered by expression of genes encoding enzymes or storage proteins which change amino acid composition and may be detected by amino acid analysis, or by enzymes which change starch quantity which may be analyzed by near infrared reflectance spectrometry. Morphological changes may include greater stature or thicker stalks.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual*, Cold Spring Harbor Press (1989); Mailga et al., *Methods in Plant Molecular Biology*, Cold Spring Harbor Press (1995; Birren et al., *Genome Analysis: Analyzing DNA*, 1, Cold Spring Harbor, N.Y. (1998)).

Having now generally described the invention, the same will be more readily understood through reference to the following example which is provided by way of illustration, and are not intended to be limiting of the present invention, unless specified.

EXAMPLE

Functions of polypeptides encoded by the microbial polynucleotide sequences described herein are determined using a hierarchical classification tool, termed FunCAT, for Functional Categories Annotation Tool. Most categories collected in FunCAT are classified by function, although other criteria are used, for example, cellular localization or temporal process. The assignment of a functional category to a query sequence is based on BLASTX sequence search, which compares two protein sequences. FunCAT assigns categories by iteratively scanning through all BLAST hits, starting with the most significant match, and reporting the first category assignment for each FunCAT source classification scheme. In the present invention, function of a query polypeptide is inferred from the function of a protein homolog where either (1) (hit_p<1e-30 or % identity>35%) AND query_coverage>50% AND hit_coverage>50%, or (2) hit_p<1e-8 AND query_coverage>70% AND hit_coverage>70%.

Functional assignments from five public classification schemes, GO_BP, GO_CC, GO_MF, KEGG and EC, and one internal Monsanto classification scheme, POI, are provided in Table 1. The column under the heading "cat_type" indicates the source of the classification. GO_BP=Gene Ontology Consortium–biological process; GO_CC=Gene Ontology Consortium–cellular component; GO_MF=Gene Ontology Consortium–molecular function; KEGG=KEGG functional hierarchy; EC=Enzyme Classification from ENZYME data bank release 25.0; POI=Pathways of Interest. The column under the heading "cat_desc" provides the name of the subcategory into which the query sequence was classified. The column under the heading "hit_desc" provides a description of the BLAST hit to the query sequences that led to the specific classification. The column under the heading "hit_p" provides the e-value for the BLAST hit.

Table 2 provides the SEQ ID NO (SEQ NUM), sequence designation (SEQ ID) of exemplary DNA sequence encoding the polypeptides described in Table 1. Table 2 also provides the SEQ ID NO (Prot Num) and sequence designation (Prot ID) of the proteins encoded by the nucleotide sequences.

Sequences useful for producing transgenic plants having improved biological properties are identified from their FunCAT annotations and are provided in Tables 3-21. a biological property of particular interest is plant yield. Plant yield may be improved by alteration of a variety of plant pathways, including those involving nitrogen, carbohydrate, or phosphorus utilization and/or uptake. Plant yield may also be improved by alteration of a plant's photosynthetic capacity or by improving a plant's ability to tolerate a variety of environmental stresses, including cold, heat, drought and osmotic stresses. Other biological properties of interest that may be improved using sequences of the present invention include pathogen or pest tolerance, herbicide tolerance, disease resistance, growth rate (for example by modification of cell cycle or expression of growth regulators), seed oil and/or protein yield and quality, rate and control of recombination, and lignin content.

TABLE 3

Cold Tolerance

Table 3A SEQ ID NOs of Polypeptides useful for improving Cold Tolerance

| 4 | 5 | 6 | 11 | 19 | 26 | 31 | 36 | 39 | 52 | 56 | 81 |
|---|---|---|----|----|----|----|----|----|----|----|----|
| 88 | 90 | 91 | 101 | 109 | 117 | 118 | 121 | 122 | 128 | 145 | 146 |
| 147 | 151 | 153 | 154 | 156 | 178 | 191 | 195 | 204 | 230 | 238 | 247 |
| 257 | 272 | 274 | 275 | 295 | 310 | 321 | 325 | 332 | 338 | 342 | 350 |
| 356 | 378 | 379 | 390 | 393 | 395 | 396 | 400 | 413 | 418 | 436 | 437 |
| 443 | 449 | 456 | 459 | 466 | 477 | 479 | 491 | 508 | 510 | 515 | 516 |
| 525 | 526 | 531 | 541 | 543 | 544 | 548 | 549 | 555 | 570 | 571 | 576 |
| 585 | 587 | 599 | 609 | 623 | 631 | 636 | 646 | 648 | 664 | 665 | 672 |
| 681 | 682 | 684 | 696 | 725 | 744 | 752 | 756 | 757 | 761 | 782 | 787 |
| 788 | 815 | 822 | 835 | 852 | 854 | 859 | 871 | 874 | 883 | 885 | 890 |
| 895 | 897 | 903 | 904 | 909 | 937 | 964 | 975 | 976 | 980 | 983 | 985 |
| 987 | 993 | 995 | 997 | 1007 | 1024 | 1025 | 1035 | 1036 | 1041 | 1047 | 1055 |
| 1057 | 1070 | 1094 | 1105 | 1113 | 1123 | 1130 | 1132 | 1135 | 1145 | 1149 | 1173 |
| 1174 | 1183 | 1184 | 1185 | 1186 | 1200 | 1207 | 1214 | 1217 | 1220 | 1229 | 1241 |
| 1245 | 1250 | 1255 | 1292 | 1309 | 1310 | 1312 | 1313 | 1337 | 1341 | 1346 | 1347 |
| 1349 | 1358 | 1402 | 1403 | 1417 | 1434 | 1437 | 1459 | 1463 | 1464 | 1476 | 1477 |
| 1500 | 1507 | 1510 | 1552 | 1556 | 1564 | 1578 | 1597 | 1604 | 1615 | 1617 | 1624 |
| 1627 | 1632 | 1636 | 1664 | 1673 | 1685 | 1699 | 1702 | 1712 | 1740 | 1746 | 1748 |
| 1797 | 1834 | 1878 | 1883 | 1899 | 1903 | 1920 | 1928 | 1934 | 1952 | 1953 | 2007 |
| 2023 | 2042 | 2044 | 2051 | 2084 | 2097 | 2105 | 2107 | 2118 | 2124 | 2139 | 2146 |
| 2147 | 2148 | 2163 | 2174 | 2184 | 2186 | 2194 | 2198 | 2211 | 2212 | 2230 | 2233 |
| 2245 | 2254 | 2259 | 2263 | 2268 | 2270 | 2280 | 2286 | 2294 | 2302 | 2303 | 2304 |
| 2306 | 2311 | 2315 | 2321 | 2333 | 2377 | 2394 | 2413 | 2425 | 2430 | 2445 | 2450 |
| 2457 | 2485 | 2496 | 2497 | 2503 | 2517 | 2518 | 2546 | 2566 | 2567 | 2568 | 2599 |
| 2602 | 2612 | 2622 | 2625 | 2626 | 2632 | 2634 | 2642 | 2651 | 2687 | 2706 | 2708 |
| 2731 | 2739 | 2746 | 2750 | 2751 | 2752 | 2755 | 2768 | 2773 | 2788 | 2818 | 2824 |
| 2828 | 2835 | 2846 | 2847 | 2851 | 2853 | 2860 | 2864 | 2878 | 2882 | 2887 | 2894 |
| 2895 | 2896 | 2900 | 2905 | 2907 | 2916 | 2919 | 2929 | 2936 | 2945 | 2947 | 2959 |
| 2960 | 2968 | 2984 | 2987 | 2990 | 2991 | 3005 | 3012 | 3031 | 3035 | 3044 | 3047 |
| 3052 | 3057 | 3066 | 3069 | 3070 | 3100 | 3137 | 3138 | 3139 | 3156 | 3165 | 3180 |
| 3184 | 3191 | 3198 | 3200 | 3231 | 3234 | 3236 | 3240 | 3260 | 3271 | 3288 | 3291 |
| 3305 | 3334 | 3343 | 3357 | 3363 | 3366 | 3389 | 3395 | 3419 | 3441 | 3442 | 3469 |
| 3481 | 3482 | 3485 | 3488 | 3518 | 3522 | 3559 | 3561 | 3563 | 3570 | 3575 | 3588 |
| 3592 | 3597 | 3603 | 3658 | 3663 | 3683 | 3688 | 3700 | 3703 | 3705 | 3715 | 3722 |
| 3724 | 3733 | 3736 | 3741 | 3747 | 3751 | 3752 | 3757 | 3775 | 3780 | 3845 | 3853 |
| 3880 | 3888 | 3892 | 3931 | 3932 | 3938 | 3958 | 3966 | 3968 | 3976 | 3978 | 3987 |
| 3995 | 4006 | 4019 | 4021 | 4041 | 4075 | 4076 | 4078 | 4079 | 4093 | 4098 | 4100 |
| 4110 | 4117 | 4122 | 4142 | 4145 | 4154 | 4160 | 4178 | 4189 | 4195 | 4198 | 4202 |
| 4205 | 4234 | 4236 | 4272 | 4277 | 4280 | 4290 | 4291 | 4294 | 4295 | 4301 | 4302 |
| 4311 | 4312 | 4313 | 4316 | 4334 | 4362 | 4366 | 4375 | 4388 | 4391 | 4398 | 4416 |
| 4433 | 4438 | 4464 | 4487 | 4491 | 4496 | 4497 | 4505 | 4506 | 4507 | 4521 | 4548 |
| 4569 | 4580 | 4582 | 4590 | 4591 | 4599 | 4644 | 4657 | 4676 | 4686 | 4701 | 4706 |
| 4709 | 4721 | 4727 | 4729 | 4748 | 4762 | 4781 | 4783 | 4805 | 4806 | 4807 | 4811 |
| 4815 | 4818 | 4826 | 4829 | 4833 | 4837 | 4850 | 4866 | 4874 | 4885 | 4897 | 4898 |
| 4899 | 4911 | 4912 | 4920 | 4926 | 4960 | 4970 | 4979 | 4990 | 4991 | 4994 | 5002 |
| 5007 | 5012 | 5022 | 5035 | 5038 | 5045 | 5065 | 5089 | 5093 | 5097 | 5105 | 5116 |
| 5117 | 5118 | 5125 | 5154 | 5158 | 5180 | 5181 | 5183 | 5208 | 5212 | 5216 | 5226 |
| 5230 | 5233 | 5238 | 5239 | 5240 | 5241 | 5247 | 5248 | 5249 | 5250 | 5251 | 5252 |
| 5254 | 5255 | 5257 | 5268 | 5275 | 5278 | 5279 | 5298 | 5306 | 5320 | 5338 | 5339 |
| 5363 | 5378 | 5380 | 5394 | 5397 | 5399 | 5408 | 5423 | 5450 | 5468 | 5480 | 5485 |
| 5493 | 5496 | 5501 | 5516 | 5544 | 5547 | 5548 | 5550 | 5553 | 5567 | 5576 | 5588 |
| 5613 | 5614 | 5615 | 5616 | 5617 | 5618 | 5638 | 5640 | 5644 | 5650 | 5659 | 5660 |
| 5669 | 5686 | 5695 | 5698 | 5699 | 5700 | 5709 | 5713 | 5714 | 5717 | 5718 | 5723 |
| 5726 | 5727 | 5736 | 5769 | 5772 | 5777 | 5784 | 5785 | 5789 | 5795 | 5805 | 5812 |
| 5814 | 5827 | 5828 | 5855 | 5858 | 5866 | 5935 | 5936 | 5937 | 5950 | 5951 | 5955 |
| 5966 | 5968 | 5974 | 5993 | 6000 | 6001 | 6002 | 6007 | 6011 | 6014 | 6017 | 6018 |
| 6024 | 6028 | 6036 | 6042 | 6057 | 6076 | 6077 | 6086 | 6089 | 6095 | 6096 | 6115 |
| 6123 | 6135 | 6136 | 6144 | 6160 | 6163 | 6173 | 6174 | 6177 | 6188 | 6190 | 6193 |
| 6194 | 6219 | 6223 | 6231 | 6240 | 6241 | 6260 | 6287 | 6310 | 6312 | 6314 | 6315 |
| 6316 | 6317 | 6318 | 6322 | 6338 | 6343 | 6347 | 6348 | 6349 | 6350 | 6351 | 6352 |
| 6365 | 6366 | 6367 | 6374 | 6376 | 6378 | 6381 | 6388 | 6400 | 6421 | 6435 | 6442 |
| 6443 | 6449 | 6455 | 6456 | 6467 | 6470 | 6509 | 6510 | 6511 | 6515 | 6518 | 6520 |
| 6531 | 6532 | 6535 | 6536 | 6546 | 6549 | 6558 | 6587 | 6588 | 6589 | 6590 | 6591 |
| 6592 | 6596 | 6602 | 6617 | 6630 | 6637 | 6654 | 6668 | 6682 | 6702 | 6703 | 6706 |
| 6728 | 6730 | 6734 | 6749 | 6750 | 6756 | 6766 | 6768 | 6773 | 6776 | 6780 | 6796 |
| 6804 | 6819 | 6820 | 6828 | 6829 | 6836 | 6839 | 6845 | 6851 | 6854 | 6870 | 6879 |
| 6880 | 6922 | 6927 | 6940 | 6941 | 6977 | 6978 | 6979 | 6983 | 6991 | 7000 | 7001 |
| 7031 | 7035 | 7046 | 7047 | 7050 | 7051 | 7057 | 7058 | 7067 | 7068 | 7069 | 7072 |
| 7090 | 7116 | 7120 | 7129 | 7136 | 7143 | 7146 | 7153 | 7172 | 7191 | 7197 | 7224 |

TABLE 3-continued

Cold Tolerance

| | | | | | | | | | | | |
|---|---|---|---|---|---|---|---|---|---|---|---|
| 7246 | 7250 | 7255 | 7256 | 7263 | 7264 | 7265 | 7266 | 7280 | 7326 | 7337 | 7339 |
| 7347 | 7348 | 7356 | 7402 | 7415 | 7432 | 7435 | 7445 | 7459 | 7465 | 7468 | 7480 |
| 7486 | 7488 | 7508 | 7521 | 7541 | 7543 | 7564 | 7565 | 7566 | 7570 | 7574 | 7577 |
| 7585 | 7588 | 7592 | 7597 | 7609 | 7625 | 7634 | 7643 | 7655 | 7656 | 7657 | 7669 |
| 7670 | 7678 | 7684 | 7718 | 7737 | 7743 | 7771 | 7772 | 7777 | 7782 | 7784 | 7794 |
| 7795 | 7805 | 7807 | 7808 | 7809 | 7810 | 7813 | 7815 | 7837 | 7840 | 7869 | 7873 |
| 7892 | 7896 | 7912 | 7913 | 7922 | 7939 | 7951 | 7966 | 7967 | 7973 | 7979 | 7993 |
| 8007 | 8011 | 8012 | 8015 | 8019 | 8022 | 8024 | 8039 | 8041 | 8047 | 8051 | 8057 |
| 8063 | 8074 | 8080 | 8083 | 8084 | 8093 | 8108 | 8112 | 8114 | 8133 | 8141 | 8159 |
| 8194 | 8195 | 8202 | 8203 | 8210 | 8219 | 8220 | 8224 | 8226 | 8241 | 8248 | 8249 |
| 8255 | 8256 | 8259 | 8260 | 8261 | 8262 | 8263 | 8265 | 8266 | 8270 | 8275 | 8276 |
| 8288 | 8290 | 8291 | 8297 | 8298 | 8304 | 8309 | 8319 | 8321 | 8323 | 8362 | 8374 |
| 8375 | 8406 | 8479 | 8484 | 8485 | 8488 | 8496 | 8502 | 8503 | 8513 | 8520 | 8530 |
| 8531 | 8545 | 8576 | 8578 | 8579 | 8581 | 8582 | 8589 | 8604 | 8606 | 8610 | 8611 |
| 8626 | 8631 | 8654 | 8676 | 8680 | 8685 | 8688 | 8692 | 8695 | 8699 | 8706 | 8707 |
| 8747 | 8750 | 8759 | 8760 | 8763 | 8767 | 8783 | 8806 | 8828 | 8843 | 8844 | 8852 |
| 8855 | 8859 | 8876 | 8880 | 8899 | 8901 | 8906 | 8913 | 8914 | 8922 | 8928 | 8939 |
| 8958 | 8977 | 8984 | 9005 | 9006 | 9017 | 9018 | 9019 | 9022 | 9023 | 9026 | 9029 |
| 9042 | 9061 | 9083 | 9088 | 9103 | 9105 | 9108 | 9123 | 9127 | 9134 | 9135 | 9136 |
| 9153 | 9156 | 9165 | 9167 | 9175 | 9186 | 9190 | 9193 | 9194 | 9195 | 9197 | 9198 |
| 9212 | 9227 | 9228 | 9236 | 9239 | 9240 | 9241 | 9243 | 9244 | 9245 | 9255 | 9257 |
| 9269 | 9270 | 9274 | 9276 | 9279 | 9280 | 9282 | 9303 | 9304 | 9320 | 9321 | 9329 |
| 9334 | 9352 | 9368 | 9369 | 9371 | 9372 | 9385 | 9386 | 9389 | 9390 | 9404 | 9409 |
| 9419 | 9420 | 9423 | 9424 | 9425 | 9435 | 9439 | 9440 | 9453 | 9460 | 9461 | 9462 |
| 9484 | 9490 | 9498 | 9507 | 9511 | 9520 | 9521 | 9524 | 9530 | 9539 | 9558 | 9575 |
| 9576 | 9586 | 9588 | 9589 | 9599 | 9612 | 9635 | 9645 | 9646 | 9650 | 9652 | 9669 |
| 9689 | 9690 | 9701 | 9713 | 9725 | 9732 | 9750 | 9751 | 9754 | 9758 | 9759 | 9774 |
| 9798 | 9814 | 9839 | 9856 | 9864 | 9866 | 9870 | 9874 | 9902 | 9928 | 9934 | 9960 |
| 9963 | 9976 | 9977 | 9981 | 9993 | 9995 | 9997 | 10026 | 10029 | 10038 | 10049 | 10061 |
| 10098 | 10099 | 10102 | 10104 | 10109 | 10114 | 10115 | 10121 | 10132 | 10135 | 10136 | 10143 |
| 10147 | 10151 | 10159 | 10163 | 10174 | 10181 | 10182 | 10185 | 10190 | 10204 | 10213 | 10223 |
| 10232 | 10262 | 10265 | 10266 | 10268 | 10285 | 10296 | 10304 | 10305 | 10311 | 10318 | 10319 |
| 10330 | 10336 | 10338 | 10339 | 10348 | 10357 | 10364 | 10365 | 10368 | 10370 | 10374 | 10381 |
| 10403 | 10404 | 10410 | 10411 | 10413 | 10417 | 10422 | 10431 | 10434 | 10438 | 10439 | 10445 |
| 10471 | 10478 | 10479 | 10487 | 10492 | 10514 | 10519 | 10521 | 10524 | 10530 | 10534 | 10543 |
| 10545 | 10572 | 10599 | 10600 | 10602 | 10603 | 10607 | 10615 | 10622 | 10629 | 10630 | 10646 |
| 10671 | 10672 | 10687 | 10690 | 10691 | 10705 | 10708 | 10736 | 10747 | 10750 | 10763 | 10765 |
| 10776 | 10782 | 10788 | 10789 | 10797 | 10798 | 10805 | 10814 | 10816 | 10850 | 10859 | 10872 |
| 10879 | 10880 | 10882 | 10898 | 10909 | 10910 | 10928 | 10968 | 10969 | 10970 | 10989 | 10990 |
| 10996 | 11005 | 11014 | 11028 | 11045 | 11050 | 11051 | 11058 | 11066 | 11073 | 11076 | 11079 |
| 11099 | 11102 | 11103 | 11105 | 11117 | 11119 | 11137 | 11160 | 11185 | 11188 | 11197 | 11216 |
| 11237 | 11245 | 11249 | 11251 | 11257 | 11262 | 11277 | 11285 | 11286 | 11297 | 11308 | 11309 |
| 11320 | 11321 | 11327 | 11329 | 11336 | 11338 | 11345 | 11364 | 11374 | 11381 | 11387 |
| 11407 | 11413 | 11427 | 11432 | 11433 | 11439 | 11442 | 11443 | 11463 | 11465 | 11466 | 11468 |
| 11469 | 11475 | 11478 | 11490 | 11498 | 11506 | 11518 | 11535 | 11537 | 11538 | 11539 | 11540 |
| 11542 | 11550 | 11554 | 11555 | 11559 | 11565 | 11578 | 11594 | 11595 | 11597 | 11598 | 11614 |
| 11623 | 11629 | 11653 | 11661 | 11663 | 11667 | 11709 | 11719 | 11722 | 11747 | 11749 | 11766 |
| 11768 | 11769 | 11774 | 11783 | 11786 | 11795 | 11796 | 11800 | 11813 | 11830 | 11837 | 11838 |
| 11839 | 11840 | 11848 | 11850 | 11859 | 11875 | 11876 | 11881 | 11887 | 11897 | 11911 | 11932 |
| 11936 | 11950 | 11951 | 11977 | 11988 | 11997 | 12013 | 12021 | 12033 | 12034 | 12041 | 12052 |
| 12053 | 12058 | 12062 | 12071 | 12078 | 12079 | 12083 | 12086 | 12096 | 12099 | 12102 | 12104 |
| 12106 | 12108 | 12109 | 12110 | 12112 | 12124 | 12135 | 12138 | 12149 | 12159 | 12167 | 12176 |
| 12178 | 12186 | 12195 | 12200 | 12212 | 12213 | 12241 | 12275 | 12282 | 12302 | 12304 | 12312 |
| 12316 | 12324 | 12341 | 12363 | 12398 | 12400 | 12408 | 12418 | 12427 | 12438 | 12472 | 12482 |
| 12486 | 12492 | 12494 | 12496 | 12506 | 12509 | 12513 | 12517 | 12554 | 12566 | 12589 | 12593 |
| 12598 | 12605 | 12607 | 12610 | 12611 | 12626 | 12664 | 12673 | 12692 | 12704 | 12709 | 12723 |
| 12728 | 12730 | 12733 | 12736 | 12758 | 12771 | 12777 | 12835 | 12836 | 12889 | 12891 | 12903 |
| 12911 | 12926 | 12943 | 12949 | 12952 | 12968 | 12969 | 12984 | 12987 | 12989 | 13023 | 13037 |
| 13040 | 13064 | 13073 | 13090 | 13091 | 13100 | 13106 | 13108 | 13111 | 13126 | 13136 | 13141 |
| 13159 | 13166 | 13169 | 13171 | 13179 | 13192 | 13195 | 13212 | 13225 | 13234 | 13241 | 13247 |
| 13257 | 13280 | 13285 | 13295 | 13301 | 13313 | 13319 | 13329 | 13387 | 13401 | 13453 | 13454 |
| 13459 | 13473 | 13479 | 13480 | 13484 | 13499 | 13532 | 13534 | 13535 | 13536 | 13538 | 13539 |
| 13543 | 13554 | 13556 | 13557 | 13562 | 13568 | 13592 | 13596 | 13598 | 13603 | 13612 | 13633 |
| 13643 | 13648 | 13650 | 13653 | 13679 | 13688 | 13694 | 13717 | 13719 | 13720 | 13728 | 13749 |
| 13755 | 13758 | 13783 | 13786 | 13787 | 13797 | 13798 | 13806 | 13813 | 13817 | 13837 | 13845 |
| 13846 | 13851 | 13865 | 13866 | 13868 | 13873 | 13874 | 13880 | 13881 | 13887 | 13901 | 13903 |
| 13904 | 13906 | 13912 | 13920 | 13927 | 13932 | 13948 | 13953 | 13971 | 14030 | 14045 | 14048 |
| 14049 | 14053 | 14062 | 14067 | 14068 | 14113 | 14143 | 14145 | 14149 | 14152 | 14157 | 14175 |
| 14181 | 14195 | 14216 | 14232 | 14233 | 14234 | 14238 | 14242 | 14246 | 14247 | 14248 | 14255 |
| 14259 | 14266 | 14277 | 14283 | 14293 | 14304 | 14308 | 14309 | 14313 | 14322 | 14324 | 14331 |
| 14332 | 14333 | 14346 | 14348 | 14356 | 14364 | 14381 | 14383 | 14392 | 14400 | 14421 | 14431 |
| 14452 | 14453 | 14473 | 14474 | 14482 | 14484 | 14487 | 14488 | 14491 | 14501 | 14510 | 14517 |
| 14522 | 14523 | 14526 | 14528 | 14529 | 14534 | 14535 | 14540 | 14551 | 14565 | 14568 | 14575 |
| 14586 | 14588 | 14594 | 14598 | 14613 | 14615 | 14616 | 14649 | 14650 | 14652 | 14657 | 14662 |
| 14663 | 14664 | 14678 | 14700 | 14705 | 14707 | 14708 | 14711 | 14717 | 14723 | 14746 | 14752 |
| 14780 | 14795 | 14810 | 14820 | 14840 | 14847 | 14863 | 14864 | 14867 | 14869 | 14871 | 14873 |
| 14876 | 14882 | 14885 | 14894 | 14901 | 14920 | 14934 | 14938 | 14943 | 14962 | 14963 | 14964 |

TABLE 3-continued

Cold Tolerance

| | | | | | | | | | | | |
|---|---|---|---|---|---|---|---|---|---|---|---|
| 14978 | 14983 | 14986 | 14991 | 15008 | 15016 | 15025 | 15029 | 15037 | 15047 | 15051 | 15058 |
| 15059 | 15060 | 15064 | 15079 | 15093 | 15103 | 15120 | 15123 | 15124 | 15125 | 15132 | 15140 |
| 15141 | 15142 | 15160 | 15183 | 15189 | 15190 | 15191 | 15193 | 15198 | 15202 | 15224 | 15229 |
| 15271 | 15289 | 15293 | 15310 | 15311 | 15312 | 15316 | 15317 | 15322 | 15334 | 15335 | 15336 |
| 15358 | 15360 | 15365 | 15374 | 15376 | 15377 | 15380 | 15388 | 15392 | 15398 | 15401 | 15406 |
| 15409 | 15415 | 15416 | 15422 | 15423 | 15428 | 15442 | 15454 | 15471 | 15482 | 15490 | 15492 |
| 15500 | 15518 | 15519 | 15526 | 15530 | 15534 | 15545 | 15553 | 15554 | 15561 | 15562 | 15575 |
| 15580 | 15582 | 15585 | 15587 | 15597 | 15601 | 15604 | 15609 | 15617 | 15624 | 15630 | 15634 |
| 15639 | 15642 | 15646 | 15647 | 15648 | 15649 | 15650 | 15651 | 15652 | 15654 | 15655 | 15656 |
| 15658 | 15659 | 15676 | 15677 | 15678 | 15682 | 15683 | 15688 | 15702 | 15703 | 15708 | 15725 |
| 15727 | 15732 | 15741 | 15744 | 15745 | 15748 | 15756 | 15760 | 15766 | 15769 | 15774 | 15777 |
| 15783 | 15784 | 15790 | 15791 | 15796 | 15799 | 15808 | 15811 | 15822 | 15841 | 15853 | 15862 |
| 15863 | 15871 | 15890 | 15891 | 15897 | 15901 | 15905 | 15917 | 15926 | 15927 | 15934 | 15935 |
| 15949 | 15951 | 15956 | 15958 | 15961 | 15963 | 15974 | 15979 | 15984 | 15992 | 15999 | 16005 |
| 16009 | 16014 | 16017 | 16021 | 16023 | 16024 | 16025 | 16026 | 16027 | 16028 | 16029 | 16030 |
| 16031 | 16033 | 16034 | 16035 | 16036 | 16037 | 16039 | 16041 | 16042 | 16045 | 16046 | 16047 |
| 16048 | 16049 | 16067 | 16068 | 16073 | 16074 | 16079 | 16092 | 16093 | 16094 | 16110 | 16111 |
| 16117 | 16126 | 16128 | 16129 | 16132 | 16139 | 16143 | 16150 | 16153 | 16157 | 16164 | 16166 |
| 16172 | 16173 | 16178 | 16181 | 16189 | 16190 | 16204 | 16233 | 16236 | 16238 | 16246 | 16263 |
| 16264 | 16269 | 16273 | 16284 | 16293 | 16294 | 16302 | 16303 | 16314 | 16315 | 16319 | 16324 |
| 16328 | 16336 | 16338 | 16342 | 16351 | 16352 | 16359 | 16363 | 16367 | 16370 | 16373 | 16376 |
| 16383 | 16386 | 16388 | 16389 | 16391 | 16407 | 16420 | 16421 | 16428 | 16429 | 16437 | 16445 |
| 16446 | 16457 | 16463 | 16478 | 16480 | 16481 | 16497 | 16519 | 16525 | 16550 | 16552 | 16558 |
| 16560 | 16561 | 16571 | 16576 | 16580 | 16590 | 16595 | 16598 | 16603 | 16610 | 16646 | 16662 |
| 16669 | 16679 | 16687 | 16690 | 16691 | 16693 | 16702 | 16703 | 16707 | 16709 | 16731 | 16735 |
| 16749 | 16756 | 16757 | 16776 | 16777 | 16783 | 16787 | 16799 | 16804 | 16805 | 16809 | 16825 |
| 16828 | 16844 | 16854 | 16864 | 16865 | 16866 | 16895 | 16901 | 16909 | 16915 | 16917 | 16920 |
| 16933 | 16935 | 16941 | 16946 | 16949 | 16959 | 16970 | 16980 | 16981 | 16987 | 16995 | 17009 |
| 17011 | 17015 | 17017 | 17024 | 17040 | 17058 | 17059 | 17065 | 17067 | 17068 | 17069 | 17088 |
| 17089 | 17093 | 17103 | 17125 | 17126 | 17155 | 17158 | 17182 | 17183 | 17184 | 17196 | 17198 |
| 17201 | 17204 | 17220 | 17226 | 17231 | 17234 | 17235 | 17237 | 17273 | 17284 | 17319 |
| 17321 | 17330 | 17345 | 17348 | 17352 | 17359 | 17375 | 17388 | 17389 | 17399 | 17410 | 17427 |
| 17439 | 17440 | 17442 | 17447 | 17454 | 17466 | 17467 | 17476 | 17510 | 17515 | 17519 | 17522 |
| 17523 | 17551 | 17552 | 17554 | 17555 | 17556 | 17564 | 17565 | 17568 | 17570 | 17571 | 17572 |
| 17579 | 17587 | 17605 | 17614 | 17615 | 17619 | 17623 | 17626 | 17635 | 17636 | 17656 | 17658 |
| 17660 | 17661 | 17670 | 17671 | 17701 | 17722 | 17724 | 17725 | 17731 | 17738 | 17739 | 17742 |
| 17745 | 17749 | 17762 | 17786 | 17788 | 17790 | 17803 | 17807 | 17809 | 17822 | 17837 | 17840 |
| 17849 | 17863 | 17868 | 17870 | 17889 | 17898 | 17899 | 17901 | 17913 | 17914 | 17921 | 17926 |
| 17927 | 17934 | 17948 | 17958 | 17967 | 17971 | 17978 | 17981 | 17985 | 17993 | 17995 |
| 18012 | 18015 | 18018 | 18025 | 18026 | 18030 | 18031 | 18034 | 18041 | 18043 | 18045 | 18049 |
| 18050 | 18051 | 18054 | 18055 | 18060 | 18063 | 18067 | 18069 | 18070 | 18071 | 18073 | 18074 |
| 18075 | 18076 | 18077 | 18078 | 18079 | 18080 | 18081 | 18082 | 18101 | 18113 | 18135 | 18143 |
| 18145 | 18149 | 18156 | 18176 | 18180 | 18192 | 18195 | 18204 | 18205 | 18213 | 18226 | 18227 |
| 18228 | 18241 | 18245 | 18255 | 18265 | 18267 | 18281 | 18308 | 18311 | 18330 | 18338 | 18345 |
| 18363 | 18367 | 18390 | 18397 | 18401 | 18402 | 18405 | 18410 | 18411 | 18417 | 18418 | 18424 |
| 18431 | 18432 | 18435 | 18442 | 18444 | 18447 | 18451 | 18473 | 18474 | 18475 | 18486 | 18487 |
| 18491 | 18500 | 18517 | 18522 | 18529 | 18537 | 18551 | 18569 | 18588 | 18595 | 18598 | 18608 |
| 18612 | 18617 | 18618 | 18625 | 18636 | 18640 | 18655 | 18660 | 18672 | 18673 | 18688 | 18692 |
| 18697 | 18699 | 18710 | 18718 | 18719 | 18731 | 18733 | 18740 | 18741 | 18751 | 18759 | 18761 |
| 18766 | 18768 | 18771 | 18804 | 18813 | 18824 | 18828 | 18838 | 18846 | 18858 | 18861 | 18862 |
| 18863 | 18869 | 18884 | 18904 | 18916 | 18925 | 18926 | 18930 | 18937 | 18941 | 18952 | 18953 |
| 18961 | 18963 | 18978 | 19005 | 19007 | 19008 | 19022 | 19023 | 19055 | 19059 | 19069 | 19073 |
| 19078 | 19118 | 19120 | 19137 | 19156 | 19158 | 19160 | 19169 | 19195 | 19198 | 19199 | 19200 |
| 19202 | 19203 | 19205 | 19216 | 19222 | 19233 | 19261 | 19264 | 19269 | 19276 | 19277 | 19280 |
| 19294 | 19300 | 19301 | 19317 | 19338 | 19351 | 19363 | 19364 | 19365 | 19366 | 19381 | 19383 |
| 19389 | 19390 | 19391 | 19394 | 19420 | 19433 | 19461 | 19464 | 19465 | 19472 | 19483 | 19486 |
| 19493 | 19502 | 19522 | 19549 | 19550 | 19553 | 19557 | 19572 | 19573 | 19575 | 19578 | 19580 |
| 19585 | 19593 | 19595 | 19599 | 19614 | 19616 | 19617 | 19620 | 19628 | 19644 | 19645 | 19656 |
| 19664 | 19666 | 19672 | 19684 | 19686 | 19698 | 19699 | 19703 | 19704 | 19708 | 19711 | 19714 |
| 19719 | 19754 | 19772 | 19791 | 19795 | 19799 | 19808 | 19831 | 19838 | 19844 | 19846 | 19847 |
| 19850 | 19852 | 19853 | 19854 | 19857 | 19860 | 19866 | 19915 | 19918 | 19921 | 19929 | 19930 |
| 19946 | 19956 | 19990 | 20007 | 20032 | 20035 | 20050 | 20055 | 20056 | 20068 | 20074 | 20086 |
| 20101 | 20103 | 20108 | 20110 | 20118 | 20119 | 20126 | 20133 | 20146 | 20155 | 20162 | 20192 |
| 20195 | 20207 | 20216 | 20220 | 20221 | 20229 | 20241 | 20253 | 20262 | 20278 | 20280 | 20297 |
| 20298 | 20301 | 20312 | 20317 | 20322 | 20358 | 20374 | 20375 | 20377 | 20378 | 20400 | 20404 |
| 20409 | 20410 | 20412 | 20417 | 20418 | 20419 | 20428 | 20437 | 20460 | 20461 | 20480 | 20515 |
| 20539 | 20543 | 20548 | 20580 | 20586 | 20603 | 20627 | 20637 | 20643 | 20646 | 20648 | 20655 |
| 20668 | 20709 | 20731 | 20736 | 20737 | 20739 | 20744 | 20745 | 20750 | 20757 | 20758 | 20765 |
| 20772 | 20784 | 20787 | 20793 | 20797 | 20801 | 20802 | 20805 | 20806 | 20811 | 20827 | 20828 |
| 20829 | 20835 | 20836 | 20840 | 20841 | 20848 | 20854 | 20868 | 20871 | 20878 | 20892 | 20894 |
| 20895 | 20910 | 20919 | 20921 | 20942 | 20943 | 20952 | 20963 | 20987 | 20988 | 20989 | 20991 |
| 20992 | 20993 | 21004 | 21008 | 21010 | 21032 | 21042 | 21045 | 21059 | 21062 | 21068 | 21073 |
| 21091 | 21103 | 21119 | 21124 | 21129 | 21147 | 21161 | 21167 | 21170 | 21185 | 21186 | 21190 |
| 21196 | 21200 | 21204 | 21209 | 21210 | 21243 | 21244 | 21256 | 21257 | 21260 | 21263 | 21267 |
| 21280 | 21281 | 21284 | 21285 | 21296 | 21313 | 21314 | 21323 | 21324 | 21328 | 21331 | 21340 |
| 21354 | 21364 | 21368 | 21371 | 21373 | 21379 | 21387 | 21396 | 21410 | 21425 | 21432 | 21441 |
| 21443 | 21446 | 21447 | 21460 | 21462 | 21464 | 21466 | 21481 | 21485 | 21503 | 21507 | 21513 |

TABLE 3-continued

Cold Tolerance

| | | | | | | | | | | | |
|---|---|---|---|---|---|---|---|---|---|---|---|
| 21527 | 21533 | 21552 | 21557 | 21574 | 21585 | 21586 | 21588 | 21590 | 21607 | 21637 | 21639 |
| 21655 | 21664 | 21670 | 21677 | 21680 | 21682 | 21683 | 21689 | 21691 | 21692 | 21694 | 21701 |
| 21704 | 21711 | 21717 | 21722 | 21726 | 21729 | 21757 | 21758 | 21760 | 21763 | 21778 | 21781 |
| 21794 | 21795 | 21803 | 21809 | 21817 | 21822 | 21824 | 21825 | 21867 | 21872 | 21882 | 21883 |
| 21896 | 21900 | 21911 | 21929 | 21937 | 21941 | 21960 | 21973 | 21987 | 21988 | 21993 | 21994 |
| 21998 | 22006 | 22011 | 22013 | 22015 | 22034 | 22035 | 22036 | 22038 | 22066 | 22071 | 22078 |
| 22094 | 22101 | 22102 | 22107 | 22124 | 22126 | 22147 | 22165 | 22170 | 22186 | 22205 | 22206 |
| 22214 | 22220 | 22221 | 22232 | 22238 | 22253 | 22279 | 22291 | 22295 | 22332 | 22335 | 22346 |
| 22370 | 22378 | 22379 | 22386 | 22389 | 22391 | 22402 | 22406 | 22425 | 22428 | 22432 | 22436 |
| 22439 | 22446 | 22492 | 22497 | 22509 | 22538 | 22544 | 22545 | 22551 | 22552 | 22565 | 22582 |
| 22583 | 22594 | 22609 | 22617 | 22632 | 22642 | 22653 | 22675 | 22685 | 22712 | 22717 | 22737 |
| 22748 | 22759 | 22768 | 22782 | 22787 | 22799 | 22817 | 22823 | 22834 | 22839 | 22840 | 22843 |
| 22854 | 22864 | 22865 | 22870 | 22873 | 22895 | 22905 | 22928 | 22962 | 22980 | 23000 | 23013 |
| 23019 | 23052 | 23071 | 23073 | 23095 | 23110 | 23126 | 23127 | 23145 | 23146 | 23147 | 23176 |
| 23179 | 23181 | 23182 | 23183 | 23185 | 23202 | 23214 | 23217 | 23226 | 23227 | 23233 | 23241 |
| 23259 | 23263 | 23272 | 23290 | 23308 | 23312 | 23313 | 23318 | 23319 | 23321 | 23322 | 23326 |
| 23329 | 23350 | 23358 | 23363 | 23376 | 23392 | 23401 | 23420 | 23421 | 23426 | 23445 | 23459 |
| 23467 | 23474 | 23479 | 23480 | 23497 | 23498 | 23502 | 23505 | 23514 | 23516 | 23520 | 23524 |
| 23531 | 23535 | 23551 | 23578 | 23583 | 23598 | 23601 | 23604 | 23610 | 23612 | 23613 | 23619 |
| 23638 | 23640 | 23650 | 23651 | 23652 | 23653 | 23666 | 23667 | 23671 | 23673 | | |

Table 3B SEQ ID NOs of Polynucleotides useful for improving Cold Tolerance

| | | | | | | | | | | | |
|---|---|---|---|---|---|---|---|---|---|---|---|
| 23691 | 23692 | 23693 | 23698 | 23706 | 23713 | 23718 | 23723 | 23726 | 23739 | 23743 | 23768 |
| 23775 | 23777 | 23778 | 23788 | 23796 | 23804 | 23805 | 23808 | 23809 | 23815 | 23832 | 23833 |
| 23834 | 23838 | 23840 | 23841 | 23843 | 23865 | 23878 | 23882 | 23891 | 23917 | 23925 | 23934 |
| 23944 | 23959 | 23961 | 23962 | 23982 | 23997 | 24008 | 24012 | 24019 | 24025 | 24029 | 24037 |
| 24043 | 24065 | 24066 | 24077 | 24080 | 24082 | 24083 | 24087 | 24100 | 24105 | 24123 | 24124 |
| 24130 | 24136 | 24143 | 24146 | 24153 | 24164 | 24166 | 24178 | 24195 | 24197 | 24202 | 24203 |
| 24212 | 24213 | 24218 | 24228 | 24230 | 24231 | 24235 | 24236 | 24242 | 24257 | 24258 | 24263 |
| 24272 | 24274 | 24286 | 24296 | 24310 | 24318 | 24323 | 24333 | 24335 | 24351 | 24352 | 24359 |
| 24368 | 24369 | 24371 | 24383 | 24412 | 24431 | 24439 | 24443 | 24444 | 24448 | 24469 | 24474 |
| 24475 | 24502 | 24509 | 24522 | 24539 | 24541 | 24546 | 24558 | 24561 | 24570 | 24572 | 24577 |
| 24582 | 24584 | 24590 | 24591 | 24596 | 24624 | 24651 | 24662 | 24663 | 24667 | 24670 | 24672 |
| 24674 | 24680 | 24682 | 24684 | 24694 | 24711 | 24712 | 24722 | 24723 | 24728 | 24734 | 24742 |
| 24744 | 24757 | 24781 | 24792 | 24800 | 24810 | 24817 | 24819 | 24822 | 24832 | 24836 | 24860 |
| 24861 | 24870 | 24871 | 24872 | 24873 | 24887 | 24894 | 24901 | 24904 | 24907 | 24916 | 24928 |
| 24932 | 24937 | 24942 | 24979 | 24996 | 24997 | 24999 | 25000 | 25024 | 25028 | 25033 | 25034 |
| 25036 | 25045 | 25089 | 25090 | 25104 | 25121 | 25124 | 25146 | 25150 | 25151 | 25163 | 25164 |
| 25187 | 25194 | 25197 | 25239 | 25243 | 25251 | 25265 | 25284 | 25291 | 25302 | 25304 | 25311 |
| 25314 | 25319 | 25323 | 25351 | 25360 | 25372 | 25386 | 25389 | 25399 | 25427 | 25433 | 25435 |
| 25484 | 25521 | 25565 | 25570 | 25586 | 25590 | 25607 | 25615 | 25621 | 25639 | 25640 | 25694 |
| 25710 | 25729 | 25731 | 25738 | 25771 | 25784 | 25792 | 25794 | 25805 | 25811 | 25826 | 25833 |
| 25834 | 25835 | 25850 | 25861 | 25871 | 25873 | 25881 | 25885 | 25898 | 25899 | 25917 | 25920 |
| 25932 | 25941 | 25946 | 25950 | 25955 | 25957 | 25967 | 25973 | 25981 | 25989 | 25990 | 25991 |
| 25993 | 25998 | 26002 | 26008 | 26020 | 26064 | 26081 | 26100 | 26112 | 26117 | 26132 | 26137 |
| 26144 | 26172 | 26183 | 26184 | 26190 | 26204 | 26205 | 26233 | 26253 | 26254 | 26255 | 26286 |
| 26289 | 26299 | 26309 | 26312 | 26313 | 26319 | 26321 | 26329 | 26338 | 26374 | 26393 | 26395 |
| 26418 | 26426 | 26433 | 26437 | 26438 | 26439 | 26442 | 26455 | 26460 | 26475 | 26505 | 26511 |
| 26515 | 26522 | 26533 | 26534 | 26538 | 26540 | 26547 | 26551 | 26565 | 26569 | 26574 | 26581 |
| 26582 | 26583 | 26587 | 26592 | 26594 | 26603 | 26606 | 26616 | 26623 | 26632 | 26634 | 26646 |
| 26647 | 26655 | 26671 | 26674 | 26677 | 26678 | 26692 | 26699 | 26722 | 26731 | 26734 | |
| 26739 | 26744 | 26753 | 26756 | 26757 | 26787 | 26824 | 26825 | 26826 | 26843 | 26852 | 26867 |
| 26871 | 26878 | 26885 | 26887 | 26918 | 26921 | 26923 | 26927 | 26947 | 26958 | 26975 | 26978 |
| 26992 | 27021 | 27030 | 27044 | 27050 | 27053 | 27076 | 27082 | 27106 | 27128 | 27129 | 27156 |
| 27168 | 27169 | 27172 | 27175 | 27205 | 27209 | 27246 | 27248 | 27250 | 27257 | 27262 | 27275 |
| 27279 | 27284 | 27290 | 27345 | 27350 | 27370 | 27375 | 27387 | 27390 | 27392 | 27402 | 27409 |
| 27411 | 27420 | 27423 | 27428 | 27434 | 27438 | 27439 | 27444 | 27462 | 27467 | 27532 | 27540 |
| 27567 | 27575 | 27579 | 27618 | 27619 | 27625 | 27645 | 27653 | 27655 | 27663 | 27665 | 27674 |
| 27682 | 27693 | 27706 | 27708 | 27728 | 27762 | 27763 | 27765 | 27780 | 27785 | 27787 | |
| 27797 | 27804 | 27809 | 27829 | 27832 | 27841 | 27847 | 27865 | 27876 | 27882 | 27885 | 27889 |
| 27892 | 27921 | 27923 | 27959 | 27964 | 27967 | 27977 | 27978 | 27981 | 27982 | 27988 | 27989 |
| 27998 | 27999 | 28000 | 28003 | 28021 | 28049 | 28053 | 28062 | 28075 | 28078 | 28085 | 28103 |
| 28120 | 28125 | 28151 | 28174 | 28178 | 28183 | 28184 | 28192 | 28193 | 28194 | 28208 | 28235 |
| 28256 | 28267 | 28269 | 28277 | 28278 | 28286 | 28331 | 28344 | 28363 | 28373 | 28388 | 28393 |
| 28396 | 28408 | 28414 | 28416 | 28435 | 28449 | 28468 | 28470 | 28492 | 28493 | 28494 | 28498 |
| 28502 | 28505 | 28513 | 28516 | 28520 | 28524 | 28537 | 28553 | 28561 | 28572 | 28584 | 28585 |
| 28586 | 28598 | 28599 | 28607 | 28613 | 28647 | 28657 | 28666 | 28677 | 28678 | 28681 | 28689 |
| 28694 | 28699 | 28709 | 28722 | 28725 | 28732 | 28752 | 28776 | 28780 | 28784 | 28792 | 28803 |
| 28804 | 28805 | 28812 | 28841 | 28845 | 28867 | 28868 | 28870 | 28895 | 28899 | 28903 | 28913 |
| 28917 | 28920 | 28925 | 28926 | 28927 | 28928 | 28934 | 28935 | 28936 | 28937 | 28938 | 28939 |
| 28941 | 28942 | 28944 | 28955 | 28962 | 28966 | 28985 | 28993 | 29007 | 29025 | 29026 | |
| 29050 | 29065 | 29067 | 29081 | 29084 | 29086 | 29095 | 29110 | 29137 | 29155 | 29167 | 29172 |
| 29180 | 29183 | 29188 | 29203 | 29231 | 29234 | 29235 | 29237 | 29240 | 29254 | 29263 | 29275 |
| 29300 | 29301 | 29302 | 29303 | 29304 | 29305 | 29325 | 29327 | 29331 | 29337 | 29346 | 29347 |
| 29356 | 29373 | 29382 | 29385 | 29386 | 29387 | 29396 | 29400 | 29401 | 29404 | 29405 | 29410 |
| 29413 | 29414 | 29423 | 29456 | 29459 | 29464 | 29471 | 29472 | 29476 | 29482 | 29492 | 29499 |

TABLE 3-continued

Cold Tolerance

| | | | | | | | | | | | |
|---|---|---|---|---|---|---|---|---|---|---|---|
| 29501 | 29514 | 29515 | 29542 | 29545 | 29553 | 29622 | 29623 | 29624 | 29637 | 29638 | 29642 |
| 29653 | 29655 | 29661 | 29680 | 29687 | 29688 | 29689 | 29694 | 29698 | 29701 | 29704 | 29705 |
| 29711 | 29715 | 29723 | 29729 | 29744 | 29763 | 29764 | 29773 | 29776 | 29782 | 29783 | 29802 |
| 29810 | 29822 | 29823 | 29831 | 29847 | 29850 | 29860 | 29861 | 29864 | 29875 | 29877 | 29880 |
| 29881 | 29906 | 29910 | 29918 | 29927 | 29928 | 29947 | 29974 | 29997 | 29999 | 30001 | 30002 |
| 30003 | 30004 | 30005 | 30009 | 30025 | 30030 | 30034 | 30035 | 30036 | 30037 | 30038 | 30039 |
| 30052 | 30053 | 30054 | 30061 | 30063 | 30065 | 30068 | 30075 | 30087 | 30108 | 30122 | 30129 |
| 30130 | 30136 | 30142 | 30143 | 30154 | 30157 | 30196 | 30197 | 30198 | 30202 | 30205 | 30207 |
| 30218 | 30219 | 30222 | 30223 | 30233 | 30236 | 30245 | 30274 | 30275 | 30276 | 30277 | 30278 |
| 30279 | 30283 | 30289 | 30304 | 30317 | 30324 | 30341 | 30355 | 30369 | 30389 | 30390 | 30393 |
| 30415 | 30417 | 30421 | 30436 | 30437 | 30443 | 30453 | 30455 | 30460 | 30463 | 30467 | 30483 |
| 30491 | 30506 | 30507 | 30515 | 30516 | 30523 | 30526 | 30532 | 30538 | 30541 | 30557 | 30566 |
| 30567 | 30609 | 30614 | 30627 | 30628 | 30664 | 30665 | 30666 | 30670 | 30678 | 30687 | 30688 |
| 30718 | 30722 | 30733 | 30734 | 30737 | 30738 | 30744 | 30745 | 30754 | 30755 | 30756 | 30759 |
| 30777 | 30803 | 30807 | 30816 | 30823 | 30830 | 30833 | 30840 | 30859 | 30878 | 30884 | 30911 |
| 30933 | 30937 | 30942 | 30943 | 30950 | 30951 | 30952 | 30953 | 30967 | 31013 | 31024 | 31026 |
| 31034 | 31035 | 31043 | 31089 | 31102 | 31119 | 31122 | 31132 | 31146 | 31152 | 31155 | 31167 |
| 31173 | 31175 | 31195 | 31208 | 31228 | 31230 | 31251 | 31252 | 31253 | 31257 | 31261 | 31264 |
| 31272 | 31275 | 31279 | 31284 | 31296 | 31312 | 31321 | 31330 | 31342 | 31343 | 31344 | 31356 |
| 31357 | 31365 | 31371 | 31405 | 31424 | 31430 | 31458 | 31459 | 31464 | 31469 | 31471 | 31481 |
| 31482 | 31492 | 31494 | 31495 | 31496 | 31497 | 31500 | 31502 | 31524 | 31527 | 31556 | 31560 |
| 31579 | 31583 | 31599 | 31600 | 31609 | 31626 | 31638 | 31653 | 31654 | 31660 | 31666 | 31680 |
| 31694 | 31698 | 31699 | 31702 | 31706 | 31709 | 31711 | 31726 | 31728 | 31734 | 31738 | 31744 |
| 31750 | 31761 | 31767 | 31770 | 31771 | 31780 | 31795 | 31799 | 31801 | 31820 | 31828 | 31846 |
| 31881 | 31882 | 31889 | 31890 | 31897 | 31906 | 31907 | 31911 | 31913 | 31928 | 31935 | 31936 |
| 31942 | 31943 | 31946 | 31947 | 31948 | 31949 | 31950 | 31952 | 31953 | 31957 | 31962 | 31963 |
| 31975 | 31977 | 31978 | 31984 | 31985 | 31991 | 31996 | 32006 | 32008 | 32010 | 32049 | 32061 |
| 32062 | 32093 | 32166 | 32171 | 32172 | 32175 | 32183 | 32189 | 32190 | 32200 | 32207 | 32217 |
| 32218 | 32232 | 32263 | 32265 | 32266 | 32268 | 32269 | 32276 | 32291 | 32293 | 32297 | 32298 |
| 32313 | 32318 | 32341 | 32363 | 32367 | 32372 | 32375 | 32379 | 32382 | 32386 | 32393 | 32394 |
| 32434 | 32437 | 32446 | 32447 | 32450 | 32454 | 32470 | 32493 | 32515 | 32530 | 32531 | 32539 |
| 32542 | 32546 | 32563 | 32567 | 32586 | 32588 | 32593 | 32600 | 32601 | 32609 | 32615 | 32626 |
| 32645 | 32664 | 32671 | 32692 | 32693 | 32704 | 32705 | 32706 | 32709 | 32710 | 32713 | 32716 |
| 32729 | 32748 | 32770 | 32775 | 32790 | 32792 | 32795 | 32810 | 32814 | 32821 | 32822 | 32823 |
| 32840 | 32843 | 32852 | 32854 | 32862 | 32873 | 32877 | 32880 | 32881 | 32882 | 32884 | 32885 |
| 32899 | 32914 | 32915 | 32923 | 32926 | 32927 | 32928 | 32930 | 32931 | 32932 | 32942 | 32944 |
| 32956 | 32957 | 32961 | 32963 | 32966 | 32967 | 32969 | 32990 | 32991 | 33007 | 33008 | 33016 |
| 33021 | 33039 | 33055 | 33056 | 33058 | 33059 | 33072 | 33073 | 33076 | 33077 | 33091 | 33096 |
| 33106 | 33107 | 33110 | 33111 | 33112 | 33122 | 33126 | 33127 | 33140 | 33147 | 33148 | 33149 |
| 33171 | 33177 | 33185 | 33194 | 33198 | 33207 | 33208 | 33211 | 33217 | 33226 | 33245 | 33262 |
| 33263 | 33273 | 33275 | 33276 | 33286 | 33299 | 33322 | 33332 | 33333 | 33337 | 33339 | 33356 |
| 33376 | 33377 | 33388 | 33400 | 33412 | 33419 | 33437 | 33438 | 33441 | 33445 | 33446 | 33461 |
| 33485 | 33501 | 33526 | 33543 | 33551 | 33553 | 33557 | 33561 | 33589 | 33615 | 33621 | 33647 |
| 33650 | 33663 | 33664 | 33668 | 33680 | 33682 | 33684 | 33713 | 33716 | 33725 | 33736 | 33748 |
| 33785 | 33786 | 33789 | 33791 | 33796 | 33801 | 33802 | 33808 | 33819 | 33822 | 33823 | 33830 |
| 33834 | 33838 | 33846 | 33850 | 33861 | 33868 | 33869 | 33872 | 33877 | 33891 | 33900 | 33910 |
| 33919 | 33949 | 33952 | 33953 | 33955 | 33972 | 33983 | 33991 | 33992 | 33998 | 34005 | 34006 |
| 34017 | 34023 | 34025 | 34026 | 34035 | 34044 | 34051 | 34052 | 34055 | 34057 | 34061 | 34068 |
| 34090 | 34091 | 34097 | 34098 | 34100 | 34104 | 34109 | 34118 | 34121 | 34125 | 34126 | 34132 |
| 34158 | 34165 | 34166 | 34174 | 34179 | 34201 | 34206 | 34208 | 34211 | 34217 | 34221 | 34230 |
| 34232 | 34259 | 34286 | 34287 | 34289 | 34290 | 34294 | 34302 | 34309 | 34316 | 34317 | 34333 |
| 34358 | 34359 | 34374 | 34377 | 34378 | 34392 | 34395 | 34423 | 34434 | 34437 | 34450 | 34452 |
| 34463 | 34469 | 34475 | 34476 | 34484 | 34485 | 34492 | 34501 | 34503 | 34537 | 34546 | 34559 |
| 34566 | 34567 | 34569 | 34585 | 34596 | 34597 | 34615 | 34655 | 34656 | 34657 | 34676 | 34677 |
| 34683 | 34692 | 34701 | 34715 | 34732 | 34737 | 34738 | 34745 | 34753 | 34760 | 34763 | 34766 |
| 34786 | 34789 | 34790 | 34792 | 34804 | 34806 | 34824 | 34847 | 34872 | 34875 | 34884 | 34903 |
| 34924 | 34932 | 34936 | 34938 | 34944 | 34949 | 34964 | 34972 | 34973 | 34984 | 34995 | 34996 |
| 35007 | 35008 | 35014 | 35016 | 35023 | 35025 | 35032 | 35051 | 35058 | 35061 | 35068 | 35074 |
| 35094 | 35100 | 35114 | 35119 | 35120 | 35126 | 35129 | 35130 | 35150 | 35152 | 35153 | 35155 |
| 35156 | 35162 | 35165 | 35177 | 35185 | 35193 | 35205 | 35222 | 35224 | 35225 | 35226 | 35227 |
| 35229 | 35237 | 35241 | 35242 | 35246 | 35252 | 35265 | 35281 | 35282 | 35284 | 35285 | 35301 |
| 35310 | 35316 | 35340 | 35348 | 35350 | 35354 | 35396 | 35406 | 35409 | 35434 | 35436 | 35453 |
| 35455 | 35456 | 35461 | 35470 | 35473 | 35482 | 35483 | 35487 | 35500 | 35517 | 35524 | 35525 |
| 35526 | 35527 | 35535 | 35557 | 35546 | 35562 | 35563 | 35574 | 35584 | 35598 | 35619 |
| 35623 | 35637 | 35638 | 35664 | 35675 | 35684 | 35700 | 35708 | 35720 | 35721 | 35728 | 35739 |
| 35740 | 35745 | 35749 | 35758 | 35765 | 35766 | 35770 | 35773 | 35783 | 35786 | 35789 | 35791 |
| 35793 | 35795 | 35796 | 35797 | 35799 | 35811 | 35822 | 35825 | 35836 | 35846 | 35854 | 35863 |
| 35865 | 35873 | 35882 | 35887 | 35899 | 35900 | 35928 | 35962 | 35969 | 35989 | 35991 | 35999 |
| 36003 | 36011 | 36028 | 36050 | 36085 | 36087 | 36095 | 36105 | 36114 | 36125 | 36159 | 36169 |
| 36173 | 36179 | 36181 | 36183 | 36193 | 36196 | 36200 | 36204 | 36241 | 36253 | 36276 | 36280 |
| 36285 | 36292 | 36294 | 36297 | 36298 | 36313 | 36351 | 36360 | 36379 | 36391 | 36396 | 36410 |
| 36415 | 36417 | 36420 | 36423 | 36445 | 36458 | 36464 | 36523 | 36576 | 36578 | 36590 |
| 36598 | 36613 | 36630 | 36636 | 36639 | 36655 | 36656 | 36671 | 36674 | 36676 | 36710 | 36724 |
| 36727 | 36751 | 36760 | 36777 | 36778 | 36787 | 36793 | 36795 | 36798 | 36813 | 36823 | 36828 |
| 36846 | 36853 | 36856 | 36858 | 36866 | 36879 | 36882 | 36899 | 36912 | 36921 | 36928 | 36934 |
| 36944 | 36967 | 36972 | 36982 | 36988 | 37000 | 37006 | 37016 | 37074 | 37088 | 37140 | 37141 |
| 37146 | 37160 | 37166 | 37167 | 37171 | 37186 | 37219 | 37221 | 37222 | 37223 | 37225 | 37226 |

TABLE 3-continued

Cold Tolerance

| | | | | | | | | | | | |
|---|---|---|---|---|---|---|---|---|---|---|---|
| 37230 | 37241 | 37243 | 37244 | 37249 | 37255 | 37279 | 37283 | 37285 | 37290 | 37299 | 37320 |
| 37330 | 37335 | 37337 | 37340 | 37366 | 37375 | 37381 | 37404 | 37406 | 37407 | 37415 | 37436 |
| 37442 | 37445 | 37470 | 37473 | 37474 | 37484 | 37485 | 37493 | 37500 | 37504 | 37524 | 37532 |
| 37533 | 37538 | 37552 | 37553 | 37555 | 37560 | 37561 | 37567 | 37568 | 37574 | 37588 | 37590 |
| 37591 | 37593 | 37599 | 37607 | 37614 | 37619 | 37635 | 37640 | 37658 | 37717 | 37732 | 37735 |
| 37736 | 37740 | 37749 | 37754 | 37755 | 37800 | 37830 | 37832 | 37836 | 37839 | 37844 | 37862 |
| 37868 | 37882 | 37903 | 37919 | 37920 | 37921 | 37925 | 37929 | 37933 | 37934 | 37935 | 37942 |
| 37946 | 37953 | 37964 | 37970 | 37980 | 37991 | 37995 | 37996 | 38000 | 38009 | 38011 | 38018 |
| 38019 | 38020 | 38033 | 38035 | 38043 | 38051 | 38068 | 38070 | 38079 | 38087 | 38108 | 38118 |
| 38139 | 38140 | 38160 | 38161 | 38169 | 38171 | 38174 | 38175 | 38178 | 38188 | 38197 | 38204 |
| 38209 | 38210 | 38213 | 38215 | 38216 | 38221 | 38222 | 38227 | 38238 | 38252 | 38255 | 38262 |
| 38273 | 38275 | 38281 | 38285 | 38300 | 38302 | 38303 | 38336 | 38337 | 38339 | 38344 | 38349 |
| 38350 | 38351 | 38365 | 38387 | 38392 | 38394 | 38395 | 38398 | 38404 | 38410 | 38433 | 38439 |
| 38467 | 38482 | 38497 | 38507 | 38527 | 38534 | 38550 | 38551 | 38554 | 38556 | 38558 | 38560 |
| 38563 | 38569 | 38572 | 38581 | 38588 | 38607 | 38621 | 38625 | 38630 | 38649 | 38650 | 38651 |
| 38665 | 38670 | 38673 | 38678 | 38695 | 38703 | 38712 | 38716 | 38724 | 38734 | 38738 | 38745 |
| 38746 | 38747 | 38751 | 38766 | 38780 | 38790 | 38807 | 38810 | 38811 | 38812 | 38819 | 38827 |
| 38828 | 38829 | 38847 | 38870 | 38876 | 38877 | 38878 | 38880 | 38885 | 38889 | 38911 | 38916 |
| 38958 | 38976 | 38980 | 38997 | 38998 | 38999 | 39003 | 39004 | 39009 | 39021 | 39022 | 39023 |
| 39045 | 39047 | 39052 | 39061 | 39063 | 39064 | 39067 | 39075 | 39079 | 39085 | 39088 | 39093 |
| 39096 | 39102 | 39103 | 39109 | 39110 | 39115 | 39129 | 39141 | 39158 | 39169 | 39177 | 39179 |
| 39187 | 39205 | 39206 | 39213 | 39217 | 39221 | 39232 | 39240 | 39241 | 39248 | 39249 | 39262 |
| 39267 | 39269 | 39272 | 39274 | 39284 | 39288 | 39291 | 39296 | 39304 | 39311 | 39317 | 39321 |
| 39326 | 39329 | 39333 | 39334 | 39335 | 39336 | 39337 | 39338 | 39339 | 39341 | 39342 | 39343 |
| 39345 | 39346 | 39363 | 39364 | 39365 | 39369 | 39370 | 39375 | 39389 | 39390 | 39395 | 39412 |
| 39414 | 39419 | 39428 | 39431 | 39432 | 39435 | 39443 | 39447 | 39453 | 39456 | 39461 | 39464 |
| 39470 | 39471 | 39477 | 39478 | 39483 | 39486 | 39495 | 39509 | 39528 | 39540 | 39549 |
| 39550 | 39558 | 39577 | 39578 | 39584 | 39588 | 39592 | 39604 | 39613 | 39614 | 39621 | 39622 |
| 39636 | 39638 | 39643 | 39645 | 39648 | 39650 | 39661 | 39666 | 39671 | 39679 | 39686 | 39692 |
| 39696 | 39701 | 39704 | 39708 | 39710 | 39711 | 39712 | 39713 | 39714 | 39715 | 39716 | 39717 |
| 39718 | 39720 | 39721 | 39722 | 39723 | 39724 | 39726 | 39728 | 39729 | 39732 | 39733 | 39734 |
| 39735 | 39736 | 39754 | 39755 | 39760 | 39761 | 39766 | 39779 | 39780 | 39781 | 39797 | 39798 |
| 39804 | 39813 | 39815 | 39816 | 39819 | 39826 | 39830 | 39837 | 39840 | 39844 | 39851 | 39853 |
| 39859 | 39860 | 39865 | 39868 | 39876 | 39877 | 39891 | 39920 | 39923 | 39925 | 39933 | 39950 |
| 39951 | 39956 | 39960 | 39971 | 39980 | 39981 | 39989 | 39999 | 40001 | 40002 | 40006 | 40011 |
| 40015 | 40023 | 40025 | 40029 | 40038 | 40039 | 40046 | 40050 | 40054 | 40057 | 40060 | 40063 |
| 40070 | 40073 | 40075 | 40076 | 40078 | 40094 | 40107 | 40108 | 40115 | 40116 | 40124 | 40132 |
| 40133 | 40144 | 40150 | 40165 | 40167 | 40168 | 40184 | 40206 | 40212 | 40237 | 40239 | 40245 |
| 40247 | 40248 | 40258 | 40263 | 40267 | 40277 | 40282 | 40290 | 40297 | 40333 | 40349 |
| 40356 | 40366 | 40374 | 40377 | 40378 | 40380 | 40389 | 40390 | 40394 | 40396 | 40418 | 40422 |
| 40436 | 40443 | 40444 | 40463 | 40464 | 40470 | 40474 | 40486 | 40491 | 40492 | 40496 | 40512 |
| 40515 | 40531 | 40541 | 40551 | 40552 | 40553 | 40582 | 40588 | 40596 | 40602 | 40604 | 40607 |
| 40620 | 40622 | 40628 | 40633 | 40636 | 40646 | 40657 | 40667 | 40674 | 40682 | 40696 |
| 40698 | 40702 | 40704 | 40711 | 40727 | 40745 | 40746 | 40752 | 40754 | 40755 | 40756 | 40775 |
| 40776 | 40780 | 40790 | 40812 | 40813 | 40842 | 40845 | 40869 | 40870 | 40871 | 40883 | 40885 |
| 40888 | 40891 | 40907 | 40913 | 40918 | 40921 | 40922 | 40924 | 40927 | 40960 | 40971 | 41006 |
| 41008 | 41017 | 41032 | 41035 | 41039 | 41046 | 41062 | 41076 | 41086 | 41097 | 41114 |
| 41126 | 41127 | 41129 | 41134 | 41141 | 41153 | 41154 | 41163 | 41197 | 41202 | 41206 | 41209 |
| 41210 | 41238 | 41239 | 41241 | 41242 | 41243 | 41251 | 41252 | 41255 | 41257 | 41258 | 41259 |
| 41266 | 41274 | 41292 | 41301 | 41302 | 41306 | 41310 | 41313 | 41322 | 41323 | 41343 | 41345 |
| 41347 | 41348 | 41357 | 41358 | 41388 | 41409 | 41411 | 41412 | 41418 | 41425 | 41426 | 41429 |
| 41432 | 41436 | 41449 | 41473 | 41475 | 41477 | 41490 | 41494 | 41496 | 41509 | 41524 | 41527 |
| 41536 | 41550 | 41555 | 41557 | 41576 | 41585 | 41586 | 41588 | 41600 | 41601 | 41608 | 41613 |
| 41614 | 41621 | 41635 | 41645 | 41654 | 41658 | 41665 | 41668 | 41671 | 41672 | 41680 | 41682 |
| 41699 | 41702 | 41705 | 41712 | 41713 | 41717 | 41718 | 41721 | 41728 | 41730 | 41732 | 41736 |
| 41737 | 41738 | 41741 | 41742 | 41747 | 41750 | 41754 | 41756 | 41757 | 41758 | 41760 | 41761 |
| 41762 | 41763 | 41764 | 41765 | 41766 | 41767 | 41768 | 41769 | 41788 | 41800 | 41822 | 41830 |
| 41832 | 41836 | 41843 | 41863 | 41867 | 41879 | 41882 | 41891 | 41892 | 41900 | 41913 | 41914 |
| 41915 | 41928 | 41932 | 41942 | 41952 | 41954 | 41968 | 41995 | 41998 | 42017 | 42025 | 42032 |
| 42050 | 42054 | 42077 | 42084 | 42088 | 42089 | 42092 | 42097 | 42104 | 42105 | 42111 |
| 42118 | 42119 | 42122 | 42129 | 42131 | 42134 | 42138 | 42160 | 42161 | 42162 | 42173 | 42174 |
| 42178 | 42187 | 42204 | 42209 | 42216 | 42224 | 42238 | 42256 | 42275 | 42282 | 42285 | 42295 |
| 42299 | 42304 | 42305 | 42312 | 42323 | 42327 | 42342 | 42347 | 42359 | 42360 | 42375 | 42379 |
| 42384 | 42386 | 42397 | 42405 | 42406 | 42418 | 42420 | 42427 | 42428 | 42438 | 42446 | 42448 |
| 42453 | 42455 | 42458 | 42491 | 42500 | 42511 | 42515 | 42525 | 42533 | 42545 | 42548 | 42549 |
| 42550 | 42556 | 42571 | 42591 | 42603 | 42612 | 42613 | 42617 | 42624 | 42628 | 42639 | 42640 |
| 42648 | 42650 | 42665 | 42692 | 42694 | 42695 | 42709 | 42710 | 42742 | 42746 | 42756 | 42760 |
| 42765 | 42805 | 42807 | 42824 | 42843 | 42845 | 42847 | 42856 | 42882 | 42885 | 42886 | 42887 |
| 42889 | 42890 | 42892 | 42903 | 42909 | 42920 | 42948 | 42951 | 42956 | 42963 | 42964 | 42967 |
| 42981 | 42987 | 42988 | 43004 | 43025 | 43038 | 43050 | 43051 | 43052 | 43053 | 43068 | 43070 |
| 43076 | 43077 | 43078 | 43081 | 43107 | 43120 | 43148 | 43151 | 43152 | 43159 | 43170 | 43173 |
| 43180 | 43189 | 43209 | 43236 | 43237 | 43240 | 43244 | 43259 | 43260 | 43262 | 43265 | 43267 |
| 43272 | 43280 | 43282 | 43286 | 43301 | 43303 | 43304 | 43307 | 43315 | 43331 | 43332 | 43343 |
| 43351 | 43353 | 43359 | 43371 | 43373 | 43385 | 43386 | 43390 | 43391 | 43395 | 43398 | 43401 |
| 43406 | 43441 | 43459 | 43478 | 43482 | 43486 | 43495 | 43518 | 43525 | 43531 | 43533 | 43534 |
| 43537 | 43539 | 43540 | 43541 | 43544 | 43547 | 43553 | 43602 | 43605 | 43608 | 43616 | 43617 |
| 43633 | 43643 | 43677 | 43694 | 43719 | 43722 | 43737 | 43742 | 43743 | 43755 | 43761 | 43773 |

TABLE 3-continued

Cold Tolerance

| | | | | | | | | | | | |
|---|---|---|---|---|---|---|---|---|---|---|---|
| 43788 | 43790 | 43795 | 43797 | 43805 | 43806 | 43813 | 43820 | 43833 | 43842 | 43849 | 43879 |
| 43882 | 43894 | 43903 | 43907 | 43908 | 43916 | 43928 | 43940 | 43949 | 43965 | 43967 | 43984 |
| 43985 | 43988 | 43999 | 44004 | 44009 | 44045 | 44061 | 44062 | 44064 | 44065 | 44087 | 44091 |
| 44096 | 44097 | 44099 | 44104 | 44105 | 44106 | 44115 | 44124 | 44147 | 44148 | 44167 | 44202 |
| 44226 | 44230 | 44235 | 44267 | 44273 | 44290 | 44314 | 44324 | 44330 | 44333 | 44335 | 44342 |
| 44355 | 44396 | 44418 | 44423 | 44424 | 44426 | 44431 | 44432 | 44437 | 44444 | 44445 | 44452 |
| 44459 | 44471 | 44474 | 44480 | 44484 | 44488 | 44489 | 44492 | 44493 | 44498 | 44514 | 44515 |
| 44516 | 44522 | 44523 | 44527 | 44528 | 44535 | 44541 | 44555 | 44558 | 44565 | 44579 | 44581 |
| 44582 | 44597 | 44606 | 44608 | 44629 | 44630 | 44639 | 44650 | 44674 | 44675 | 44676 | 44678 |
| 44679 | 44680 | 44691 | 44695 | 44697 | 44719 | 44729 | 44732 | 44746 | 44749 | 44755 | 44760 |
| 44778 | 44790 | 44806 | 44811 | 44816 | 44834 | 44848 | 44854 | 44857 | 44872 | 44873 | 44877 |
| 44883 | 44887 | 44891 | 44896 | 44897 | 44930 | 44931 | 44943 | 44944 | 44947 | 44950 | 44954 |
| 44967 | 44968 | 44971 | 44972 | 44983 | 45000 | 45001 | 45010 | 45011 | 45015 | 45018 | 45027 |
| 45041 | 45051 | 45055 | 45058 | 45060 | 45066 | 45074 | 45083 | 45097 | 45112 | 45119 | 45128 |
| 45130 | 45133 | 45134 | 45147 | 45149 | 45151 | 45153 | 45168 | 45172 | 45190 | 45194 | 45200 |
| 45214 | 45220 | 45239 | 45244 | 45261 | 45272 | 45273 | 45275 | 45277 | 45294 | 45324 | 45326 |
| 45342 | 45351 | 45357 | 45364 | 45367 | 45369 | 45370 | 45376 | 45378 | 45379 | 45381 | 45388 |
| 45391 | 45398 | 45404 | 45409 | 45413 | 45416 | 45444 | 45445 | 45447 | 45450 | 45465 | 45468 |
| 45481 | 45482 | 45490 | 45496 | 45504 | 45509 | 45511 | 45512 | 45554 | 45559 | 45569 | 45570 |
| 45583 | 45587 | 45598 | 45616 | 45624 | 45628 | 45647 | 45660 | 45674 | 45675 | 45680 | 45681 |
| 45685 | 45693 | 45698 | 45700 | 45702 | 45721 | 45722 | 45723 | 45725 | 45753 | 45758 | 45765 |
| 45781 | 45788 | 45789 | 45794 | 45811 | 45813 | 45834 | 45857 | 45873 | 45892 | 45893 | |
| 45901 | 45907 | 45908 | 45919 | 45925 | 45940 | 45966 | 45978 | 45982 | 46019 | 46022 | 46033 |
| 46057 | 46065 | 46066 | 46073 | 46076 | 46078 | 46089 | 46093 | 46112 | 46115 | 46119 | 46123 |
| 46126 | 46133 | 46179 | 46184 | 46196 | 46225 | 46231 | 46232 | 46238 | 46239 | 46252 | 46269 |
| 46270 | 46281 | 46296 | 46304 | 46319 | 46329 | 46340 | 46362 | 46372 | 46399 | 46404 | 46424 |
| 46435 | 46446 | 46455 | 46469 | 46474 | 46486 | 46504 | 46510 | 46521 | 46526 | 46527 | 46530 |
| 46541 | 46551 | 46552 | 46557 | 46560 | 46582 | 46592 | 46615 | 46649 | 46667 | 46687 | 46700 |
| 46706 | 46739 | 46758 | 46760 | 46782 | 46797 | 46813 | 46814 | 46832 | 46833 | 46834 | 46863 |
| 46866 | 46868 | 46869 | 46870 | 46872 | 46889 | 46901 | 46904 | 46913 | 46914 | 46920 | 46928 |
| 46946 | 46950 | 46959 | 46977 | 46995 | 46999 | 47000 | 47005 | 47006 | 47008 | 47009 | 47013 |
| 47016 | 47037 | 47045 | 47050 | 47063 | 47079 | 47088 | 47107 | 47108 | 47113 | 47132 | 47146 |
| 47154 | 47161 | 47166 | 47167 | 47184 | 47185 | 47189 | 47192 | 47201 | 47203 | 47207 | 47211 |
| 47218 | 47222 | 47238 | 47265 | 47270 | 47285 | 47288 | 47291 | 47297 | 47299 | 47300 | 47306 |
| 47325 | 47327 | 47337 | 47338 | 47339 | 47340 | 47353 | 47354 | 47358 | 47360 | | |

TABLE 4

Disease Control

Table 4A SEQ ID NOs of Polypeptides useful for Improving Disease Control

| | | | | | | | | | | |
|---|---|---|---|---|---|---|---|---|---|---|
| 415 | 492 | 507 | 653 | 721 | 833 | 1355 | 1356 | 1472 | 1539 | 1545 | 1684 |
| 1802 | 1878 | 1928 | 1932 | 1957 | 2023 | 2335 | 2337 | 2880 | 2924 | 3089 | 3135 |
| 3308 | 3399 | 3492 | 3566 | 3785 | 3812 | 3831 | 3951 | 4035 | 4049 | 4051 | 4114 |
| 4125 | 4167 | 4288 | 4408 | 4456 | 4659 | 4680 | 4711 | 4743 | 4756 | 4824 | 4838 |
| 4949 | 5146 | 5302 | 5381 | 5421 | 5520 | 5521 | 5522 | 5523 | 5524 | 5525 | 5664 |
| 5897 | 5984 | 6023 | 6195 | 6215 | 6248 | 6303 | 6353 | 6391 | 6450 | 6507 | 6508 |
| 6581 | 6582 | 6583 | 6743 | 6901 | 7044 | 7164 | 7216 | 7418 | 7439 | 7471 | 7503 |
| 7515 | 7583 | 7707 | 7816 | 7890 | 7983 | 7993 | 8158 | 8165 | 8236 | 8244 | 8470 |
| 8547 | 8599 | 8641 | 8700 | 8722 | 8812 | 8961 | 9115 | 9117 | 9120 | 9281 | 9309 |
| 9398 | 9399 | 10218 | 10228 | 10461 | 10562 | 10717 | 10803 | 10892 | 10919 | 11040 | 11058 |
| 11065 | 11114 | 11177 | 11298 | 11345 | 11395 | 11462 | 11500 | 11527 | 11556 | 11684 | 11765 |
| 11807 | 11860 | 11865 | 11889 | 11934 | 12024 | 12262 | 12263 | 12329 | 12339 | 12435 | 12478 |
| 12511 | 12631 | 12670 | 12727 | 12804 | 12818 | 12910 | 12950 | 13012 | 13016 | 13060 | 13100 |
| 13135 | 13147 | 13220 | 13288 | 13372 | 13482 | 13557 | 13631 | 13656 | 13690 | 13691 | 13805 |
| 13850 | 13927 | 14042 | 14080 | 14111 | 14179 | 14207 | 14347 | 14420 | 14475 | 14511 | |
| 14593 | 14671 | 14728 | 14787 | 14789 | 14922 | 14948 | 14953 | 14961 | 15106 | 15152 | 15208 |
| 15360 | 15414 | 15727 | 15782 | 15948 | 16111 | 16165 | 16394 | 16399 | 16459 | 16514 | 16538 |
| 16543 | 16644 | 16742 | 16746 | 16840 | 16849 | 16889 | 16891 | 17022 | 17136 | 17162 | 17274 |
| 17479 | 17563 | 17612 | 17614 | 17735 | 17952 | 18118 | 18204 | 18212 | 18262 | 18473 | 18493 |
| 18503 | 18584 | 18585 | 18613 | 18984 | 19136 | 19211 | 19361 | 19400 | 19484 | 19507 | |
| 19514 | 19529 | 19684 | 19726 | 19739 | 19750 | 19803 | 19830 | 19890 | 19963 | 19972 | 20183 |
| 20187 | 20189 | 20271 | 20427 | 20462 | 20499 | 20552 | 20590 | 20624 | 20721 | 20851 | 20915 |
| 21113 | 21172 | 21317 | 21318 | 21322 | 22719 | 22735 | 22884 | 22908 | 22951 | 23041 | 23167 |
| 23211 | 23365 | 23452 | 23465 | 23680 | 23682 | 23685 | | | | | |

Table 4B SEQ ID NOs of Polynucleotides useful for Improving Disease Control

| | | | | | | | | | | |
|---|---|---|---|---|---|---|---|---|---|---|
| 24102 | 24179 | 24194 | 24340 | 24408 | 24520 | 25042 | 25043 | 25159 | 25226 | 25232 | 25371 |
| 25489 | 25565 | 25615 | 25619 | 25644 | 25710 | 26022 | 26024 | 26567 | 26611 | 26776 | 26822 |
| 26995 | 27086 | 27179 | 27253 | 27472 | 27499 | 27518 | 27638 | 27722 | 27736 | 27738 | 27801 |
| 27812 | 27854 | 27975 | 28095 | 28143 | 28346 | 28367 | 28398 | 28430 | 28443 | 28511 | 28525 |
| 28636 | 28833 | 28989 | 29068 | 29108 | 29207 | 29208 | 29209 | 29210 | 29211 | 29212 | 29351 |

TABLE 4-continued

Disease Control

| | | | | | | | | | | | |
|---|---|---|---|---|---|---|---|---|---|---|---|
| 29584 | 29671 | 29710 | 29882 | 29902 | 29935 | 29990 | 30040 | 30078 | 30137 | 30194 | 30195 |
| 30268 | 30269 | 30270 | 30430 | 30588 | 30731 | 30851 | 30903 | 31105 | 31126 | 31158 | 31190 |
| 31202 | 31270 | 31394 | 31503 | 31577 | 31670 | 31680 | 31845 | 31852 | 31923 | 31931 | 32157 |
| 32234 | 32286 | 32328 | 32387 | 32409 | 32499 | 32648 | 32802 | 32804 | 32807 | 32968 | 32996 |
| 33085 | 33086 | 33905 | 33915 | 34148 | 34249 | 34404 | 34490 | 34579 | 34606 | 34727 | 34745 |
| 34752 | 34801 | 34864 | 34985 | 35032 | 35082 | 35149 | 35187 | 35214 | 35243 | 35371 | 35452 |
| 35494 | 35547 | 35552 | 35576 | 35621 | 35711 | 35949 | 35950 | 36016 | 36026 | 36122 | 36165 |
| 36198 | 36318 | 36357 | 36414 | 36491 | 36505 | 36597 | 36637 | 36699 | 36703 | 36747 | 36787 |
| 36822 | 36834 | 36907 | 36975 | 37059 | 37169 | 37244 | 37318 | 37343 | 37377 | 37378 | 37492 |
| 37537 | 37614 | 37729 | 37767 | 37798 | 37866 | 37894 | 37967 | 38034 | 38107 | 38162 | 38198 |
| 38280 | 38358 | 38415 | 38474 | 38476 | 38609 | 38635 | 38640 | 38648 | 38793 | 38839 | 38895 |
| 39047 | 39101 | 39414 | 39469 | 39635 | 39798 | 39852 | 40081 | 40086 | 40146 | 40201 | 40225 |
| 40230 | 40331 | 40429 | 40433 | 40527 | 40536 | 40576 | 40578 | 40709 | 40823 | 40849 | 40961 |
| 41166 | 41250 | 41299 | 41301 | 41422 | 41639 | 41805 | 41891 | 41949 | 42080 | 42180 |
| 42190 | 42271 | 42272 | 42300 | 42671 | 42823 | 42898 | 42976 | 43048 | 43087 | 43171 | 43194 |
| 43201 | 43216 | 43371 | 43413 | 43426 | 43437 | 43490 | 43517 | 43577 | 43650 | 43659 | 43870 |
| 43874 | 43876 | 43958 | 44114 | 44149 | 44186 | 44239 | 44277 | 44311 | 44408 | 44538 | 44602 |
| 44800 | 44859 | 45004 | 45005 | 45009 | 46406 | 46422 | 46571 | 46595 | 46638 | 46728 | 46854 |
| 46898 | 47052 | 47139 | 47152 | 47367 | 47369 | 47372 | | | | | |

TABLE 5

Drought Tolerance

Table 5A SEQ ID NOs of Polypeptides useful for Improving Drought Tolerance

| | | | | | | | | | | | |
|---|---|---|---|---|---|---|---|---|---|---|---|
| 390 | 752 | 874 | 1463 | 1624 | 1883 | 1920 | 2245 | 2268 | 2311 | 2546 | 2751 |
| 2968 | 3030 | 3191 | 3411 | 3588 | 3853 | 4019 | 4375 | 4438 | 4644 | 4706 | 4960 |
| 5268 | 5378 | 7129 | 7197 | 7402 | 7465 | 7718 | 7973 | 8022 | 8321 | 8654 | 9976 |
| 10422 | 10519 | 10572 | 10616 | 11099 | 11374 | 11737 | 11837 | 12302 | 12438 | 12607 | 12704 |
| 12968 | 13045 | 13234 | 13603 | 14304 | 14427 | 14780 | 14793 | 14934 | 14959 | 15271 | 15597 |
| 15604 | 15974 | 15979 | 16336 | 16338 | 16731 | 17184 | 17803 | 18255 | 18766 | 19269 | 19383 |
| 19844 | 19866 | 20146 | 20637 | 20793 | 20943 | 21062 | 21190 | 21533 | 21717 | 22074 | 22238 |
| 22749 | 22787 | 23212 | 23310 | 23354 | 23445 | | | | | | |

Table 5B SEQ ID NOs of Polynucleotides useful for Improving Drought Tolerance

| | | | | | | | | | | | |
|---|---|---|---|---|---|---|---|---|---|---|---|
| 24077 | 24439 | 24561 | 25150 | 25311 | 25570 | 25607 | 25932 | 25955 | 25998 | 26233 | 26438 |
| 26655 | 26717 | 26878 | 27098 | 27275 | 27540 | 27706 | 28062 | 28125 | 28331 | 28393 | 28647 |
| 28955 | 29065 | 30816 | 30884 | 31089 | 31152 | 31405 | 31660 | 31709 | 32008 | 32341 | 33663 |
| 34109 | 34206 | 34259 | 34303 | 34786 | 35061 | 35424 | 35524 | 35989 | 36125 | 36294 | 36391 |
| 36655 | 36732 | 36921 | 37290 | 37991 | 38114 | 38467 | 38480 | 38621 | 38646 | 38958 | 39284 |
| 39291 | 39661 | 39666 | 40023 | 40025 | 40418 | 40871 | 41490 | 41942 | 42453 | 42956 | 43070 |
| 43531 | 43553 | 43833 | 44324 | 44480 | 44630 | 44749 | 44877 | 45220 | 45404 | 45761 | 45925 |
| 46436 | 46474 | 46899 | 46997 | 47041 | 47132 | | | | | | |

TABLE 6

Plant Growth/Cell Cycle

Table 6A SEQ ID NOs of Polypeptides useful for improving Plant Growth - Cell Cycle

| | | | | | | | | | | | |
|---|---|---|---|---|---|---|---|---|---|---|---|
| 38 | 52 | 83 | 91 | 152 | 160 | 167 | 184 | 212 | 229 | 258 | 284 |
| 295 | 300 | 355 | 363 | 444 | 553 | 614 | 617 | 623 | 627 | 628 | 658 |
| 670 | 723 | 746 | 844 | 859 | 865 | 866 | 870 | 872 | 921 | 929 | 939 |
| 942 | 944 | 959 | 960 | 963 | 974 | 984 | 985 | 1005 | 1006 | 1031 | 1041 |
| 1056 | 1062 | 1083 | 1098 | 1103 | 1116 | 1117 | 1124 | 1125 | 1168 | 1180 | 1213 |
| 1217 | 1230 | 1242 | 1246 | 1247 | 1249 | 1251 | 1272 | 1273 | 1279 | 1286 | 1287 |
| 1293 | 1305 | 1306 | 1312 | 1318 | 1322 | 1350 | 1351 | 1352 | 1353 | 1354 | 1355 |
| 1356 | 1357 | 1358 | 1359 | 1360 | 1361 | 1362 | 1363 | 1364 | 1365 | 1366 | 1367 |
| 1368 | 1369 | 1370 | 1371 | 1372 | 1373 | 1374 | 1375 | 1376 | 1377 | 1378 | 1379 |
| 1380 | 1381 | 1382 | 1383 | 1384 | 1385 | 1386 | 1387 | 1388 | 1389 | 1390 | 1398 |
| 1399 | 1400 | 1407 | 1422 | 1424 | 1438 | 1448 | 1452 | 1455 | 1467 | 1475 | 1487 |
| 1493 | 1503 | 1524 | 1533 | 1535 | 1540 | 1542 | 1551 | 1553 | 1561 | 1563 | 1568 |
| 1569 | 1570 | 1576 | 1581 | 1585 | 1586 | 1591 | 1619 | 1620 | 1621 | 1625 | 1627 |
| 1628 | 1630 | 1650 | 1653 | 1655 | 1678 | 1715 | 1735 | 1744 | 1761 | 1768 | 1770 |
| 1776 | 1790 | 1798 | 1800 | 1842 | 1852 | 1855 | 1870 | 1875 | 1891 | 1894 | 1901 |
| 1908 | 1919 | 1938 | 1942 | 1965 | 1984 | 1990 | 2001 | 2009 | 2012 | 2030 | 2033 |
| 2036 | 2037 | 2040 | 2061 | 2070 | 2072 | 2073 | 2076 | 2088 | 2099 | 2101 | 2114 |
| 2116 | 2133 | 2135 | 2136 | 2138 | 2150 | 2157 | 2161 | 2179 | 2184 | 2187 | 2188 |
| 2210 | 2213 | 2217 | 2219 | 2224 | 2234 | 2239 | 2240 | 2248 | 2257 | 2258 | 2276 |
| 2290 | 2294 | 2302 | 2309 | 2317 | 2318 | 2323 | 2324 | 2326 | 2335 | 2337 | 2342 |

TABLE 6-continued

Plant Growth/Cell Cycle

| | | | | | | | | | | |
|---|---|---|---|---|---|---|---|---|---|---|
| 2344 | 2347 | 2348 | 2353 | 2362 | 2370 | 2371 | 2375 | 2376 | 2382 | 2390 | 2391 |
| 2395 | 2400 | 2401 | 2405 | 2434 | 2447 | 2452 | 2454 | 2465 | 2468 | 2469 | 2472 |
| 2473 | 2479 | 2487 | 2491 | 2498 | 2502 | 2505 | 2525 | 2544 | 2553 | 2556 | 2563 |
| 2565 | 2577 | 2581 | 2582 | 2584 | 2590 | 2591 | 2593 | 2594 | 2691 | 2693 | 2823 |
| 2840 | 2846 | 2853 | 2904 | 2906 | 2924 | 2940 | 2987 | 3033 | 3035 | 3070 | 3075 |
| 3084 | 3092 | 3093 | 3101 | 3112 | 3118 | 3134 | 3142 | 3151 | 3162 | 3174 | 3195 |
| 3209 | 3210 | 3227 | 3230 | 3242 | 3247 | 3255 | 3256 | 3268 | 3272 | 3275 | 3279 |
| 3293 | 3294 | 3318 | 3319 | 3329 | 3340 | 3345 | 3346 | 3347 | 3349 | 3368 | 3370 |
| 3371 | 3374 | 3375 | 3377 | 3386 | 3388 | 3402 | 3405 | 3406 | 3408 | 3417 | 3433 |
| 3434 | 3438 | 3449 | 3456 | 3464 | 3467 | 3477 | 3487 | 3491 | 3494 | 3503 | 3519 |
| 3526 | 3539 | 3553 | 3557 | 3564 | 3565 | 3569 | 3572 | 3574 | 3585 | 3587 | 3606 |
| 3607 | 3613 | 3626 | 3648 | 3649 | 3650 | 3653 | 3676 | 3691 | 3700 | 3706 | 3707 |
| 3713 | 3716 | 3718 | 3719 | 3729 | 3732 | 3734 | 3738 | 3753 | 3767 | 3768 | 3790 |
| 3791 | 3801 | 3802 | 3807 | 3822 | 3829 | 3841 | 3847 | 3870 | 3883 | 3892 | 3903 |
| 3904 | 3909 | 3922 | 3926 | 3933 | 3935 | 3938 | 3941 | 3942 | 3944 | 3950 | 3959 |
| 3961 | 3963 | 3965 | 3975 | 3989 | 4007 | 4025 | 4026 | 4036 | 4039 | 4053 | 4055 |
| 4058 | 4062 | 4067 | 4070 | 4073 | 4087 | 4089 | 4090 | 4091 | 4102 | 4120 | 4132 |
| 4148 | 4151 | 4155 | 4156 | 4170 | 4174 | 4193 | 4195 | 4197 | 4199 | 4208 | 4222 |
| 4239 | 4261 | 4314 | 4347 | 4363 | 4371 | 4385 | 4389 | 4408 | 4416 | 4435 | 4509 |
| 4511 | 4525 | 4548 | 4634 | 4636 | 4658 | 4666 | 4692 | 4703 | 4735 | 4736 | 4773 |
| 4813 | 4850 | 4859 | 4920 | 4934 | 4947 | 4967 | 4977 | 4980 | 4988 | 4992 | 4995 |
| 5002 | 5014 | 5018 | 5030 | 5053 | 5094 | 5101 | 5102 | 5109 | 5110 | 5113 | 5128 |
| 5129 | 5137 | 5138 | 5141 | 5156 | 5159 | 5162 | 5163 | 5172 | 5173 | 5174 | 5175 |
| 5186 | 5190 | 5191 | 5192 | 5207 | 5227 | 5234 | 5235 | 5236 | 5237 | 5271 | 5296 |
| 5297 | 5305 | 5307 | 5308 | 5341 | 5342 | 5357 | 5366 | 5368 | 5372 | 5388 | 5400 |
| 5413 | 5414 | 5420 | 5447 | 5455 | 5459 | 5460 | 5478 | 5482 | 5505 | 5506 | 5514 |
| 5517 | 5519 | 5526 | 5552 | 5558 | 5566 | 5571 | 5601 | 5607 | 5609 | 5620 | 5639 |
| 5643 | 5653 | 5663 | 5671 | 5672 | 5680 | 5690 | 5692 | 5696 | 5697 | 5705 | 5719 |
| 5721 | 5733 | 5739 | 5743 | 5746 | 5769 | 5781 | 5791 | 5797 | 5822 | 5838 | 5839 |
| 5840 | 5848 | 5849 | 5853 | 5854 | 5855 | 5874 | 5875 | 5877 | 5881 | 5887 | 5890 |
| 5894 | 5895 | 5901 | 5902 | 5904 | 5920 | 5929 | 5930 | 5940 | 5949 | 5955 | 5964 |
| 5972 | 5973 | 5975 | 5977 | 5979 | 5990 | 6020 | 6026 | 6027 | 6063 | 6064 | 6067 |
| 6074 | 6092 | 6106 | 6117 | 6118 | 6119 | 6143 | 6150 | 6156 | 6157 | 6161 | 6187 |
| 6188 | 6189 | 6194 | 6200 | 6201 | 6209 | 6210 | 6237 | 6246 | 6247 | 6248 | 6270 |
| 6289 | 6298 | 6304 | 6328 | 6330 | 6343 | 6346 | 6362 | 6364 | 6376 | 6390 | 6395 |
| 6397 | 6432 | 6440 | 6449 | 6453 | 6460 | 6479 | 6480 | 6481 | 6501 | 6516 | 6527 |
| 6564 | 6573 | 6586 | 6597 | 6604 | 6612 | 6621 | 6625 | 6631 | 6638 | 6639 | 6665 |
| 6676 | 6724 | 6727 | 6729 | 6751 | 6770 | 6774 | 6821 | 6832 | 6834 | 6840 | 6841 |
| 6844 | 6888 | 6922 | 6924 | 6925 | 6926 | 6928 | 6929 | 6943 | 6963 | 6964 |
| 6973 | 6974 | 6975 | 6995 | 6998 | 7016 | 7017 | 7027 | 7029 | 7030 | 7070 | 7102 |
| 7117 | 7125 | 7140 | 7144 | 7164 | 7172 | 7194 | 7267 | 7269 | 7284 | 7322 | 7389 |
| 7392 | 7394 | 7416 | 7417 | 7461 | 7495 | 7533 | 7572 | 7609 | 7618 | 7678 | 7692 |
| 7705 | 7725 | 7751 | 7765 | 7797 | 7800 | 7824 | 7852 | 7931 | 7951 | 7964 |
| 8029 | 8067 | 8074 | 8115 | 8119 | 8131 | 8199 | 8215 | 8228 | 8233 | 8259 | 8267 |
| 8278 | 8286 | 8458 | 8467 | 8474 | 8493 | 8650 | 8678 | 8685 | 8695 | 8702 | 8731 |
| 8773 | 8794 | 8804 | 8832 | 8847 | 8849 | 8851 | 8878 | 8880 | 8933 | 8961 | 8973 |
| 8974 | 9007 | 9015 | 9075 | 9076 | 9088 | 9103 | 9114 | 9141 | 9250 | 9265 | 9271 |
| 9282 | 9287 | 9297 | 9301 | 9376 | 9430 | 9476 | 9505 | 9524 | 9536 | 9541 | 9625 |
| 9646 | 9731 | 9770 | 9790 | 9839 | 9853 | 9876 | 9899 | 9967 | 10053 | 10100 | 10109 |
| 10111 | 10140 | 10154 | 10158 | 10249 | 10254 | 10259 | 10287 | 10321 | 10375 | 10395 | 10404 |
| 10414 | 10454 | 10472 | 10545 | 10562 | 10583 | 10621 | 10644 | 10646 | 10683 | 10684 | 10855 |
| 10878 | 10887 | 10890 | 10892 | 10901 | 10914 | 10917 | 10933 | 10954 | 10959 | 10987 | 11000 |
| 11003 | 11005 | 11023 | 11031 | 11044 | 11060 | 11071 | 11104 | 11105 | 11107 | 11108 | 11119 |
| 11148 | 11160 | 11164 | 11228 | 11236 | 11275 | 11277 | 11279 | 11291 | 11295 | 11302 | 11312 |
| 11330 | 11333 | 11335 | 11354 | 11379 | 11384 | 11411 | 11453 | 11462 | 11487 | 11505 | 11539 |
| 11565 | 11606 | 11623 | 11660 | 11663 | 11689 | 11700 | 11798 | 11841 | 11849 | 11860 | 11869 |
| 11887 | 11907 | 11951 | 11980 | 11988 | 12017 | 12040 | 12114 | 12128 | 12150 | 12192 | 12215 |
| 12249 | 12336 | 12365 | 12387 | 12411 | 12415 | 12424 | 12429 | 12442 | 12443 | 12464 | 12474 |
| 12512 | 12534 | 12545 | 12547 | 12555 | 12557 | 12560 | 12561 | 12564 | 12567 | 12571 | 12578 |
| 12581 | 12582 | 12584 | 12588 | 12591 | 12604 | 12609 | 12616 | 12649 | 12651 | 12654 |
| 12660 | 12677 | 12685 | 12687 | 12705 | 12719 | 12724 | 12732 | 12740 | 12745 | 12752 | 12754 |
| 12755 | 12756 | 12775 | 12779 | 12785 | 12831 | 12839 | 12856 | 12862 | 12867 | 12885 | 12886 |
| 12888 | 12898 | 12915 | 12917 | 12931 | 12940 | 12945 | 12948 | 12951 | 12954 | 12955 | 12961 |
| 12965 | 12966 | 12972 | 12977 | 12992 | 12998 | 13005 | 13007 | 13066 | 13077 | 13082 | 13083 |
| 13084 | 13088 | 13093 | 13103 | 13114 | 13117 | 13118 | 13132 | 13133 | 13141 | 13159 | 13162 |
| 13178 | 13208 | 13223 | 13227 | 13231 | 13238 | 13243 | 13248 | 13270 | 13273 | 13290 | 13300 |
| 13302 | 13315 | 13342 | 13363 | 13372 | 13374 | 13376 | 13383 | 13398 | 13399 | 13402 | 13404 |
| 13407 | 13412 | 13413 | 13414 | 13415 | 13445 | 13464 | 13482 | 13487 | 13489 | 13490 | 13495 |
| 13500 | 13504 | 13513 | 13538 | 13539 | 13543 | 13570 | 13572 | 13580 | 13581 | 13583 | 13590 |
| 13593 | 13606 | 13607 | 13609 | 13635 | 13640 | 13653 | 13683 | 13708 | 13726 | 13730 | 13737 |
| 13773 | 13776 | 13808 | 13840 | 13857 | 13919 | 13947 | 13955 | 13971 | 13985 | 14059 | 14084 |
| 14156 | 14254 | 14280 | 14283 | 14293 | 14309 | 14313 | 14315 | 14318 | 14387 | 14390 | 14428 |
| 14473 | 14474 | 14482 | 14532 | 14540 | 14552 | 14606 | 14661 | 14702 | 14728 | 14731 | 14742 |
| 14867 | 15007 | 15054 | 15079 | 15093 | 15103 | 15121 | 15138 | 15184 | 15208 | 15211 | 15477 |
| 15503 | 15512 | 15548 | 15559 | 15601 | 15635 | 15808 | 15847 | 15875 | 15884 | 15920 | 15921 |
| 15932 | 15970 | 16010 | 16022 | 16040 | 16044 | 16189 | 16226 | 16250 | 16257 | 16287 | 16289 |
| 16299 | 16364 | 16382 | 16431 | 16504 | 16508 | 16524 | 16543 | 16545 | 16582 | 16638 | 16647 |

TABLE 6-continued

Plant Growth/Cell Cycle

| | | | | | | | | | | | |
|---|---|---|---|---|---|---|---|---|---|---|---|
| 16692 | 16733 | 16787 | 16837 | 16940 | 16984 | 17007 | 17048 | 17073 | 17091 | 17107 | 17108 |
| 17155 | 17189 | 17192 | 17226 | 17231 | 17271 | 17284 | 17348 | 17398 | 17403 | 17405 | 17428 |
| 17476 | 17479 | 17482 | 17499 | 17503 | 17524 | 17537 | 17645 | 17676 | 17704 | 17796 | 17809 |
| 17845 | 17971 | 18005 | 18013 | 18057 | 18060 | 18109 | 18110 | 18116 | 18137 | 18148 | 18176 |
| 18184 | 18190 | 18192 | 18195 | 18198 | 18211 | 18215 | 18216 | 18218 | 18225 | 18229 | 18244 |
| 18253 | 18256 | 18257 | 18258 | 18268 | 18284 | 18288 | 18350 | 18393 | 18424 | 18430 | 18450 |
| 18481 | 18537 | 18538 | 18542 | 18543 | 18544 | 18559 | 18566 | 18569 | 18579 | 18589 | 18594 |
| 18602 | 18612 | 18638 | 18645 | 18664 | 18666 | 18670 | 18676 | 18677 | 18685 | 18686 | 18689 |
| 18702 | 18755 | 18771 | 18775 | 18818 | 18823 | 18897 | 18932 | 18939 | 18994 | 18997 | 19033 |
| 19034 | 19044 | 19074 | 19126 | 19139 | 19146 | 19152 | 19166 | 19176 | 19218 | 19262 | 19310 |
| 19319 | 19330 | 19381 | 19415 | 19417 | 19433 | 19495 | 19522 | 19527 | 19548 | 19565 | 19576 |
| 19581 | 19616 | 19640 | 19655 | 19656 | 19662 | 19690 | 19831 | 19859 | 19935 | 19939 | 19947 |
| 19958 | 19972 | 19984 | 19993 | 20050 | 20102 | 20109 | 20141 | 20143 | 20185 | 20203 | 20256 |
| 20281 | 20313 | 20314 | 20316 | 20318 | 20338 | 20339 | 20345 | 20352 | 20353 | 20359 | 20371 |
| 20377 | 20383 | 20387 | 20450 | 20482 | 20486 | 20527 | 20547 | 20553 | 20554 | 20557 | 20581 |
| 20643 | 20706 | 20707 | 20721 | 20746 | 20787 | 20817 | 20826 | 20851 | 20910 | 20920 | 20946 |
| 21075 | 21077 | 21123 | 21130 | 21221 | 21247 | 21269 | 21304 | 21322 | 21348 | 21352 | 21359 |
| 21388 | 21389 | 21407 | 21409 | 21414 | 21436 | 21437 | 21451 | 21452 | 21457 | 21469 | 21482 |
| 21490 | 21521 | 21522 | 21524 | 21538 | 21575 | 21580 | 21586 | 21594 | 21595 | 21606 | 21609 |
| 21621 | 21634 | 21635 | 21636 | 21663 | 21665 | 21666 | 21668 | 21695 | 21779 | 21813 | 21816 |
| 21817 | 21868 | 21874 | 21888 | 21890 | 21899 | 21902 | 21904 | 21907 | 21910 | 21923 | 21924 |
| 21927 | 21931 | 21940 | 21949 | 21955 | 21957 | 21964 | 21967 | 21970 | 21976 | 21977 | 21978 |
| 21981 | 21985 | 21989 | 21995 | 21997 | 22005 | 22025 | 22030 | 22042 | 22059 | 22068 | 22069 |
| 22073 | 22080 | 22084 | 22087 | 22092 | 22103 | 22104 | 22105 | 22108 | 22133 | 22142 | 22149 |
| 22150 | 22151 | 22153 | 22171 | 22173 | 22174 | 22179 | 22189 | 22199 | 22211 | 22221 | 22228 |
| 22235 | 22246 | 22247 | 22262 | 22272 | 22276 | 22285 | 22288 | 22292 | 22304 | 22311 | 22312 |
| 22317 | 22318 | 22319 | 22327 | 22338 | 22343 | 22349 | 22354 | 22356 | 22360 | 22364 | 22387 |
| 22421 | 22422 | 22423 | 22426 | 22427 | 22429 | 22430 | 22434 | 22435 | 22437 | 22439 | 22449 |
| 22453 | 22456 | 22457 | 22462 | 22488 | 22500 | 22502 | 22505 | 22511 | 22513 | 22520 | 22526 |
| 22530 | 22531 | 22548 | 22556 | 22559 | 22561 | 22562 | 22564 | 22578 | 22595 | 22604 | 22616 |
| 22618 | 22624 | 22625 | 22627 | 22641 | 22656 | 22669 | 22673 | 22686 | 22695 | 22702 | |
| 22703 | 22704 | 22712 | 22718 | 22725 | 22734 | 22741 | 22742 | 22745 | 22747 | 22771 | 22778 |
| 22784 | 22785 | 22802 | 22806 | 22811 | 22818 | 22820 | 22829 | 22832 | 22838 | 22841 | 22842 |
| 22860 | 22866 | 22869 | 22884 | 22892 | 22895 | 22929 | 22939 | 22942 | 22950 | 22960 | 22961 |
| 22974 | 23038 | 23039 | 23095 | 23098 | 23128 | 23134 | 23183 | 23185 | 23230 | 23240 | 23247 |
| 23249 | 23261 | 23276 | 23284 | 23350 | 23423 | 23435 | 23458 | 23473 | 23535 | 23543 | 23564 |
| 23606 | 23658 | 23680 | 23685 | | | | | | | | |

Table 6B SEQ ID NOs of Polynucleotides useful for improving Plant Growth - Cell Cycle

| | | | | | | | | | | | |
|---|---|---|---|---|---|---|---|---|---|---|---|
| 23725 | 23739 | 23770 | 23778 | 23839 | 23847 | 23854 | 23871 | 23899 | 23916 | 23945 | 23971 |
| 23982 | 23987 | 24042 | 24050 | 24131 | 24240 | 24301 | 24304 | 24310 | 24314 | 24315 | 24345 |
| 24357 | 24410 | 24433 | 24531 | 24546 | 24552 | 24553 | 24557 | 24559 | 24608 | 24616 | 24626 |
| 24629 | 24631 | 24646 | 24647 | 24650 | 24661 | 24671 | 24672 | 24692 | 24693 | 24718 | 24728 |
| 24743 | 24749 | 24770 | 24785 | 24790 | 24803 | 24804 | 24811 | 24812 | 24855 | 24867 | 24900 |
| 24904 | 24917 | 24929 | 24933 | 24934 | 24936 | 24938 | 24959 | 24960 | 24966 | 24973 | 24974 |
| 24980 | 24992 | 24993 | 24999 | 25005 | 25009 | 25037 | 25038 | 25039 | 25040 | 25041 | 25042 |
| 25043 | 25044 | 25045 | 25046 | 25047 | 25048 | 25049 | 25050 | 25051 | 25052 | 25053 | 25054 |
| 25055 | 25056 | 25057 | 25058 | 25059 | 25060 | 25061 | 25062 | 25063 | 25064 | 25065 | 25066 |
| 25067 | 25068 | 25069 | 25070 | 25071 | 25072 | 25073 | 25074 | 25075 | 25076 | 25077 | 25085 |
| 25086 | 25087 | 25094 | 25109 | 25111 | 25125 | 25135 | 25139 | 25142 | 25154 | 25162 | 25174 |
| 25180 | 25190 | 25211 | 25220 | 25222 | 25227 | 25229 | 25238 | 25248 | 25250 | 25255 | |
| 25256 | 25257 | 25263 | 25268 | 25272 | 25273 | 25278 | 25306 | 25307 | 25308 | 25312 | 25314 |
| 25315 | 25317 | 25337 | 25340 | 25342 | 25365 | 25402 | 25422 | 25431 | 25448 | 25455 | 25457 |
| 25463 | 25477 | 25485 | 25487 | 25529 | 25539 | 25542 | 25557 | 25562 | 25578 | 25581 | 25588 |
| 25595 | 25606 | 25625 | 25629 | 25652 | 25671 | 25677 | 25688 | 25695 | 25699 | 25717 | 25720 |
| 25723 | 25724 | 25727 | 25748 | 25757 | 25759 | 25760 | 25763 | 25775 | 25786 | 25788 | 25801 |
| 25803 | 25820 | 25822 | 25823 | 25825 | 25837 | 25844 | 25848 | 25866 | 25871 | 25874 | 25875 |
| 25897 | 25900 | 25904 | 25906 | 25911 | 25921 | 25926 | 25927 | 25935 | 25944 | 25945 | 25963 |
| 25977 | 25981 | 25989 | 25996 | 26004 | 26005 | 26010 | 26011 | 26013 | 26022 | 26024 | 26029 |
| 26031 | 26034 | 26035 | 26040 | 26049 | 26057 | 26058 | 26062 | 26063 | 26069 | 26077 | 26078 |
| 26082 | 26087 | 26088 | 26092 | 26121 | 26134 | 26139 | 26141 | 26152 | 26155 | 26156 | 26159 |
| 26160 | 26166 | 26174 | 26178 | 26185 | 26189 | 26192 | 26212 | 26231 | 26240 | 26243 | 26250 |
| 26252 | 26264 | 26268 | 26269 | 26271 | 26277 | 26278 | 26378 | 26380 | 26510 | | |
| 26527 | 26533 | 26540 | 26591 | 26593 | 26611 | 26627 | 26674 | 26720 | 26722 | 26757 | 26762 |
| 26771 | 26779 | 26780 | 26788 | 26799 | 26805 | 26821 | 26829 | 26838 | 26849 | 26861 | 26882 |
| 26896 | 26897 | 26914 | 26917 | 26929 | 26934 | 26942 | 26943 | 26955 | 26959 | 26962 | 26966 |
| 26980 | 26981 | 27005 | 27006 | 27016 | 27027 | 27032 | 27033 | 27034 | 27036 | 27055 | 27057 |
| 27058 | 27061 | 27062 | 27064 | 27073 | 27075 | 27089 | 27092 | 27093 | 27095 | 27104 | 27120 |
| 27121 | 27125 | 27136 | 27143 | 27151 | 27154 | 27164 | 27174 | 27178 | 27181 | 27190 | 27206 |
| 27213 | 27226 | 27240 | 27244 | 27251 | 27252 | 27256 | 27259 | 27261 | 27272 | 27274 | 27293 |
| 27294 | 27300 | 27313 | 27335 | 27336 | 27337 | 27340 | 27363 | 27378 | 27387 | 27393 | 27394 |
| 27400 | 27403 | 27405 | 27406 | 27416 | 27419 | 27421 | 27425 | 27440 | 27454 | 27455 | 27477 |
| 27478 | 27488 | 27489 | 27494 | 27509 | 27516 | 27528 | 27534 | 27557 | 27570 | 27579 | 27590 |
| 27591 | 27596 | 27609 | 27613 | 27620 | 27622 | 27625 | 27628 | 27629 | 27631 | 27637 | 27646 |
| 27648 | 27650 | 27652 | 27662 | 27676 | 27694 | 27712 | 27713 | 27723 | 27726 | 27740 | 27742 |
| 27745 | 27749 | 27754 | 27757 | 27760 | 27774 | 27776 | 27777 | 27778 | 27789 | 27807 | 27819 |

TABLE 6-continued

Plant Growth/Cell Cycle

| | | | | | | | | | | | |
|---|---|---|---|---|---|---|---|---|---|---|---|
| 27835 | 27838 | 27842 | 27843 | 27857 | 27861 | 27880 | 27882 | 27884 | 27886 | 27895 | 27909 |
| 27926 | 27948 | 28001 | 28034 | 28050 | 28058 | 28072 | 28076 | 28095 | 28103 | 28122 | 28196 |
| 28198 | 28212 | 28235 | 28321 | 28323 | 28345 | 28353 | 28379 | 28390 | 28422 | 28423 | 28460 |
| 28500 | 28537 | 28546 | 28607 | 28621 | 28634 | 28654 | 28664 | 28667 | 28675 | 28679 | 28682 |
| 28689 | 28701 | 28705 | 28717 | 28740 | 28781 | 28788 | 28789 | 28796 | 28797 | 28800 | 28815 |
| 28816 | 28824 | 28825 | 28828 | 28843 | 28846 | 28849 | 28850 | 28859 | 28860 | 28861 | 28862 |
| 28873 | 28877 | 28878 | 28879 | 28894 | 28914 | 28921 | 28922 | 28923 | 28924 | 28958 | 28983 |
| 28984 | 28992 | 28994 | 28995 | 29028 | 29029 | 29044 | 29053 | 29055 | 29059 | 29075 | 29087 |
| 29100 | 29101 | 29107 | 29134 | 29142 | 29146 | 29147 | 29165 | 29169 | 29192 | 29193 | 29201 |
| 29204 | 29206 | 29213 | 29239 | 29245 | 29253 | 29258 | 29288 | 29294 | 29296 | 29307 | 29326 |
| 29330 | 29340 | 29350 | 29358 | 29359 | 29367 | 29377 | 29379 | 29383 | 29384 | 29392 | 29406 |
| 29408 | 29420 | 29426 | 29430 | 29433 | 29456 | 29468 | 29478 | 29484 | 29509 | 29525 | 29526 |
| 29527 | 29535 | 29536 | 29540 | 29541 | 29542 | 29561 | 29562 | 29564 | 29568 | 29574 | 29577 |
| 29581 | 29582 | 29588 | 29589 | 29591 | 29607 | 29616 | 29617 | 29627 | 29636 | 29642 | 29651 |
| 29659 | 29660 | 29662 | 29664 | 29666 | 29677 | 29707 | 29713 | 29714 | 29750 | 29751 | 29754 |
| 29761 | 29779 | 29793 | 29804 | 29805 | 29806 | 29830 | 29837 | 29843 | 29844 | 29848 | 29874 |
| 29875 | 29876 | 29881 | 29887 | 29888 | 29896 | 29897 | 29924 | 29933 | 29934 | 29935 | 29957 |
| 29976 | 29985 | 29991 | 30015 | 30017 | 30030 | 30033 | 30049 | 30051 | 30063 | 30077 | 30082 |
| 30084 | 30119 | 30127 | 30136 | 30140 | 30147 | 30166 | 30167 | 30168 | 30188 | 30203 | 30214 |
| 30251 | 30260 | 30273 | 30284 | 30291 | 30299 | 30308 | 30312 | 30318 | 30325 | 30326 | 30352 |
| 30363 | 30411 | 30414 | 30416 | 30438 | 30457 | 30461 | 30508 | 30519 | 30521 | 30527 | 30528 |
| 30531 | 30575 | 30609 | 30611 | 30612 | 30613 | 30615 | 30616 | 30629 | 30630 | 30650 | 30651 |
| 30660 | 30661 | 30662 | 30682 | 30685 | 30703 | 30704 | 30714 | 30716 | 30717 | 30757 | 30789 |
| 30804 | 30812 | 30827 | 30831 | 30851 | 30859 | 30881 | 30954 | 30956 | 30971 | 31009 | 31076 |
| 31079 | 31081 | 31103 | 31104 | 31148 | 31182 | 31220 | 31259 | 31296 | 31305 | 31365 | 31379 |
| 31392 | 31412 | 31438 | 31452 | 31484 | 31487 | 31511 | 31539 | 31574 | 31618 | 31638 | 31651 |
| 31716 | 31754 | 31761 | 31802 | 31806 | 31818 | 31886 | 31902 | 31915 | 31920 | 31946 | 31954 |
| 31965 | 31973 | 32145 | 32154 | 32161 | 32180 | 32337 | 32365 | 32372 | 32382 | 32389 | 32418 |
| 32460 | 32481 | 32491 | 32519 | 32534 | 32536 | 32538 | 32565 | 32567 | 32620 | 32648 | 32660 |
| 32661 | 32694 | 32702 | 32762 | 32763 | 32775 | 32790 | 32801 | 32828 | 32937 | 32952 | 32958 |
| 32969 | 32974 | 32984 | 32988 | 33063 | 33117 | 33163 | 33192 | 33211 | 33223 | 33228 | 33312 |
| 33333 | 33418 | 33457 | 33477 | 33526 | 33540 | 33563 | 33586 | 33654 | 33740 | 33787 | 33796 |
| 33798 | 33827 | 33841 | 33845 | 33936 | 33941 | 33946 | 33974 | 34008 | 34062 | 34082 | 34091 |
| 34101 | 34141 | 34159 | 34232 | 34249 | 34270 | 34308 | 34331 | 34333 | 34370 | 34371 | 34542 |
| 34565 | 34574 | 34577 | 34579 | 34588 | 34601 | 34604 | 34620 | 34641 | 34646 | 34674 | 34687 |
| 34690 | 34692 | 34710 | 34718 | 34731 | 34747 | 34758 | 34791 | 34792 | 34794 | 34795 | 34806 |
| 34835 | 34847 | 34851 | 34915 | 34923 | 34962 | 34964 | 34966 | 34978 | 34982 | 34989 | 34999 |
| 35017 | 35020 | 35022 | 35041 | 35066 | 35071 | 35098 | 35140 | 35149 | 35174 | 35192 | 35226 |
| 35252 | 35293 | 35310 | 35347 | 35350 | 35376 | 35387 | 35455 | 35485 | 35536 | 35547 | 35556 |
| 35574 | 35594 | 35638 | 35667 | 35675 | 35704 | 35727 | 35801 | 35815 | 35837 | 35879 | 35902 |
| 35936 | 36023 | 36052 | 36074 | 36098 | 36102 | 36111 | 36116 | 36129 | 36130 | 36151 | 36161 |
| 36199 | 36221 | 36232 | 36234 | 36242 | 36244 | 36247 | 36248 | 36251 | 36254 | 36258 | 36265 |
| 36268 | 36269 | 36271 | 36275 | 36278 | 36291 | 36296 | 36303 | 36333 | 36336 | 36338 | 36341 |
| 36347 | 36364 | 36372 | 36374 | 36392 | 36406 | 36411 | 36419 | 36427 | 36432 | 36439 | 36441 |
| 36442 | 36443 | 36462 | 36466 | 36472 | 36518 | 36526 | 36543 | 36549 | 36554 | 36572 | 36573 |
| 36575 | 36585 | 36602 | 36604 | 36618 | 36627 | 36632 | 36635 | 36638 | 36641 | 36642 | 36648 |
| 36652 | 36653 | 36659 | 36664 | 36679 | 36685 | 36692 | 36694 | 36753 | 36764 | 36769 | 36770 |
| 36771 | 36775 | 36780 | 36790 | 36801 | 36804 | 36805 | 36819 | 36820 | 36828 | 36846 | 36849 |
| 36865 | 36895 | 36910 | 36914 | 36918 | 36925 | 36930 | 36935 | 36957 | 36960 | 36977 | 36987 |
| 36989 | 37002 | 37029 | 37050 | 37059 | 37061 | 37063 | 37070 | 37085 | 37086 | 37089 | 37091 |
| 37094 | 37099 | 37100 | 37101 | 37102 | 37132 | 37151 | 37169 | 37174 | 37176 | 37177 | 37182 |
| 37187 | 37191 | 37200 | 37225 | 37226 | 37230 | 37257 | 37259 | 37267 | 37268 | 37270 | 37277 |
| 37280 | 37293 | 37294 | 37296 | 37322 | 37327 | 37340 | 37370 | 37395 | 37413 | 37417 | 37424 |
| 37460 | 37463 | 37495 | 37527 | 37544 | 37606 | 37634 | 37642 | 37658 | 37672 | 37746 | 37771 |
| 37843 | 37941 | 37967 | 37970 | 37980 | 37996 | 38000 | 38002 | 38005 | 38074 | 38077 | 38115 |
| 38160 | 38161 | 38169 | 38219 | 38227 | 38239 | 38293 | 38348 | 38389 | 38415 | 38418 | 38429 |
| 38554 | 38694 | 38741 | 38766 | 38780 | 38790 | 38808 | 38825 | 38871 | 38895 | 38898 | 39164 |
| 39190 | 39199 | 39235 | 39246 | 39288 | 39322 | 39495 | 39534 | 39562 | 39571 | 39607 | 39608 |
| 39619 | 39657 | 39697 | 39709 | 39727 | 39731 | 39876 | 39913 | 39937 | 39944 | 39974 | 39976 |
| 39986 | 40051 | 40069 | 40118 | 40191 | 40195 | 40211 | 40230 | 40232 | 40269 | 40325 | 40334 |
| 40379 | 40420 | 40474 | 40524 | 40627 | 40671 | 40694 | 40735 | 40760 | 40778 | 40794 | 40795 |
| 40842 | 40876 | 40879 | 40913 | 40918 | 40958 | 40971 | 41035 | 41085 | 41090 | 41092 | 41115 |
| 41163 | 41166 | 41169 | 41186 | 41190 | 41211 | 41224 | 41332 | 41363 | 41391 | 41483 | 41496 |
| 41532 | 41658 | 41692 | 41700 | 41744 | 41747 | 41796 | 41803 | 41824 | 41855 | 41863 | 41863 |
| 41871 | 41877 | 41879 | 41882 | 41885 | 41898 | 41902 | 41903 | 41905 | 41912 | 41916 | 41931 |
| 41940 | 41943 | 41944 | 41945 | 41955 | 41971 | 41975 | 42037 | 42080 | 42111 | 42117 | 42137 |
| 42168 | 42224 | 42225 | 42229 | 42230 | 42231 | 42246 | 42253 | 42256 | 42266 | 42276 | 42281 |
| 42289 | 42299 | 42325 | 42332 | 42351 | 42357 | 42363 | 42364 | 42372 | 42373 | 42376 | |
| 42389 | 42442 | 42458 | 42462 | 42505 | 42510 | 42584 | 42619 | 42626 | 42681 | 42684 | 42720 |
| 42721 | 42731 | 42761 | 42813 | 42826 | 42833 | 42839 | 42853 | 42863 | 42905 | 42949 | 42997 |
| 43006 | 43017 | 43068 | 43102 | 43104 | 43120 | 43182 | 43209 | 43214 | 43235 | 43252 | 43263 |
| 43268 | 43303 | 43327 | 43342 | 43343 | 43377 | 43518 | 43546 | 43622 | 43626 | 43634 | |
| 43645 | 43659 | 43671 | 43680 | 43737 | 43789 | 43796 | 43828 | 43830 | 43872 | 43890 | 43943 |
| 43968 | 44000 | 44001 | 44003 | 44005 | 44025 | 44026 | 44032 | 44039 | 44040 | 44046 | 44058 |
| 44064 | 44070 | 44074 | 44137 | 44169 | 44173 | 44214 | 44234 | 44240 | 44241 | 44244 | 44268 |
| 44330 | 44393 | 44394 | 44408 | 44433 | 44474 | 44504 | 44513 | 44538 | 44597 | 44607 | 44633 |
| 44762 | 44764 | 44810 | 44817 | 44908 | 44934 | 44956 | 44991 | 45009 | 45035 | 45039 | 45046 |

TABLE 6-continued

Plant Growth/Cell Cycle

| | | | | | | | | | | | |
|---|---|---|---|---|---|---|---|---|---|---|---|
| 45075 | 45076 | 45094 | 45096 | 45101 | 45123 | 45124 | 45138 | 45139 | 45144 | 45156 | 45169 |
| 45177 | 45208 | 45209 | 45211 | 45225 | 45262 | 45267 | 45273 | 45281 | 45282 | 45293 | 45296 |
| 45308 | 45321 | 45322 | 45323 | 45350 | 45352 | 45353 | 45355 | 45382 | 45466 | 45500 | 45503 |
| 45504 | 45555 | 45561 | 45575 | 45577 | 45586 | 45589 | 45591 | 45594 | 45597 | 45610 | 45611 |
| 45614 | 45618 | 45627 | 45636 | 45642 | 45644 | 45651 | 45654 | 45657 | 45663 | 45664 | 45665 |
| 45668 | 45672 | 45676 | 45682 | 45684 | 45692 | 45712 | 45717 | 45729 | 45746 | 45755 | 45756 |
| 45760 | 45767 | 45771 | 45774 | 45779 | 45790 | 45791 | 45792 | 45795 | 45820 | 45829 | 45836 |
| 45837 | 45838 | 45840 | 45858 | 45860 | 45861 | 45866 | 45876 | 45886 | 45898 | 45908 | 45915 |
| 45922 | 45933 | 45934 | 45949 | 45959 | 45963 | 45972 | 45975 | 45979 | 45991 | 45998 | 45999 |
| 46004 | 46005 | 46006 | 46014 | 46025 | 46030 | 46036 | 46041 | 46043 | 46047 | 46051 | 46074 |
| 46108 | 46109 | 46110 | 46113 | 46114 | 46116 | 46117 | 46121 | 46122 | 46124 | 46126 | 46136 |
| 46140 | 46143 | 46144 | 46149 | 46175 | 46187 | 46189 | 46192 | 46198 | 46200 | 46207 | 46213 |
| 46217 | 46218 | 46235 | 46243 | 46246 | 46248 | 46249 | 46251 | 46265 | 46282 | 46291 | 46303 |
| 46305 | 46311 | 46312 | 46314 | 46328 | 46343 | 46356 | 46360 | 46361 | 46373 | 46382 | 46389 |
| 46390 | 46391 | 46399 | 46405 | 46412 | 46421 | 46428 | 46429 | 46432 | 46434 | 46458 | 46465 |
| 46471 | 46472 | 46489 | 46493 | 46498 | 46505 | 46507 | 46516 | 46519 | 46525 | 46528 | 46529 |
| 46547 | 46553 | 46556 | 46571 | 46579 | 46582 | 46616 | 46626 | 46629 | 46637 | 46647 | 46648 |
| 46661 | 46725 | 46726 | 46782 | 46785 | 46815 | 46821 | 46870 | 46872 | 46917 | 46927 | 46934 |
| 46936 | 46948 | 46963 | 46971 | 47037 | 47110 | 47122 | 47145 | 47160 | 47222 | 47230 | 47251 |
| 47293 | 47345 | 47367 | 47372 | | | | | | | | |

TABLE 7

Plant Growth/Growth Regulators

Table 7A SEQ ID NOs of Polypeptides useful for improving Plant Growth - Growth Regulators

| | | | | | | | | | | | |
|---|---|---|---|---|---|---|---|---|---|---|---|
| 13 | 35 | 55 | 61 | 63 | 65 | 135 | 173 | 183 | 201 | 211 | 251 |
| 305 | 349 | 372 | 383 | 417 | 420 | 440 | 448 | 467 | 480 | 481 | 483 |
| 496 | 504 | 518 | 529 | 547 | 565 | 586 | 588 | 598 | 610 | 619 | 622 |
| 704 | 711 | 731 | 732 | 737 | 773 | 802 | 816 | 863 | 877 | 892 | 941 |
| 953 | 1044 | 1091 | 1097 | 1101 | 1114 | 1127 | 1136 | 1215 | 1233 | 1240 | 1276 |
| 1280 | 1335 | 1427 | 1471 | 1484 | 1526 | 1607 | 1654 | 1660 | 1694 | 1859 | 1868 |
| 1923 | 1974 | 2050 | 2080 | 2134 | 2176 | 2346 | 2351 | 2378 | 2433 | 2495 | 2506 |
| 2526 | 2534 | 2586 | 2597 | 2607 | 2608 | 2618 | 2645 | 2652 | 2664 | 2716 | 2717 |
| 2724 | 2732 | 2740 | 2748 | 2753 | 2810 | 2817 | 2852 | 2898 | 2903 | 2908 | 2952 |
| 2985 | 3024 | 3025 | 3028 | 3043 | 3056 | 3058 | 3102 | 3116 | 3134 | 3153 | 3163 |
| 3239 | 3267 | 3281 | 3313 | 3373 | 3435 | 3475 | 3496 | 3504 | 3551 | 3576 | 3612 |
| 3617 | 3620 | 3649 | 3679 | 3842 | 3854 | 3885 | 3893 | 3921 | 3945 | 4024 |
| 4061 | 4124 | 4143 | 4150 | 4165 | 4221 | 4298 | 4387 | 4492 | 4494 | 4495 | 4498 |
| 4540 | 4615 | 4623 | 4627 | 4651 | 4669 | 4670 | 4682 | 4730 | 4779 | 4808 | 4825 |
| 4856 | 4876 | 4877 | 4891 | 4900 | 4906 | 4921 | 4932 | 4959 | 5040 | 5046 | 5048 |
| 5051 | 5055 | 5099 | 5111 | 5151 | 5246 | 5256 | 5335 | 5529 | 5530 | 5531 | 5532 |
| 5584 | 5648 | 5670 | 5732 | 5775 | 5952 | 6131 | 6175 | 6301 | 6324 | 6331 | 6513 |
| 6538 | 6539 | 6568 | 6584 | 6678 | 6679 | 6787 | 6869 | 6932 | 6966 | 6967 | 6968 |
| 7054 | 7142 | 7178 | 7251 | 7253 | 7254 | 7257 | 7298 | 7372 | 7381 | 7385 | 7409 |
| 7428 | 7429 | 7441 | 7489 | 7490 | 7539 | 7567 | 7584 | 7615 | 7636 | 7649 | 7658 |
| 7664 | 7679 | 7690 | 7717 | 7730 | 7736 | 7744 | 7748 | 7761 | 7804 | 7818 | 7828 |
| 7851 | 7857 | 7858 | 7893 | 7894 | 7907 | 7945 | 7961 | 7990 | 8043 | 8070 | 8090 |
| 8106 | 8172 | 8173 | 8178 | 8190 | 8225 | 8227 | 8293 | 8348 | 8360 | 8419 | 8421 |
| 8472 | 8506 | 8507 | 8550 | 8630 | 8669 | 8682 | 8687 | 8689 | 8690 | 8772 | 8778 |
| 8893 | 8930 | 8946 | 8955 | 8957 | 8962 | 8982 | 9003 | 9033 | 9077 | 9079 | 9085 |
| 9143 | 9151 | 9172 | 9178 | 9184 | 9188 | 9211 | 9272 | 9290 | 9299 | 9300 | 9307 |
| 9343 | 9356 | 9359 | 9367 | 9375 | 9429 | 9451 | 9452 | 9503 | 9509 | 9513 | 9546 |
| 9550 | 9571 | 9596 | 9617 | 9622 | 9630 | 9660 | 9686 | 9695 | 9710 | 9711 | 9749 |
| 9769 | 9782 | 9867 | 9897 | 9924 | 9932 | 9935 | 9940 | 9952 | 9956 | 9962 | 9972 |
| 9973 | 9978 | 9979 | 9992 | 10000 | 10008 | 10012 | 10013 | 10025 | 10028 | 10030 | 10036 |
| 10046 | 10047 | 10048 | 10056 | 10057 | 10062 | 10068 | 10071 | 10074 | 10076 | 10077 | 10081 |
| 10082 | 10085 | 10087 | 10088 | 10093 | 10094 | 10095 | 10096 | 10101 | 10123 | 10124 | 10127 |
| 10128 | 10129 | 10137 | 10138 | 10146 | 10152 | 10166 | 10176 | 10177 | 10180 | 10186 | 10187 |
| 10188 | 10202 | 10219 | 10247 | 10269 | 10280 | 10292 | 10298 | 10308 | 10316 | 10317 | 10332 |
| 10341 | 10353 | 10362 | 10363 | 10366 | 10367 | 10377 | 10452 | 10464 | 10518 | 10554 | 10577 |
| 10617 | 10625 | 10637 | 10645 | 10724 | 10795 | 10806 | 10848 | 10875 | 10894 | 10961 | 10973 |
| 10983 | 11057 | 11136 | 11143 | 11175 | 11231 | 11233 | 11235 | 11239 | 11276 | 11280 | 11355 |
| 11356 | 11359 | 11370 | 11390 | 11397 | 11418 | 11449 | 11544 | 11547 | 11549 | 11573 | 11580 |
| 11581 | 11611 | 11622 | 11753 | 11763 | 11764 | 11779 | 11785 | 11799 | 11811 | 11816 | 11896 |
| 11938 | 11968 | 11989 | 12009 | 12016 | 12134 | 12139 | 12164 | 12184 | 12185 | 12201 | 12202 |
| 12231 | 12239 | 12283 | 12284 | 12290 | 12405 | 12421 | 12466 | 12476 | 12523 | 12549 | 12559 |
| 12595 | 12606 | 12622 | 12625 | 12641 | 12663 | 12680 | 12714 | 12748 | 12759 | 12785 | 12796 |
| 12799 | 12809 | 12853 | 12858 | 12865 | 12900 | 12905 | 12919 | 12970 | 12974 | 12982 | 12988 |
| 12991 | 13034 | 13046 | 13061 | 13096 | 13125 | 13153 | 13181 | 13272 | 13305 | 13332 | 13363 |
| 13385 | 13388 | 13417 | 13448 | 13481 | 13578 | 13616 | 13649 | 13681 | 13725 | 13756 | 13766 |
| 13771 | 13803 | 13814 | 13816 | 13823 | 13854 | 13879 | 13882 | 13940 | 13944 | 13946 | 13965 |

TABLE 7-continued

Plant Growth/Growth Regulators

| | | | | | | | | | | | |
|---|---|---|---|---|---|---|---|---|---|---|---|
| 13986 | 13998 | 13999 | 14003 | 14013 | 14020 | 14043 | 14112 | 14114 | 14148 | 14169 | 14191 |
| 14198 | 14237 | 14281 | 14306 | 14362 | 14369 | 14373 | 14376 | 14380 | 14419 | 14435 | 14451 |
| 14493 | 14539 | 14546 | 14569 | 14582 | 14583 | 14591 | 14620 | 14669 | 14670 | 14672 | 14759 |
| 14768 | 14775 | 14816 | 14829 | 14853 | 14862 | 14881 | 14886 | 14897 | 14916 | 14921 | 14928 |
| 14957 | 15003 | 15011 | 15034 | 15067 | 15078 | 15108 | 15149 | 15150 | 15245 | 15248 | 15249 |
| 15250 | 15251 | 15252 | 15253 | 15254 | 15255 | 15262 | 15266 | 15267 | 15274 | 15277 | 15278 |
| 15279 | 15280 | 15281 | 15282 | 15284 | 15292 | 15298 | 15304 | 15324 | 15331 | 15333 | 15351 |
| 15354 | 15355 | 15396 | 15432 | 15440 | 15449 | 15476 | 15489 | 15537 | 15540 | 15568 | 15594 |
| 15619 | 15628 | 15637 | 15657 | 15662 | 15664 | 15670 | 15690 | 15698 | 15700 | 15718 | 15721 |
| 15722 | 15764 | 15809 | 15817 | 15846 | 15861 | 15872 | 15908 | 15911 | 15941 | 15971 | 15994 |
| 16003 | 16012 | 16053 | 16054 | 16060 | 16082 | 16089 | 16091 | 16105 | 16107 | 16138 | 16148 |
| 16191 | 16200 | 16225 | 16240 | 16247 | 16279 | 16281 | 16307 | 16358 | 16365 | 16393 | 16461 |
| 16496 | 16509 | 16523 | 16526 | 16541 | 16548 | 16549 | 16573 | 16584 | 16604 | 16652 | 16665 |
| 16697 | 16723 | 16739 | 16750 | 16768 | 16773 | 16800 | 16822 | 16831 | 16836 | 16839 | 16874 |
| 16925 | 16937 | 16942 | 16943 | 16948 | 16960 | 16994 | 17001 | 17004 | 17008 | 17025 | 17038 |
| 17041 | 17076 | 17084 | 17087 | 17097 | 17099 | 17191 | 17202 | 17210 | 17227 | 17236 | 17275 |
| 17308 | 17313 | 17334 | 17346 | 17357 | 17358 | 17379 | 17450 | 17478 | 17501 | 17502 | 17504 |
| 17527 | 17561 | 17589 | 17621 | 17644 | 17734 | 17751 | 17755 | 17829 | 17842 | 17871 | 17895 |
| 17925 | 17939 | 17944 | 17957 | 18000 | 18010 | 18021 | 18022 | 18029 | 18033 | 18040 | 18044 |
| 18090 | 18132 | 18150 | 18207 | 18261 | 18289 | 18306 | 18326 | 18335 | 18347 | 18391 | 18404 |
| 18434 | 18440 | 18445 | 18463 | 18467 | 18468 | 18472 | 18556 | 18567 | 18606 | 18651 | 18674 |
| 18727 | 18750 | 18752 | 18753 | 18757 | 18784 | 18787 | 18799 | 18803 | 18833 | 18843 | 18849 |
| 18853 | 18860 | 18875 | 18894 | 18911 | 18920 | 18923 | 18931 | 18947 | 18949 | 19001 | 19003 |
| 19006 | 19027 | 19041 | 19058 | 19068 | 19095 | 19096 | 19188 | 19189 | 19190 | 19191 | 19194 |
| 19206 | 19227 | 19306 | 19313 | 19329 | 19356 | 19399 | 19468 | 19471 | 19520 | 19552 | 19561 |
| 19586 | 19588 | 19643 | 19661 | 19670 | 19675 | 19687 | 19696 | 19717 | 19761 | 19798 | 19827 |
| 19835 | 19836 | 19837 | 19843 | 19851 | 19864 | 19883 | 19886 | 19922 | 19926 | 19933 | 19934 |
| 19952 | 19976 | 19987 | 19991 | 20004 | 20015 | 20017 | 20023 | 20029 | 20052 | 20076 | 20094 |
| 20098 | 20142 | 20145 | 20168 | 20176 | 20179 | 20188 | 20196 | 20206 | 20209 | 20212 | 20255 |
| 20265 | 20283 | 20290 | 20342 | 20346 | 20399 | 20441 | 20483 | 20510 | 20569 | 20579 | 20595 |
| 20596 | 20601 | 20620 | 20686 | 20697 | 20734 | 20763 | 20788 | 20796 | 20832 | 20853 | 20893 |
| 20900 | 20918 | 20926 | 20928 | 20939 | 20944 | 20945 | 20973 | 21022 | 21033 | 21056 | 21079 |
| 21083 | 21089 | 21105 | 21137 | 21173 | 21174 | 21195 | 21197 | 21211 | 21225 | 21264 | 21289 |
| 21319 | 21366 | 21419 | 21422 | 21459 | 21484 | 21492 | 21512 | 21529 | 21542 | 21562 | 21615 |
| 21633 | 21696 | 21719 | 21725 | 21759 | 21768 | 21770 | 21782 | 21805 | 21821 | 21913 | 21917 |
| 21934 | 21997 | 22041 | 22060 | 22137 | 22145 | 22203 | 22271 | 22280 | 22362 | 22390 | 22473 |
| 22474 | 22475 | 22476 | 22477 | 22478 | 22479 | 22480 | 22481 | 22482 | 22483 | 22484 | 22485 |
| 22486 | 22487 | 22488 | 22489 | 22494 | 22524 | 22558 | 22566 | 22567 | 22572 | 22598 | 22680 |
| 22687 | 22691 | 22711 | 22716 | 22757 | 22794 | 22798 | 22815 | 22920 | 22977 | 22984 | 23025 |
| 23046 | 23048 | 23090 | 23096 | 23108 | 23114 | 23149 | 23153 | 23168 | 23180 | 23200 | 23201 |
| 23205 | 23216 | 23279 | 23325 | 23364 | 23369 | 23381 | 23414 | 23494 | 23506 | 23528 | 23540 |
| 23548 | 23568 | 23618 | 23629 | 23655 | | | | | | | |

Table 7B SEQ ID NOs of Polynucleotides useful for improving Plant Growth - Growth Regulators

| | | | | | | | | | | | |
|---|---|---|---|---|---|---|---|---|---|---|---|
| 23700 | 23722 | 23742 | 23748 | 23750 | 23752 | 23822 | 23860 | 23870 | 23888 | 23898 | 23938 |
| 23992 | 24036 | 24059 | 24070 | 24104 | 24107 | 24127 | 24135 | 24154 | 24167 | 24168 | 24170 |
| 24183 | 24191 | 24205 | 24216 | 24234 | 24252 | 24273 | 24275 | 24285 | 24297 | 24306 | 24309 |
| 24391 | 24398 | 24418 | 24419 | 24424 | 24460 | 24489 | 24503 | 24550 | 24564 | 24579 | 24628 |
| 24640 | 24731 | 24778 | 24784 | 24788 | 24801 | 24814 | 24823 | 24902 | 24920 | 24927 | 24963 |
| 24967 | 25022 | 25114 | 25158 | 25171 | 25213 | 25294 | 25341 | 25347 | 25381 | 25546 | 25555 |
| 25610 | 25661 | 25737 | 25767 | 25821 | 25863 | 26033 | 26038 | 26065 | 26120 | 26182 | 26193 |
| 26213 | 26221 | 26273 | 26284 | 26294 | 26295 | 26305 | 26332 | 26347 | 26351 | 26403 | 26404 |
| 26411 | 26419 | 26427 | 26435 | 26440 | 26497 | 26504 | 26539 | 26585 | 26590 | 26595 | 26639 |
| 26672 | 26711 | 26712 | 26715 | 26730 | 26743 | 26745 | 26789 | 26803 | 26821 | 26840 | 26850 |
| 26926 | 26954 | 26968 | 27000 | 27060 | 27122 | 27162 | 27183 | 27191 | 27238 | 27263 | 27299 |
| 27304 | 27307 | 27336 | 27366 | 27529 | 27541 | 27572 | 27580 | 27587 | 27608 | 27632 | 27711 |
| 27748 | 27811 | 27830 | 27837 | 27852 | 27908 | 27985 | 28074 | 28179 | 28181 | 28182 | 28185 |
| 28227 | 28302 | 28310 | 28314 | 28338 | 28356 | 28357 | 28369 | 28417 | 28466 | 28495 | 28512 |
| 28543 | 28563 | 28564 | 28578 | 28587 | 28593 | 28608 | 28619 | 28646 | 28727 | 28733 | 28735 |
| 28738 | 28742 | 28786 | 28798 | 28838 | 28933 | 28943 | 29022 | 29216 | 29217 | 29218 | 29219 |
| 29271 | 29335 | 29357 | 29419 | 29462 | 29639 | 29818 | 29862 | 29988 | 30011 | 30018 | 30200 |
| 30225 | 30226 | 30255 | 30271 | 30365 | 30366 | 30474 | 30506 | 30519 | 30653 | 30654 | 30655 |
| 30741 | 30829 | 30865 | 30938 | 30940 | 30941 | 30944 | 30985 | 31059 | 31068 | 31072 | 31096 |
| 31115 | 31116 | 31128 | 31176 | 31177 | 31226 | 31254 | 31271 | 31302 | 31323 | 31336 | 31345 |
| 31351 | 31366 | 31377 | 31404 | 31417 | 31423 | 31431 | 31435 | 31448 | 31491 | 31505 | 31515 |
| 31538 | 31544 | 31545 | 31580 | 31581 | 31594 | 31632 | 31648 | 31677 | 31730 | 31757 | 31777 |
| 31793 | 31859 | 31860 | 31865 | 31877 | 31912 | 31914 | 31980 | 32035 | 32047 | 32106 | 32108 |
| 32159 | 32193 | 32194 | 32237 | 32317 | 32356 | 32369 | 32374 | 32376 | 32377 | 32459 | 32465 |
| 32580 | 32617 | 32633 | 32642 | 32644 | 32649 | 32669 | 32690 | 32720 | 32764 | 32766 | 32772 |
| 32830 | 32838 | 32859 | 32865 | 32871 | 32875 | 32898 | 32959 | 32986 | 32987 | 32994 |
| 33030 | 33043 | 33046 | 33054 | 33062 | 33116 | 33138 | 33139 | 33190 | 33196 | 33200 | 33233 |
| 33237 | 33258 | 33283 | 33304 | 33309 | 33317 | 33347 | 33373 | 33382 | 33397 | 33398 | 33436 |
| 33456 | 33469 | 33554 | 33584 | 33611 | 33619 | 33622 | 33627 | 33639 | 33643 | 33649 | 33659 |
| 33660 | 33665 | 33666 | 33679 | 33687 | 33695 | 33699 | 33700 | 33712 | 33715 | 33717 | 33723 |
| 33733 | 33734 | 33735 | 33743 | 33744 | 33749 | 33755 | 33758 | 33761 | 33763 | 33764 | 33768 |

TABLE 7-continued

Plant Growth/Growth Regulators

| | | | | | | | | | | | |
|---|---|---|---|---|---|---|---|---|---|---|---|
| 33769 | 33772 | 33774 | 33775 | 33780 | 33781 | 33782 | 33783 | 33788 | 33810 | 33811 | 33814 |
| 33815 | 33816 | 33824 | 33825 | 33833 | 33839 | 33853 | 33863 | 33864 | 33867 | 33873 | 33874 |
| 33875 | 33889 | 33906 | 33934 | 33956 | 33967 | 33979 | 33985 | 33995 | 34003 | 34004 | 34019 |
| 34028 | 34040 | 34049 | 34050 | 34053 | 34054 | 34064 | 34139 | 34151 | 34205 | 34241 | 34264 |
| 34304 | 34312 | 34324 | 34332 | 34411 | 34482 | 34493 | 34535 | 34562 | 34581 | 34648 | 34660 |
| 34670 | 34744 | 34823 | 34830 | 34862 | 34918 | 34920 | 34922 | 34926 | 34963 | 34967 | 35042 |
| 35043 | 35046 | 35057 | 35077 | 35084 | 35105 | 35136 | 35231 | 35234 | 35236 | 35260 | 35267 |
| 35268 | 35298 | 35309 | 35440 | 35450 | 35451 | 35466 | 35472 | 35486 | 35498 | 35503 | 35583 |
| 35625 | 35655 | 35676 | 35696 | 35703 | 35821 | 35826 | 35851 | 35871 | 35872 | 35888 | 35889 |
| 35918 | 35926 | 35970 | 35971 | 35977 | 36092 | 36108 | 36153 | 36163 | 36210 | 36236 | 36246 |
| 36282 | 36293 | 36309 | 36312 | 36328 | 36350 | 36367 | 36401 | 36435 | 36446 | 36472 | 36483 |
| 36486 | 36496 | 36540 | 36545 | 36552 | 36587 | 36592 | 36606 | 36657 | 36661 | 36669 | 36675 |
| 36678 | 36721 | 36733 | 36748 | 36783 | 36812 | 36840 | 36868 | 36959 | 36992 | 37019 | 37050 |
| 37072 | 37075 | 37104 | 37135 | 37168 | 37265 | 37303 | 37336 | 37368 | 37412 | 37443 | 37453 |
| 37458 | 37490 | 37501 | 37503 | 37510 | 37541 | 37566 | 37569 | 37627 | 37631 | 37633 | 37652 |
| 37673 | 37685 | 37686 | 37690 | 37700 | 37707 | 37730 | 37799 | 37801 | 37835 | 37856 | 37878 |
| 37885 | 37924 | 37968 | 37993 | 38049 | 38056 | 38060 | 38063 | 38067 | 38106 | 38122 | 38138 |
| 38180 | 38226 | 38233 | 38256 | 38269 | 38270 | 38278 | 38307 | 38356 | 38357 | 38359 | 38446 |
| 38455 | 38462 | 38503 | 38516 | 38540 | 38549 | 38568 | 38573 | 38584 | 38603 | 38608 | 38615 |
| 38644 | 38690 | 38698 | 38721 | 38754 | 38765 | 38795 | 38836 | 38837 | 38932 | 38935 | 38936 |
| 38937 | 38938 | 38939 | 38940 | 38941 | 38942 | 38949 | 38953 | 38954 | 38961 | 38964 | 38965 |
| 38966 | 38967 | 38968 | 38969 | 38971 | 38979 | 38985 | 38991 | 39011 | 39018 | 39020 | 39038 |
| 39041 | 39042 | 39083 | 39119 | 39127 | 39136 | 39163 | 39176 | 39224 | 39227 | 39255 | 39281 |
| 39306 | 39315 | 39324 | 39344 | 39349 | 39351 | 39357 | 39377 | 39385 | 39387 | 39405 | 39408 |
| 39409 | 39451 | 39496 | 39504 | 39533 | 39548 | 39559 | 39595 | 39598 | 39628 | 39658 | 39681 |
| 39690 | 39699 | 39740 | 39741 | 39747 | 39769 | 39776 | 39778 | 39792 | 39794 | 39825 | 39835 |
| 39878 | 39887 | 39912 | 39927 | 39934 | 39966 | 39968 | 39994 | 40045 | 40052 | 40080 | 40148 |
| 40183 | 40196 | 40210 | 40213 | 40228 | 40235 | 40236 | 40260 | 40271 | 40291 | 40339 | 40352 |
| 40384 | 40410 | 40426 | 40437 | 40455 | 40460 | 40487 | 40509 | 40518 | 40523 | 40526 | 40561 |
| 40612 | 40624 | 40629 | 40630 | 40635 | 40647 | 40681 | 40688 | 40691 | 40695 | 40712 | 40725 |
| 40728 | 40763 | 40771 | 40774 | 40784 | 40786 | 40878 | 40889 | 40897 | 40914 | 40923 | 40962 |
| 40995 | 41000 | 41021 | 41033 | 41044 | 41045 | 41066 | 41137 | 41165 | 41188 | 41189 | 41191 |
| 41214 | 41248 | 41276 | 41308 | 41331 | 41421 | 41438 | 41442 | 41516 | 41529 | 41558 | 41582 |
| 41612 | 41626 | 41631 | 41644 | 41687 | 41697 | 41708 | 41709 | 41716 | 41720 | 41727 | 41731 |
| 41777 | 41819 | 41837 | 41894 | 41948 | 41976 | 41993 | 42013 | 42022 | 42034 | 42078 | 42091 |
| 42121 | 42127 | 42132 | 42150 | 42154 | 42155 | 42159 | 42243 | 42254 | 42293 | 42338 | 42361 |
| 42414 | 42437 | 42439 | 42440 | 42444 | 42471 | 42474 | 42486 | 42490 | 42520 | 42530 | 42536 |
| 42540 | 42547 | 42562 | 42581 | 42598 | 42607 | 42610 | 42618 | 42634 | 42636 | 42688 | 42690 |
| 42693 | 42714 | 42728 | 42745 | 42755 | 42782 | 42783 | 42875 | 42877 | 42878 | 42881 | |
| 42893 | 42914 | 42993 | 43000 | 43016 | 43043 | 43086 | 43155 | 43158 | 43207 | 43239 | 43248 |
| 43273 | 43275 | 43330 | 43348 | 43357 | 43362 | 43374 | 43383 | 43404 | 43448 | 43485 | 43514 |
| 43522 | 43523 | 43524 | 43530 | 43538 | 43551 | 43570 | 43573 | 43609 | 43613 | 43620 | 43621 |
| 43639 | 43663 | 43674 | 43678 | 43691 | 43702 | 43704 | 43710 | 43716 | 43739 | 43763 | 43781 |
| 43785 | 43829 | 43832 | 43855 | 43863 | 43866 | 43875 | 43883 | 43893 | 43896 | 43899 | 43942 |
| 43952 | 43970 | 43977 | 44029 | 44033 | 44086 | 44128 | 44170 | 44197 | 44256 | 44266 | 44282 |
| 44283 | 44288 | 44307 | 44373 | 44384 | 44421 | 44450 | 44475 | 44483 | 44519 | 44540 | 44580 |
| 44587 | 44605 | 44613 | 44615 | 44626 | 44631 | 44632 | 44660 | 44709 | 44720 | 44743 | 44766 |
| 44770 | 44776 | 44792 | 44824 | 44860 | 44861 | 44882 | 44884 | 44898 | 44912 | 44951 | 44976 |
| 45006 | 45053 | 45106 | 45109 | 45146 | 45171 | 45179 | 45199 | 45216 | 45229 | 45249 | 45302 |
| 45320 | 45383 | 45406 | 45412 | 45446 | 45455 | 45457 | 45469 | 45492 | 45508 | 45600 | 45604 |
| 45621 | 45684 | 45728 | 45747 | 45824 | 45832 | 45890 | 45958 | 45967 | 46049 | 46077 | 46160 |
| 46161 | 46162 | 46163 | 46164 | 46165 | 46166 | 46167 | 46168 | 46169 | 46170 | 46171 | 46172 |
| 46173 | 46174 | 46175 | 46176 | 46181 | 46211 | 46245 | 46253 | 46254 | 46259 | 46285 | 46367 |
| 46374 | 46378 | 46398 | 46403 | 46444 | 46481 | 46485 | 46502 | 46607 | 46664 | 46671 | 46712 |
| 46733 | 46735 | 46777 | 46783 | 46795 | 46801 | 46836 | 46840 | 46855 | 46867 | 46887 | 46888 |
| 46892 | 46903 | 46966 | 47012 | 47051 | 47056 | 47068 | 47101 | 47181 | 47193 | 47215 | 47227 |
| 47235 | 47255 | 47305 | 47316 | 47342 | | | | | | | |

TABLE 8

Heat Tolerance

Table 8A SEQ ID NOs of Polypeptides useful for improving Heat Tolerance

| | | | | | | | | | | | |
|---|---|---|---|---|---|---|---|---|---|---|---|
| 20 | 31 | 47 | 72 | 73 | 98 | 122 | 126 | 134 | 166 | 181 | 189 |
| 205 | 244 | 268 | 280 | 298 | 311 | 351 | 356 | 365 | 373 | 386 | 387 |
| 390 | 414 | 421 | 449 | 459 | 477 | 513 | 558 | 562 | 566 | 591 | 636 |
| 645 | 682 | 688 | 689 | 733 | 734 | 738 | 750 | 752 | 777 | 790 | 822 |
| 835 | 839 | 874 | 923 | 931 | 989 | 993 | 1132 | 1155 | 1211 | 1212 | 1394 |
| 1409 | 1423 | 1434 | 1439 | 1440 | 1445 | 1463 | 1474 | 1476 | 1479 | 1522 | 1544 |
| 1568 | 1589 | 1591 | 1597 | 1609 | 1624 | 1625 | 1632 | 1641 | 1649 | 1665 | 1673 |
| 1716 | 1728 | 1760 | 1768 | 1798 | 1821 | 1838 | 1839 | 1847 | 1883 | 1899 | 1904 |
| 1907 | 1917 | 1920 | 1943 | 1956 | 1971 | 1975 | 1998 | 2001 | 2018 | 2047 | 2053 |
| 2079 | 2119 | 2121 | 2130 | 2157 | 2158 | 2171 | 2202 | 2205 | 2208 | 2211 | 2213 |

TABLE 8-continued

Heat Tolerance

| | | | | | | | | | | | |
|---|---|---|---|---|---|---|---|---|---|---|---|
| 2245 | 2268 | 2270 | 2304 | 2311 | 2359 | 2397 | 2419 | 2420 | 2453 | 2524 | 2536 |
| 2546 | 2551 | 2574 | 2639 | 2642 | 2647 | 2648 | 2738 | 2745 | 2751 | 2752 | 2762 |
| 2766 | 2769 | 2779 | 2791 | 2799 | 2805 | 2834 | 2856 | 2878 | 2894 | 2902 | 2916 |
| 2937 | 2945 | 2949 | 2950 | 2968 | 2975 | 2984 | 3026 | 3031 | 3050 | 3087 | 3103 |
| 3120 | 3130 | 3133 | 3191 | 3198 | 3203 | 3206 | 3232 | 3236 | 3249 | 3292 | 3299 |
| 3305 | 3345 | 3357 | 3376 | 3462 | 3465 | 3478 | 3487 | 3491 | 3505 | 3526 | 3527 |
| 3561 | 3571 | 3588 | 3592 | 3603 | 3615 | 3629 | 3698 | 3724 | 3762 | 3788 | 3834 |
| 3835 | 3847 | 3853 | 3871 | 3950 | 3990 | 4019 | 4056 | 4083 | 4086 | 4100 | 4116 |
| 4137 | 4144 | 4146 | 4198 | 4216 | 4227 | 4236 | 4259 | 4284 | 4291 | 4314 | 4337 |
| 4361 | 4363 | 4369 | 4375 | 4413 | 4424 | 4438 | 4455 | 4506 | 4510 | 4573 | 4574 |
| 4593 | 4618 | 4644 | 4663 | 4689 | 4694 | 4706 | 4720 | 4727 | 4781 | 4806 | 4844 |
| 4960 | 4968 | 4970 | 4988 | 4992 | 4994 | 5003 | 5023 | 5027 | 5068 | 5090 | 5104 |
| 5184 | 5225 | 5268 | 5298 | 5330 | 5334 | 5338 | 5339 | 5363 | 5378 | 5415 | 5448 |
| 5491 | 5533 | 5534 | 5540 | 5544 | 5548 | 5552 | 5576 | 5592 | 5593 | 5609 | 5644 |
| 5693 | 5743 | 5745 | 5773 | 5777 | 5780 | 5791 | 5796 | 5798 | 5858 | 5862 | 5863 |
| 5901 | 5902 | 5904 | 5915 | 5916 | 5922 | 5975 | 5990 | 5993 | 6014 | 6018 | 6026 |
| 6027 | 6042 | 6057 | 6062 | 6081 | 6104 | 6107 | 6108 | 6133 | 6134 | 6143 | 6152 |
| 6163 | 6189 | 6210 | 6214 | 6233 | 6240 | 6241 | 6253 | 6272 | 6274 | 6309 | 6315 |
| 6316 | 6317 | 6318 | 6322 | 6325 | 6326 | 6348 | 6349 | 6350 | 6351 | 6352 | 6355 |
| 6356 | 6361 | 6365 | 6366 | 6367 | 6384 | 6388 | 6394 | 6397 | 6400 | 6413 | 6422 |
| 6423 | 6424 | 6425 | 6438 | 6471 | 6472 | 6473 | 6484 | 6485 | 6503 | 6578 | 6579 |
| 6587 | 6588 | 6589 | 6590 | 6591 | 6592 | 6597 | 6607 | 6617 | 6625 | 6636 | 6663 |
| 6664 | 6740 | 6749 | 6759 | 6766 | 6788 | 6790 | 6792 | 6796 | 6819 | 6829 | 6955 |
| 6978 | 6979 | 6983 | 6986 | 7031 | 7039 | 7047 | 7070 | 7092 | 7102 | 7115 | 7117 |
| 7123 | 7129 | 7169 | 7182 | 7197 | 7264 | 7268 | 7330 | 7331 | 7350 | 7375 | 7402 |
| 7422 | 7448 | 7465 | 7479 | 7486 | 7541 | 7565 | 7603 | 7718 | 7726 | 7776 | 7778 |
| 7784 | 7799 | 7831 | 7869 | 7908 | 7916 | 7917 | 7973 | 8000 | 8022 | 8041 | 8063 |
| 8064 | 8065 | 8094 | 8095 | 8096 | 8109 | 8114 | 8242 | 8260 | 8289 | 8309 | 8319 |
| 8321 | 8322 | 8434 | 8450 | 8487 | 8495 | 8498 | 8575 | 8579 | 8617 | 8654 | 8706 |
| 8792 | 8814 | 8874 | 8888 | 8902 | 8915 | 8926 | 8927 | 8932 | 9019 | 9038 | 9080 |
| 9112 | 9140 | 9156 | 9166 | 9196 | 9240 | 9269 | 9287 | 9305 | 9306 | 9313 | 9337 |
| 9347 | 9374 | 9378 | 9385 | 9439 | 9459 | 9467 | 9493 | 9496 | 9597 | 9606 | 9635 |
| 9641 | 9654 | 9656 | 9697 | 9759 | 9767 | 9794 | 9870 | 9898 | 9928 | 9938 | 9944 |
| 9961 | 9976 | 9982 | 9983 | 10014 | 10015 | 10058 | 10060 | 10066 | 10163 | 10170 | 10172 |
| 10244 | 10294 | 10295 | 10297 | 10300 | 10336 | 10368 | 10371 | 10380 | 10386 | 10398 | 10422 |
| 10492 | 10519 | 10534 | 10572 | 10603 | 10608 | 10623 | 10648 | 10649 | 10657 | 10673 | 10763 |
| 10798 | 10802 | 10814 | 10849 | 10862 | 10863 | 10870 | 10890 | 10928 | 11007 | 11087 | 11088 |
| 11099 | 11135 | 11178 | 11204 | 11232 | 11374 | 11393 | 11475 | 11478 | 11483 | 11504 | 11535 |
| 11550 | 11595 | 11598 | 11643 | 11704 | 11710 | 11759 | 11760 | 11797 | 11817 | 11834 | 11837 |
| 11838 | 11895 | 11908 | 11916 | 11917 | 11920 | 11921 | 11971 | 11982 | 12087 | 12088 | 12096 |
| 12106 | 12108 | 12170 | 12294 | 12302 | 12330 | 12331 | 12348 | 12349 | 12366 | 12426 | 12438 |
| 12482 | 12506 | 12517 | 12535 | 12536 | 12554 | 12592 | 12607 | 12614 | 12619 | 12640 | 12645 |
| 12665 | 12703 | 12704 | 12741 | 12788 | 12817 | 12830 | 12873 | 12911 | 12922 | 12968 | 12992 |
| 12995 | 12997 | 13007 | 13011 | 13097 | 13099 | 13185 | 13234 | 13279 | 13280 | 13281 | 13285 |
| 13292 | 13301 | 13393 | 13503 | 13532 | 13592 | 13603 | 13643 | 13657 | 13658 | 13666 | 13684 |
| 13718 | 13722 | 13736 | 13739 | 13744 | 13764 | 13817 | 13818 | 13867 | 14027 | 14055 | 14061 |
| 14063 | 14068 | 14074 | 14104 | 14113 | 14131 | 14157 | 14206 | 14213 | 14265 | 14304 | 14356 |
| 14436 | 14449 | 14459 | 14521 | 14535 | 14543 | 14565 | 14588 | 14613 | 14656 | 14769 | 14780 |
| 14882 | 14919 | 14934 | 14943 | 14980 | 14987 | 15051 | 15059 | 15087 | 15130 | 15163 | 15247 |
| 15263 | 15264 | 15265 | 15271 | 15310 | 15311 | 15312 | 15347 | 15374 | 15389 | 15468 | 15487 |
| 15488 | 15521 | 15524 | 15554 | 15561 | 15580 | 15597 | 15599 | 15604 | 15639 | 15645 | 15676 |
| 15677 | 15678 | 15714 | 15741 | 15757 | 15838 | 15859 | 15860 | 15892 | 15895 | 15927 | 15934 |
| 15956 | 15974 | 15976 | 15979 | 16014 | 16020 | 16067 | 16068 | 16126 | 16141 | 16217 | 16235 |
| 16265 | 16268 | 16293 | 16302 | 16319 | 16333 | 16336 | 16338 | 16343 | 16367 | 16372 | 16445 |
| 16515 | 16519 | 16530 | 16558 | 16571 | 16622 | 16635 | 16731 | 16749 | 16753 | 16754 | 16818 |
| 16825 | 16834 | 16865 | 16917 | 16934 | 16990 | 17101 | 17132 | 17172 | 17182 | 17184 | 17208 |
| 17209 | 17234 | 17272 | 17294 | 17305 | 17345 | 17352 | 17386 | 17392 | 17514 | 17524 | 17546 |
| 17551 | 17569 | 17593 | 17615 | 17643 | 17660 | 17710 | 17725 | 17733 | 17803 | 17826 | 17841 |
| 17874 | 17875 | 17907 | 17908 | 17910 | 17945 | 17958 | 17967 | 17978 | 18017 | 18050 | 18239 |
| 18240 | 18241 | 18255 | 18341 | 18348 | 18363 | 18418 | 18432 | 18444 | 18448 | 18517 | 18523 |
| 18560 | 18561 | 18660 | 18669 | 18728 | 18744 | 18756 | 18766 | 18769 | 18770 | 18772 | 18794 |
| 18813 | 18826 | 18874 | 18913 | 18937 | 18988 | 18989 | 19014 | 19070 | 19076 | 19077 | 19111 |
| 19116 | 19121 | 19140 | 19144 | 19148 | 19153 | 19154 | 19157 | 19161 | 19170 | 19183 | 19186 |
| 19204 | 19217 | 19226 | 19247 | 19254 | 19267 | 19269 | 19277 | 19290 | 19335 | 19351 | 19372 |
| 19377 | 19383 | 19384 | 19403 | 19420 | 19421 | 19432 | 19458 | 19460 | 19473 | 19502 | 19516 |
| 19534 | 19544 | 19574 | 19578 | 19591 | 19596 | 19614 | 19625 | 19646 | 19647 | 19665 | 19725 |
| 19735 | 19756 | 19762 | 19786 | 19820 | 19832 | 19833 | 19844 | 19854 | 19866 | 19884 | 19909 |
| 19962 | 20032 | 20046 | 20047 | 20064 | 20070 | 20072 | 20073 | 20099 | 20100 | 20146 | 20184 |
| 20211 | 20216 | 20217 | 20276 | 20488 | 20490 | 20521 | 20609 | 20611 | 20616 | 20637 | 20653 |
| 20654 | 20711 | 20733 | 20739 | 20776 | 20793 | 20809 | 20826 | 20841 | 20843 | 20854 | 20873 |
| 20886 | 20889 | 20911 | 20941 | 20942 | 20943 | 20953 | 20981 | 20987 | 21005 | 21018 | 21024 |
| 21062 | 21076 | 21109 | 21121 | 21167 | 21190 | 21204 | 21218 | 21223 | 21226 | 21245 | 21305 |
| 21306 | 21323 | 21354 | 21363 | 21379 | 21381 | 21428 | 21533 | 21552 | 21717 | 21758 | 21767 |
| 21775 | 21781 | 21798 | 21824 | 21848 | 21849 | 21863 | 21867 | 21871 | 21872 | 21936 | 21993 |
| 22015 | 22016 | 22040 | 22053 | 22106 | 22110 | 22115 | 22150 | 22167 | 22185 | 22231 | 22238 |
| 22252 | 22297 | 22298 | 22325 | 22335 | 22350 | 22355 | 22384 | 22411 | 22412 | 22419 | 22446 |
| 22452 | 22463 | 22490 | 22497 | 22551 | 22555 | 22578 | 22583 | 22587 | 22595 | 22651 | 22655 |

TABLE 8-continued

Heat Tolerance

| | | | | | | | | | | | |
|---|---|---|---|---|---|---|---|---|---|---|---|
| 22664 | 22684 | 22697 | 22699 | 22768 | 22772 | 22783 | 22787 | 22801 | 22823 | 22890 | 23050 |
| 23094 | 23147 | 23182 | 23206 | 23224 | 23233 | 23308 | 23372 | 23376 | 23402 | 23416 | 23420 |
| 23431 | 23445 | 23464 | 23500 | 23508 | 23531 | 23598 | 23601 | 23604 | 23630 | 23640 | |

Table 8B SEQ ID NOs of Polynucleotides useful for improving Heat Tolerance

| | | | | | | | | | | | |
|---|---|---|---|---|---|---|---|---|---|---|---|
| 23707 | 23718 | 23734 | 23759 | 23760 | 23785 | 23809 | 23813 | 23821 | 23853 | 23868 | 23876 |
| 23892 | 23931 | 23955 | 23967 | 23985 | 23998 | 24038 | 24043 | 24052 | 24060 | 24073 | 24074 |
| 24077 | 24101 | 24108 | 24136 | 24146 | 24164 | 24200 | 24245 | 24249 | 24253 | 24278 | 24323 |
| 24332 | 24369 | 24375 | 24376 | 24420 | 24421 | 24425 | 24437 | 24439 | 24464 | 24477 | 24509 |
| 24522 | 24526 | 24561 | 24610 | 24618 | 24676 | 24680 | 24819 | 24842 | 24898 | 24899 | 25081 |
| 25096 | 25110 | 25121 | 25126 | 25127 | 25132 | 25150 | 25161 | 25163 | 25166 | 25209 | 25231 |
| 25255 | 25276 | 25278 | 25284 | 25296 | 25311 | 25312 | 25319 | 25328 | 25336 | 25352 | 25360 |
| 25403 | 25415 | 25447 | 25455 | 25485 | 25508 | 25525 | 25526 | 25534 | 25570 | 25586 | 25591 |
| 25594 | 25604 | 25607 | 25630 | 25643 | 25658 | 25662 | 25685 | 25688 | 25705 | 25734 | 25740 |
| 25766 | 25806 | 25808 | 25817 | 25844 | 25845 | 25858 | 25889 | 25892 | 25895 | 25898 | 25900 |
| 25932 | 25955 | 25957 | 25991 | 25998 | 26046 | 26084 | 26106 | 26107 | 26140 | 26211 | 26223 |
| 26233 | 26238 | 26261 | 26326 | 26329 | 26334 | 26335 | 26425 | 26432 | 26438 | 26439 | 26449 |
| 26453 | 26456 | 26466 | 26478 | 26486 | 26492 | 26521 | 26543 | 26565 | 26581 | 26589 | 26603 |
| 26624 | 26632 | 26636 | 26637 | 26655 | 26662 | 26671 | 26713 | 26718 | 26737 | 26774 | 26790 |
| 26807 | 26817 | 26820 | 26878 | 26885 | 26890 | 26893 | 26919 | 26923 | 26936 | 26979 | 26986 |
| 26992 | 27032 | 27044 | 27063 | 27149 | 27152 | 27165 | 27174 | 27178 | 27192 | 27213 | 27214 |
| 27248 | 27258 | 27275 | 27279 | 27290 | 27302 | 27316 | 27385 | 27411 | 27449 | 27475 | 27521 |
| 27522 | 27534 | 27540 | 27558 | 27637 | 27677 | 27706 | 27743 | 27770 | 27773 | 27787 | 27803 |
| 27824 | 27831 | 27833 | 27885 | 27903 | 27914 | 27923 | 27946 | 27971 | 27978 | 28001 | 28024 |
| 28048 | 28050 | 28056 | 28062 | 28100 | 28111 | 28125 | 28142 | 28193 | 28197 | 28260 | 28261 |
| 28280 | 28305 | 28331 | 28350 | 28376 | 28381 | 28393 | 28407 | 28414 | 28468 | 28493 | 28531 |
| 28647 | 28655 | 28657 | 28675 | 28679 | 28681 | 28690 | 28710 | 28714 | 28755 | 28777 | 28791 |
| 28871 | 28912 | 28955 | 28985 | 29017 | 29021 | 29025 | 29026 | 29050 | 29065 | 29102 | 29135 |
| 29178 | 29220 | 29221 | 29227 | 29231 | 29235 | 29239 | 29263 | 29279 | 29280 | 29296 | 29331 |
| 29380 | 29430 | 29432 | 29460 | 29464 | 29467 | 29478 | 29483 | 29485 | 29545 | 29549 | 29550 |
| 29588 | 29589 | 29591 | 29602 | 29603 | 29609 | 29662 | 29677 | 29680 | 29701 | 29705 | 29713 |
| 29714 | 29729 | 29744 | 29749 | 29768 | 29791 | 29794 | 29795 | 29820 | 29821 | 29830 | 29839 |
| 29850 | 29876 | 29897 | 29901 | 29920 | 29927 | 29928 | 29940 | 29959 | 29961 | 29996 | 30002 |
| 30003 | 30004 | 30005 | 30009 | 30012 | 30013 | 30035 | 30036 | 30037 | 30038 | 30039 | 30042 |
| 30043 | 30048 | 30052 | 30053 | 30054 | 30071 | 30075 | 30081 | 30084 | 30087 | 30100 | 30109 |
| 30110 | 30111 | 30112 | 30125 | 30158 | 30159 | 30160 | 30171 | 30172 | 30190 | 30265 | 30266 |
| 30274 | 30275 | 30276 | 30277 | 30278 | 30279 | 30284 | 30294 | 30304 | 30312 | 30323 | 30350 |
| 30351 | 30427 | 30436 | 30446 | 30453 | 30475 | 30477 | 30479 | 30483 | 30506 | 30516 | 30642 |
| 30665 | 30666 | 30670 | 30673 | 30718 | 30726 | 30734 | 30757 | 30779 | 30789 | 30802 | 30804 |
| 30810 | 30816 | 30856 | 30869 | 30884 | 30951 | 30955 | 31017 | 31018 | 31037 | 31062 | 31089 |
| 31109 | 31135 | 31152 | 31166 | 31173 | 31228 | 31252 | 31290 | 31405 | 31413 | 31463 | 31465 |
| 31471 | 31486 | 31518 | 31556 | 31595 | 31603 | 31604 | 31660 | 31687 | 31709 | 31728 | 31750 |
| 31751 | 31752 | 31781 | 31782 | 31783 | 31796 | 31801 | 31929 | 31947 | 31976 | 31996 | 32006 |
| 32008 | 32009 | 32121 | 32137 | 32174 | 32182 | 32185 | 32262 | 32266 | 32304 | 32341 | 32393 |
| 32479 | 32501 | 32561 | 32575 | 32589 | 32602 | 32613 | 32614 | 32619 | 32706 | 32725 | 32767 |
| 32799 | 32827 | 32843 | 32853 | 32883 | 32927 | 32956 | 32974 | 32992 | 32993 | 33000 | 33024 |
| 33034 | 33061 | 33065 | 33072 | 33126 | 33146 | 33154 | 33180 | 33183 | 33284 | 33293 | 33322 |
| 33328 | 33341 | 33343 | 33384 | 33446 | 33454 | 33481 | 33557 | 33585 | 33615 | 33625 | 33631 |
| 33648 | 33663 | 33669 | 33670 | 33701 | 33702 | 33745 | 33747 | 33753 | 33850 | 33857 | 33859 |
| 33931 | 33981 | 33982 | 33984 | 33987 | 34023 | 34055 | 34058 | 34067 | 34073 | 34085 | 34109 |
| 34179 | 34206 | 34221 | 34259 | 34290 | 34295 | 34310 | 34335 | 34336 | 34344 | 34360 | 34450 |
| 34485 | 34489 | 34501 | 34536 | 34549 | 34550 | 34557 | 34577 | 34615 | 34694 | 34774 | 34775 |
| 34786 | 34822 | 34865 | 34891 | 34919 | 35061 | 35080 | 35162 | 35165 | 35170 | 35191 | 35222 |
| 35237 | 35282 | 35285 | 35330 | 35391 | 35397 | 35446 | 35447 | 35484 | 35504 | 35521 | 35524 |
| 35525 | 35582 | 35595 | 35603 | 35604 | 35607 | 35608 | 35658 | 35669 | 35774 | 35775 | 35783 |
| 35793 | 35795 | 35857 | 35981 | 35989 | 36017 | 36018 | 36035 | 36036 | 36053 | 36113 | 36125 |
| 36169 | 36193 | 36204 | 36222 | 36223 | 36241 | 36279 | 36294 | 36301 | 36306 | 36327 | 36332 |
| 36352 | 36390 | 36391 | 36428 | 36475 | 36504 | 36517 | 36560 | 36598 | 36609 | 36655 | 36679 |
| 36682 | 36684 | 36694 | 36698 | 36784 | 36786 | 36872 | 36921 | 36966 | 36967 | 36968 | 36972 |
| 36979 | 36988 | 37080 | 37190 | 37219 | 37279 | 37290 | 37330 | 37344 | 37345 | 37353 | 37371 |
| 37405 | 37409 | 37423 | 37426 | 37431 | 37451 | 37504 | 37505 | 37554 | 37714 | 37742 | 37748 |
| 37750 | 37755 | 37761 | 37791 | 37800 | 37818 | 37844 | 37893 | 37900 | 37952 | 37991 | 38043 |
| 38123 | 38136 | 38146 | 38208 | 38222 | 38230 | 38252 | 38275 | 38300 | 38343 | 38456 | 38467 |
| 38569 | 38606 | 38621 | 38630 | 38667 | 38674 | 38738 | 38746 | 38774 | 38817 | 38850 | 38934 |
| 38950 | 38951 | 38952 | 38958 | 38997 | 38998 | 38999 | 39034 | 39061 | 39076 | 39155 | 39174 |
| 39175 | 39208 | 39211 | 39241 | 39248 | 39267 | 39284 | 39286 | 39291 | 39326 | 39332 | 39363 |
| 39364 | 39365 | 39401 | 39428 | 39444 | 39525 | 39546 | 39547 | 39579 | 39582 | 39614 | 39621 |
| 39643 | 39661 | 39663 | 39666 | 39701 | 39707 | 39754 | 39755 | 39813 | 39828 | 39904 | 39922 |
| 39952 | 39955 | 39980 | 39989 | 40006 | 40020 | 40023 | 40025 | 40030 | 40054 | 40059 | 40132 |
| 40202 | 40206 | 40217 | 40245 | 40258 | 40309 | 40322 | 40418 | 40436 | 40440 | 40441 | 40505 |
| 40512 | 40521 | 40552 | 40604 | 40621 | 40677 | 40788 | 40859 | 40869 | 40819 | 40871 | 40895 |
| 40896 | 40921 | 40959 | 40981 | 40992 | 41032 | 41039 | 41073 | 41079 | 41201 | 41211 | 41233 |
| 41238 | 41256 | 41280 | 41302 | 41330 | 41347 | 41397 | 41412 | 41420 | 41490 | 41513 | 41528 |
| 41561 | 41562 | 41594 | 41595 | 41597 | 41632 | 41645 | 41654 | 41665 | 41704 | 41737 | 41926 |
| 41927 | 41928 | 41942 | 42028 | 42035 | 42050 | 42105 | 42119 | 42131 | 42135 | 42204 | 42210 |
| 42247 | 42248 | 42347 | 42356 | 42415 | 42431 | 42443 | 42453 | 42456 | 42457 | 42459 | 42481 |

TABLE 8-continued

Heat Tolerance

| | | | | | | | | | | | |
|---|---|---|---|---|---|---|---|---|---|---|---|
| 42500 | 42513 | 42561 | 42600 | 42624 | 42675 | 42676 | 42701 | 42757 | 42763 | 42764 | 42798 |
| 42803 | 42808 | 42827 | 42831 | 42835 | 42840 | 42841 | 42844 | 42848 | 42857 | 42870 | 42873 |
| 42891 | 42904 | 42913 | 42934 | 42941 | 42954 | 42956 | 42964 | 42977 | 43022 | 43038 | 43059 |
| 43064 | 43070 | 43071 | 43090 | 43107 | 43108 | 43119 | 43145 | 43147 | 43160 | 43189 | 43203 |
| 43221 | 43231 | 43261 | 43265 | 43278 | 43283 | 43301 | 43312 | 43333 | 43334 | 43352 | 43412 |
| 43422 | 43443 | 43449 | 43473 | 43507 | 43519 | 43520 | 43531 | 43541 | 43553 | 43571 | 43596 |
| 43649 | 43719 | 43733 | 43734 | 43751 | 43757 | 43759 | 43760 | 43786 | 43787 | 43833 | 43871 |
| 43898 | 43903 | 43904 | 43963 | 44175 | 44177 | 44208 | 44296 | 44298 | 44303 | 44324 | 44340 |
| 44341 | 44398 | 44420 | 44426 | 44463 | 44480 | 44496 | 44513 | 44528 | 44530 | 44541 | 44560 |
| 44573 | 44576 | 44598 | 44628 | 44629 | 44630 | 44640 | 44668 | 44674 | 44692 | 44705 | 44711 |
| 44749 | 44763 | 44796 | 44808 | 44854 | 44877 | 44891 | 44905 | 44910 | 44913 | 44932 | 44992 |
| 44993 | 45010 | 45041 | 45050 | 45066 | 45068 | 45115 | 45220 | 45239 | 45404 | 45445 | 45454 |
| 45462 | 45468 | 45485 | 45511 | 45535 | 45536 | 45550 | 45554 | 45558 | 45559 | 45623 | 45680 |
| 45702 | 45703 | 45727 | 45740 | 45793 | 45797 | 45802 | 45837 | 45854 | 45872 | 45918 | 45925 |
| 45939 | 45984 | 45985 | 46012 | 46022 | 46037 | 46042 | 46071 | 46098 | 46099 | 46106 | 46133 |
| 46139 | 46150 | 46177 | 46184 | 46238 | 46242 | 46265 | 46270 | 46274 | 46282 | 46338 | 46342 |
| 46351 | 46371 | 46384 | 46386 | 46455 | 46459 | 46470 | 46474 | 46488 | 46510 | 46577 | 46737 |
| 46781 | 46834 | 46869 | 46893 | 46911 | 46920 | 46995 | 47059 | 47063 | 47089 | 47103 | 47107 |
| 47118 | 47132 | 47151 | 47187 | 47195 | 47218 | 47285 | 47288 | 47291 | 47317 | 47327 | |

TABLE 9

Herbicide Tolerance

Table 9A SEQ ID NOs of Polypeptides useful for improving Herbicide Tolerance

| | | | | | | | | | | | |
|---|---|---|---|---|---|---|---|---|---|---|---|
| 3 | 5 | 10 | 22 | 23 | 26 | 30 | 42 | 57 | 59 | 69 | 92 |
| 96 | 99 | 113 | 120 | 121 | 123 | 125 | 138 | 145 | 148 | 149 | 150 |
| 158 | 161 | 165 | 170 | 196 | 200 | 203 | 206 | 223 | 227 | 233 | 241 |
| 242 | 243 | 246 | 254 | 259 | 273 | 292 | 297 | 302 | 322 | 323 | 324 |
| 326 | 331 | 336 | 354 | 358 | 382 | 384 | 389 | 397 | 399 | 400 | 404 |
| 406 | 412 | 422 | 441 | 445 | 450 | 451 | 463 | 482 | 510 | 511 | 514 |
| 532 | 533 | 536 | 563 | 567 | 568 | 569 | 570 | 573 | 575 | 576 | 589 |
| 594 | 595 | 629 | 646 | 654 | 655 | 659 | 660 | 661 | 663 | 669 | 678 |
| 680 | 700 | 703 | 706 | 714 | 726 | 728 | 739 | 743 | 751 | 758 | 760 |
| 761 | 762 | 770 | 771 | 775 | 783 | 801 | 803 | 804 | 814 | 826 | 850 |
| 854 | 857 | 880 | 881 | 882 | 884 | 898 | 912 | 916 | 925 | 930 | 947 |
| 962 | 971 | 992 | 1007 | 1030 | 1049 | 1051 | 1055 | 1058 | 1059 | 1066 | 1067 |
| 1071 | 1076 | 1078 | 1080 | 1102 | 1104 | 1108 | 1113 | 1118 | 1119 | 1120 | 1128 |
| 1131 | 1138 | 1139 | 1144 | 1147 | 1149 | 1156 | 1159 | 1162 | 1163 | 1164 | 1165 |
| 1179 | 1181 | 1196 | 1198 | 1206 | 1210 | 1218 | 1221 | 1232 | 1239 | 1260 | 1261 |
| 1288 | 1294 | 1298 | 1302 | 1308 | 1319 | 1323 | 1340 | 1410 | 1443 | 1444 | 1465 |
| 1501 | 1511 | 1513 | 1548 | 1582 | 1610 | 1614 | 1616 | 1617 | 1622 | 1635 | 1645 |
| 1659 | 1664 | 1701 | 1707 | 1727 | 1743 | 1757 | 1783 | 1832 | 1869 | 1946 | 1947 |
| 2005 | 2041 | 2048 | 2063 | 2064 | 2098 | 2175 | 2227 | 2237 | 2247 | 2305 | 2334 |
| 2336 | 2417 | 2435 | 2461 | 2484 | 2496 | 2580 | 2616 | 2620 | 2628 | 2630 | 2637 |
| 2641 | 2643 | 2650 | 2652 | 2674 | 2677 | 2681 | 2701 | 2704 | 2712 | 2721 | 2729 |
| 2755 | 2758 | 2764 | 2784 | 2789 | 2793 | 2794 | 2796 | 2802 | 2804 | 2812 | 2819 |
| 2821 | 2822 | 2827 | 2835 | 2837 | 2838 | 2849 | 2851 | 2872 | 2883 | 2891 | 2931 |
| 2933 | 2989 | 2991 | 2992 | 2993 | 3013 | 3022 | 3049 | 3063 | 3069 | 3071 | 3076 |
| 3098 | 3106 | 3111 | 3140 | 3143 | 3157 | 3167 | 3199 | 3200 | 3214 | 3218 | 3244 |
| 3250 | 3260 | 3363 | 3383 | 3390 | 3397 | 3455 | 3466 | 3474 | 3524 | 3556 | 3578 |
| 3579 | 3699 | 3702 | 3705 | 3708 | 3782 | 3814 | 3850 | 3905 | 3906 | 3916 | 3970 |
| 3972 | 4079 | 4080 | 4113 | 4133 | 4153 | 4172 | 4178 | 4179 | 4181 | 4196 | 4214 |
| 4230 | 4232 | 4245 | 4247 | 4264 | 4273 | 4274 | 4293 | 4300 | 4323 | 4348 | 4368 |
| 4372 | 4386 | 4415 | 4417 | 4419 | 4431 | 4433 | 4469 | 4470 | 4476 | 4477 | 4507 |
| 4513 | 4516 | 4533 | 4538 | 4545 | 4547 | 4551 | 4571 | 4575 | 4576 | 4580 | 4588 |
| 4589 | 4590 | 4592 | 4607 | 4616 | 4649 | 4650 | 4655 | 4726 | 4728 | 4759 | 4764 |
| 4778 | 4810 | 4811 | 4821 | 4826 | 4878 | 4922 | 4927 | 4929 | 4930 | 4941 | 4966 |
| 5037 | 5211 | 5445 | 5454 | 5501 | 5588 | 5628 | 5650 | 5676 | 5736 | 5747 | 5752 |
| 5776 | 5778 | 5942 | 5978 | 6052 | 6071 | 6151 | 6188 | 6228 | 6245 | 6327 | 6360 |
| 6392 | 6526 | 6530 | 6577 | 6691 | 6902 | 6905 | 6922 | 6987 | 7001 | 7049 | 7056 |
| 7079 | 7103 | 7122 | 7126 | 7141 | 7171 | 7173 | 7175 | 7189 | 7191 | 7229 | 7230 |
| 7235 | 7236 | 7265 | 7271 | 7275 | 7291 | 7296 | 7303 | 7305 | 7308 | 7328 | 7332 |
| 7333 | 7337 | 7345 | 7346 | 7347 | 7349 | 7364 | 7373 | 7407 | 7408 | 7413 | 7485 |
| 7518 | 7524 | 7538 | 7569 | 7570 | 7580 | 7585 | 7637 | 7680 | 7685 | 7687 | 7688 |
| 7699 | 7724 | 7743 | 7746 | 7749 | 7779 | 7790 | 7801 | 7802 | 7803 | 7814 | 7820 |
| 7830 | 7853 | 7861 | 7872 | 7876 | 7886 | 7888 | 7903 | 7914 | 7950 | 7953 | 7958 |
| 7966 | 7968 | 7971 | 7996 | 7997 | 7999 | 8013 | 8014 | 8015 | 8016 | 8023 | 8028 |
| 8038 | 8044 | 8046 | 8062 | 8069 | 8079 | 8080 | 8081 | 8086 | 8087 | 8102 | 8110 |
| 8111 | 8120 | 8134 | 8135 | 8136 | 8137 | 8161 | 8185 | 8197 | 8200 | 8201 | 8202 |
| 8210 | 8248 | 8276 | 8277 | 8279 | 8301 | 8302 | 8313 | 8327 | 8333 | 8339 | 8358 |
| 8362 | 8363 | 8403 | 8406 | 8418 | 8420 | 8436 | 8448 | 8453 | 8460 | 8461 | 8465 |
| 8480 | 8481 | 8497 | 8529 | 8558 | 8583 | 8584 | 8613 | 8623 | 8642 | 8644 | 8647 |

TABLE 9-continued

Herbicide Tolerance

| | | | | | | | | | | | |
|---|---|---|---|---|---|---|---|---|---|---|---|
| 8658 | 8660 | 8666 | 8670 | 8676 | 8681 | 8691 | 8692 | 8694 | 8696 | 8736 | 8737 |
| 8754 | 8758 | 8760 | 8761 | 8762 | 8763 | 8775 | 8776 | 8790 | 8818 | 8844 | 8852 |
| 8858 | 8868 | 8883 | 8887 | 8904 | 8920 | 8942 | 8948 | 8967 | 8970 | 8975 | 8976 |
| 8977 | 8978 | 8989 | 8993 | 8996 | 9011 | 9022 | 9045 | 9047 | 9052 | 9053 | 9054 |
| 9065 | 9098 | 9099 | 9105 | 9125 | 9127 | 9130 | 9137 | 9146 | 9152 | 9155 | 9180 |
| 9181 | 9183 | 9185 | 9192 | 9206 | 9212 | 9214 | 9215 | 9223 | 9224 | 9234 | 9252 |
| 9259 | 9261 | 9263 | 9273 | 9274 | 9288 | 9298 | 9302 | 9314 | 9317 | 9318 | 9319 |
| 9320 | 9322 | 9345 | 9351 | 9360 | 9361 | 9362 | 9363 | 9368 | 9379 | 9382 | 9388 |
| 9390 | 9391 | 9392 | 9393 | 9394 | 9421 | 9426 | 9441 | 9442 | 9446 | 9448 | 9449 |
| 9453 | 9463 | 9471 | 9474 | 9499 | 9504 | 9523 | 9538 | 9543 | 9548 | 9552 | 9555 |
| 9557 | 9567 | 9572 | 9580 | 9581 | 9585 | 9591 | 9599 | 9610 | 9628 | 9638 | 9642 |
| 9647 | 9649 | 9650 | 9655 | 9659 | 9677 | 9678 | 9688 | 9690 | 9691 | 9692 | 9694 |
| 9705 | 9712 | 9713 | 9719 | 9726 | 9727 | 9733 | 9745 | 9764 | 9768 | 9777 | 9778 |
| 9779 | 9780 | 9819 | 9835 | 9836 | 9837 | 9856 | 9864 | 9865 | 9880 | 9904 | 9930 |
| 9933 | 9937 | 9943 | 9957 | 9959 | 9971 | 9974 | 9985 | 9994 | 9995 | 10024 | 10029 |
| 10032 | 10033 | 10034 | 10051 | 10054 | 10078 | 10080 | 10083 | 10105 | 10117 | 10118 | 10119 |
| 10120 | 10121 | 10122 | 10139 | 10155 | 10162 | 10213 | 10215 | 10220 | 10221 | 10265 | 10276 |
| 10284 | 10290 | 10301 | 10313 | 10323 | 10335 | 10339 | 10340 | 10344 | 10358 | 10374 | 10378 |
| 10392 | 10393 | 10394 | 10401 | 10407 | 10408 | 10416 | 10419 | 10441 | 10449 | 10471 | 10476 |
| 10491 | 10495 | 10508 | 10511 | 10523 | 10524 | 10525 | 10535 | 10606 | 10609 | 10639 | 10647 |
| 10675 | 10678 | 10680 | 10729 | 10768 | 10779 | 10780 | 10788 | 10790 | 10791 | 10796 | 10801 |
| 10833 | 10834 | 10835 | 10838 | 10840 | 10853 | 10865 | 10868 | 10877 | 10884 | 10885 | 10896 |
| 10903 | 10936 | 10945 | 10955 | 10958 | 10967 | 10970 | 10971 | 10980 | 10988 | 10989 | 10991 |
| 11019 | 11029 | 11030 | 11059 | 11077 | 11078 | 11086 | 11094 | 11101 | 11102 | 11116 | 11144 |
| 11151 | 11155 | 11168 | 11172 | 11173 | 11179 | 11196 | 11198 | 11209 | 11210 | 11216 | 11238 |
| 11241 | 11250 | 11254 | 11255 | 11257 | 11261 | 11262 | 11267 | 11268 | 11269 | 11270 | 11271 |
| 11272 | 11297 | 11305 | 11306 | 11310 | 11311 | 11329 | 11353 | 11367 | 11386 | 11405 | 11421 |
| 11431 | 11438 | 11439 | 11440 | 11441 | 11444 | 11460 | 11461 | 11463 | 11464 | 11469 | 11476 |
| 11508 | 11515 | 11529 | 11533 | 11534 | 11569 | 11571 | 11576 | 11604 | 11616 | 11618 | 11621 |
| 11627 | 11652 | 11656 | 11658 | 11662 | 11718 | 11733 | 11752 | 11762 | 11771 | 11777 | 11787 |
| 11792 | 11830 | 11831 | 11843 | 11852 | 11872 | 11873 | 11874 | 11875 | 11877 | 11883 | 11892 |
| 11911 | 11933 | 11937 | 11941 | 11954 | 11991 | 11994 | 12003 | 12050 | 12057 | 12058 | 12059 |
| 12060 | 12071 | 12072 | 12084 | 12100 | 12102 | 12105 | 12113 | 12115 | 12116 | 12147 | 12156 |
| 12160 | 12166 | 12175 | 12182 | 12183 | 12187 | 12189 | 12190 | 12194 | 12209 | 12210 | 12216 |
| 12220 | 12224 | 12243 | 12257 | 12259 | 12264 | 12289 | 12313 | 12335 | 12342 | 12367 | 12374 |
| 12398 | 12412 | 12425 | 12445 | 12456 | 12472 | 12475 | 12502 | 12510 | 12514 | 12519 | 12537 |
| 12544 | 12572 | 12579 | 12603 | 12621 | 12652 | 12673 | 12675 | 12692 | 12701 | 12735 | 12736 |
| 12757 | 12792 | 12811 | 12814 | 12829 | 12851 | 12891 | 12903 | 12944 | 13015 | 13017 | 13059 |
| 13068 | 13079 | 13104 | 13124 | 13196 | 13216 | 13266 | 13267 | 13278 | 13328 | 13346 | 13368 |
| 13397 | 13408 | 13437 | 13451 | 13484 | 13485 | 13494 | 13514 | 13519 | 13520 | 13521 | 13533 |
| 13565 | 13573 | 13582 | 13585 | 13587 | 13612 | 13613 | 13625 | 13651 | 13668 | 13669 | 13679 |
| 13724 | 13759 | 13760 | 13762 | 13765 | 13775 | 13782 | 13787 | 13788 | 13806 | 13813 | 13833 |
| 13834 | 13835 | 13838 | 13868 | 13869 | 13872 | 13883 | 13884 | 13923 | 13933 | 13934 |
| 13937 | 13941 | 13943 | 13948 | 13958 | 13961 | 13976 | 13977 | 13978 | 13983 | 13987 | 13988 |
| 13995 | 13997 | 14002 | 14006 | 14026 | 14046 | 14050 | 14060 | 14064 | 14065 | 14099 | 14100 |
| 14105 | 14118 | 14133 | 14146 | 14155 | 14171 | 14190 | 14203 | 14217 | 14244 | 14247 | 14272 |
| 14290 | 14292 | 14323 | 14324 | 14325 | 14326 | 14331 | 14334 | 14351 | 14367 | 14374 | 14378 |
| 14379 | 14395 | 14407 | 14409 | 14411 | 14414 | 14430 | 14434 | 14441 | 14442 | 14443 | 14477 |
| 14479 | 14489 | 14490 | 14491 | 14492 | 14495 | 14515 | 14523 | 14524 | 14544 | 14548 | 14553 |
| 14554 | 14557 | 14574 | 14595 | 14600 | 14602 | 14605 | 14609 | 14649 | 14668 | 14675 | 14677 |
| 14690 | 14699 | 14704 | 14726 | 14727 | 14729 | 14756 | 14763 | 14764 | 14776 | 14804 | 14813 |
| 14822 | 14850 | 14874 | 14875 | 14876 | 14877 | 14890 | 14902 | 14929 | 14951 | 14969 | 14981 |
| 14990 | 14991 | 14992 | 14995 | 14998 | 15000 | 15013 | 15032 | 15041 | 15090 | 15110 | 15112 |
| 15116 | 15123 | 15128 | 15134 | 15151 | 15153 | 15159 | 15173 | 15182 | 15187 | 15205 | 15207 |
| 15209 | 15235 | 15240 | 15244 | 15286 | 15290 | 15299 | 15315 | 15317 | 15318 | 15319 | 15320 |
| 15321 | 15323 | 15325 | 15349 | 15352 | 15356 | 15371 | 15383 | 15404 | 15408 | 15412 |
| 15413 | 15430 | 15454 | 15455 | 15464 | 15484 | 15500 | 15504 | 15505 | 15506 | 15533 | 15542 |
| 15573 | 15587 | 15589 | 15593 | 15596 | 15610 | 15624 | 15632 | 15633 | 15634 | 15643 | 15665 |
| 15681 | 15683 | 15684 | 15685 | 15686 | 15687 | 15689 | 15691 | 15716 | 15719 | 15723 | 15738 |
| 15751 | 15761 | 15772 | 15776 | 15780 | 15781 | 15798 | 15822 | 15823 | 15833 | 15855 | 15871 |
| 15876 | 15877 | 15878 | 15904 | 15913 | 15946 | 15963 | 15965 | 15969 | 15973 | 15986 | 15999 |
| 16007 | 16008 | 16009 | 16018 | 16055 | 16072 | 16074 | 16075 | 16076 | 16077 | 16078 | 17242 |
| 17245 | 17273 | 17295 | 17297 | 17321 | 17322 | 17347 | 17377 | 17381 | 17382 | 17383 | 17384 |
| 17385 | 17393 | 17395 | 17416 | 17438 | 17440 | 17441 | 17452 | 17457 | 17471 | 17474 | 17477 |
| 17485 | 17486 | 17520 | 17525 | 17532 | 17535 | 17573 | 17579 | 17581 | 17582 | 17583 | 17585 |
| 17591 | 17603 | 17608 | 17634 | 17636 | 17637 | 17638 | 17639 | 17642 | 17655 | 17656 | 17659 |
| 17671 | 17672 | 17673 | 17690 | 17703 | 17714 | 17727 | 17728 | 17730 | 17741 | 17742 | 17750 |
| 17752 | 17758 | 17767 | 17786 | 17787 | 17789 | 17791 | 17793 | 17794 | 17799 | 17800 | 17812 |
| 17814 | 17824 | 17836 | 17837 | 17838 | 17843 | 17851 | 17852 | 17855 | 17904 | 17911 | 17922 |
| 17965 | 17973 | 17975 | 17977 | 17992 | 18014 | 18018 | 18019 | 18039 | 18055 | 18056 | 18065 |
| 18066 | 18085 | 18095 | 18124 | 18135 | 18136 | 18161 | 18163 | 18166 | 18167 | 18202 | 18217 |
| 18220 | 18222 | 18238 | 18251 | 18252 | 18265 | 18266 | 18291 | 18299 | 18322 | 18327 | 18328 |
| 18329 | 18330 | 18340 | 18380 | 18385 | 18402 | 18408 | 18409 | 18410 | 18412 | 18419 | 18429 |
| 18456 | 18481 | 18482 | 18483 | 18485 | 18495 | 18508 | 18514 | 18519 | 18526 | 18558 | 18570 |
| 18596 | 18603 | 18607 | 18615 | 18616 | 18627 | 18635 | 18636 | 18637 | 18648 | 18679 | 18687 |
| 18692 | 18694 | 18695 | 18697 | 18714 | 18721 | 18722 | 18729 | 18734 | 18742 | 18746 | 18774 |
| 18790 | 18797 | 18798 | 18805 | 18810 | 18814 | 18816 | 18834 | 18836 | 18838 | 18841 | 18842 |

TABLE 9-continued

Herbicide Tolerance

| | | | | | | | | | | | |
|---|---|---|---|---|---|---|---|---|---|---|---|
| 18847 | 18857 | 18858 | 18862 | 18863 | 18866 | 18867 | 18868 | 18870 | 18873 | 18877 | 18880 |
| 18895 | 18900 | 18903 | 18909 | 18919 | 18934 | 18960 | 18969 | 18974 | 18976 | 18987 | 18991 |
| 19018 | 19029 | 19054 | 19061 | 19110 | 19119 | 19127 | 19147 | 19149 | 19160 | 19167 | 19168 |
| 19169 | 19175 | 19177 | 19200 | 19201 | 19215 | 19229 | 19232 | 19244 | 19272 | 19285 | 19294 |
| 19314 | 19327 | 19347 | 19350 | 19357 | 19371 | 19380 | 19423 | 19426 | 19427 | 19474 | 19481 |
| 19489 | 19506 | 19526 | 19536 | 19569 | 19593 | 19594 | 19606 | 19609 | 19610 | 19622 | 19634 |
| 19636 | 19639 | 19641 | 19649 | 19651 | 19657 | 19671 | 19672 | 19673 | 19674 | 19676 | 19678 |
| 19683 | 19685 | 19692 | 19694 | 19697 | 19699 | 19700 | 19711 | 19722 | 19731 | 19738 | 19746 |
| 19749 | 19764 | 19767 | 19778 | 19800 | 19813 | 19815 | 19816 | 19819 | 19824 | 19838 | 19850 |
| 19895 | 19896 | 19918 | 19924 | 19938 | 19950 | 19953 | 19967 | 19971 | 19994 | 20000 | 20002 |
| 20038 | 20055 | 20061 | 20075 | 20078 | 20113 | 20124 | 20130 | 20131 | 20137 | 20162 | 20164 |
| 20181 | 20204 | 20208 | 20210 | 20225 | 20226 | 20230 | 20231 | 20234 | 20238 | 20239 | 20252 |
| 20254 | 20278 | 20289 | 20292 | 20296 | 20305 | 20327 | 20328 | 20354 | 20360 | 20364 | 20368 |
| 20373 | 20384 | 20388 | 20403 | 20434 | 20435 | 20436 | 20437 | 20439 | 20442 | 20443 | 20445 |
| 20446 | 20447 | 20448 | 20472 | 20478 | 20479 | 20487 | 20524 | 20539 | 20549 | 20550 | 20564 |
| 20572 | 20582 | 20587 | 20613 | 20629 | 20630 | 20633 | 20634 | 20641 | 20644 | 20651 | 20658 |
| 20659 | 20675 | 20684 | 20694 | 20702 | 20727 | 20735 | 20737 | 20748 | 20749 | 20750 | 20751 |
| 20766 | 20767 | 20768 | 20790 | 20799 | 20803 | 20818 | 20847 | 20862 | 20864 | 20877 | 20879 |
| 20881 | 20891 | 20902 | 20914 | 20917 | 20930 | 20933 | 20934 | 20937 | 20952 | 20954 | 20958 |
| 20961 | 20964 | 20965 | 20966 | 20967 | 20969 | 20975 | 20978 | 20979 | 20984 | 20994 | 20995 |
| 20996 | 21001 | 21012 | 21017 | 21043 | 21045 | 21053 | 21065 | 21069 | 21078 | 21080 | 21081 |
| 21091 | 21092 | 21120 | 21126 | 21128 | 21134 | 21145 | 21148 | 21150 | 21152 | 21155 | 21159 |
| 21160 | 21184 | 21194 | 21198 | 21203 | 21215 | 21216 | 21217 | 21227 | 21228 | 21229 | 21234 |
| 21239 | 21255 | 21257 | 21258 | 21259 | 21261 | 21266 | 21270 | 21280 | 21290 | 21321 | 21329 |
| 21341 | 21342 | 21358 | 21361 | 21364 | 21365 | 21370 | 21383 | 21392 | 21393 | 21397 | 21401 |
| 21408 | 21410 | 21411 | 21413 | 21427 | 21431 | 21439 | 21445 | 21454 | 21466 | 21468 | 21473 |
| 21476 | 21480 | 21485 | 21488 | 21495 | 21496 | 21500 | 21503 | 21504 | 21508 | 21514 | 21515 |
| 21519 | 21531 | 21544 | 21567 | 21572 | 21573 | 21578 | 21592 | 21598 | 21601 | 21605 | 21610 |
| 21649 | 21650 | 21684 | 21685 | 21699 | 21703 | 21708 | 21724 | 21727 | 21739 | 21750 | 21755 |
| 21756 | 21773 | 21774 | 21799 | 21808 | 21811 | 21814 | 21829 | 21832 | 21836 | 21837 | 21838 |
| 21853 | 21884 | 21897 | 21922 | 21945 | 21959 | 21973 | 21991 | 22018 | 22091 | 22095 | |
| 22162 | 22223 | 22248 | 22275 | 22290 | 22334 | 22342 | 22345 | 22378 | 22382 | 22389 | 22410 |
| 22431 | 22442 | 22447 | 22518 | 22597 | 22602 | 22617 | 22626 | 22639 | 22659 | 22685 | 22738 |
| 22746 | 22761 | 22779 | 22780 | 22792 | 22817 | 22844 | 22849 | 22850 | 22851 | 22856 | 22857 |
| 22872 | 22873 | 22896 | 22903 | 22926 | 22937 | 22948 | 22955 | 22957 | 22958 | 22970 | |
| 22990 | 22995 | 23002 | 23005 | 23019 | 23033 | 23047 | 23051 | 23057 | 23058 | 23064 | 23073 |
| 23074 | 23079 | 23099 | 23125 | 23126 | 23135 | 23160 | 23165 | 23166 | 23171 | 23174 | 23175 |
| 23178 | 23213 | 23219 | 23220 | 23221 | 23222 | 23223 | 23237 | 23248 | 23255 | 23256 | 23258 |
| 23317 | 23319 | 23320 | 23328 | 23335 | 23346 | 23348 | 23358 | 23363 | 23367 | 23382 | 23383 |
| 23410 | 23413 | 23421 | 23424 | 23425 | 23429 | 23441 | 23459 | 23461 | 23467 | 23472 | 23478 |
| 23483 | 23486 | 23488 | 23491 | 23509 | 23512 | 23513 | 23560 | 23569 | 23571 | 23573 | 23575 |
| 23580 | 23600 | 23607 | 23621 | 23622 | 23623 | 23634 | 23643 | 23653 | 23670 | | |

| Table 9B SEQ ID NOs of Polynucleotides useful for improving Herbicide Tolerance | | | | | | | | | | | |
|---|---|---|---|---|---|---|---|---|---|---|---|
| 23690 | 23692 | 23697 | 23709 | 23710 | 23713 | 23717 | 23729 | 23744 | 23746 | 23756 | 23779 |
| 23783 | 23786 | 23800 | 23807 | 23808 | 23810 | 23812 | 23825 | 23832 | 23835 | 23836 | 23837 |
| 23845 | 23848 | 23852 | 23857 | 23883 | 23887 | 23890 | 23893 | 23910 | 23914 | 23920 | 23928 |
| 23929 | 23930 | 23933 | 23941 | 23946 | 23960 | 23979 | 23984 | 23989 | 24009 | 24010 | 24011 |
| 24013 | 24018 | 24023 | 24041 | 24045 | 24069 | 24071 | 24076 | 24084 | 24086 | 24087 | 24091 |
| 24093 | 24099 | 24109 | 24128 | 24132 | 24137 | 24138 | 24150 | 24169 | 24197 | 24198 | 24201 |
| 24219 | 24220 | 24223 | 24250 | 24254 | 24255 | 24256 | 24257 | 24260 | 24262 | 24263 | 24276 |
| 24281 | 24282 | 24316 | 24333 | 24341 | 24342 | 24346 | 24347 | 24348 | 24350 | 24356 | 24365 |
| 24367 | 24387 | 24390 | 24393 | 24401 | 24413 | 24415 | 24426 | 24430 | 24438 | 24445 | 24447 |
| 24448 | 24449 | 24457 | 24458 | 24462 | 24470 | 24488 | 24490 | 24491 | 24501 | 24513 | 24537 |
| 24541 | 24544 | 24567 | 24568 | 24569 | 24571 | 24585 | 24599 | 24603 | 24612 | 24617 | 24634 |
| 24649 | 24658 | 24679 | 24694 | 24717 | 24736 | 24738 | 24742 | 24745 | 24746 | 24753 | 24754 |
| 24758 | 24763 | 24765 | 24767 | 24789 | 24791 | 24795 | 24800 | 24805 | 24806 | 24807 | 24815 |
| 24818 | 24825 | 24826 | 24831 | 24834 | 24836 | 24843 | 24846 | 24849 | 24850 | 24851 | 24852 |
| 24866 | 24868 | 24883 | 24885 | 24893 | 24897 | 24905 | 24908 | 24919 | 24926 | 24947 | 24948 |
| 24975 | 24981 | 24985 | 24989 | 24995 | 25006 | 25010 | 25027 | 25097 | 25130 | 25131 | 25152 |
| 25188 | 25198 | 25200 | 25235 | 25269 | 25297 | 25301 | 25303 | 25304 | 25309 | 25322 | 25332 |
| 25346 | 25351 | 25388 | 25394 | 25414 | 25430 | 25444 | 25470 | 25519 | 25556 | 25633 | 25634 |
| 25692 | 25728 | 25735 | 25750 | 25751 | 25785 | 25862 | 25914 | 25924 | 25934 | 25992 | 26021 |
| 26023 | 26104 | 26122 | 26148 | 26171 | 26183 | 26267 | 26303 | 26307 | 26315 | 26317 | 26324 |
| 26328 | 26330 | 26337 | 26339 | 26361 | 26364 | 26368 | 26388 | 26391 | 26399 | 26408 | 26416 |
| 26442 | 26445 | 26451 | 26471 | 26476 | 26480 | 26481 | 26483 | 26489 | 26491 | 26499 | 26506 |
| 26508 | 26509 | 26514 | 26522 | 26524 | 26525 | 26536 | 26538 | 26559 | 26570 | 26578 | 26618 |
| 26620 | 26676 | 26678 | 26679 | 26680 | 26700 | 26709 | 26736 | 26750 | 26756 | 26758 | 26763 |
| 26785 | 26793 | 26798 | 26827 | 26830 | 26844 | 26854 | 26886 | 26887 | 26901 | 26905 | 26931 |
| 26937 | 26947 | 27050 | 27070 | 27077 | 27084 | 27142 | 27153 | 27161 | 27211 | 27243 | 27265 |
| 27266 | 27386 | 27389 | 27392 | 27395 | 27469 | 27501 | 27537 | 27592 | 27593 | 27603 | 27657 |
| 27659 | 27766 | 27767 | 27800 | 27820 | 27840 | 27859 | 27865 | 27866 | 27868 | 27883 | 27901 |
| 27917 | 27919 | 27932 | 27934 | 27951 | 27960 | 27961 | 27980 | 27987 | 28010 | 28035 | 28055 |
| 28059 | 28073 | 28102 | 28104 | 28106 | 28118 | 28120 | 28156 | 28157 | 28163 | 28164 | 28194 |
| 28200 | 28203 | 28220 | 28225 | 28232 | 28234 | 28238 | 28258 | 28262 | 28263 | 28267 | 28275 |
| 28276 | 28277 | 28279 | 28294 | 28303 | 28336 | 28337 | 28342 | 28413 | 28415 | 28446 | 28451 |

TABLE 9-continued

Herbicide Tolerance

| | | | | | | | | | | | |
|---|---|---|---|---|---|---|---|---|---|---|---|
| 28465 | 28497 | 28498 | 28508 | 28513 | 28565 | 28609 | 28614 | 28616 | 28617 | 28628 | 28653 |
| 28724 | 28898 | 29132 | 29141 | 29188 | 29275 | 29315 | 29337 | 29363 | 29423 | 29434 | 29439 |
| 29463 | 29465 | 29629 | 29665 | 29739 | 29758 | 29838 | 29875 | 29915 | 29932 | 30014 | 30047 |
| 30079 | 30213 | 30217 | 30264 | 30378 | 30589 | 30592 | 30609 | 30674 | 30688 | 30736 | 30743 |
| 30766 | 30790 | 30809 | 30813 | 30828 | 30858 | 30860 | 30862 | 30876 | 30878 | 30916 | 30917 |
| 30922 | 30923 | 30952 | 30958 | 30962 | 30978 | 30983 | 30990 | 30992 | 30995 | 31015 | 31019 |
| 31020 | 31024 | 31032 | 31033 | 31034 | 31036 | 31051 | 31060 | 31094 | 31095 | 31100 | 31172 |
| 31205 | 31211 | 31225 | 31256 | 31257 | 31267 | 31272 | 31324 | 31367 | 31372 | 31374 | 31375 |
| 31386 | 31411 | 31430 | 31433 | 31436 | 31466 | 31477 | 31488 | 31489 | 31490 | 31501 | 31507 |
| 31517 | 31540 | 31548 | 31559 | 31563 | 31573 | 31575 | 31590 | 31601 | 31637 | 31640 | 31645 |
| 31653 | 31655 | 31658 | 31683 | 31684 | 31686 | 31700 | 31701 | 31702 | 31703 | 31710 | 31715 |
| 31725 | 31731 | 31733 | 31749 | 31756 | 31766 | 31767 | 31768 | 31773 | 31774 | 31789 | 31797 |
| 31798 | 31807 | 31821 | 31822 | 31823 | 31824 | 31848 | 31872 | 31884 | 31887 | 31888 | 31889 |
| 31897 | 31935 | 31963 | 31964 | 31966 | 31988 | 31989 | 32000 | 32014 | 32020 | 32026 | 32045 |
| 32049 | 32050 | 32090 | 32093 | 32105 | 32107 | 32123 | 32135 | 32140 | 32147 | 32148 | 32152 |
| 32167 | 32168 | 32184 | 32216 | 32245 | 32270 | 32271 | 32300 | 32310 | 32329 | 32331 | 32334 |
| 32345 | 32347 | 32353 | 32357 | 32363 | 32368 | 32378 | 32379 | 32381 | 32383 | 32423 | 32424 |
| 32441 | 32445 | 32447 | 32448 | 32449 | 32450 | 32462 | 32463 | 32477 | 32505 | 32531 | 32539 |
| 32545 | 32555 | 32570 | 32574 | 32591 | 32607 | 32629 | 32635 | 32654 | 32657 | 32662 | 32663 |
| 32664 | 32665 | 32676 | 32680 | 32683 | 32698 | 32709 | 32732 | 32734 | 32739 | 32740 | 32741 |
| 32752 | 32785 | 32786 | 32792 | 32812 | 32814 | 32817 | 32824 | 32833 | 32839 | 32842 | 32867 |
| 32868 | 32870 | 32872 | 32879 | 32883 | 32899 | 32901 | 32902 | 32910 | 32911 | 32921 | 32939 |
| 32946 | 32948 | 32950 | 32960 | 32961 | 32975 | 32985 | 32989 | 33001 | 33004 | 33005 | 33006 |
| 33007 | 33009 | 33032 | 33038 | 33047 | 33048 | 33049 | 33050 | 33055 | 33066 | 33069 | 33075 |
| 33077 | 33078 | 33079 | 33080 | 33081 | 33108 | 33113 | 33128 | 33129 | 33133 | 33135 | 33136 |
| 33140 | 33150 | 33158 | 33161 | 33186 | 33191 | 33210 | 33225 | 33230 | 33235 | 33239 | 33242 |
| 33244 | 33254 | 33259 | 33267 | 33268 | 33272 | 33278 | 33286 | 33297 | 33315 | 33325 | 33329 |
| 33334 | 33336 | 33337 | 33342 | 33346 | 33364 | 33365 | 33375 | 33377 | 33378 | 33379 | 33381 |
| 33392 | 33399 | 33400 | 33406 | 33413 | 33414 | 33420 | 33432 | 33451 | 33455 | 33464 | 33465 |
| 33466 | 33467 | 33506 | 33522 | 33523 | 33524 | 33543 | 33551 | 33552 | 33567 | 33591 | 33617 |
| 33620 | 33624 | 33630 | 33644 | 33646 | 33658 | 33661 | 33672 | 33681 | 33682 | 33711 | 33716 |
| 33719 | 33720 | 33721 | 33738 | 33741 | 33765 | 33767 | 33770 | 33792 | 33804 | 33805 | 33806 |
| 33807 | 33808 | 33809 | 33826 | 33842 | 33849 | 33900 | 33902 | 33907 | 33908 | 33952 | 33963 |
| 33971 | 33977 | 33988 | 34000 | 34010 | 34022 | 34026 | 34027 | 34031 | 34045 | 34061 | 34065 |
| 34079 | 34080 | 34081 | 34088 | 34094 | 34095 | 34103 | 34106 | 34128 | 34136 | 34158 | 34163 |
| 34178 | 34182 | 34195 | 34198 | 34210 | 34211 | 34212 | 34222 | 34293 | 34296 | 34326 | 34334 |
| 34362 | 34365 | 34367 | 34416 | 34455 | 34466 | 34467 | 34475 | 34477 | 34478 | 34483 | 34488 |
| 34520 | 34521 | 34522 | 34525 | 34527 | 34540 | 34552 | 34555 | 34564 | 34571 | 34572 | 34583 |
| 34590 | 34623 | 34632 | 34642 | 34645 | 34654 | 34657 | 34658 | 34674 | 34675 | 34676 | 34678 |
| 34706 | 34716 | 34717 | 34746 | 34764 | 34765 | 34773 | 34781 | 34788 | 34789 | 34803 | 34831 |
| 34838 | 34842 | 34855 | 34859 | 34860 | 34866 | 34883 | 34885 | 34896 | 34897 | 34903 | 34925 |
| 34928 | 34937 | 34941 | 34942 | 34944 | 34948 | 34949 | 34954 | 34955 | 34956 | 34957 | 34958 |
| 34959 | 34984 | 34992 | 34993 | 34997 | 34998 | 35016 | 35040 | 35054 | 35073 | 35092 | 35108 |
| 35118 | 35125 | 35126 | 35127 | 35128 | 35131 | 35147 | 35148 | 35150 | 35151 | 35156 | 35163 |
| 35195 | 35202 | 35216 | 35220 | 35221 | 35256 | 35258 | 35263 | 35291 | 35303 | 35305 | 35308 |
| 35314 | 35339 | 35343 | 35345 | 35349 | 35405 | 35420 | 35439 | 35449 | 35458 | 35464 | 35474 |
| 35479 | 35517 | 35518 | 35530 | 35539 | 35559 | 35560 | 35561 | 35562 | 35564 | 35570 | 35579 |
| 35598 | 35620 | 35624 | 35628 | 35641 | 35678 | 35681 | 35690 | 35737 | 35744 | 35745 | 35746 |
| 35747 | 35758 | 35759 | 35771 | 35787 | 35789 | 35792 | 35800 | 35802 | 35803 | 35834 | 35843 |
| 35847 | 35853 | 35862 | 35869 | 35870 | 35874 | 35876 | 35877 | 35881 | 35896 | 35897 | 35903 |
| 35907 | 35911 | 35930 | 35944 | 35946 | 35951 | 35976 | 36000 | 36022 | 36029 | 36054 | 36061 |
| 36085 | 36099 | 36112 | 36132 | 36143 | 36159 | 36162 | 36189 | 36197 | 36201 | 36206 | 36224 |
| 36231 | 36259 | 36266 | 36290 | 36308 | 36339 | 36360 | 36362 | 36379 | 36388 | 36422 | 36423 |
| 36444 | 36479 | 36498 | 36501 | 36516 | 36538 | 36578 | 36590 | 36631 | 36702 | 36704 | 36746 |
| 36755 | 36766 | 36791 | 36811 | 36883 | 36903 | 36953 | 36954 | 36965 | 37015 | 37033 | 37055 |
| 37084 | 37095 | 37124 | 37138 | 37171 | 37172 | 37181 | 37206 | 37207 | 37208 | 37220 |
| 37252 | 37260 | 37269 | 37272 | 37274 | 37299 | 37300 | 37312 | 37338 | 37355 | 37356 | 37366 |
| 37411 | 37446 | 37447 | 37449 | 37452 | 37462 | 37469 | 37474 | 37475 | 37493 | 37500 | 37520 |
| 37521 | 37522 | 37525 | 37555 | 37556 | 37559 | 37570 | 37571 | 37605 | 37610 | 37620 | 37621 |
| 37624 | 37628 | 37630 | 37635 | 37645 | 37648 | 37663 | 37664 | 37665 | 37670 | 37674 | 37675 |
| 37682 | 37684 | 37689 | 37693 | 37713 | 37733 | 37737 | 37747 | 37751 | 37752 | 37786 | 37787 |
| 37792 | 37805 | 37820 | 37833 | 37842 | 37858 | 37877 | 37890 | 37904 | 37931 | 37934 | 37959 |
| 37977 | 37979 | 38010 | 38011 | 38012 | 38013 | 38018 | 38021 | 38038 | 38054 | 38061 | 38065 |
| 38066 | 38082 | 38094 | 38096 | 38098 | 38101 | 38117 | 38121 | 38128 | 38129 | 38130 | 38164 |
| 38166 | 38176 | 38177 | 38178 | 38179 | 38182 | 38202 | 38210 | 38211 | 38231 | 38235 | 38240 |
| 38241 | 38244 | 38261 | 38282 | 38287 | 38289 | 38292 | 38296 | 38336 | 38355 | 38362 | 38364 |
| 38377 | 38386 | 38391 | 38413 | 38414 | 38416 | 38443 | 38450 | 38451 | 38463 | 38491 | 38500 |
| 38509 | 38537 | 38561 | 38562 | 38563 | 38564 | 38574 | 38589 | 38638 | 38656 | 38668 |
| 38677 | 38678 | 38679 | 38682 | 38685 | 38687 | 38700 | 38719 | 38728 | 38777 | 38797 | 38799 |
| 38803 | 38810 | 38815 | 38821 | 38838 | 38840 | 38846 | 38860 | 38869 | 38874 | 38892 | 38894 |
| 38896 | 38922 | 38927 | 38931 | 38973 | 38977 | 38986 | 39002 | 39004 | 39005 | 39006 | 39007 |
| 39008 | 39010 | 39012 | 39036 | 39039 | 39043 | 39058 | 39070 | 39080 | 39091 | 39095 | 39099 |
| 39100 | 39117 | 39141 | 39142 | 39151 | 39171 | 39187 | 39191 | 39192 | 39193 | 39220 | 39229 |
| 39260 | 39274 | 39276 | 39280 | 39283 | 39297 | 39311 | 39319 | 39320 | 39321 | 39330 | 39352 |
| 39368 | 39370 | 39371 | 39372 | 39373 | 39374 | 39376 | 39378 | 39403 | 39406 | 39410 | 39425 |
| 39438 | 39448 | 39459 | 39463 | 39467 | 39468 | 39485 | 39509 | 39510 | 39520 | 39542 | 39558 |
| 39563 | 39564 | 39565 | 39591 | 39600 | 39633 | 39650 | 39652 | 39656 | 39660 | 39673 | 39686 |

TABLE 9-continued

Herbicide Tolerance

| | | | | | | | | | | | |
|---|---|---|---|---|---|---|---|---|---|---|---|
| 39694 | 39695 | 39696 | 39705 | 39742 | 39759 | 39761 | 39762 | 39763 | 39764 | 39765 | 40929 |
| 40932 | 40960 | 40982 | 40984 | 41008 | 41009 | 41034 | 41064 | 41068 | 41069 | 41070 | 41071 |
| 41072 | 41080 | 41082 | 41103 | 41125 | 41127 | 41128 | 41139 | 41144 | 41158 | 41161 | 41164 |
| 41172 | 41173 | 41207 | 41212 | 41219 | 41222 | 41260 | 41266 | 41268 | 41269 | 41270 | 41272 |
| 41278 | 41290 | 41295 | 41321 | 41323 | 41324 | 41325 | 41326 | 41329 | 41342 | 41343 | 41346 |
| 41358 | 41359 | 41360 | 41377 | 41390 | 41401 | 41414 | 41415 | 41417 | 41428 | 41429 | 41437 |
| 41439 | 41445 | 41454 | 41473 | 41474 | 41476 | 41478 | 41480 | 41481 | 41486 | 41487 | 41499 |
| 41501 | 41511 | 41523 | 41524 | 41525 | 41530 | 41538 | 41539 | 41542 | 41591 | 41598 | 41609 |
| 41652 | 41660 | 41662 | 41664 | 41679 | 41701 | 41705 | 41706 | 41726 | 41742 | 41743 | 41752 |
| 41753 | 41772 | 41782 | 41811 | 41822 | 41823 | 41848 | 41850 | 41853 | 41854 | 41889 | 41904 |
| 41907 | 41909 | 41925 | 41938 | 41939 | 41952 | 41953 | 41978 | 41986 | 42009 | 42014 | 42015 |
| 42016 | 42017 | 42027 | 42067 | 42072 | 42089 | 42095 | 42096 | 42097 | 42099 | 42106 | 42116 |
| 42143 | 42168 | 42169 | 42170 | 42172 | 42182 | 42195 | 42201 | 42206 | 42213 | 42245 | 42257 |
| 42283 | 42290 | 42294 | 42302 | 42303 | 42314 | 42322 | 42323 | 42335 | 42366 | 42374 | |
| 42379 | 42381 | 42382 | 42384 | 42401 | 42408 | 42409 | 42416 | 42421 | 42429 | 42433 | 42461 |
| 42477 | 42484 | 42485 | 42492 | 42497 | 42501 | 42503 | 42521 | 42523 | 42525 | 42528 | 42529 |
| 42534 | 42544 | 42545 | 42549 | 42550 | 42553 | 42554 | 42555 | 42557 | 42560 | 42564 | 42567 |
| 42582 | 42587 | 42590 | 42596 | 42606 | 42621 | 42647 | 42656 | 42661 | 42663 | 42674 | 42678 |
| 42705 | 42716 | 42741 | 42748 | 42797 | 42806 | 42814 | 42834 | 42836 | 42847 | 42854 | 42855 |
| 42856 | 42862 | 42864 | 42887 | 42888 | 42902 | 42916 | 42919 | 42931 | 42959 | 42972 | 42981 |
| 43001 | 43014 | 43034 | 43037 | 43044 | 43058 | 43067 | 43110 | 43113 | 43114 | 43161 | 43168 |
| 43176 | 43193 | 43213 | 43223 | 43256 | 43280 | 43281 | 43293 | 43296 | 43297 | 43309 | 43321 |
| 43323 | 43326 | 43328 | 43336 | 43338 | 43344 | 43358 | 43359 | 43360 | 43361 | 43363 | 43365 |
| 43370 | 43372 | 43379 | 43381 | 43384 | 43386 | 43387 | 43398 | 43409 | 43418 | 43425 | 43433 |
| 43436 | 43451 | 43454 | 43465 | 43487 | 43500 | 43502 | 43503 | 43506 | 43511 | 43525 | 43537 |
| 43582 | 43583 | 43605 | 43611 | 43625 | 43637 | 43640 | 43654 | 43681 | 43687 | 43689 | |
| 43725 | 43742 | 43748 | 43762 | 43765 | 43800 | 43811 | 43817 | 43818 | 43824 | 43849 | 43851 |
| 43868 | 43891 | 43895 | 43897 | 43912 | 43913 | 43917 | 43918 | 43921 | 43925 | 43926 | 43939 |
| 43941 | 43965 | 43976 | 43979 | 43983 | 43992 | 44014 | 44015 | 44041 | 44047 | 44051 | 44055 |
| 44060 | 44071 | 44075 | 44090 | 44121 | 44122 | 44123 | 44124 | 44126 | 44129 | 44130 | 44132 |
| 44133 | 44134 | 44135 | 44159 | 44165 | 44166 | 44174 | 44211 | 44226 | 44236 | 44237 | 44251 |
| 44259 | 44269 | 44274 | 44300 | 44316 | 44317 | 44320 | 44321 | 44328 | 44331 | 44338 | 44345 |
| 44346 | 44362 | 44371 | 44381 | 44389 | 44414 | 44422 | 44424 | 44435 | 44436 | 44437 | 44438 |
| 44453 | 44454 | 44455 | 44477 | 44486 | 44490 | 44505 | 44534 | 44549 | 44551 | 44564 | 44566 |
| 44568 | 44578 | 44589 | 44601 | 44604 | 44617 | 44620 | 44624 | 44639 | 44641 | 44645 | |
| 44648 | 44651 | 44652 | 44653 | 44654 | 44656 | 44662 | 44665 | 44666 | 44671 | 44681 | 44682 |
| 44683 | 44688 | 44699 | 44704 | 44730 | 44732 | 44740 | 44752 | 44756 | 44765 | 44767 | 44768 |
| 44778 | 44779 | 44807 | 44813 | 44815 | 44821 | 44832 | 44835 | 44837 | 44839 | 44842 | 44846 |
| 44847 | 44871 | 44881 | 44885 | 44890 | 44902 | 44903 | 44914 | 44915 | 44916 | 44921 | |
| 44926 | 44942 | 44944 | 44945 | 44946 | 44948 | 44953 | 44957 | 44967 | 44977 | 45008 | 45016 |
| 45028 | 45029 | 45045 | 45048 | 45051 | 45052 | 45057 | 45070 | 45079 | 45080 | 45084 | 45088 |
| 45095 | 45097 | 45098 | 45100 | 45114 | 45118 | 45126 | 45132 | 45141 | 45153 | 45155 | 45160 |
| 45163 | 45167 | 45172 | 45175 | 45182 | 45183 | 45187 | 45190 | 45191 | 45195 | 45201 | 45202 |
| 45206 | 45218 | 45231 | 45254 | 45259 | 45260 | 45265 | 45279 | 45285 | 45288 | 45292 | 45297 |
| 45336 | 45337 | 45371 | 45372 | 45386 | 45390 | 45395 | 45411 | 45414 | 45426 | 45437 | 45442 |
| 45443 | 45460 | 45461 | 45486 | 45495 | 45498 | 45501 | 45516 | 45519 | 45523 | 45524 | 45525 |
| 45540 | 45571 | 45584 | 45609 | 45632 | 45646 | 45660 | 45678 | 45686 | 45705 | 45778 | 45782 |
| 45849 | 45910 | 45935 | 45962 | 45977 | 46021 | 46029 | 46032 | 46065 | 46069 | 46076 | 46097 |
| 46118 | 46129 | 46134 | 46205 | 46284 | 46289 | 46304 | 46313 | 46326 | 46346 | 46372 | 46425 |
| 46433 | 46448 | 46466 | 46467 | 46479 | 46504 | 46531 | 46536 | 46537 | 46538 | 46543 | 46544 |
| 46559 | 46560 | 46583 | 46590 | 46613 | 46624 | 46635 | 46642 | 46643 | 46644 | 46645 | 46657 |
| 46677 | 46682 | 46689 | 46692 | 46706 | 46720 | 46734 | 46738 | 46744 | 46745 | 46751 | 46760 |
| 46761 | 46766 | 46786 | 46812 | 46813 | 46822 | 46847 | 46852 | 46853 | 46858 | 46861 | 46862 |
| 46865 | 46900 | 46906 | 46907 | 46908 | 46909 | 46910 | 46924 | 46935 | 46942 | 46943 | 46945 |
| 47004 | 47006 | 47007 | 47015 | 47022 | 47033 | 47035 | 47045 | 47050 | 47054 | 47069 | 47070 |
| 47097 | 47100 | 47108 | 47111 | 47112 | 47116 | 47128 | 47146 | 47148 | 47154 | 47159 | 47165 |
| 47170 | 47173 | 47175 | 47178 | 47196 | 47199 | 47200 | 47247 | 47256 | 47258 | 47260 | 47262 |
| 47267 | 47287 | 47294 | 47308 | 47309 | 47310 | 47321 | 47330 | 47340 | 47357 | | |

TABLE 10A

Homologous Recombination

Table 10A SEQ ID NOs of Polypeptides useful for improving Homologous Recombination

| | | | | | | | | | | | |
|---|---|---|---|---|---|---|---|---|---|---|---|
| 11 | 25 | 43 | 45 | 58 | 70 | 75 | 105 | 109 | 116 | 179 | 219 |
| 236 | 263 | 269 | 270 | 271 | 272 | 286 | 346 | 431 | 453 | 468 | 517 |
| 524 | 525 | 539 | 615 | 624 | 652 | 665 | 697 | 774 | 786 | 797 | 817 |
| 858 | 860 | 903 | 904 | 911 | 917 | 932 | 939 | 955 | 958 | 959 | 961 |
| 966 | 967 | 1009 | 1016 | 1024 | 1048 | 1061 | 1075 | 1083 | 1084 | 1095 | 1096 |
| 1115 | 1121 | 1141 | 1143 | 1151 | 1154 | 1184 | 1195 | 1197 | 1213 | 1219 | 1223 |
| 1227 | 1237 | 1238 | 1247 | 1248 | 1251 | 1253 | 1254 | 1271 | 1289 | 1301 | 1314 |
| 1317 | 1320 | 1330 | 1333 | 1338 | 1343 | 1347 | 1365 | 1366 | 1372 | 1373 | 1385 |
| 1391 | 1392 | 1395 | 1405 | 1407 | 1413 | 1414 | 1416 | 1420 | 1422 | 1424 | 1432 |

TABLE 10A-continued

| Homologous Recombination | | | | | | | | | | | |
|---|---|---|---|---|---|---|---|---|---|---|---|
| 1436 | 1442 | 1447 | 1448 | 1452 | 1456 | 1457 | 1458 | 1459 | 1462 | 1466 | 1467 |
| 1468 | 1475 | 1477 | 1482 | 1483 | 1485 | 1487 | 1502 | 1509 | 1512 | 1514 | 1516 |
| 1517 | 1523 | 1528 | 1530 | 1534 | 1536 | 1537 | 1545 | 1546 | 1547 | 1551 | 1552 |
| 1557 | 1558 | 1561 | 1562 | 1567 | 1568 | 1569 | 1571 | 1576 | 1577 | 1581 | 1585 |
| 1586 | 1587 | 1591 | 1594 | 1595 | 1602 | 1620 | 1621 | 1625 | 1627 | 1629 | 1633 |
| 1638 | 1640 | 1644 | 1646 | 1647 | 1648 | 1652 | 1656 | 1657 | 1658 | 1666 | 1671 |
| 1672 | 1676 | 1677 | 1678 | 1682 | 1687 | 1691 | 1693 | 1700 | 1708 | 1709 | 1714 |
| 1715 | 1723 | 1729 | 1738 | 1748 | 1752 | 1755 | 1758 | 1761 | 1763 | 1766 | 1767 |
| 1768 | 1771 | 1773 | 1777 | 1779 | 1782 | 1786 | 1787 | 1788 | 1790 | 1791 | 1793 |
| 1794 | 1799 | 1800 | 1804 | 1807 | 1808 | 1809 | 1810 | 1811 | 1822 | 1825 | 1827 |
| 1840 | 1843 | 1845 | 1848 | 1852 | 1853 | 1854 | 1855 | 1858 | 1860 | 1861 | 1863 |
| 1864 | 1870 | 1871 | 1873 | 1875 | 1881 | 1886 | 1888 | 1889 | 1891 | 1900 | 1901 |
| 1908 | 1911 | 1913 | 1914 | 1915 | 1916 | 1919 | 1925 | 1934 | 1937 | 1939 | 1940 |
| 1941 | 1943 | 1945 | 1948 | 1950 | 1954 | 1957 | 1959 | 1961 | 1963 | 1965 | 1967 |
| 1968 | 1972 | 1976 | 1978 | 1979 | 1980 | 1981 | 1982 | 1985 | 1990 | 1991 | 1996 |
| 2001 | 2011 | 2012 | 2015 | 2016 | 2018 | 2020 | 2021 | 2022 | 2035 | 2036 | 2038 |
| 2039 | 2046 | 2049 | 2052 | 2054 | 2055 | 2056 | 2060 | 2061 | 2075 | 2081 | 2088 |
| 2089 | 2090 | 2092 | 2093 | 2094 | 2097 | 2100 | 2101 | 2103 | 2105 | 2106 | 2107 |
| 2108 | 2113 | 2114 | 2125 | 2128 | 2131 | 2132 | 2135 | 2136 | 2138 | 2141 | 2142 |
| 2145 | 2146 | 2149 | 2153 | 2157 | 2161 | 2163 | 2170 | 2172 | 2173 | 2178 | 2179 |
| 2180 | 2183 | 2185 | 2187 | 2188 | 2189 | 2190 | 2193 | 2196 | 2197 | 2203 | 2213 |
| 2215 | 2219 | 2221 | 2222 | 2224 | 2234 | 2236 | 2240 | 2242 | 2248 | 2253 | 2254 |
| 2256 | 2259 | 2261 | 2266 | 2271 | 2274 | 2275 | 2281 | 2286 | 2287 | 2288 | 2290 |
| 2295 | 2296 | 2298 | 2302 | 2307 | 2309 | 2312 | 2317 | 2318 | 2323 | 2324 | 2326 |
| 2329 | 2332 | 2344 | 2348 | 2353 | 2360 | 2361 | 2370 | 2371 | 2372 | 2376 | 2377 |
| 2379 | 2380 | 2385 | 2386 | 2389 | 2395 | 2396 | 2399 | 2401 | 2405 | 2412 | 2416 |
| 2419 | 2420 | 2434 | 2436 | 2437 | 2443 | 2449 | 2454 | 2456 | 2459 | 2460 | 2462 |
| 2464 | 2465 | 2467 | 2471 | 2477 | 2480 | 2483 | 2493 | 2498 | 2501 | 2505 | 2509 |
| 2516 | 2519 | 2520 | 2525 | 2532 | 2535 | 2539 | 2540 | 2541 | 2542 | 2543 | 2545 |
| 2548 | 2552 | 2555 | 2558 | 2561 | 2572 | 2573 | 2574 | 2577 | 2579 | 2581 | 2583 |
| 2585 | 2587 | 2594 | 2595 | 2671 | 2673 | 2686 | 2697 | 2709 | 2713 | 2746 | 2763 |
| 2772 | 2882 | 2886 | 2895 | 2911 | 2962 | 3001 | 3006 | 3011 | 3018 | 3053 | 3081 |
| 3084 | 3099 | 3101 | 3112 | 3114 | 3117 | 3123 | 3141 | 3146 | 3149 | 3164 | 3170 |
| 3183 | 3184 | 3192 | 3204 | 3207 | 3212 | 3213 | 3215 | 3222 | 3223 | 3238 | 3242 |
| 3243 | 3255 | 3258 | 3261 | 3265 | 3268 | 3272 | 3275 | 3287 | 3296 | 3297 | 3303 |
| 3314 | 3317 | 3319 | 3329 | 3336 | 3341 | 3342 | 3345 | 3349 | 3365 | 3366 | 3367 |
| 3369 | 3370 | 3374 | 3375 | 3400 | 3402 | 3403 | 3405 | 3408 | 3412 | 3413 | 3427 |
| 3432 | 3434 | 3438 | 3439 | 3443 | 3447 | 3448 | 3459 | 3464 | 3467 | 3472 | 3477 |
| 3487 | 3488 | 3491 | 3492 | 3497 | 3499 | 3502 | 3503 | 3509 | 3510 | 3525 | 3526 |
| 3536 | 3537 | 3539 | 3542 | 3546 | 3550 | 3552 | 3564 | 3567 | 3569 | 3572 | 3574 |
| 3577 | 3582 | 3584 | 3586 | 3593 | 3594 | 3598 | 3602 | 3604 | 3606 | 3613 | 3614 |
| 3622 | 3631 | 3633 | 3645 | 3651 | 3655 | 3664 | 3668 | 3672 | 3691 | 3693 | 3706 |
| 3712 | 3716 | 3718 | 3719 | 3720 | 3721 | 3735 | 3738 | 3741 | 3743 | 3750 | 3754 |
| 3755 | 3756 | 3763 | 3767 | 3775 | 3779 | 3789 | 3790 | 3791 | 3795 | 3796 | 3797 |
| 3801 | 3807 | 3813 | 3823 | 3826 | 3832 | 3841 | 3845 | 3847 | 3849 | 3851 | 3858 |
| 3861 | 3862 | 3863 | 3873 | 3874 | 3877 | 3878 | 3882 | 3883 | 3892 | 3897 | 3898 |
| 3910 | 3914 | 3917 | 3918 | 3923 | 3935 | 3942 | 3947 | 3949 | 3950 | 3952 | 3952 |
| 3953 | 3961 | 3962 | 3971 | 3980 | 3983 | 3988 | 3992 | 4007 | 4008 | 4010 | 4021 |
| 4023 | 4027 | 4028 | 4036 | 4037 | 4042 | 4050 | 4056 | 4057 | 4058 | 4063 | 4067 |
| 4069 | 4071 | 4072 | 4078 | 4088 | 4090 | 4091 | 4092 | 4099 | 4105 | 4109 | 4112 |
| 4119 | 4120 | 4122 | 4127 | 4132 | 4135 | 4138 | 4139 | 4141 | 4145 | 4147 | 4151 |
| 4155 | 4160 | 4170 | 4171 | 4174 | 4175 | 4190 | 4193 | 4197 | 4208 | 4210 | 4210 |
| 4212 | 4219 | 4225 | 4226 | 4231 | 4237 | 4239 | 4281 | 4333 | 4374 | 4378 | 4396 |
| 4436 | 4491 | 4496 | 4497 | 4518 | 4537 | 4570 | 4662 | 4774 | 4839 | 4867 | 4971 |
| 4974 | 4977 | 4988 | 4992 | 4995 | 4997 | 4999 | 5001 | 5003 | 5004 | 5019 | 5023 |
| 5024 | 5030 | 5031 | 5032 | 5035 | 5036 | 5043 | 5047 | 5053 | 5054 | 5058 | 5065 |
| 5066 | 5068 | 5076 | 5077 | 5079 | 5082 | 5085 | 5101 | 5102 | 5104 | 5106 | 5123 |
| 5124 | 5130 | 5131 | 5132 | 5134 | 5136 | 5137 | 5138 | 5139 | 5141 | 5146 | 5156 |
| 5159 | 5160 | 5182 | 5186 | 5190 | 5191 | 5192 | 5193 | 5195 | 5196 | 5197 | 5200 |
| 5201 | 5207 | 5218 | 5219 | 5224 | 5227 | 5234 | 5235 | 5236 | 5237 | 5243 | 5253 |
| 5254 | 5255 | 5261 | 5271 | 5292 | 5293 | 5303 | 5305 | 5315 | 5317 | 5342 | 5359 |
| 5360 | 5368 | 5369 | 5383 | 5384 | 5385 | 5388 | 5393 | 5397 | 5401 | 5403 | 5404 |
| 5405 | 5406 | 5420 | 5422 | 5424 | 5425 | 5427 | 5430 | 5435 | 5438 | 5447 | 5456 |
| 5457 | 5461 | 5466 | 5468 | 5469 | 5472 | 5473 | 5475 | 5479 | 5485 | 5489 | 5499 |
| 5511 | 5517 | 5526 | 5533 | 5534 | 5538 | 5540 | 5551 | 5552 | 5554 | 5555 | 5559 |
| 5560 | 5561 | 5563 | 5566 | 5574 | 5577 | 5578 | 5580 | 5581 | 5585 | 5594 | 5596 |
| 5597 | 5598 | 5601 | 5603 | 5609 | 5620 | 5643 | 5647 | 5649 | 5653 | 5663 | 5675 |
| 5683 | 5685 | 5686 | 5689 | 5690 | 5691 | 5692 | 5694 | 5702 | 5704 | 5716 | 5720 |
| 5722 | 5739 | 5743 | 5744 | 5760 | 5762 | 5767 | 5780 | 5790 | 5791 | 5792 | 5793 |
| 5796 | 5814 | 5822 | 5828 | 5837 | 5838 | 5839 | 5846 | 5847 | 5848 | 5849 | 5853 |
| 5854 | 5861 | 5862 | 5863 | 5869 | 5870 | 5878 | 5880 | 5881 | 5882 | 5891 | 5901 |
| 5902 | 5904 | 5913 | 5920 | 5927 | 5928 | 5929 | 5930 | 5931 | 5943 | 5945 | 5953 |
| 5961 | 5962 | 5963 | 5964 | 5967 | 5968 | 5972 | 5973 | 5975 | 5977 | 5981 | 5987 |
| 5988 | 5989 | 5990 | 5994 | 5995 | 5997 | 6004 | 6005 | 6006 | 6025 | 6026 | 6027 |
| 6031 | 6037 | 6045 | 6054 | 6056 | 6062 | 6063 | 6064 | 6065 | 6074 | 6079 | 6081 |
| 6083 | 6092 | 6117 | 6118 | 6119 | 6121 | 6126 | 6132 | 6143 | 6144 | 6147 | 6150 |
| 6152 | 6155 | 6157 | 6161 | 6162 | 6170 | 6176 | 6185 | 6187 | 6189 | 6201 | 6204 |

TABLE 10A-continued

| Homologous Recombination | | | | | | | | | | | |
|---|---|---|---|---|---|---|---|---|---|---|---|
| 6205 | 6209 | 6210 | 6212 | 6217 | 6229 | 6230 | 6236 | 6237 | 6242 | 6261 | 6267 |
| 6304 | 6307 | 6328 | 6341 | 6375 | 6394 | 6395 | 6397 | 6409 | 6426 | 6434 | 6438 |
| 6442 | 6453 | 6457 | 6461 | 6462 | 6465 | 6471 | 6472 | 6473 | 6474 | 6478 | 6482 |
| 6483 | 6498 | 6499 | 6519 | 6524 | 6527 | 6528 | 6529 | 6535 | 6536 | 6537 | 6573 |
| 6597 | 6600 | 6601 | 6602 | 6603 | 6605 | 6606 | 6612 | 6614 | 6621 | 6631 | 6632 |
| 6633 | 6665 | 6694 | 6700 | 6708 | 6725 | 6729 | 6731 | 6744 | 6745 | 6756 | 6757 |
| 6765 | 6770 | 6774 | 6791 | 6846 | 6851 | 6881 | 6882 | 6908 | 6909 | 6920 | 6923 |
| 6928 | 6929 | 6931 | 6946 | 6947 | 6973 | 6974 | 6975 | 6991 | 6992 | 6993 | 6998 |
| 7012 | 7015 | 7027 | 7028 | 7029 | 7030 | 7036 | 7042 | 7089 | 7128 | 7132 | 7151 |
| 7195 | 7250 | 7255 | 7256 | 7277 | 7295 | 7322 | 7327 | 7421 | 7534 | 7598 | 7626 |
| 7741 | 7767 | 7780 | 7808 | 7821 | 7849 | 7865 | 7880 | 7889 | 8042 | 8059 | 8118 |
| 8133 | 8212 | 8217 | 8297 | 8298 | 8316 | 8325 | 8336 | 8389 | 8463 | 8511 | 8543 |
| 8559 | 8570 | 8581 | 8610 | 8611 | 8656 | 8693 | 8745 | 8784 | 8808 | 8811 | 8824 |
| 8846 | 8889 | 8905 | 8956 | 8986 | 8992 | 9009 | 9025 | 9044 | 9071 | 9131 | 9134 |
| 9157 | 9179 | 9187 | 9194 | 9195 | 9199 | 9207 | 9219 | 9247 | 9275 | 9353 | 9432 |
| 9433 | 9434 | 9455 | 9460 | 9461 | 9486 | 9510 | 9579 | 9618 | 9651 | 9683 | 9696 |
| 9722 | 9739 | 9740 | 9755 | 9770 | 9874 | 9905 | 9951 | 10043 | 10072 | 10090 | 10126 |
| 10147 | 10148 | 10189 | 10206 | 10251 | 10271 | 10289 | 10291 | 10320 | 10324 | 10331 | 10364 |
| 10365 | 10387 | 10391 | 10400 | 10455 | 10633 | 10676 | 10706 | 10737 | 10767 | 10778 | 10846 |
| 10874 | 10879 | 10880 | 10918 | 10948 | 10954 | 10963 | 10964 | 10965 | 11015 | 11016 | 11047 |
| 11051 | 11080 | 11081 | 11082 | 11083 | 11100 | 11104 | 11133 | 11135 | 11145 | 11146 | 11150 |
| 11158 | 11159 | 11197 | 11199 | 11201 | 11220 | 11222 | 11224 | 11228 | 11243 | 11256 | 11266 |
| 11278 | 11285 | 11289 | 11290 | 11292 | 11313 | 11315 | 11316 | 11319 | 11322 | 11323 | 11324 |
| 11334 | 11341 | 11342 | 11348 | 11354 | 11423 | 11454 | 11510 | 11541 | 11561 | 11585 | 11654 |
| 11746 | 11758 | 11784 | 11800 | 11858 | 11884 | 11910 | 11930 | 11976 | 12051 | 12076 | 12133 |
| 12292 | 12325 | 12334 | 12354 | 12355 | 12357 | 12359 | 12363 | 12365 | 12369 | 12372 | 12378 |
| 12392 | 12406 | 12415 | 12432 | 12444 | 12462 | 12464 | 12474 | 12479 | 12490 | 12493 | 12497 |
| 12504 | 12508 | 12515 | 12522 | 12525 | 12531 | 12543 | 12547 | 12550 | 12552 | 12555 | 12557 |
| 12560 | 12564 | 12567 | 12571 | 12581 | 12582 | 12584 | 12587 | 12588 | 12599 | 12604 | 12609 |
| 12611 | 12615 | 12616 | 12632 | 12633 | 12637 | 12647 | 12649 | 12651 | 12654 | 12655 | 12656 |
| 12660 | 12667 | 12668 | 12669 | 12674 | 12677 | 12691 | 12702 | 12705 | 12707 | 12709 | 12717 |
| 12718 | 12729 | 12731 | 12740 | 12747 | 12749 | 12752 | 12754 | 12755 | 12776 | 12777 | 12787 |
| 12788 | 12795 | 12798 | 12805 | 12816 | 12822 | 12826 | 12838 | 12839 | 12852 | 12860 | 12866 |
| 12875 | 12878 | 12881 | 12884 | 12898 | 12906 | 12909 | 12915 | 12916 | 12930 | 12931 | 12935 |
| 12937 | 12943 | 12945 | 12948 | 12951 | 12964 | 12965 | 12966 | 12973 | 12981 | 12992 | 12993 |
| 12998 | 13007 | 13009 | 13021 | 13024 | 13041 | 13052 | 13058 | 13073 | 13077 | 13080 | 13082 |
| 13108 | 13110 | 13112 | 13116 | 13123 | 13130 | 13138 | 13141 | 13143 | 13149 | 13157 | 13165 |
| 13172 | 13174 | 13175 | 13176 | 13178 | 13186 | 13189 | 13207 | 13208 | 13213 | 13218 | 13219 |
| 13223 | 13228 | 13232 | 13248 | 13257 | 13268 | 13270 | 13271 | 13298 | 13299 | 13302 |
| 13309 | 13312 | 13315 | 13321 | 13331 | 13338 | 13345 | 13364 | 13366 | 13367 | 13369 | 13374 |
| 13377 | 13378 | 13387 | 13398 | 13399 | 13401 | 13402 | 13404 | 13409 | 13411 | 13413 | 13421 |
| 13425 | 13441 | 13449 | 13452 | 13453 | 13454 | 13457 | 13459 | 13468 | 13477 | 13491 | 13501 |
| 13511 | 13512 | 13544 | 13545 | 13558 | 13572 | 13580 | 13589 | 13602 | 13637 | 13687 | 13701 |
| 13727 | 13758 | 13830 | 13840 | 13852 | 13858 | 13886 | 13891 | 13920 | 13954 | 14023 | 14056 |
| 14076 | 14108 | 14188 | 14189 | 14224 | 14229 | 14253 | 14255 | 14282 | 14305 | 14311 | 14558 |
| 14568 | 14570 | 14572 | 14627 | 14635 | 14653 | 14655 | 14745 | 14751 | 14767 | 14855 | 14885 |
| 14890 | 14899 | 15044 | 15086 | 15097 | 15126 | 15129 | 15145 | 15227 | 15230 | 15246 | 15330 |
| 15381 | 15384 | 15411 | 15429 | 15518 | 15519 | 15528 | 15549 | 15588 | 15618 | 15638 | 15697 |
| 15749 | 15752 | 15779 | 15797 | 15890 | 15891 | 15899 | 15922 | 15964 | 15970 | 15993 | 16013 |
| 16066 | 16088 | 16133 | 16136 | 16162 | 16179 | 16263 | 16264 | 16270 | 16287 | 16288 | 16325 |
| 16366 | 16432 | 16439 | 16456 | 16475 | 16503 | 16557 | 16572 | 16602 | 16617 | 16623 | 16627 |
| 16633 | 16638 | 16648 | 16672 | 16673 | 16702 | 16722 | 16745 | 16755 | 16777 | 16788 | 16820 |
| 16894 | 16936 | 17065 | 17083 | 17096 | 17125 | 17126 | 17138 | 17173 | 17311 | 17312 | 17320 |
| 17323 | 17363 | 17406 | 17465 | 17482 | 17490 | 17497 | 17533 | 17570 | 17571 | 17620 | 17628 |
| 17683 | 17697 | 17709 | 17717 | 17743 | 17748 | 17753 | 17754 | 17823 | 17831 | 17962 | 17972 |
| 18023 | 18025 | 18026 | 18053 | 18057 | 18058 | 18081 | 18091 | 18093 | 18097 | 18106 | 18194 |
| 18198 | 18203 | 18214 | 18215 | 18224 | 18231 | 18243 | 18246 | 18249 | 18279 | 18281 | 18283 |
| 18286 | 18287 | 18312 | 18331 | 18339 | 18376 | 18383 | 18392 | 18397 | 18400 | 18415 | 18428 |
| 18439 | 18520 | 18521 | 18536 | 18539 | 18541 | 18546 | 18547 | 18562 | 18563 | 18564 | 18591 |
| 18623 | 18624 | 18628 | 18629 | 18631 | 18640 | 18641 | 18642 | 18643 | 18659 | 18663 | 18665 |
| 18667 | 18672 | 18673 | 18689 | 18691 | 18699 | 18707 | 18708 | 18737 | 18738 | 18747 | 18755 |
| 18795 | 18806 | 18821 | 18845 | 18871 | 18883 | 18891 | 18905 | 18907 | 18927 | 18939 | 18951 |
| 18965 | 19032 | 19034 | 19046 | 19050 | 19053 | 19064 | 19098 | 19112 | 19113 | 19123 | 19125 |
| 19218 | 19236 | 19278 | 19279 | 19319 | 19354 | 19362 | 19363 | 19364 | 19385 | 19415 | 19437 |
| 19454 | 19457 | 19463 | 19467 | 19476 | 19592 | 19600 | 19650 | 19677 | 19720 | 19730 | 19732 |
| 19744 | 19773 | 19775 | 19792 | 19794 | 19795 | 19855 | 19865 | 19869 | 19898 | 19899 | 19941 |
| 19944 | 19945 | 19974 | 19983 | 20058 | 20059 | 20066 | 20079 | 20081 | 20091 | 20095 | 20096 |
| 20122 | 20143 | 20148 | 20149 | 20166 | 20175 | 20205 | 20224 | 20242 | 20246 | 20247 | 20287 |
| 20288 | 20291 | 20295 | 20301 | 20314 | 20315 | 20318 | 20320 | 20321 | 20337 | 20355 | 20367 |
| 20379 | 20382 | 20385 | 20394 | 20397 | 20401 | 20406 | 20409 | 20410 | 20484 | 20538 | 20571 |
| 20638 | 20667 | 20669 | 20738 | 20794 | 20819 | 20976 | 21030 | 21040 | 21055 | 21099 | 21100 |
| 21107 | 21138 | 21139 | 21169 | 21231 | 21237 | 21240 | 21251 | 21265 | 21279 | 21299 | 21347 |
| 21351 | 21360 | 21367 | 21371 | 21382 | 21404 | 21406 | 21438 | 21440 | 21447 | 21451 | 21453 |
| 21457 | 21493 | 21499 | 21502 | 21517 | 21523 | 21528 | 21537 | 21538 | 21547 | 21550 | 21554 |
| 21558 | 21561 | 21577 | 21581 | 21584 | 21599 | 21611 | 21643 | 21656 | 21660 | 21663 | 21667 |
| 21668 | 21677 | 21688 | 21692 | 21764 | 21830 | 21874 | 21875 | 21876 | 21877 | 21885 | 21887 |
| 21888 | 21890 | 21899 | 21901 | 21902 | 21903 | 21905 | 21910 | 21911 | 21912 | 21915 | 21927 |

TABLE 10A-continued

Homologous Recombination

| | | | | | | | | | | |
|---|---|---|---|---|---|---|---|---|---|---|
| 21928 | 21929 | 21932 | 21933 | 21935 | 21940 | 21944 | 21949 | 21955 | 21957 | 21961 | 21964 |
| 21969 | 21971 | 21974 | 21977 | 21978 | 21979 | 21981 | 21987 | 21989 | 22004 | 22007 | 22008 |
| 22016 | 22019 | 22020 | 22025 | 22030 | 22031 | 22050 | 22052 | 22054 | 22056 | 22057 | 22058 |
| 22059 | 22076 | 22079 | 22083 | 22085 | 22094 | 22099 | 22100 | 22101 | 22105 | 22108 | 22111 |
| 22112 | 22117 | 22118 | 22129 | 22136 | 22138 | 22142 | 22148 | 22151 | 22153 | 22155 | 22157 |
| 22158 | 22159 | 22160 | 22169 | 22170 | 22172 | 22175 | 22178 | 22182 | 22188 | 22190 | 22191 |
| 22192 | 22195 | 22199 | 22217 | 22218 | 22228 | 22235 | 22243 | 22250 | 22255 | 22256 | 22258 |
| 22262 | 22272 | 22274 | 22278 | 22279 | 22296 | 22299 | 22301 | 22305 | 22314 | 22315 | 22319 |
| 22320 | 22324 | 22330 | 22339 | 22341 | 22344 | 22348 | 22350 | 22356 | 22358 | 22360 | 22363 |
| 22364 | 22365 | 22368 | 22369 | 22375 | 22376 | 22383 | 22384 | 22385 | 22387 | 22388 | 22395 |
| 22396 | 22406 | 22422 | 22427 | 22445 | 22449 | 22450 | 22460 | 22463 | 22465 | 22466 | 22467 |
| 22469 | 22475 | 22484 | 22500 | 22502 | 22505 | 22507 | 22511 | 22513 | 22515 | 22520 | 22521 |
| 22522 | 22523 | 22528 | 22530 | 22531 | 22534 | 22535 | 22538 | 22540 | 22541 | 22545 | 22550 |
| 22554 | 22556 | 22557 | 22564 | 22565 | 22570 | 22571 | 22575 | 22576 | 22578 | 22579 | 22580 |
| 22588 | 22589 | 22590 | 22595 | 22600 | 22604 | 22605 | 22615 | 22629 | 22637 | 22638 | 22641 |
| 22642 | 22643 | 22647 | 22650 | 22654 | 22656 | 22660 | 22661 | 22662 | 22663 | 22665 | 22667 |
| 22668 | 22669 | 22671 | 22676 | 22692 | 22693 | 22701 | 22703 | 22704 | 22705 | 22706 | 22713 |
| 22714 | 22719 | 22721 | 22727 | 22728 | 22731 | 22734 | 22741 | 22742 | 22744 | 22752 | 22758 |
| 22760 | 22771 | 22774 | 22775 | 22795 | 22800 | 22808 | 22811 | 22812 | 22825 | 22826 | 22827 |
| 22829 | 22832 | 22840 | 22842 | 22847 | 22867 | 22868 | 22874 | 22894 | 22906 | 22923 | 22943 |
| 22944 | 22950 | 22966 | 22979 | 23010 | 23013 | 23045 | 23085 | 23101 | 23124 | 23127 | 23136 |
| 23137 | 23145 | 23146 | 23199 | 23250 | 23353 | 23357 | 23380 | 23386 | 23417 | 23458 | 23474 |
| 23475 | 23507 | 23514 | 23519 | 23617 | 23625 | | | | | | |

Table 10B SEQ ID NOs of Polynucleotides useful for improving Homologous Recombination

| | | | | | | | | | | |
|---|---|---|---|---|---|---|---|---|---|---|
| 23698 | 23712 | 23730 | 23732 | 23745 | 23757 | 23762 | 23792 | 23796 | 23803 | 23866 | 23906 |
| 23923 | 23950 | 23956 | 23957 | 23958 | 23959 | 23973 | 24033 | 24118 | 24140 | 24155 | 24204 |
| 24211 | 24212 | 24226 | 24302 | 24311 | 24339 | 24352 | 24384 | 24461 | 24473 | 24484 | 24504 |
| 24545 | 24547 | 24590 | 24591 | 24598 | 24604 | 24619 | 24626 | 24642 | 24645 | 24646 | 24648 |
| 24653 | 24654 | 24696 | 24703 | 24711 | 24735 | 24748 | 24770 | 24771 | 24782 | 24783 |
| 24802 | 24808 | 24828 | 24830 | 24838 | 24841 | 24871 | 24882 | 24884 | 24900 | 24906 | 24910 |
| 24914 | 24924 | 24925 | 24934 | 24935 | 24938 | 24940 | 24941 | 24958 | 24976 | 24988 | 25001 |
| 25004 | 25007 | 25017 | 25020 | 25025 | 25030 | 25034 | 25052 | 25053 | 25059 | 25060 | 25072 |
| 25078 | 25079 | 25082 | 25092 | 25094 | 25100 | 25101 | 25103 | 25107 | 25109 | 25111 | 25119 |
| 25123 | 25129 | 25134 | 25135 | 25139 | 25143 | 25144 | 25145 | 25146 | 25149 | 25153 | 25154 |
| 25155 | 25162 | 25164 | 25169 | 25170 | 25172 | 25174 | 25189 | 25196 | 25199 | 25201 | 25203 |
| 25204 | 25210 | 25215 | 25217 | 25221 | 25223 | 25224 | 25232 | 25233 | 25234 | 25238 | 25239 |
| 25244 | 25245 | 25248 | 25249 | 25254 | 25255 | 25256 | 25258 | 25263 | 25264 | 25268 | 25272 |
| 25273 | 25274 | 25278 | 25281 | 25282 | 25289 | 25307 | 25308 | 25312 | 25314 | 25316 | 25320 |
| 25325 | 25327 | 25331 | 25333 | 25334 | 25335 | 25339 | 25343 | 25344 | 25345 | 25353 | 25358 |
| 25359 | 25363 | 25364 | 25365 | 25369 | 25374 | 25378 | 25380 | 25387 | 25395 | 25396 | 25401 |
| 25402 | 25410 | 25416 | 25425 | 25435 | 25439 | 25442 | 25448 | 25450 | 25453 | 25454 |
| 25455 | 25458 | 25460 | 25464 | 25466 | 25469 | 25473 | 25474 | 25475 | 25477 | 25478 | 25480 |
| 25481 | 25486 | 25487 | 25491 | 25494 | 25495 | 25496 | 25497 | 25498 | 25509 | 25512 | 25514 |
| 25527 | 25530 | 25532 | 25535 | 25539 | 25540 | 25541 | 25542 | 25545 | 25547 | 25548 | 25550 |
| 25551 | 25557 | 25558 | 25560 | 25562 | 25568 | 25573 | 25575 | 25578 | 25587 | 25588 |
| 25595 | 25598 | 25600 | 25601 | 25602 | 25603 | 25606 | 25612 | 25621 | 25624 | 25626 | 25627 |
| 25628 | 25630 | 25632 | 25635 | 25637 | 25641 | 25644 | 25646 | 25648 | 25650 | 25652 | 25654 |
| 25655 | 25659 | 25663 | 25665 | 25666 | 25667 | 25668 | 25669 | 25672 | 25677 | 25678 | 25683 |
| 25688 | 25698 | 25699 | 25702 | 25703 | 25705 | 25707 | 25708 | 25709 | 25722 | 25723 | 25725 |
| 25726 | 25733 | 25736 | 25739 | 25741 | 25742 | 25743 | 25747 | 25748 | 25762 | 25768 | 25775 |
| 25776 | 25777 | 25779 | 25780 | 25781 | 25784 | 25787 | 25788 | 25790 | 25792 | 25793 | 25794 |
| 25795 | 25800 | 25801 | 25812 | 25815 | 25818 | 25819 | 25822 | 25823 | 25825 | 25828 | 25829 |
| 25832 | 25833 | 25836 | 25840 | 25844 | 25848 | 25850 | 25857 | 25859 | 25860 | 25865 | 25866 |
| 25867 | 25870 | 25872 | 25874 | 25875 | 25876 | 25877 | 25880 | 25883 | 25884 | 25890 | 25900 |
| 25902 | 25906 | 25908 | 25909 | 25911 | 25921 | 25923 | 25927 | 25929 | 25935 | 25940 | 25941 |
| 25943 | 25946 | 25948 | 25953 | 25958 | 25961 | 25962 | 25968 | 25973 | 25974 | 25975 | 25977 |
| 25982 | 25983 | 25985 | 25989 | 25994 | 25996 | 25999 | 26004 | 26005 | 26010 | 26011 | 26013 |
| 26016 | 26019 | 26031 | 26035 | 26040 | 26047 | 26048 | 26057 | 26058 | 26059 | 26063 | 26064 |
| 26066 | 26067 | 26072 | 26073 | 26076 | 26082 | 26083 | 26086 | 26088 | 26092 | 26099 | 26103 |
| 26106 | 26107 | 26121 | 26123 | 26124 | 26130 | 26136 | 26141 | 26143 | 26146 | 26147 | 26149 |
| 26151 | 26152 | 26154 | 26158 | 26164 | 26167 | 26170 | 26180 | 26185 | 26188 | 26192 | 26196 |
| 26203 | 26206 | 26207 | 26212 | 26219 | 26222 | 26226 | 26227 | 26228 | 26229 | 26230 | 26232 |
| 26235 | 26239 | 26242 | 26245 | 26248 | 26259 | 26260 | 26261 | 26264 | 26266 | 26268 | 26270 |
| 26272 | 26274 | 26281 | 26282 | 26358 | 26360 | 26373 | 26384 | 26396 | 26400 | 26433 | 26450 |
| 26459 | 26569 | 26573 | 26582 | 26598 | 26649 | 26688 | 26693 | 26698 | 26705 | 26740 | 26768 |
| 26771 | 26786 | 26788 | 26799 | 26801 | 26804 | 26810 | 26828 | 26833 | 26836 | 26851 | 26857 |
| 26870 | 26871 | 26879 | 26891 | 26894 | 26899 | 26900 | 26902 | 26909 | 26910 | 26925 | 26929 |
| 26930 | 26942 | 26945 | 26948 | 26952 | 26955 | 26959 | 26962 | 26974 | 26983 | 26984 | 26990 |
| 27001 | 27004 | 27006 | 27016 | 27023 | 27028 | 27029 | 27032 | 27036 | 27052 | 27053 | 27054 |
| 27056 | 27057 | 27061 | 27062 | 27087 | 27089 | 27090 | 27092 | 27095 | 27099 | 27100 | 27114 |
| 27119 | 27121 | 27125 | 27126 | 27130 | 27134 | 27135 | 27146 | 27151 | 27154 | 27159 | 27164 |
| 27174 | 27175 | 27178 | 27179 | 27184 | 27186 | 27189 | 27190 | 27196 | 27197 | 27212 | 27213 |
| 27223 | 27224 | 27226 | 27229 | 27233 | 27237 | 27239 | 27251 | 27254 | 27256 | 27259 | 27261 |
| 27264 | 27269 | 27271 | 27273 | 27280 | 27281 | 27285 | 27289 | 27291 | 27293 | 27300 | 27301 |
| 27309 | 27318 | 27320 | 27332 | 27338 | 27342 | 27351 | 27355 | 27359 | 27378 | 27380 | 27393 |

TABLE 10A-continued

Homologous Recombination

| | | | | | | | | | | | |
|---|---|---|---|---|---|---|---|---|---|---|---|
| 27399 | 27403 | 27405 | 27406 | 27407 | 27408 | 27422 | 27425 | 27428 | 27430 | 27437 | 27441 |
| 27442 | 27443 | 27450 | 27454 | 27462 | 27466 | 27476 | 27477 | 27478 | 27482 | 27483 | 27484 |
| 27488 | 27494 | 27500 | 27510 | 27513 | 27519 | 27528 | 27532 | 27534 | 27536 | 27538 | 27545 |
| 27548 | 27549 | 27550 | 27560 | 27561 | 27564 | 27565 | 27569 | 27570 | 27579 | 27584 | 27585 |
| 27597 | 27601 | 27604 | 27605 | 27610 | 27622 | 27629 | 27631 | 27634 | 27636 | 27637 | 27639 |
| 27640 | 27648 | 27649 | 27658 | 27667 | 27670 | 27675 | 27679 | 27694 | 27695 | 27697 | 27708 |
| 27710 | 27714 | 27715 | 27723 | 27724 | 27729 | 27737 | 27743 | 27744 | 27745 | 27750 | 27754 |
| 27756 | 27758 | 27759 | 27765 | 27775 | 27777 | 27778 | 27779 | 27786 | 27792 | 27796 | 27799 |
| 27806 | 27807 | 27809 | 27814 | 27819 | 27822 | 27825 | 27826 | 27828 | 27832 | 27834 | 27838 |
| 27842 | 27847 | 27857 | 27858 | 27861 | 27862 | 27877 | 27878 | 27880 | 27884 | 27895 | 27897 |
| 27899 | 27906 | 27912 | 27913 | 27918 | 27924 | 27926 | 27968 | 28020 | 28061 | 28065 | 28083 |
| 28123 | 28178 | 28183 | 28184 | 28205 | 28224 | 28257 | 28349 | 28461 | 28526 | 28554 | 28658 |
| 28661 | 28664 | 28675 | 28679 | 28682 | 28684 | 28686 | 28688 | 28690 | 28691 | 28706 | 28710 |
| 28711 | 28717 | 28718 | 28719 | 28722 | 28723 | 28730 | 28734 | 28740 | 28741 | 28745 | 28752 |
| 28753 | 28755 | 28763 | 28764 | 28766 | 28769 | 28772 | 28788 | 28789 | 28791 | 28793 | 28810 |
| 28811 | 28817 | 28818 | 28819 | 28821 | 28823 | 28824 | 28825 | 28826 | 28828 | 28833 | 28843 |
| 28846 | 28847 | 28869 | 28873 | 28877 | 28878 | 28879 | 28880 | 28882 | 28883 | 28884 | 28887 |
| 28888 | 28894 | 28905 | 28906 | 28911 | 28914 | 28921 | 28922 | 28923 | 28924 | 28930 | 28940 |
| 28941 | 28942 | 28948 | 28958 | 28979 | 28980 | 28990 | 28992 | 29002 | 29004 | 29029 | 29046 |
| 29047 | 29055 | 29056 | 29070 | 29071 | 29072 | 29075 | 29080 | 29084 | 29088 | 29090 | 29091 |
| 29092 | 29093 | 29107 | 29109 | 29111 | 29112 | 29114 | 29117 | 29122 | 29125 | 29134 | 29143 |
| 29144 | 29153 | 29155 | 29156 | 29159 | 29160 | 29162 | 29166 | 29172 | 29176 | 29186 |
| 29198 | 29204 | 29213 | 29220 | 29221 | 29225 | 29227 | 29238 | 29239 | 29241 | 29242 | 29246 |
| 29247 | 29248 | 29250 | 29253 | 29261 | 29264 | 29265 | 29267 | 29268 | 29272 | 29281 | 29283 |
| 29284 | 29285 | 29288 | 29290 | 29296 | 29307 | 29330 | 29334 | 29336 | 29340 | 29350 | 29362 |
| 29370 | 29372 | 29373 | 29376 | 29377 | 29378 | 29379 | 29381 | 29389 | 29391 | 29403 | 29407 |
| 29409 | 29426 | 29430 | 29431 | 29447 | 29449 | 29454 | 29467 | 29477 | 29478 | 29479 | 29480 |
| 29483 | 29501 | 29509 | 29515 | 29524 | 29525 | 29526 | 29533 | 29534 | 29535 | 29536 | 29540 |
| 29541 | 29548 | 29549 | 29550 | 29556 | 29557 | 29565 | 29567 | 29568 | 29569 | 29578 | 29588 |
| 29589 | 29591 | 29600 | 29607 | 29614 | 29615 | 29616 | 29617 | 29618 | 29630 | 29632 | 29640 |
| 29648 | 29649 | 29650 | 29651 | 29654 | 29655 | 29659 | 29660 | 29662 | 29664 | 29668 | 29674 |
| 29675 | 29676 | 29677 | 29681 | 29682 | 29684 | 29691 | 29692 | 29693 | 29712 | 29713 | 29714 |
| 29718 | 29724 | 29732 | 29741 | 29743 | 29749 | 29750 | 29751 | 29752 | 29761 | 29766 | 29768 |
| 29770 | 29779 | 29804 | 29805 | 29806 | 29808 | 29813 | 29819 | 29830 | 29831 | 29834 | 29837 |
| 29839 | 29842 | 29844 | 29848 | 29849 | 29857 | 29863 | 29872 | 29874 | 29876 | 29888 | 29891 |
| 29892 | 29896 | 29897 | 29899 | 29904 | 29916 | 29917 | 29923 | 29924 | 29929 | 29948 | 29954 |
| 29991 | 29994 | 30015 | 30028 | 30062 | 30081 | 30082 | 30084 | 30096 | 30113 | 30121 | 30125 |
| 30129 | 30140 | 30144 | 30148 | 30149 | 30152 | 30158 | 30159 | 30160 | 30161 | 30165 | 30169 |
| 30170 | 30185 | 30186 | 30206 | 30211 | 30214 | 30215 | 30216 | 30222 | 30223 | 30224 | 30260 |
| 30284 | 30287 | 30288 | 30289 | 30290 | 30292 | 30293 | 30299 | 30301 | 30308 | 30318 | 30319 |
| 30320 | 30352 | 30381 | 30387 | 30395 | 30412 | 30416 | 30418 | 30431 | 30432 | 30443 | 30444 |
| 30452 | 30457 | 30461 | 30478 | 30533 | 30538 | 30568 | 30569 | 30595 | 30596 | 30607 | 30610 |
| 30615 | 30616 | 30618 | 30633 | 30634 | 30660 | 30661 | 30662 | 30679 | 30680 | 30685 |
| 30699 | 30702 | 30714 | 30715 | 30716 | 30717 | 30723 | 30729 | 30776 | 30815 | 30819 | 30838 |
| 30882 | 30937 | 30942 | 30943 | 30964 | 30982 | 31009 | 31014 | 31108 | 31221 | 31285 | 31313 |
| 31428 | 31454 | 31467 | 31495 | 31508 | 31536 | 31552 | 31567 | 31576 | 31729 | 31746 | 31805 |
| 31820 | 31899 | 31904 | 31984 | 31985 | 32003 | 32012 | 32023 | 32150 | 32198 | 32230 |
| 32246 | 32257 | 32268 | 32297 | 32298 | 32343 | 32380 | 32432 | 32471 | 32495 | 32498 | 32511 |
| 32533 | 32576 | 32592 | 32643 | 32673 | 32679 | 32696 | 32712 | 32731 | 32758 | 32818 | 32821 |
| 32844 | 32866 | 32874 | 32881 | 32882 | 32886 | 32894 | 32906 | 32934 | 32962 | 33040 | 33119 |
| 33120 | 33121 | 33142 | 33147 | 33148 | 33173 | 33197 | 33266 | 33305 | 33338 | 33370 | 33383 |
| 33409 | 33426 | 33427 | 33442 | 33457 | 33561 | 33592 | 33638 | 33730 | 33759 | 33777 | 33813 |
| 33834 | 33835 | 33876 | 33893 | 33938 | 33958 | 33976 | 33978 | 34007 | 34011 | 34018 | 34051 |
| 34052 | 34074 | 34078 | 34087 | 34142 | 34320 | 34363 | 34393 | 34424 | 34454 | 34465 | 34533 |
| 34561 | 34566 | 34567 | 34605 | 34635 | 34641 | 34650 | 34651 | 34652 | 34702 | 34703 | 34734 |
| 34738 | 34767 | 34768 | 34769 | 34770 | 34787 | 34791 | 34820 | 34822 | 34832 | 34833 | 34837 |
| 34845 | 34846 | 34884 | 34886 | 34888 | 34907 | 34909 | 34911 | 34915 | 34930 | 34943 | 34953 |
| 34965 | 34972 | 34976 | 34977 | 34979 | 35000 | 35002 | 35003 | 35006 | 35009 | 35010 | 35011 |
| 35021 | 35028 | 35029 | 35035 | 35041 | 35110 | 35141 | 35197 | 35228 | 35248 | 35272 | 35341 |
| 35433 | 35445 | 35471 | 35487 | 35545 | 35571 | 35597 | 35617 | 35663 | 35738 | 35763 | 35820 |
| 35979 | 36012 | 36021 | 36041 | 36042 | 36044 | 36046 | 36050 | 36052 | 36056 | 36059 | 36065 |
| 36079 | 36093 | 36102 | 36119 | 36131 | 36149 | 36151 | 36161 | 36166 | 36177 | 36180 | 36184 |
| 36191 | 36195 | 36202 | 36209 | 36212 | 36218 | 36230 | 36234 | 36237 | 36239 | 36242 | 36244 |
| 36247 | 36251 | 36254 | 36258 | 36268 | 36269 | 36271 | 36274 | 36276 | 36286 | 36291 | 36296 |
| 36298 | 36302 | 36303 | 36319 | 36320 | 36324 | 36334 | 36336 | 36338 | 36341 | 36342 | 36343 |
| 36347 | 36354 | 36355 | 36356 | 36361 | 36364 | 36378 | 36389 | 36392 | 36394 | 36396 | 36404 |
| 36405 | 36416 | 36418 | 36427 | 36434 | 36436 | 36439 | 36441 | 36442 | 36463 | 36464 | 36474 |
| 36475 | 36482 | 36485 | 36492 | 36503 | 36509 | 36513 | 36525 | 36526 | 36539 | 36547 | 36553 |
| 36562 | 36565 | 36568 | 36571 | 36585 | 36593 | 36596 | 36602 | 36603 | 36617 | 36618 | 36622 |
| 36624 | 36630 | 36632 | 36635 | 36638 | 36651 | 36652 | 36653 | 36660 | 36668 | 36679 | 36680 |
| 36685 | 36694 | 36696 | 36708 | 36711 | 36728 | 36739 | 36745 | 36760 | 36764 | 36767 | 36769 |
| 36795 | 36797 | 36799 | 36803 | 36810 | 36817 | 36825 | 36828 | 36830 | 36836 | 36844 | 36852 |
| 36859 | 36861 | 36862 | 36863 | 36865 | 36873 | 36876 | 36894 | 36895 | 36900 | 36905 | 36906 |
| 36910 | 36915 | 36919 | 36935 | 36944 | 36955 | 36957 | 36958 | 36964 | 36985 | 36986 | 36989 |
| 36996 | 36999 | 37002 | 37008 | 37018 | 37025 | 37032 | 37051 | 37053 | 37054 | 37056 | 37061 |
| 37064 | 37065 | 37074 | 37085 | 37086 | 37088 | 37089 | 37091 | 37096 | 37098 | 37100 | 37108 |
| 37112 | 37128 | 37136 | 37139 | 37140 | 37141 | 37144 | 37146 | 37155 | 37164 | 37178 | 37188 |

TABLE 10A-continued

Homologous Recombination

| | | | | | | | | | | | |
|---|---|---|---|---|---|---|---|---|---|---|---|
| 37198 | 37199 | 37231 | 37232 | 37245 | 37259 | 37267 | 37276 | 37289 | 37324 | 37374 | 37388 |
| 37414 | 37445 | 37517 | 37527 | 37539 | 37545 | 37573 | 37578 | 37607 | 37641 | 37710 | 37743 |
| 37763 | 37795 | 37875 | 37876 | 37911 | 37916 | 37940 | 37942 | 37969 | 37992 | 37998 | 38245 |
| 38255 | 38257 | 38259 | 38314 | 38322 | 38340 | 38342 | 38432 | 38438 | 38454 | 38542 | 38572 |
| 38577 | 38586 | 38731 | 38773 | 38784 | 38813 | 38816 | 38832 | 38914 | 38917 | 38933 | 39017 |
| 39068 | 39071 | 39098 | 39116 | 39205 | 39206 | 39215 | 39236 | 39275 | 39305 | 39325 | 39384 |
| 39436 | 39439 | 39466 | 39484 | 39577 | 39578 | 39586 | 39609 | 39651 | 39657 | 39680 | 39700 |
| 39753 | 39775 | 39820 | 39823 | 39849 | 39866 | 39950 | 39951 | 39957 | 39974 | 39975 | 40012 |
| 40053 | 40119 | 40126 | 40143 | 40162 | 40190 | 40244 | 40259 | 40289 | 40304 | 40310 | 40314 |
| 40320 | 40325 | 40335 | 40359 | 40360 | 40389 | 40409 | 40432 | 40442 | 40464 | 40475 | 40507 |
| 40581 | 40623 | 40752 | 40770 | 40783 | 40812 | 40813 | 40825 | 40860 | 40998 | 40999 | 41007 |
| 41010 | 41050 | 41093 | 41152 | 41169 | 41177 | 41184 | 41220 | 41257 | 41258 | 41307 | 41315 |
| 41370 | 41384 | 41396 | 41404 | 41430 | 41435 | 41440 | 41441 | 41510 | 41518 | 41649 | 41659 |
| 41710 | 41712 | 41713 | 41740 | 41744 | 41745 | 41768 | 41778 | 41780 | 41784 | 41793 | 41881 |
| 41885 | 41890 | 41901 | 41902 | 41911 | 41918 | 41930 | 41933 | 41936 | 41966 | 41968 | 41970 |
| 41973 | 41974 | 41999 | 42018 | 42026 | 42063 | 42070 | 42079 | 42084 | 42087 | 42102 | 42115 |
| 42126 | 42207 | 42208 | 42223 | 42226 | 42228 | 42233 | 42234 | 42249 | 42250 | 42251 | 42278 |
| 42310 | 42311 | 42315 | 42316 | 42318 | 42327 | 42328 | 42329 | 42330 | 42346 | 42350 | 42352 |
| 42354 | 42359 | 42360 | 42376 | 42378 | 42386 | 42394 | 42395 | 42424 | 42425 | 42434 | 42442 |
| 42482 | 42493 | 42508 | 42532 | 42558 | 42570 | 42578 | 42592 | 42594 | 42614 | 42626 | 42638 |
| 42652 | 42719 | 42721 | 42733 | 42737 | 42740 | 42751 | 42785 | 42799 | 42800 | 42810 | 42812 |
| 42905 | 42923 | 42965 | 42966 | 43006 | 43041 | 43049 | 43050 | 43051 | 43072 | 43102 | 43124 |
| 43141 | 43144 | 43150 | 43154 | 43163 | 43279 | 43287 | 43337 | 43364 | 43407 | 43417 | 43419 |
| 43431 | 43460 | 43462 | 43479 | 43481 | 43482 | 43542 | 43552 | 43556 | 43585 | 43586 | 43628 |
| 43631 | 43632 | 43661 | 43670 | 43745 | 43746 | 43753 | 43766 | 43768 | 43778 | 43782 | 43783 |
| 43809 | 43830 | 43835 | 43836 | 43853 | 43862 | 43892 | 43911 | 43929 | 43933 | 43934 | 43974 |
| 43975 | 43978 | 43982 | 43988 | 44001 | 44002 | 44005 | 44007 | 44008 | 44024 | 44042 | 44054 |
| 44066 | 44069 | 44072 | 44081 | 44084 | 44088 | 44093 | 44096 | 44097 | 44171 | 44225 | 44258 |
| 44325 | 44354 | 44356 | 44425 | 44481 | 44506 | 44663 | 44717 | 44727 | 44742 | 44786 | 44787 |
| 44794 | 44825 | 44826 | 44856 | 44918 | 44924 | 44927 | 44938 | 44952 | 44966 | 44986 | 45034 |
| 45038 | 45047 | 45054 | 45058 | 45069 | 45091 | 45093 | 45125 | 45127 | 45134 | 45138 | 45140 |
| 45144 | 45180 | 45186 | 45189 | 45204 | 45210 | 45215 | 45224 | 45225 | 45234 | 45237 | 45241 |
| 45245 | 45248 | 45264 | 45268 | 45271 | 45286 | 45298 | 45330 | 45343 | 45347 | 45350 | 45354 |
| 45355 | 45364 | 45375 | 45379 | 45451 | 45517 | 45561 | 45562 | 45563 | 45564 | 45572 | 45574 |
| 45575 | 45577 | 45586 | 45588 | 45589 | 45590 | 45592 | 45597 | 45598 | 45599 | 45602 | 45614 |
| 45615 | 45616 | 45619 | 45620 | 45622 | 45627 | 45631 | 45636 | 45642 | 45644 | 45648 | 45651 |
| 45656 | 45658 | 45661 | 45664 | 45665 | 45666 | 45668 | 45674 | 45676 | 45691 | 45694 | 45695 |
| 45703 | 45706 | 45707 | 45712 | 45717 | 45718 | 45737 | 45739 | 45741 | 45743 | 45744 | 45745 |
| 45746 | 45763 | 45766 | 45770 | 45772 | 45781 | 45786 | 45787 | 45788 | 45792 | 45795 | 45798 |
| 45799 | 45804 | 45805 | 45816 | 45823 | 45825 | 45829 | 45835 | 45838 | 45840 | 45842 | 45844 |
| 45845 | 45846 | 45847 | 45856 | 45857 | 45859 | 45862 | 45865 | 45869 | 45875 | 45877 | 45878 |
| 45879 | 45882 | 45886 | 45904 | 45905 | 45915 | 45922 | 45930 | 45937 | 45942 | 45943 | 45945 |
| 45949 | 45959 | 45961 | 45965 | 45966 | 45983 | 45986 | 45992 | 46001 | 46002 | 46006 |
| 46007 | 46011 | 46017 | 46026 | 46028 | 46031 | 46035 | 46037 | 46043 | 46045 | 46047 | 46050 |
| 46051 | 46052 | 46055 | 46056 | 46062 | 46063 | 46070 | 46071 | 46072 | 46074 | 46075 | 46082 |
| 46083 | 46093 | 46109 | 46114 | 46132 | 46136 | 46137 | 46147 | 46150 | 46152 | 46153 | 46154 |
| 46156 | 46162 | 46171 | 46187 | 46189 | 46192 | 46194 | 46198 | 46200 | 46202 | 46207 | 46208 |
| 46209 | 46210 | 46215 | 46217 | 46218 | 46221 | 46222 | 46225 | 46227 | 46228 | 46232 | 46237 |
| 46241 | 46243 | 46244 | 46251 | 46252 | 46257 | 46258 | 46262 | 46263 | 46265 | 46266 | 46267 |
| 46275 | 46276 | 46277 | 46282 | 46287 | 46291 | 46292 | 46302 | 46316 | 46324 | 46325 | 46328 |
| 46329 | 46330 | 46334 | 46337 | 46341 | 46343 | 46347 | 46348 | 46349 | 46350 | 46352 | 46354 |
| 46355 | 46356 | 46358 | 46363 | 46379 | 46380 | 46388 | 46390 | 46391 | 46392 | 46393 | 46400 |
| 46401 | 46406 | 46408 | 46414 | 46415 | 46418 | 46421 | 46428 | 46429 | 46431 | 46439 | 46445 |
| 46447 | 46458 | 46461 | 46462 | 46482 | 46487 | 46495 | 46498 | 46499 | 46512 | 46513 | 46514 |
| 46516 | 46519 | 46527 | 46529 | 46534 | 46554 | 46555 | 46561 | 46581 | 46593 | 46610 | 46630 |
| 46631 | 46637 | 46653 | 46666 | 46697 | 46700 | 46732 | 46772 | 46788 | 46811 | 46814 | 46823 |
| 46824 | 46832 | 46833 | 46886 | 46937 | 47040 | 47044 | 47067 | 47073 | 47104 | 47145 | 47161 |
| 47162 | 47194 | 47201 | 47206 | 47304 | 47312 | | | | | | |

TABLE 11

Osmotic Tolerance

Table 11A SEQ ID NOs of Polypeptides useful for improving Osmotic Tolerance

| | | | | | | | | | | |
|---|---|---|---|---|---|---|---|---|---|---|
| 15 | 101 | 122 | 227 | 242 | 273 | 350 | 356 | 406 | 413 | 429 | 445 |
| 463 | 682 | 700 | 714 | 727 | 826 | 898 | 1132 | 1341 | 1385 | 1414 | 1432 |
| 1436 | 1443 | 1444 | 1462 | 1465 | 1513 | 1519 | 1532 | 1586 | 1597 | 1602 | 1616 |
| 1636 | 1645 | 1690 | 1701 | 1707 | 1733 | 1746 | 1750 | 1765 | 1783 | 1786 | 1810 |
| 1813 | 1881 | 1885 | 1945 | 1946 | 1947 | 1959 | 1985 | 2000 | 2035 | 2038 | 2046 |
| 2177 | 2178 | 2224 | 2228 | 2264 | 2271 | 2275 | 2304 | 2390 | 2396 | 2408 | 2410 |
| 2419 | 2420 | 2436 | 2477 | 2512 | 2516 | 2559 | 2566 | 2580 | 2642 | 2699 | 2867 |
| 2957 | 3012 | 3119 | 3141 | 3146 | 3157 | 3180 | 3198 | 3199 | 3212 | 3213 | 3244 |
| 3250 | 3288 | 3297 | 3302 | 3334 | 3387 | 3412 | 3413 | 3416 | 3455 | 3466 | 3472 |

TABLE 11-continued

Osmotic Tolerance

| 3549 | 3638 | 3699 | 3702 | 3744 | 3767 | 3797 | 3833 | 3850 | 3859 | 3861 | 3891 |
|---|---|---|---|---|---|---|---|---|---|---|---|
| 3917 | 3955 | 3962 | 4069 | 4080 | 4092 | 4105 | 4112 | 4141 | 4505 | 4726 | 4762 |
| 5164 | 5298 | 5469 | 5562 | 5647 | 5684 | 5704 | 5858 | 5927 | 5943 | 6030 | 6092 |
| 6219 | 6395 | 6457 | 6527 | 6614 | 6707 | 6729 | 6745 | 6752 | 6930 | 7263 | 7485 |
| 7521 | 7756 | 8140 | 8265 | 8319 | 8448 | 8453 | 8620 | 8658 | 8660 | 8778 | 9008 |
| 9043 | 9138 | 9153 | 9156 | 9580 | 9635 | 9812 | 9940 | 9973 | 9979 | 10025 | 10030 |
| 10031 | 10068 | 10104 | 10123 | 10137 | 10163 | 10177 | 10180 | 10296 | 10314 | 10336 | 10511 |
| 10534 | 10643 | 10978 | 11171 | 11249 | 11309 | 11570 | 11661 | 11997 | 12041 | 12211 | 12372 |
| 12374 | 12425 | 12445 | 12482 | 12508 | 12522 | 12537 | 12560 | 12572 | 12621 | 12636 | 12652 |
| 12675 | 12681 | 12684 | 12729 | 12747 | 12757 | 12792 | 12829 | 12860 | 12880 | 12935 | 12964 |
| 12973 | 13049 | 13068 | 13123 | 13124 | 13126 | 13179 | 13186 | 13218 | 13280 | 13283 | 13287 |
| 13295 | 13301 | 13326 | 13328 | 13382 | 13397 | 13573 | 13591 | 13713 | 13724 | 13788 | 13816 |
| 13817 | 13953 | 14046 | 14065 | 14075 | 14232 | 14371 | 14551 | 14610 | 14615 | 15040 | 15060 |
| 15120 | 15442 | 15653 | 15811 | 16038 | 16043 | 16190 | 16484 | 16515 | 16595 | 16608 | 16653 |
| 16728 | 16836 | 17159 | 17221 | 17234 | 17326 | 17442 | 17572 | 17615 | 17658 | 18015 | 18054 |
| 18072 | 18103 | 18327 | 18328 | 18329 | 18367 | 18432 | 18498 | 18519 | 18804 | 18978 | 19028 |
| 19086 | 19095 | 19133 | 19216 | 19222 | 19277 | 19399 | 19578 | 19931 | 19933 | 20023 | 20133 |
| 20243 | 20404 | 20449 | 20734 | 20739 | 20798 | 20801 | 20885 | 21137 | 21147 | 21148 | 21208 |
| 21215 | 21261 | 21267 | 21323 | 21329 | 21701 | 21872 | 21991 | 22025 | 22035 | 22036 | 22054 |
| 22076 | 22082 | 22102 | 22109 | 22148 | 22158 | 22190 | 22237 | 22255 | 22266 | 22275 | 22290 |
| 22306 | 22314 | 22335 | 22345 | 22350 | 22373 | 22385 | 22392 | 22422 | 22431 | 22442 | 22447 |
| 22515 | 22583 | 22602 | 22693 | 22701 | 22704 | 22738 | 22760 | 22767 | 22792 | 22799 | 22828 |
| 23057 | 23058 | 23064 | 23099 | 23157 | 23182 | 23188 | 23207 | 23213 | 23258 | 23321 | 23348 |
| 23367 | 23382 | 23479 | 23513 | 23516 | 23578 | 23604 | 23610 | 23621 | 23670 | | |

Table 11B SEQ ID NOs of Polynucleotides useful for improving Osmotic Tolerance

| 23702 | 23788 | 23809 | 23914 | 23929 | 23960 | 24037 | 24043 | 24093 | 24100 | 24116 | 24132 |
|---|---|---|---|---|---|---|---|---|---|---|---|
| 24150 | 24369 | 24387 | 24401 | 24414 | 24513 | 24585 | 24819 | 25028 | 25072 | 25101 | 25119 |
| 25123 | 25130 | 25131 | 25149 | 25152 | 25200 | 25206 | 25219 | 25273 | 25284 | 25289 | 25303 |
| 25323 | 25332 | 25377 | 25388 | 25394 | 25420 | 25433 | 25437 | 25452 | 25470 | 25473 | 25497 |
| 25500 | 25568 | 25572 | 25632 | 25633 | 25634 | 25646 | 25672 | 25687 | 25722 | 25725 | 25733 |
| 25864 | 25865 | 25911 | 25915 | 25951 | 25958 | 25962 | 25991 | 26077 | 26083 | 26095 | 26097 |
| 26106 | 26107 | 26123 | 26164 | 26199 | 26203 | 26246 | 26253 | 26267 | 26329 | 26386 | 26554 |
| 26644 | 26699 | 26806 | 26828 | 26833 | 26844 | 26867 | 26885 | 26886 | 26899 | 26900 | 26931 |
| 26937 | 26975 | 26984 | 26989 | 27021 | 27074 | 27099 | 27100 | 27103 | 27142 | 27153 | 27159 |
| 27236 | 27325 | 27386 | 27389 | 27431 | 27454 | 27484 | 27520 | 27537 | 27546 | 27548 | 27578 |
| 27604 | 27642 | 27649 | 27756 | 27767 | 27779 | 27792 | 27799 | 27828 | 28192 | 28413 | 28449 |
| 28851 | 28985 | 29156 | 29249 | 29334 | 29371 | 29391 | 29545 | 29614 | 29630 | 29717 | 29779 |
| 29906 | 30082 | 30144 | 30214 | 30301 | 30394 | 30416 | 30432 | 30439 | 30617 | 30950 | 31172 |
| 31208 | 31443 | 31827 | 31952 | 32006 | 32135 | 32140 | 32307 | 32345 | 32347 | 32465 | 32695 |
| 32730 | 32825 | 32840 | 32843 | 33267 | 33322 | 33499 | 33627 | 33660 | 33666 | 33712 | 33717 |
| 33718 | 33755 | 33791 | 33810 | 33824 | 33850 | 33864 | 33867 | 33983 | 34001 | 34023 | 34198 |
| 34221 | 34330 | 34665 | 34858 | 34936 | 34996 | 35257 | 35348 | 35684 | 35728 | 35898 | 36059 |
| 36061 | 36112 | 36132 | 36169 | 36195 | 36209 | 36224 | 36247 | 36259 | 36308 | 36323 | 36339 |
| 36362 | 36368 | 36371 | 36416 | 36434 | 36444 | 36479 | 36516 | 36547 | 36567 | 36622 | 36651 |
| 36660 | 36736 | 36755 | 36810 | 36811 | 36813 | 36866 | 36873 | 36905 | 36967 | 36970 | 36974 |
| 36982 | 36988 | 37013 | 37015 | 37069 | 37084 | 37260 | 37278 | 37400 | 37411 | 37475 | 37503 |
| 37504 | 37640 | 37733 | 37752 | 37762 | 37919 | 38058 | 38238 | 38297 | 38302 | 38727 | 38747 |
| 38807 | 39129 | 39340 | 39498 | 39725 | 39730 | 39877 | 40171 | 40206 | 40282 | 40295 | 40340 |
| 40415 | 40523 | 40846 | 40908 | 40921 | 41013 | 41129 | 41259 | 41302 | 41345 | 41702 | 41741 |
| 41759 | 41790 | 42014 | 42015 | 42016 | 42054 | 42119 | 42185 | 42206 | 42491 | 42665 | 42715 |
| 42773 | 42782 | 42820 | 42903 | 42909 | 42964 | 43086 | 43265 | 43618 | 43620 | 43710 | 43820 |
| 43930 | 44091 | 44136 | 44421 | 44426 | 44485 | 44488 | 44572 | 44824 | 44834 | 44835 | 44895 |
| 44902 | 44948 | 44954 | 45010 | 45016 | 45388 | 45559 | 45678 | 45712 | 45722 | 45723 | 45741 |
| 45763 | 45769 | 45789 | 45796 | 45835 | 45845 | 45877 | 45924 | 45942 | 45953 | 45962 | 45977 |
| 45993 | 46001 | 46022 | 46032 | 46037 | 46060 | 46072 | 46079 | 46109 | 46118 | 46129 | 46134 |
| 46202 | 46270 | 46289 | 46380 | 46388 | 46391 | 46425 | 46447 | 46454 | 46479 | 46486 | 46515 |
| 46744 | 46745 | 46751 | 46786 | 46844 | 46869 | 46875 | 46894 | 46900 | 46945 | 47008 | 47035 |
| 47054 | 47069 | 47166 | 47200 | 47203 | 47265 | 47291 | 47297 | 47308 | 47357 | | |

TABLE 12

Pathogen/Pest Tolerance

Table 12A SEQ ID NOs of Polypeptides useful for improving Pathogen/Pest Tolerance

| 20 | 67 | 71 | 98 | 102 | 126 | 168 | 176 | 189 | 191 | 195 | 221 |
|---|---|---|---|---|---|---|---|---|---|---|---|
| 239 | 245 | 298 | 308 | 309 | 330 | 338 | 351 | 365 | 373 | 414 | 509 |
| 539 | 555 | 556 | 558 | 566 | 571 | 585 | 592 | 611 | 616 | 621 | 631 |
| 645 | 648 | 734 | 750 | 777 | 838 | 955 | 956 | 957 | 1022 | 1048 | 1050 |
| 1054 | 1084 | 1110 | 1157 | 1161 | 1195 | 1205 | 1253 | 1275 | 1300 | 1311 | 1333 |
| 1358 | 1394 | 1401 | 1403 | 1409 | 1411 | 1417 | 1418 | 1419 | 1423 | 1425 | 1441 |
| 1447 | 1453 | 1454 | 1459 | 1469 | 1479 | 1486 | 1488 | 1494 | 1507 | 1508 | 1517 |

TABLE 12-continued

| \multicolumn{12}{c}{Pathogen/Pest Tolerance} |
|---|---|---|---|---|---|---|---|---|---|---|---|
| 1535 | 1544 | 1546 | 1571 | 1573 | 1590 | 1596 | 1599 | 1601 | 1623 | 1636 | 1639 |
| 1657 | 1661 | 1665 | 1685 | 1691 | 1697 | 1716 | 1724 | 1725 | 1730 | 1732 | 1751 |
| 1754 | 1756 | 1759 | 1760 | 1769 | 1772 | 1773 | 1786 | 1809 | 1814 | 1821 | 1822 |
| 1826 | 1827 | 1831 | 1846 | 1855 | 1872 | 1877 | 1880 | 1885 | 1892 | 1893 | 1899 |
| 1910 | 1914 | 1926 | 1929 | 1930 | 1931 | 1935 | 1943 | 1951 | 1953 | 1956 | 1962 |
| 1963 | 1979 | 1985 | 1987 | 1989 | 2004 | 2007 | 2018 | 2051 | 2057 | 2059 | 2067 |
| 2071 | 2079 | 2083 | 2089 | 2095 | 2100 | 2105 | 2107 | 2115 | 2121 | 2126 | 2131 |
| 2146 | 2157 | 2158 | 2180 | 2184 | 2192 | 2205 | 2212 | 2226 | 2230 | 2233 | 2243 |
| 2244 | 2249 | 2252 | 2253 | 2254 | 2260 | 2262 | 2264 | 2269 | 2272 | 2274 | 2279 |
| 2286 | 2294 | 2301 | 2306 | 2308 | 2315 | 2321 | 2333 | 2338 | 2341 | 2345 | 2352 |
| 2355 | 2357 | 2369 | 2373 | 2384 | 2387 | 2390 | 2392 | 2397 | 2402 | 2406 | 2419 |
| 2420 | 2436 | 2457 | 2464 | 2476 | 2477 | 2481 | 2482 | 2483 | 2490 | 2494 | 2499 |
| 2503 | 2510 | 2516 | 2517 | 2518 | 2530 | 2531 | 2536 | 2538 | 2540 | 2549 | 2554 |
| 2566 | 2569 | 2570 | 2579 | 2588 | 2638 | 2653 | 2683 | 2702 | 2708 | 2741 | 2750 |
| 2757 | 2762 | 2769 | 2770 | 2791 | 2798 | 2805 | 2806 | 2857 | 2862 | 2866 | 2878 |
| 2902 | 2925 | 2936 | 2958 | 3018 | 3026 | 3050 | 3061 | 3066 | 3074 | 3079 | 3088 |
| 3096 | 3100 | 3105 | 3109 | 3115 | 3120 | 3121 | 3126 | 3146 | 3150 | 3156 | 3166 |
| 3169 | 3170 | 3171 | 3172 | 3173 | 3175 | 3182 | 3185 | 3202 | 3203 | 3207 | 3216 |
| 3217 | 3221 | 3226 | 3231 | 3238 | 3240 | 3259 | 3266 | 3269 | 3273 | 3282 | 3284 |
| 3288 | 3292 | 3302 | 3307 | 3312 | 3342 | 3344 | 3345 | 3350 | 3353 | 3354 | 3355 |
| 3365 | 3389 | 3394 | 3404 | 3410 | 3413 | 3422 | 3425 | 3426 | 3427 | 3430 | 3431 |
| 3452 | 3461 | 3471 | 3481 | 3483 | 3485 | 3488 | 3489 | 3495 | 3520 | 3525 | 3527 |
| 3542 | 3558 | 3563 | 3583 | 3597 | 3599 | 3602 | 3615 | 3618 | 3619 | 3632 | 3634 |
| 3655 | 3658 | 3661 | 3694 | 3700 | 3703 | 3715 | 3722 | 3741 | 3775 | 3778 | 3783 |
| 3785 | 3788 | 3792 | 3797 | 3798 | 3803 | 3808 | 3813 | 3843 | 3845 | 3851 | 3868 |
| 3872 | 3877 | 3879 | 3886 | 3891 | 3907 | 3911 | 3912 | 3913 | 3917 | 3934 | 3938 |
| 3955 | 3966 | 3979 | 3983 | 3990 | 3993 | 3998 | 4001 | 4002 | 4016 | 4018 | 4031 |
| 4032 | 4041 | 4043 | 4075 | 4078 | 4083 | 4086 | 4091 | 4098 | 4100 | 4105 | 4111 |
| 4117 | 4130 | 4145 | 4146 | 4154 | 4161 | 4166 | 4169 | 4173 | 4209 | 4216 | 4225 |
| 4228 | 4240 | 4337 | 4361 | 4369 | 4391 | 4397 | 4413 | 4444 | 4450 | 4493 | 4663 |
| 4664 | 4689 | 4713 | 4804 | 4807 | 4833 | 4849 | 4874 | 4885 | 4897 | 4955 | 4968 |
| 4975 | 4976 | 4989 | 5007 | 5008 | 5012 | 5015 | 5035 | 5045 | 5050 | 5062 | 5065 |
| 5067 | 5068 | 5070 | 5071 | 5072 | 5073 | 5074 | 5093 | 5098 | 5103 | 5105 | 5116 |
| 5117 | 5118 | 5126 | 5134 | 5154 | 5155 | 5157 | 5164 | 5176 | 5177 | 5184 | 5202 |
| 5208 | 5213 | 5217 | 5225 | 5228 | 5230 | 5238 | 5239 | 5241 | 5244 | 5245 | 5245 |
| 5247 | 5248 | 5249 | 5250 | 5251 | 5252 | 5275 | 5277 | 5286 | 5294 | 5300 | 5302 |
| 5306 | 5313 | 5314 | 5317 | 5332 | 5333 | 5335 | 5340 | 5343 | 5344 | 5348 | 5349 |
| 5350 | 5351 | 5352 | 5353 | 5354 | 5355 | 5358 | 5361 | 5371 | 5374 | 5379 | 5382 |
| 5383 | 5390 | 5394 | 5397 | 5398 | 5408 | 5411 | 5415 | 5419 | 5423 | 5446 | 5448 |
| 5452 | 5469 | 5472 | 5473 | 5491 | 5494 | 5499 | 5515 | 5535 | 5542 | 5545 | 5546 |
| 5550 | 5551 | 5562 | 5583 | 5586 | 5587 | 5590 | 5592 | 5593 | 5606 | 5611 | 5625 |
| 5626 | 5638 | 5657 | 5658 | 5659 | 5660 | 5684 | 5695 | 5698 | 5699 | 5700 | 5709 |
| 5714 | 5717 | 5725 | 5738 | 5749 | 5753 | 5756 | 5775 | 5784 | 5785 | 5789 |  |
| 5795 | 5799 | 5804 | 5814 | 5827 | 5837 | 5850 | 5855 | 5864 | 5865 | 5866 | 5879 |
| 5903 | 5927 | 5935 | 5936 | 5937 | 5951 | 5961 | 5965 | 5968 | 5990 | 5998 | 6007 |
| 6008 | 6013 | 6016 | 6026 | 6030 | 6036 | 6044 | 6062 | 6068 | 6083 | 6088 | 6089 |
| 6095 | 6096 | 6115 | 6126 | 6142 | 6143 | 6144 | 6160 | 6163 | 6198 | 6210 | 6223 |
| 6229 | 6231 | 6233 | 6257 | 6258 | 6259 | 6260 | 6264 | 6265 | 6266 | 6285 | 6286 |
| 6287 | 6309 | 6310 | 6314 | 6329 | 6334 | 6336 | 6337 | 6341 | 6343 | 6358 | 6359 |
| 6363 | 6374 | 6381 | 6402 | 6403 | 6404 | 6405 | 6416 | 6417 | 6418 | 6421 | 6427 |
| 6436 | 6441 | 6442 | 6443 | 6451 | 6452 | 6454 | 6455 | 6456 | 6457 | 6459 | 6461 |
| 6462 | 6476 | 6509 | 6510 | 6512 | 6514 | 6515 | 6517 | 6518 | 6520 | 6531 | 6532 |
| 6535 | 6536 | 6538 | 6539 | 6543 | 6546 | 6548 | 6549 | 6560 | 6567 | 6593 | 6595 |
| 6610 | 6611 | 6619 | 6622 | 6623 | 6643 | 6645 | 6672 | 6675 | 6680 | 6681 | 6695 |
| 6702 | 6703 | 6706 | 6728 | 6734 | 6740 | 6773 | 6776 | 6777 | 6780 | 6792 | 6795 |
| 6798 | 6799 | 6802 | 6810 | 6828 | 6836 | 6842 | 6850 | 6851 | 6854 | 6869 | 6870 |
| 6879 | 6880 | 6886 | 6920 | 6945 | 6959 | 6960 | 6962 | 6977 | 6981 | 6982 | 6991 |
| 6992 | 7000 | 7002 | 7003 | 7004 | 7006 | 7011 | 7024 | 7092 | 7115 | 7123 | 7146 |
| 7152 | 7169 | 7203 | 7210 | 7252 | 7422 | 7423 | 7432 | 7448 | 7473 | 7563 | 7566 |
| 7592 | 7608 | 7634 | 7643 | 7655 | 7713 | 7726 | 7794 | 7799 | 7831 | 7837 | 7908 |
| 7959 | 7992 | 8000 | 8024 | 8039 | 8064 | 8066 | 8082 | 8096 | 8100 | 8128 | 8159 |
| 8177 | 8219 | 8241 | 8289 | 8292 | 8311 | 8375 | 8376 | 8381 | 8434 | 8462 | 8489 |
| 8511 | 8575 | 8578 | 8615 | 8707 | 8792 | 8897 | 8902 | 8907 | 8915 | 8922 | 8932 |
| 8969 | 9004 | 9010 | 9018 | 9029 | 9035 | 9112 | 9124 | 9135 | 9140 | 9160 | 9161 |
| 9166 | 9191 | 9196 | 9203 | 9204 | 9205 | 9270 | 9328 | 9347 | 9353 | 9374 | 9384 |
| 9417 | 9440 | 9459 | 9493 | 9506 | 9522 | 9529 | 9553 | 9589 | 9616 | 9654 | 9656 |
| 9696 | 9700 | 9707 | 9717 | 9794 | 9806 | 9881 | 9925 | 9928 | 9961 | 9982 | 9983 |
| 10001 | 10018 | 10026 | 10058 | 10073 | 10143 | 10157 | 10159 | 10172 | 10178 | 10183 | 10234 |
| 10236 | 10239 | 10240 | 10242 | 10243 | 10244 | 10249 | 10268 | 10286 | 10297 | 10319 | 10368 |
| 10381 | 10398 | 10440 | 10443 | 10446 | 10514 | 10515 | 10521 | 10602 | 10608 | 10615 | 10623 |
| 10670 | 10676 | 10687 | 10797 | 10800 | 10802 | 10827 | 10845 | 10854 | 10899 | 10922 | 10929 |
| 10942 | 10985 | 11014 | 11032 | 11047 | 11088 | 11135 | 11146 | 11150 | 11154 | 11178 |  |
| 11200 | 11202 | 11222 | 11282 | 11298 | 11313 | 11347 | 11351 | 11352 | 11364 | 11365 | 11366 |
| 11371 | 11393 | 11483 | 11498 | 11506 | 11578 | 11590 | 11594 | 11597 | 11612 | 11629 | 11632 |
| 11681 | 11704 | 11710 | 11748 | 11768 | 11795 | 11834 | 11839 | 11920 | 11976 | 11978 | 11982 |
| 11985 | 12006 | 12023 | 12042 | 12062 | 12086 | 12112 | 12275 | 12282 | 12291 | 12304 | 12316 |
| 12332 | 12333 | 12348 | 12349 | 12366 | 12372 | 12390 | 12393 | 12401 | 12408 | 12414 | 12422 |

TABLE 12-continued

| Pathogen/Pest Tolerance | | | | | | | | | | | |
|---|---|---|---|---|---|---|---|---|---|---|---|
| 12426 | 12427 | 12430 | 12437 | 12449 | 12451 | 12453 | 12468 | 12477 | 12480 | 12496 | 12503 |
| 12509 | 12516 | 12531 | 12556 | 12566 | 12598 | 12611 | 12613 | 12643 | 12655 | 12683 | 12693 |
| 12702 | 12708 | 12713 | 12717 | 12729 | 12730 | 12741 | 12747 | 12750 | 12778 | 12786 | 12788 |
| 12802 | 12808 | 12828 | 12838 | 12849 | 12857 | 12866 | 12871 | 12874 | 12887 | 12894 | 12902 |
| 12906 | 12916 | 12918 | 12923 | 12937 | 12938 | 12949 | 12987 | 12990 | 12995 | 13011 | 13040 |
| 13054 | 13057 | 13072 | 13073 | 13074 | 13090 | 13091 | 13092 | 13099 | 13102 | 13106 | 13108 |
| 13136 | 13140 | 13146 | 13167 | 13179 | 13188 | 13195 | 13197 | 13203 | 13204 | 13212 | 13225 |
| 13230 | 13233 | 13239 | 13240 | 13242 | 13247 | 13256 | 13257 | 13258 | 13271 | 13277 | 13287 |
| 13295 | 13304 | 13319 | 13324 | 13327 | 13331 | 13333 | 13338 | 13365 | 13371 | 13379 | 13387 |
| 13393 | 13406 | 13421 | 13429 | 13432 | 13434 | 13435 | 13488 | 13491 | 13540 | 13554 | 13558 |
| 13614 | 13615 | 13662 | 13666 | 13688 | 13707 | 13709 | 13712 | 13722 | 13739 | 13744 | 13749 |
| 13764 | 13770 | 13825 | 13906 | 13955 | 13980 | 13994 | 14009 | 14055 | 14061 | 14063 | 14067 |
| 14131 | 14145 | 14194 | 14242 | 14265 | 14266 | 14322 | 14384 | 14385 | 14403 | 14404 | 14431 |
| 14449 | 14501 | 14510 | 14526 | 14529 | 14534 | 14543 | 14615 | 14644 | 14696 | 14747 | 14769 |
| 14785 | 14795 | 14810 | 14832 | 14847 | 14848 | 14849 | 14894 | 14920 | 14962 | 14980 | 14983 |
| 15016 | 15020 | 15037 | 15038 | 15047 | 15058 | 15060 | 15087 | 15109 | 15177 | 15225 | 15247 |
| 15310 | 15339 | 15345 | 15358 | 15364 | 15365 | 15366 | 15386 | 15387 | 15389 | 15409 | 15418 |
| 15431 | 15445 | 15447 | 15451 | 15452 | 15453 | 15499 | 15507 | 15508 | 15517 | 15524 | 15543 |
| 15562 | 15592 | 15599 | 15605 | 15631 | 15642 | 15647 | 15648 | 15649 | 15650 | 15651 | 15652 |
| 15654 | 15655 | 15656 | 15659 | 15676 | 15706 | 15712 | 15725 | 15731 | 15732 | 15754 | 15755 |
| 15757 | 15777 | 15786 | 15800 | 15813 | 15815 | 15819 | 15820 | 15821 | 15870 | 15879 | 15880 |
| 15889 | 15895 | 15915 | 15935 | 15951 | 15968 | 15976 | 15980 | 16006 | 16017 | 16023 | 16024 |
| 16025 | 16026 | 16027 | 16028 | 16029 | 16030 | 16031 | 16033 | 16034 | 16035 | 16036 | 16037 |
| 16039 | 16041 | 16042 | 16045 | 16046 | 16047 | 16067 | 16096 | 16101 | 16110 | 16116 | 16117 |
| 16140 | 16141 | 16168 | 16182 | 16195 | 16197 | 16201 | 16202 | 16245 | 16252 | 16260 | 16268 |
| 16286 | 16303 | 16315 | 16330 | 16333 | 16340 | 16360 | 16370 | 16391 | 16410 | 16420 | 16421 |
| 16426 | 16429 | 16435 | 16450 | 16453 | 16457 | 16463 | 16530 | 16579 | 16622 | 16635 | 16671 |
| 16715 | 16732 | 16824 | 16828 | 16834 | 16849 | 16866 | 16891 | 16920 | 16934 | 16953 | 16970 |
| 16990 | 17020 | 17042 | 17054 | 17066 | 17082 | 17100 | 17101 | 17141 | 17158 | 17183 | 17220 |
| 17268 | 17282 | 17294 | 17304 | 17318 | 17373 | 17375 | 17376 | 17386 | 17467 | 17491 | 17492 |
| 17514 | 17521 | 17569 | 17576 | 17593 | 17597 | 17624 | 17627 | 17682 | 17688 | 17710 |
| 17724 | 17765 | 17797 | 17802 | 17826 | 17828 | 17844 | 17874 | 17875 | 17879 | 17889 | 17890 |
| 17894 | 17915 | 17919 | 17926 | 17930 | 17937 | 17945 | 17948 | 17969 | 17981 | 18030 | 18031 |
| 18035 | 18048 | 18049 | 18058 | 18063 | 18067 | 18070 | 18071 | 18073 | 18074 | 18075 | 18076 |
| 18077 | 18078 | 18079 | 18080 | 18133 | 18134 | 18172 | 18180 | 18200 | 18203 | 18260 | 18290 |
| 18319 | 18341 | 18348 | 18379 | 18417 | 18442 | 18448 | 18460 | 18473 | 18474 | 18475 | 18492 |
| 18540 | 18562 | 18590 | 18628 | 18629 | 18641 | 18643 | 18665 | 18667 | 18749 | 18772 | 18773 |
| 18795 | 18796 | 18800 | 18824 | 18854 | 18882 | 18886 | 18892 | 18913 | 18914 | 18936 | 18985 |
| 18992 | 18993 | 18999 | 19000 | 19052 | 19109 | 19111 | 19123 | 19132 | 19135 | 19137 | 19140 |
| 19141 | 19148 | 19153 | 19162 | 19170 | 19186 | 19192 | 19195 | 19205 | 19209 | 19217 | 19241 |
| 19247 | 19254 | 19264 | 19266 | 19267 | 19270 | 19284 | 19299 | 19320 | 19323 | 19335 | 19349 |
| 19353 | 19374 | 19375 | 19382 | 19389 | 19402 | 19403 | 19413 | 19430 | 19432 | 19434 | 19443 |
| 19452 | 19462 | 19463 | 19467 | 19475 | 19515 | 19535 | 19537 | 19553 | 19568 | 19579 | 19591 |
| 19596 | 19607 | 19618 | 19625 | 19629 | 19725 | 19734 | 19762 | 19772 | 19779 | 19780 | 19789 |
| 19791 | 19795 | 19826 | 19842 | 19846 | 19852 | 19878 | 19887 | 19909 | 19916 | 19979 | 19989 |
| 20021 | 20033 | 20047 | 20114 | 20115 | 20117 | 20171 | 20192 | 20211 | 20216 | 20217 | 20221 |
| 20232 | 20264 | 20291 | 20294 | 20320 | 20341 | 20366 | 20376 | 20488 | 20521 | 20562 |
| 20607 | 20627 | 20642 | 20645 | 20653 | 20654 | 20784 | 20797 | 20819 | 20848 | 20872 | 20896 |
| 20911 | 20935 | 20942 | 20947 | 20953 | 20957 | 20988 | 20989 | 21005 | 21007 | 21052 | 21076 |
| 21098 | 21109 | 21121 | 21201 | 21218 | 21222 | 21223 | 21268 | 21292 | 21347 | 21351 | 21394 |
| 21406 | 21442 | 21475 | 21528 | 21547 | 21549 | 21561 | 21587 | 21600 | 21619 | 21632 | 21660 |
| 21711 | 21726 | 21775 | 21798 | 21807 | 21823 | 21825 | 21850 | 21879 | 21880 | 21881 | 21892 |
| 21894 | 21909 | 21929 | 21943 | 21946 | 21948 | 21951 | 21961 | 21962 | 21969 | 21971 | 21980 |
| 21982 | 21990 | 21994 | 22000 | 22010 | 22011 | 22013 | 22016 | 22026 | 22028 | 22029 | 22034 |
| 22037 | 22040 | 22050 | 22054 | 22055 | 22064 | 22066 | 22070 | 22071 | 22077 | 22078 | 22086 |
| 22094 | 22096 | 22098 | 22109 | 22111 | 22113 | 22123 | 22124 | 22126 | 22131 | 22135 | 22139 |
| 22140 | 22141 | 22144 | 22158 | 22166 | 22167 | 22176 | 22177 | 22190 | 22194 | 22195 | 22197 |
| 22202 | 22206 | 22207 | 22220 | 22226 | 22227 | 22229 | 22233 | 22236 | 22237 | 22244 | 22252 |
| 22266 | 22279 | 22281 | 22287 | 22293 | 22296 | 22297 | 22298 | 22314 | 22322 | 22323 | 22328 |
| 22340 | 22350 | 22351 | 22352 | 22367 | 22371 | 22374 | 22381 | 22397 | 22399 | 22406 | 22407 |
| 22408 | 22433 | 22436 | 22470 | 22490 | 22493 | 22498 | 22512 | 22515 | 22527 | 22532 | 22538 |
| 22545 | 22546 | 22555 | 22560 | 22581 | 22590 | 22595 | 22599 | 22603 | 22606 | 22614 | 22616 |
| 22619 | 22640 | 22642 | 22644 | 22645 | 22646 | 22652 | 22681 | 22682 | 22688 | 22689 | 22690 |
| 22701 | 22705 | 22706 | 22710 | 22724 | 22725 | 22726 | 22727 | 22728 | 22739 | 22755 | 22759 |
| 22772 | 22775 | 22782 | 22786 | 22791 | 22793 | 22797 | 22805 | 22806 | 22807 | 22808 | 22816 |
| 22848 | 22868 | 22894 | 22897 | 22936 | 22966 | 23003 | 23021 | 23049 | 23050 | 23071 | 23110 |
| 23129 | 23224 | 23272 | 23290 | 23313 | 23416 | 23430 | 23431 | 23463 | 23500 | 23504 | 23508 |
| 23533 | 23544 | 23567 | 23583 | 23593 | 23608 | 23633 | 23673 | | | | |

| Table 12B SEQ ID NOs of Polynucleotides useful for improving Pathogen/Pest Tolerance | | | | | | | | | | | |
|---|---|---|---|---|---|---|---|---|---|---|---|
| 23707 | 23754 | 23758 | 23785 | 23789 | 23813 | 23855 | 23863 | 23876 | 23878 | 23882 | 23908 |
| 23926 | 23932 | 23985 | 23995 | 23996 | 24017 | 24025 | 24038 | 24052 | 24060 | 24101 | 24196 |
| 24226 | 24242 | 24243 | 24245 | 24253 | 24258 | 24272 | 24279 | 24298 | 24303 | 24308 | 24318 |
| 24332 | 24335 | 24421 | 24437 | 24464 | 24525 | 24642 | 24643 | 24644 | 24709 | 24735 | 24737 |
| 24741 | 24771 | 24797 | 24844 | 24848 | 24882 | 24892 | 24940 | 24962 | 24987 | 24998 | 25020 |
| 25045 | 25081 | 25088 | 25090 | 25096 | 25098 | 25104 | 25105 | 25106 | 25110 | 25112 | 25128 |

TABLE 12-continued

Pathogen/Pest Tolerance

| | | | | | | | | | | | |
|---|---|---|---|---|---|---|---|---|---|---|---|
| 25134 | 25140 | 25141 | 25146 | 25156 | 25166 | 25173 | 25175 | 25181 | 25194 | 25195 | 25204 |
| 25222 | 25231 | 25233 | 25258 | 25260 | 25277 | 25283 | 25286 | 25288 | 25310 | 25323 | 25326 |
| 25344 | 25348 | 25352 | 25372 | 25378 | 25384 | 25403 | 25411 | 25412 | 25417 | 25419 | 25438 |
| 25441 | 25443 | 25446 | 25447 | 25456 | 25459 | 25460 | 25473 | 25496 | 25501 | 25508 | 25509 |
| 25513 | 25514 | 25518 | 25533 | 25542 | 25559 | 25564 | 25567 | 25572 | 25579 | 25580 | 25586 |
| 25597 | 25601 | 25613 | 25616 | 25617 | 25618 | 25622 | 25630 | 25638 | 25640 | 25643 | 25649 |
| 25650 | 25666 | 25672 | 25674 | 25676 | 25691 | 25694 | 25705 | 25738 | 25744 | 25746 | 25754 |
| 25758 | 25766 | 25770 | 25776 | 25782 | 25787 | 25792 | 25794 | 25802 | 25808 | 25813 | 25818 |
| 25833 | 25844 | 25845 | 25867 | 25871 | 25879 | 25892 | 25899 | 25913 | 25917 | 25920 | 25930 |
| 25931 | 25936 | 25939 | 25940 | 25941 | 25947 | 25949 | 25951 | 25956 | 25959 | 25961 | 25966 |
| 25973 | 25981 | 25988 | 25993 | 25995 | 26002 | 26008 | 26020 | 26025 | 26028 | 26032 | 26039 |
| 26042 | 26044 | 26056 | 26060 | 26071 | 26074 | 26077 | 26079 | 26084 | 26089 | 26093 | 26106 |
| 26107 | 26123 | 26144 | 26151 | 26163 | 26164 | 26168 | 26169 | 26170 | 26177 | 26181 | 26186 |
| 26190 | 26197 | 26203 | 26204 | 26205 | 26217 | 26218 | 26223 | 26225 | 26227 | 26236 | 26241 |
| 26253 | 26256 | 26257 | 26266 | 26275 | 26325 | 26340 | 26370 | 26389 | 26395 | 26428 | 26437 |
| 26444 | 26449 | 26456 | 26457 | 26478 | 26485 | 26492 | 26493 | 26544 | 26549 | 26553 | 26565 |
| 26589 | 26612 | 26623 | 26645 | 26705 | 26713 | 26737 | 26748 | 26753 | 26761 | 26766 | 26775 |
| 26783 | 26787 | 26792 | 26796 | 26802 | 26807 | 26808 | 26813 | 26833 | 26837 | 26843 | 26853 |
| 26856 | 26857 | 26858 | 26859 | 26860 | 26862 | 26869 | 26872 | 26889 | 26890 | 26894 | 26903 |
| 26904 | 26908 | 26913 | 26918 | 26925 | 26927 | 26946 | 26953 | 26956 | 26960 | 26969 | 26971 |
| 26975 | 26979 | 26989 | 26994 | 26999 | 27029 | 27031 | 27032 | 27037 | 27040 | 27041 | 27042 |
| 27052 | 27076 | 27081 | 27091 | 27097 | 27100 | 27109 | 27112 | 27113 | 27114 | 27117 | 27118 |
| 27139 | 27148 | 27158 | 27168 | 27170 | 27172 | 27175 | 27176 | 27182 | 27207 | 27212 | 27214 |
| 27229 | 27245 | 27250 | 27270 | 27284 | 27286 | 27289 | 27302 | 27305 | 27306 | 27319 | 27321 |
| 27342 | 27345 | 27348 | 27381 | 27387 | 27390 | 27402 | 27409 | 27428 | 27462 | 27465 | 27470 |
| 27472 | 27475 | 27479 | 27484 | 27485 | 27490 | 27495 | 27500 | 27530 | 27532 | 27538 | 27555 |
| 27559 | 27564 | 27566 | 27573 | 27578 | 27594 | 27598 | 27599 | 27600 | 27604 | 27621 | 27625 |
| 27642 | 27653 | 27666 | 27670 | 27677 | 27680 | 27685 | 27688 | 27689 | 27703 | 27705 | 27718 |
| 27719 | 27728 | 27730 | 27762 | 27765 | 27770 | 27773 | 27778 | 27785 | 27787 | 27792 | 27798 |
| 27804 | 27817 | 27832 | 27833 | 27841 | 27848 | 27853 | 27856 | 27860 | 27896 | 27903 | 27912 |
| 27915 | 27927 | 28024 | 28048 | 28056 | 28078 | 28084 | 28100 | 28131 | 28137 | 28180 | 28350 |
| 28351 | 28376 | 28400 | 28491 | 28494 | 28520 | 28536 | 28561 | 28572 | 28584 | 28642 | 28655 |
| 28662 | 28663 | 28676 | 28694 | 28695 | 28699 | 28702 | 28722 | 28732 | 28737 | 28749 | 28752 |
| 28754 | 28755 | 28757 | 28758 | 28759 | 28760 | 28761 | 28780 | 28785 | 28790 | 28792 | 28803 |
| 28804 | 28805 | 28813 | 28821 | 28841 | 28842 | 28844 | 28863 | 28864 | 28871 | 28889 | |
| 28895 | 28900 | 28904 | 28912 | 28915 | 28917 | 28925 | 28926 | 28927 | 28928 | 28931 | 28932 |
| 28934 | 28935 | 28936 | 28937 | 28938 | 28939 | 28962 | 28964 | 28973 | 28981 | 28987 | 28989 |
| 28993 | 29000 | 29001 | 29004 | 29019 | 29020 | 29022 | 29027 | 29030 | 29031 | 29035 | 29036 |
| 29037 | 29038 | 29039 | 29040 | 29041 | 29042 | 29045 | 29048 | 29058 | 29061 | 29066 | 29069 |
| 29070 | 29077 | 29081 | 29084 | 29085 | 29095 | 29098 | 29102 | 29106 | 29110 | 29133 | 29135 |
| 29139 | 29156 | 29159 | 29160 | 29178 | 29181 | 29186 | 29202 | 29222 | 29229 | 29232 | 29233 |
| 29237 | 29238 | 29249 | 29270 | 29273 | 29274 | 29277 | 29279 | 29280 | 29293 | 29298 | 29312 |
| 29313 | 29325 | 29344 | 29345 | 29346 | 29347 | 29371 | 29382 | 29385 | 29386 | 29387 | 29396 |
| 29401 | 29404 | 29412 | 29425 | 29436 | 29440 | 29443 | 29462 | 29464 | 29471 | 29472 | 29476 |
| 29482 | 29486 | 29491 | 29501 | 29514 | 29524 | 29537 | 29542 | 29551 | 29552 | 29553 | 29566 |
| 29590 | 29614 | 29622 | 29623 | 29624 | 29638 | 29648 | 29652 | 29655 | 29677 | 29685 | 29694 |
| 29695 | 29700 | 29703 | 29713 | 29717 | 29723 | 29731 | 29749 | 29755 | 29770 | 29775 | 29776 |
| 29782 | 29783 | 29802 | 29813 | 29829 | 29830 | 29831 | 29847 | 29850 | 29885 | 29897 | 29910 |
| 29916 | 29918 | 29920 | 29944 | 29945 | 29946 | 29947 | 29951 | 29952 | 29953 | 29972 | 29973 |
| 29974 | 29996 | 29997 | 30001 | 30016 | 30021 | 30023 | 30024 | 30028 | 30030 | 30045 | 30046 |
| 30050 | 30061 | 30068 | 30089 | 30090 | 30091 | 30092 | 30103 | 30104 | 30105 | 30108 | 30114 |
| 30123 | 30128 | 30129 | 30130 | 30138 | 30139 | 30141 | 30142 | 30143 | 30144 | 30146 | 30148 |
| 30149 | 30163 | 30196 | 30197 | 30199 | 30201 | 30202 | 30204 | 30205 | 30207 | 30218 | 30219 |
| 30222 | 30223 | 30225 | 30226 | 30230 | 30233 | 30235 | 30236 | 30247 | 30254 | 30280 | 30282 |
| 30297 | 30298 | 30306 | 30309 | 30310 | 30330 | 30332 | 30359 | 30362 | 30367 | 30368 | 30382 |
| 30389 | 30390 | 30393 | 30415 | 30421 | 30427 | 30460 | 30463 | 30464 | 30467 | 30479 | 30482 |
| 30485 | 30486 | 30489 | 30497 | 30515 | 30523 | 30529 | 30537 | 30538 | 30541 | 30556 | 30557 |
| 30566 | 30567 | 30573 | 30607 | 30632 | 30646 | 30647 | 30649 | 30664 | 30668 | 30669 | 30678 |
| 30679 | 30687 | 30689 | 30690 | 30691 | 30693 | 30698 | 30711 | 30779 | 30802 | 30810 | 30833 |
| 30839 | 30856 | 30890 | 30897 | 30939 | 31109 | 31110 | 31119 | 31135 | 31160 | 31250 | 31253 |
| 31279 | 31295 | 31321 | 31330 | 31342 | 31400 | 31413 | 31481 | 31486 | 31518 | 31524 | 31595 |
| 31646 | 31679 | 31687 | 31711 | 31726 | 31751 | 31753 | 31769 | 31783 | 31787 | 31815 | 31846 |
| 31864 | 31906 | 31928 | 31976 | 31979 | 31998 | 32062 | 32063 | 32068 | 32121 | 32149 | 32176 |
| 32198 | 32262 | 32265 | 32302 | 32394 | 32479 | 32584 | 32594 | 32602 | 32609 | 32619 | |
| 32656 | 32691 | 32697 | 32705 | 32716 | 32722 | 32799 | 32811 | 32822 | 32827 | 32847 | 32848 |
| 32853 | 32878 | 32883 | 32890 | 32891 | 32892 | 32957 | 33015 | 33034 | 33040 | 33061 | 33071 |
| 33104 | 33127 | 33146 | 33180 | 33193 | 33209 | 33216 | 33240 | 33276 | 33303 | 33341 | 33343 |
| 33383 | 33387 | 33394 | 33404 | 33481 | 33493 | 33568 | 33612 | 33615 | 33648 | 33669 | 33670 |
| 33688 | 33705 | 33713 | 33745 | 33760 | 33830 | 33844 | 33846 | 33859 | 33865 | 33870 | 33921 |
| 33923 | 33926 | 33927 | 33929 | 33930 | 33931 | 33936 | 33955 | 33973 | 33984 | 34006 | 34055 |
| 34068 | 34085 | 34127 | 34130 | 34133 | 34201 | 34202 | 34208 | 34289 | 34295 | 34302 | 34310 |
| 34357 | 34363 | 34374 | 34484 | 34487 | 34489 | 34514 | 34532 | 34541 | 34586 | 34609 | 34616 |
| 34629 | 34672 | 34701 | 34719 | 34734 | 34775 | 34822 | 34832 | 34833 | 34837 | 34841 | 34865 |
| 34887 | 34889 | 34909 | 34969 | 34985 | 35000 | 35034 | 35038 | 35039 | 35051 | 35052 | 35053 |
| 35058 | 35080 | 35170 | 35185 | 35193 | 35265 | 35277 | 35281 | 35284 | 35299 | 35316 | 35319 |
| 35368 | 35391 | 35397 | 35435 | 35455 | 35482 | 35521 | 35526 | 35607 | 35663 | 35665 | 35669 |
| 35672 | 35693 | 35710 | 35729 | 35749 | 35773 | 35799 | 35962 | 35969 | 35978 | 35991 | 36003 |

TABLE 12-continued

Pathogen/Pest Tolerance

| | | | | | | | | | | |
|---|---|---|---|---|---|---|---|---|---|---|
| 36019 | 36020 | 36035 | 36036 | 36053 | 36059 | 36077 | 36080 | 36088 | 36095 | 36101 | 36109 |
| 36113 | 36114 | 36117 | 36124 | 36136 | 36138 | 36140 | 36155 | 36164 | 36167 | 36183 | 36190 |
| 36196 | 36203 | 36218 | 36243 | 36253 | 36285 | 36298 | 36300 | 36330 | 36342 | 36370 | 36380 |
| 36389 | 36395 | 36400 | 36404 | 36416 | 36417 | 36428 | 36434 | 36437 | 36465 | 36473 | 36475 |
| 36489 | 36495 | 36515 | 36525 | 36536 | 36544 | 36553 | 36558 | 36561 | 36574 | 36581 | 36589 |
| 36593 | 36603 | 36605 | 36610 | 36624 | 36625 | 36636 | 36674 | 36677 | 36682 | 36698 | 36727 |
| 36741 | 36744 | 36759 | 36760 | 36761 | 36777 | 36778 | 36779 | 36786 | 36789 | 36793 | 36795 |
| 36823 | 36827 | 36833 | 36854 | 36866 | 36875 | 36882 | 36884 | 36890 | 36891 | 36899 | 36912 |
| 36917 | 36920 | 36926 | 36927 | 36929 | 36934 | 36943 | 36944 | 36945 | 36958 | 36964 | 36974 |
| 36982 | 36991 | 37006 | 37011 | 37014 | 37018 | 37020 | 37025 | 37052 | 37058 | 37066 | 37074 |
| 37080 | 37093 | 37108 | 37116 | 37119 | 37121 | 37122 | 37175 | 37178 | 37227 | 37241 | 37245 |
| 37301 | 37302 | 37349 | 37353 | 37375 | 37394 | 37396 | 37399 | 37409 | 37426 | 37431 | 37436 |
| 37451 | 37457 | 37512 | 37593 | 37642 | 37667 | 37681 | 37696 | 37742 | 37748 | 37750 | 37754 |
| 37818 | 37832 | 37881 | 37929 | 37952 | 37953 | 38009 | 38071 | 38072 | 38090 | 38091 | 38118 |
| 38136 | 38188 | 38197 | 38213 | 38216 | 38221 | 38230 | 38302 | 38331 | 38383 | 38434 | 38456 |
| 38472 | 38482 | 38497 | 38519 | 38534 | 38535 | 38536 | 38581 | 38607 | 38649 | 38667 | 38670 |
| 38703 | 38707 | 38724 | 38725 | 38734 | 38745 | 38747 | 38774 | 38796 | 38864 | 38912 | 38934 |
| 38997 | 39026 | 39032 | 39045 | 39051 | 39052 | 39053 | 39073 | 39074 | 39076 | 39096 | 39105 |
| 39118 | 39132 | 39134 | 39138 | 39139 | 39140 | 39186 | 39194 | 39195 | 39204 | 39211 | 39230 |
| 39249 | 39279 | 39286 | 39292 | 39318 | 39329 | 39334 | 39335 | 39336 | 39337 | 39338 | 39339 |
| 39341 | 39342 | 39343 | 39346 | 39363 | 39393 | 39399 | 39412 | 39418 | 39419 | 39441 | 39442 |
| 39444 | 39464 | 39473 | 39487 | 39500 | 39502 | 39506 | 39507 | 39508 | 39557 | 39566 | 39567 |
| 39576 | 39582 | 39602 | 39622 | 39638 | 39655 | 39663 | 39667 | 39693 | 39704 | 39710 | 39711 |
| 39712 | 39713 | 39714 | 39715 | 39716 | 39717 | 39718 | 39720 | 39721 | 39722 | 39723 | 39724 |
| 39726 | 39728 | 39729 | 39732 | 39733 | 39734 | 39754 | 39783 | 39788 | 39797 | 39803 | 39804 |
| 39827 | 39828 | 39855 | 39869 | 39882 | 39884 | 39888 | 39889 | 39932 | 39939 | 39947 | 39955 |
| 39973 | 39990 | 40002 | 40017 | 40020 | 40027 | 40047 | 40057 | 40078 | 40097 | 40107 | 40108 |
| 40113 | 40116 | 40122 | 40137 | 40140 | 40144 | 40150 | 40217 | 40266 | 40309 | 40322 | 40358 |
| 40402 | 40419 | 40511 | 40515 | 40521 | 40536 | 40553 | 40578 | 40607 | 40621 | 40640 | 40657 |
| 40677 | 40707 | 40729 | 40741 | 40753 | 40769 | 40787 | 40788 | 40828 | 40845 | 40870 | 40907 |
| 40955 | 40969 | 40981 | 40991 | 41005 | 41060 | 41062 | 41063 | 41073 | 41154 | 41178 | 41179 |
| 41201 | 41208 | 41256 | 41263 | 41280 | 41284 | 41311 | 41314 | 41348 | 41369 | 41375 | 41397 |
| 41411 | 41452 | 41484 | 41489 | 41513 | 41515 | 41531 | 41561 | 41562 | 41566 | 41576 | 41577 |
| 41581 | 41602 | 41606 | 41613 | 41617 | 41624 | 41632 | 41635 | 41656 | 41668 | 41717 | 41718 |
| 41722 | 41735 | 41736 | 41745 | 41750 | 41754 | 41757 | 41758 | 41761 | 41762 | 41763 |
| 41764 | 41765 | 41766 | 41767 | 41820 | 41821 | 41859 | 41867 | 41887 | 41890 | 41947 | 41977 |
| 42006 | 42028 | 42035 | 42066 | 42104 | 42129 | 42135 | 42147 | 42160 | 42161 | 42162 | 42179 |
| 42227 | 42249 | 42277 | 42315 | 42316 | 42328 | 42330 | 42352 | 42354 | 42436 | 42459 | 42460 |
| 42482 | 42483 | 42487 | 42511 | 42541 | 42569 | 42573 | 42579 | 42600 | 42601 | 42623 | 42672 |
| 42679 | 42680 | 42686 | 42687 | 42739 | 42796 | 42798 | 42810 | 42819 | 42822 | 42824 | 42827 |
| 42828 | 42835 | 42840 | 42849 | 42857 | 42873 | 42879 | 42882 | 42892 | 42896 | 42904 | 42928 |
| 42934 | 42941 | 42951 | 42953 | 42954 | 42957 | 42971 | 42986 | 43007 | 43010 | 43022 | 43036 |
| 43040 | 43061 | 43062 | 43069 | 43076 | 43089 | 43090 | 43100 | 43117 | 43119 | 43121 | 43130 |
| 43139 | 43149 | 43150 | 43154 | 43162 | 43202 | 43222 | 43224 | 43240 | 43255 | 43266 | 43278 |
| 43283 | 43294 | 43305 | 43312 | 43316 | 43412 | 43421 | 43449 | 43459 | 43466 | 43467 | 43476 |
| 43478 | 43482 | 43513 | 43529 | 43533 | 43539 | 43565 | 43574 | 43596 | 43603 | 43666 | 43676 |
| 43708 | 43720 | 43734 | 43801 | 43802 | 43804 | 43858 | 43879 | 43898 | 43903 | 43904 | 43908 |
| 43919 | 43951 | 43978 | 43981 | 44007 | 44028 | 44053 | 44063 | 44084 | 44175 | 44208 | 44249 |
| 44294 | 44314 | 44329 | 44332 | 44340 | 44341 | 44471 | 44484 | 44506 | 44535 | 44559 | 44583 |
| 44598 | 44622 | 44629 | 44634 | 44640 | 44644 | 44675 | 44676 | 44692 | 44694 | 44739 | 44763 |
| 44785 | 44796 | 44808 | 44888 | 44905 | 44909 | 44910 | 44955 | 44979 | 45034 | 45038 | 45081 |
| 45093 | 45129 | 45162 | 45215 | 45234 | 45236 | 45248 | 45274 | 45287 | 45306 | 45319 | 45347 |
| 45398 | 45413 | 45462 | 45485 | 45494 | 45510 | 45512 | 45537 | 45566 | 45567 | 45568 | 45579 |
| 45581 | 45596 | 45616 | 45630 | 45633 | 45635 | 45638 | 45648 | 45649 | 45656 | 45658 | 45667 |
| 45669 | 45677 | 45681 | 45687 | 45697 | 45698 | 45700 | 45703 | 45713 | 45715 | 45716 | 45721 |
| 45724 | 45727 | 45737 | 45741 | 45742 | 45751 | 45753 | 45757 | 45758 | 45764 | 45765 | 45773 |
| 45781 | 45783 | 45785 | 45796 | 45798 | 45800 | 45810 | 45811 | 45813 | 45818 | 45822 | 45826 |
| 45827 | 45828 | 45831 | 45845 | 45853 | 45854 | 45863 | 45864 | 45877 | 45881 | 45882 | 45884 |
| 45889 | 45893 | 45894 | 45907 | 45913 | 45914 | 45916 | 45920 | 45923 | 45924 | 45931 | 45939 |
| 45953 | 45966 | 45968 | 45974 | 45980 | 45983 | 45984 | 45985 | 46001 | 46009 | 46010 | 46015 |
| 46027 | 46037 | 46038 | 46039 | 46054 | 46058 | 46061 | 46068 | 46084 | 46086 | 46093 | 46094 |
| 46095 | 46120 | 46123 | 46157 | 46177 | 46180 | 46185 | 46199 | 46202 | 46214 | 46219 | 46225 |
| 46232 | 46233 | 46242 | 46247 | 46268 | 46277 | 46282 | 46286 | 46290 | 46293 | 46301 | 46303 |
| 46306 | 46327 | 46329 | 46331 | 46332 | 46333 | 46339 | 46368 | 46369 | 46375 | 46376 | 46377 |
| 46388 | 46392 | 46393 | 46397 | 46411 | 46412 | 46413 | 46414 | 46415 | 46426 | 46442 | 46446 |
| 46459 | 46462 | 46469 | 46473 | 46478 | 46480 | 46484 | 46492 | 46493 | 46494 | 46495 | 46503 |
| 46535 | 46555 | 46581 | 46584 | 46623 | 46653 | 46690 | 46708 | 46736 | 46737 | 46758 | 46797 |
| 46816 | 46911 | 46959 | 46977 | 47000 | 47103 | 47117 | 47118 | 47150 | 47187 | 47191 | 47195 |
| 47220 | 47231 | 47254 | 47270 | 47280 | 47295 | 47320 | 47360 | | | | |

TABLE 13A

Seed Oil Yield/Content

Table 13A SEQ ID NOs of Polypeptides useful for improving Seed Oil Yield/Content

| | | | | | | | | | | | |
|---|---|---|---|---|---|---|---|---|---|---|---|
| 1 | 2 | 4 | 5 | 6 | 7 | 8 | 11 | 12 | 13 | 17 | 19 |
| 26 | 27 | 31 | 32 | 34 | 36 | 37 | 39 | 50 | 52 | 55 | 56 |
| 60 | 62 | 63 | 64 | 73 | 77 | 81 | 82 | 86 | 88 | 90 | 91 |
| 99 | 100 | 101 | 108 | 109 | 111 | 112 | 113 | 114 | 117 | 118 | 119 |
| 120 | 121 | 122 | 124 | 125 | 128 | 131 | 132 | 133 | 138 | 145 | 146 |
| 147 | 151 | 153 | 154 | 156 | 157 | 160 | 163 | 169 | 175 | 178 | 183 |
| 184 | 187 | 188 | 191 | 192 | 193 | 194 | 195 | 197 | 202 | 204 | 207 |
| 208 | 211 | 212 | 215 | 223 | 224 | 225 | 226 | 227 | 228 | 230 | 237 |
| 238 | 242 | 244 | 246 | 247 | 256 | 257 | 258 | 266 | 272 | 273 | 274 |
| 275 | 276 | 277 | 278 | 279 | 281 | 282 | 287 | 289 | 290 | 291 | 292 |
| 295 | 297 | 302 | 310 | 311 | 318 | 320 | 321 | 325 | 327 | 329 | 332 |
| 335 | 338 | 340 | 341 | 342 | 350 | 356 | 357 | 363 | 366 | 367 | 370 |
| 371 | 375 | 376 | 377 | 378 | 379 | 384 | 385 | 388 | 391 | 392 | 393 |
| 395 | 396 | 398 | 400 | 403 | 406 | 410 | 413 | 418 | 424 | 427 | 428 |
| 432 | 433 | 436 | 437 | 439 | 442 | 443 | 444 | 445 | 449 | 456 | 459 |
| 460 | 461 | 463 | 466 | 474 | 477 | 478 | 479 | 480 | 484 | 490 | 491 |
| 493 | 494 | 495 | 497 | 498 | 500 | 501 | 502 | 504 | 505 | 508 | 510 |
| 515 | 516 | 519 | 525 | 526 | 529 | 531 | 534 | 535 | 537 | 538 | 539 |
| 541 | 543 | 544 | 546 | 548 | 549 | 552 | 554 | 555 | 559 | 560 | 561 |
| 562 | 563 | 570 | 571 | 572 | 573 | 574 | 575 | 576 | 577 | 579 | 580 |
| 581 | 582 | 583 | 585 | 587 | 593 | 599 | 600 | 602 | 604 | 605 | 609 |
| 613 | 622 | 623 | 629 | 630 | 631 | 632 | 636 | 637 | 638 | 639 | 640 |
| 641 | 642 | 643 | 644 | 646 | 648 | 662 | 664 | 665 | 670 | 671 | 672 |
| 673 | 674 | 675 | 679 | 681 | 682 | 684 | 685 | 693 | 694 | 695 | 696 |
| 700 | 701 | 703 | 707 | 713 | 714 | 720 | 723 | 725 | 729 | 732 | 742 |
| 744 | 745 | 746 | 748 | 749 | 753 | 756 | 757 | 759 | 761 | 762 | 767 |
| 781 | 782 | 783 | 785 | 787 | 788 | 792 | 793 | 794 | 795 | 796 | 800 |
| 812 | 813 | 815 | 818 | 819 | 820 | 823 | 825 | 826 | 834 | 835 | 837 |
| 839 | 844 | 845 | 846 | 847 | 848 | 849 | 850 | 851 | 852 | 853 | 854 |
| 855 | 856 | 859 | 861 | 863 | 867 | 870 | 871 | 872 | 876 | 879 | 883 |
| 885 | 890 | 894 | 895 | 897 | 898 | 899 | 900 | 902 | 903 | 904 | 905 |
| 906 | 907 | 908 | 909 | 920 | 921 | 922 | 923 | 924 | 926 | 928 | 931 |
| 933 | 934 | 935 | 937 | 938 | 940 | 941 | 942 | 943 | 946 | 948 | 949 |
| 950 | 951 | 953 | 964 | 965 | 972 | 974 | 975 | 976 | 977 | 979 | 980 |
| 983 | 985 | 987 | 989 | 991 | 992 | 993 | 995 | 997 | 998 | 1003 | 1004 |
| 1005 | 1006 | 1007 | 1008 | 1011 | 1012 | 1013 | 1014 | 1015 | 1017 | 1020 | 1021 |
| 1024 | 1025 | 1027 | 1028 | 1029 | 1035 | 1036 | 1037 | 1038 | 1041 | 1043 | 1047 |
| 1052 | 1053 | 1055 | 1057 | 1060 | 1070 | 1073 | 1079 | 1081 | 1085 | 1086 | 1087 |
| 1093 | 1094 | 1099 | 1101 | 1105 | 1107 | 1113 | 1116 | 1122 | 1123 | 1127 | 1129 |
| 1130 | 1132 | 1133 | 1135 | 1136 | 1142 | 1145 | 1146 | 1149 | 1150 | 1155 | 1158 |
| 1160 | 1164 | 1166 | 1167 | 1173 | 1174 | 1183 | 1184 | 1185 | 1186 | 1188 | 1189 |
| 1194 | 1198 | 1199 | 1200 | 1203 | 1204 | 1207 | 1214 | 1217 | 1220 | 1229 | 1236 |
| 1240 | 1241 | 1245 | 1246 | 1250 | 1252 | 1255 | 1259 | 1274 | 1276 | 1283 | 1284 |
| 1291 | 1292 | 1299 | 1303 | 1304 | 1309 | 1310 | 1312 | 1313 | 1321 | 1332 | 1334 |
| 1337 | 1339 | 1341 | 1342 | 1346 | 1347 | 1349 | 1358 | 1361 | 1375 | 1397 | 1402 |
| 1403 | 1412 | 1417 | 1428 | 1434 | 1437 | 1438 | 1443 | 1444 | 1458 | 1459 | 1464 |
| 1465 | 1474 | 1477 | 1478 | 1482 | 1484 | 1489 | 1491 | 1492 | 1493 | 1494 | 1495 |
| 1497 | 1500 | 1501 | 1506 | 1507 | 1510 | 1513 | 1521 | 1525 | 1526 | 1541 | 1543 |
| 1552 | 1556 | 1564 | 1565 | 1574 | 1580 | 1582 | 1584 | 1589 | 1597 | 1604 | 1610 |
| 1615 | 1616 | 1617 | 1618 | 1627 | 1632 | 1635 | 1641 | 1642 | 1645 | 1664 |
| 1670 | 1679 | 1680 | 1681 | 1685 | 1688 | 1689 | 1698 | 1699 | 1701 | 1702 | 1704 |
| 1706 | 1707 | 1711 | 1712 | 1719 | 1720 | 1721 | 1728 | 1731 | 1734 | 1736 | 1740 |
| 1742 | 1745 | 1746 | 1748 | 1749 | 1781 | 1783 | 1784 | 1785 | 1789 | 1795 | 1797 |
| 1816 | 1823 | 1824 | 1834 | 1838 | 1839 | 1841 | 1847 | 1850 | 1857 | 1865 | 1866 |
| 1867 | 1878 | 1883 | 1884 | 1890 | 1895 | 1896 | 1897 | 1899 | 1903 | 1904 | 1905 |
| 1912 | 1916 | 1917 | 1921 | 1928 | 1933 | 1934 | 1936 | 1946 | 1947 | 1948 | 1952 |
| 1953 | 1966 | 1971 | 1973 | 1975 | 1983 | 1992 | 1993 | 1994 | 1998 | 2006 | 2007 |
| 2008 | 2013 | 2014 | 2017 | 2019 | 2023 | 2026 | 2027 | 2028 | 2031 | 2042 | 2043 |
| 2044 | 2045 | 2051 | 2062 | 2063 | 2064 | 2066 | 2068 | 2074 | 2084 | 2097 | 2104 |
| 2105 | 2107 | 2109 | 2110 | 2118 | 2119 | 2120 | 2122 | 2124 | 2130 | 2139 | 2140 |
| 2146 | 2147 | 2148 | 2155 | 2163 | 2174 | 2182 | 2184 | 2186 | 2191 | 2194 | 2198 |
| 2202 | 2203 | 2208 | 2212 | 2220 | 2225 | 2229 | 2230 | 2233 | 2254 | 2259 | 2263 |
| 2265 | 2267 | 2270 | 2280 | 2281 | 2283 | 2286 | 2294 | 2302 | 2303 | 2304 | 2305 |
| 2306 | 2315 | 2316 | 2319 | 2321 | 2322 | 2325 | 2327 | 2333 | 2350 | 2359 | 2364 |
| 2377 | 2394 | 2403 | 2413 | 2414 | 2418 | 2422 | 2425 | 2430 | 2438 | 2445 | 2450 |
| 2453 | 2455 | 2457 | 2466 | 2480 | 2485 | 2488 | 2489 | 2496 | 2497 | 2503 | 2504 |
| 2508 | 2517 | 2518 | 2524 | 2537 | 2546 | 2547 | 2551 | 2562 | 2566 | 2567 | 2568 |
| 2578 | 2580 | 2589 | 2592 | 2596 | 2599 | 2602 | 2606 | 2608 | 2609 | 2612 | 2622 |
| 2625 | 2626 | 2631 | 2632 | 2634 | 2639 | 2640 | 2642 | 2649 | 2651 | 2654 | 2658 |
| 2665 | 2666 | 2668 | 2672 | 2675 | 2676 | 2679 | 2687 | 2689 | 2691 | 2692 |
| 2694 | 2695 | 2698 | 2703 | 2706 | 2708 | 2715 | 2719 | 2722 | 2726 | 2730 | 2731 |
| 2734 | 2737 | 2738 | 2739 | 2745 | 2746 | 2748 | 2749 | 2750 | 2752 | 2755 | 2756 |
| 2760 | 2761 | 2766 | 2767 | 2768 | 2771 | 2773 | 2774 | 2775 | 2780 | 2781 | 2782 |
| 2785 | 2787 | 2788 | 2790 | 2797 | 2807 | 2818 | 2822 | 2823 | 2824 | 2828 | 2832 |
| 2833 | 2835 | 2840 | 2842 | 2846 | 2847 | 2848 | 2851 | 2852 | 2853 | 2860 | 2863 |

TABLE 13A-continued

Seed Oil Yield/Content

| | | | | | | | | | | | |
|---|---|---|---|---|---|---|---|---|---|---|---|
| 2864 | 2870 | 2873 | 2878 | 2879 | 2882 | 2885 | 2887 | 2889 | 2891 | 2892 | 2894 |
| 2895 | 2896 | 2898 | 2900 | 2904 | 2905 | 2907 | 2909 | 2910 | 2912 | 2916 | 2919 |
| 2922 | 2923 | 2925 | 2928 | 2929 | 2930 | 2931 | 2932 | 2934 | 2935 | 2936 | 2941 |
| 2942 | 2944 | 2945 | 2947 | 2959 | 2960 | 2961 | 2963 | 2964 | 2965 | 2966 | 2967 |
| 2968 | 2970 | 2971 | 2972 | 2973 | 2974 | 2977 | 2981 | 2984 | 2985 | 2987 | 2990 |
| 2991 | 2996 | 3002 | 3004 | 3005 | 3012 | 3016 | 3020 | 3021 | 3027 | 3030 | 3031 |
| 3032 | 3034 | 3035 | 3042 | 3043 | 3044 | 3045 | 3047 | 3052 | 3054 | 3057 | 3064 |
| 3066 | 3067 | 3069 | 3070 | 3075 | 3077 | 3087 | 3097 | 3100 | 3103 | 3107 | 3110 |
| 3113 | 3115 | 3124 | 3125 | 3130 | 3137 | 3138 | 3139 | 3145 | 3154 | 3156 | 3157 |
| 3165 | 3176 | 3178 | 3180 | 3184 | 3186 | 3188 | 3189 | 3198 | 3199 | 3200 | 3201 |
| 3206 | 3211 | 3219 | 3231 | 3232 | 3234 | 3235 | 3237 | 3240 | 3244 | 3246 | 3249 |
| 3250 | 3260 | 3270 | 3271 | 3276 | 3285 | 3286 | 3288 | 3290 | 3291 | 3295 | 3299 |
| 3301 | 3304 | 3305 | 3309 | 3311 | 3315 | 3318 | 3320 | 3322 | 3323 | 3324 | 3325 |
| 3326 | 3328 | 3331 | 3334 | 3338 | 3339 | 3343 | 3348 | 3357 | 3363 | 3366 | 3372 |
| 3381 | 3389 | 3392 | 3393 | 3395 | 3397 | 3411 | 3415 | 3419 | 3421 | 3423 | 3424 |
| 3436 | 3437 | 3440 | 3441 | 3442 | 3453 | 3455 | 3458 | 3466 | 3468 | 3469 | 3473 |
| 3474 | 3476 | 3478 | 3481 | 3482 | 3484 | 3485 | 3488 | 3490 | 3507 | 3511 | 3513 |
| 3514 | 3515 | 3518 | 3522 | 3529 | 3541 | 3544 | 3555 | 3559 | 3560 | 3563 | 3570 |
| 3571 | 3573 | 3575 | 3580 | 3590 | 3591 | 3592 | 3593 | 3597 | 3601 | 3605 | 3609 |
| 3616 | 3621 | 3623 | 3629 | 3635 | 3637 | 3639 | 3640 | 3647 | 3652 | 3654 | 3658 |
| 3662 | 3663 | 3667 | 3678 | 3682 | 3683 | 3686 | 3688 | 3689 | 3697 | 3698 | 3699 |
| 3700 | 3701 | 3702 | 3703 | 3705 | 3711 | 3713 | 3714 | 3715 | 3717 | 3722 | 3724 |
| 3725 | 3733 | 3735 | 3736 | 3739 | 3741 | 3745 | 3746 | 3747 | 3751 | 3757 | 3761 |
| 3762 | 3772 | 3774 | 3775 | 3777 | 3780 | 3792 | 3793 | 3794 | 3800 | 3805 | 3811 |
| 3815 | 3819 | 3830 | 3834 | 3835 | 3836 | 3840 | 3845 | 3846 | 3850 | 3865 | 3866 |
| 3867 | 3871 | 3876 | 3878 | 3881 | 3884 | 3887 | 3888 | 3890 | 3892 | 3898 | 3904 |
| 3908 | 3915 | 3920 | 3924 | 3925 | 3931 | 3932 | 3937 | 3938 | 3948 | 3954 | 3956 |
| 3957 | 3958 | 3964 | 3966 | 3967 | 3968 | 3969 | 3976 | 3978 | 3982 | 3984 | 3986 |
| 3987 | 3995 | 3999 | 4003 | 4005 | 4006 | 4013 | 4019 | 4021 | 4022 | 4023 | 4025 |
| 4030 | 4033 | 4041 | 4044 | 4045 | 4047 | 4048 | 4052 | 4057 | 4061 | 4066 | 4074 |
| 4075 | 4076 | 4077 | 4078 | 4079 | 4080 | 4084 | 4093 | 4098 | 4100 | 4106 | 4110 |
| 4111 | 4117 | 4118 | 4122 | 4123 | 4126 | 4127 | 4131 | 4134 | 4137 | 4140 | 4142 |
| 4143 | 4145 | 4152 | 4154 | 4160 | 4164 | 4166 | 4168 | 4176 | 4178 | 4180 | 4181 |
| 4183 | 4186 | 4188 | 4189 | 4192 | 4195 | 4198 | 4200 | 4201 | 4202 | 4205 | 4218 |
| 4220 | 4222 | 4227 | 4232 | 4233 | 4234 | 4238 | 4242 | 4243 | 4248 | 4250 | 4251 |
| 4252 | 4254 | 4256 | 4258 | 4259 | 4261 | 4262 | 4263 | 4264 | 4265 | 4266 | 4271 |
| 4272 | 4274 | 4275 | 4277 | 4278 | 4279 | 4280 | 4282 | 4283 | 4284 | 4285 | 4287 |
| 4289 | 4290 | 4291 | 4293 | 4294 | 4295 | 4297 | 4301 | 4302 | 4304 | 4305 | 4306 |
| 4307 | 4308 | 4309 | 4311 | 4312 | 4313 | 4314 | 4315 | 4316 | 4318 | 4322 | 4326 |
| 4327 | 4330 | 4331 | 4332 | 4334 | 4338 | 4339 | 4341 | 4343 | 4344 | 4347 | 4350 |
| 4351 | 4352 | 4353 | 4354 | 4356 | 4358 | 4360 | 4362 | 4363 | 4365 | 4366 | 4367 |
| 4373 | 4376 | 4379 | 4380 | 4381 | 4383 | 4384 | 4387 | 4388 | 4390 | 4391 | 4398 |
| 4399 | 4400 | 4401 | 4405 | 4411 | 4416 | 4418 | 4422 | 4424 | 4425 | 4427 | 4428 |
| 4429 | 4430 | 4432 | 4433 | 4453 | 4454 | 4455 | 4460 | 4461 | 4462 | 4463 | 4464 |
| 4466 | 4467 | 4471 | 4474 | 4477 | 4479 | 4483 | 4484 | 4486 | 4487 | 4490 | 4491 |
| 4496 | 4497 | 4499 | 4500 | 4502 | 4503 | 4504 | 4505 | 4506 | 4507 | 4514 | 4521 |
| 4524 | 4526 | 4527 | 4528 | 4530 | 4534 | 4536 | 4539 | 4541 | 4542 | 4548 | 4549 |
| 4550 | 4553 | 4555 | 4556 | 4557 | 4558 | 4561 | 4562 | 4563 | 4567 | 4568 | 4569 |
| 4572 | 4576 | 4580 | 4581 | 4582 | 4584 | 4590 | 4591 | 4596 | 4599 | 4601 | 4602 |
| 4604 | 4605 | 4606 | 4607 | 4608 | 4609 | 4611 | 4614 | 4618 | 4619 | 4621 | 4622 |
| 4625 | 4626 | 4628 | 4629 | 4630 | 4631 | 4632 | 4633 | 4634 | 4635 | 4637 | 4638 |
| 4639 | 4641 | 4642 | 4645 | 4651 | 4654 | 4656 | 4657 | 4658 | 4667 | 4668 | 4674 |
| 4676 | 4681 | 4684 | 4686 | 4688 | 4690 | 4691 | 4693 | 4696 | 4699 | 4700 | 4701 |
| 4702 | 4704 | 4705 | 4708 | 4709 | 4711 | 4712 | 4715 | 4716 | 4721 | 4725 | 4726 |
| 4727 | 4729 | 4731 | 4732 | 4733 | 4736 | 4739 | 4740 | 4742 | 4744 | 4745 | 4746 |
| 4747 | 4748 | 4749 | 4751 | 4752 | 4753 | 4755 | 4758 | 4762 | 4763 | 4769 | 4770 |
| 4771 | 4772 | 4773 | 4776 | 4777 | 4781 | 4783 | 4785 | 4787 | 4789 | 4792 | 4793 |
| 4794 | 4795 | 4798 | 4799 | 4802 | 4805 | 4806 | 4807 | 4809 | 4811 | 4812 | 4813 |
| 4815 | 4818 | 4821 | 4826 | 4829 | 4833 | 4834 | 4836 | 4837 | 4843 | 4845 | 4846 |
| 4847 | 4850 | 4854 | 4855 | 4860 | 4865 | 4866 | 4869 | 4870 | 4874 | 4878 | 4885 |
| 4886 | 4888 | 4889 | 4894 | 4895 | 4897 | 4898 | 4899 | 4901 | 4902 | 4903 | 4905 |
| 4907 | 4909 | 4910 | 4911 | 4912 | 4914 | 4917 | 4918 | 4920 | 4923 | 4924 | 4926 |
| 4929 | 4930 | 4933 | 4935 | 4939 | 4944 | 4946 | 4947 | 4948 | 4950 | 4951 | 4952 |
| 4954 | 4957 | 4958 | 4962 | 4969 | 4985 | 4987 | 4991 | 4998 | 5002 | 5005 | |
| 5006 | 5007 | 5012 | 5021 | 5022 | 5027 | 5033 | 5034 | 5035 | 5038 | 5045 | 5057 |
| 5060 | 5065 | 5078 | 5080 | 5083 | 5088 | 5089 | 5090 | 5093 | 5095 | 5097 | 5105 |
| 5115 | 5116 | 5117 | 5118 | 5120 | 5125 | 5135 | 5140 | 5147 | 5153 | 5154 | 5158 |
| 5161 | 5165 | 5170 | 5171 | 5172 | 5173 | 5180 | 5181 | 5183 | 5204 | 5208 | 5209 |
| 5212 | 5216 | 5226 | 5229 | 5230 | 5233 | 5238 | 5239 | 5240 | 5241 | 5247 | 5248 |
| 5249 | 5250 | 5251 | 5252 | 5254 | 5255 | 5257 | 5258 | 5259 | 5260 | 5263 | 5264 |
| 5265 | 5266 | 5268 | 5269 | 5270 | 5275 | 5278 | 5279 | 5281 | 5282 | 5283 | 5284 |
| 5298 | 5299 | 5306 | 5309 | 5310 | 5311 | 5312 | 5316 | 5318 | 5320 | 5322 | 5323 |
| 5326 | 5327 | 5329 | 5330 | 5331 | 5334 | 5336 | 5337 | 5345 | 5346 | 5363 | 5364 |
| 5370 | 5372 | 5373 | 5378 | 5379 | 5380 | 5387 | 5394 | 5397 | 5399 | 5402 | 5407 |
| 5408 | 5416 | 5423 | 5426 | 5428 | 5429 | 5433 | 5437 | 5439 | 5440 | 5441 | 5442 |
| 5444 | 5450 | 5451 | 5465 | 5468 | 5470 | 5480 | 5481 | 5485 | 5486 | 5487 | 5488 |
| 5493 | 5496 | 5497 | 5501 | 5507 | 5513 | 5516 | 5518 | 5527 | 5536 | 5537 | 5539 |

TABLE 13A-continued

Seed Oil Yield/Content

| | | | | | | | | | | | |
|---|---|---|---|---|---|---|---|---|---|---|---|
| 5541 | 5543 | 5544 | 5547 | 5548 | 5549 | 5550 | 5553 | 5567 | 5575 | 5578 | 5579 |
| 5584 | 5588 | 5589 | 5595 | 5599 | 5602 | 5604 | 5610 | 5612 | 5613 | 5614 | 5615 |
| 5616 | 5617 | 5618 | 5627 | 5631 | 5634 | 5638 | 5640 | 5642 | 5644 | 5646 | 5650 |
| 5652 | 5659 | 5660 | 5665 | 5669 | 5680 | 5686 | 5688 | 5693 | 5695 | 5698 | 5699 |
| 5700 | 5706 | 5709 | 5710 | 5713 | 5714 | 5715 | 5716 | 5717 | 5718 | 5723 | 5726 |
| 5727 | 5729 | 5734 | 5735 | 5736 | 5741 | 5745 | 5752 | 5758 | 5769 | 5770 | 5772 |
| 5773 | 5774 | 5777 | 5779 | 5784 | 5785 | 5787 | 5789 | 5795 | 5800 | 5803 | 5805 |
| 5812 | 5814 | 5817 | 5823 | 5825 | 5827 | 5828 | 5829 | 5830 | 5831 | 5834 | 5836 |
| 5844 | 5855 | 5857 | 5858 | 5866 | 5867 | 5871 | 5872 | 5873 | 5877 | 5884 | 5886 |
| 5911 | 5912 | 5914 | 5919 | 5922 | 5923 | 5932 | 5933 | 5934 | 5935 | 5936 | 5937 |
| 5938 | 5941 | 5947 | 5951 | 5958 | 5966 | 5968 | 5974 | 5976 | 5980 | 5982 | 5991 |
| 5992 | 5999 | 6000 | 6001 | 6002 | 6007 | 6010 | 6011 | 6017 | 6021 | 6022 | 6024 |
| 6028 | 6029 | 6032 | 6034 | 6036 | 6041 | 6042 | 6045 | 6047 | 6052 | 6057 | 6058 |
| 6059 | 6066 | 6072 | 6073 | 6076 | 6077 | 6084 | 6085 | 6086 | 6089 | 6090 | 6093 |
| 6094 | 6095 | 6096 | 6098 | 6103 | 6104 | 6107 | 6108 | 6112 | 6113 | 6114 | 6115 |
| 6116 | 6120 | 6122 | 6123 | 6129 | 6130 | 6133 | 6134 | 6137 | 6138 | 6139 | 6140 |
| 6141 | 6144 | 6148 | 6149 | 6156 | 6158 | 6159 | 6160 | 6163 | 6168 | 6169 | 6173 |
| 6174 | 6175 | 6177 | 6188 | 6190 | 6191 | 6192 | 6193 | 6194 | 6196 | 6197 | 6200 |
| 6206 | 6207 | 6214 | 6219 | 6220 | 6221 | 6222 | 6223 | 6227 | 6231 | 6234 | 6235 |
| 6243 | 6244 | 6252 | 6256 | 6260 | 6262 | 6263 | 6268 | 6271 | 6272 | 6274 | 6279 |
| 6280 | 6281 | 6283 | 6287 | 6289 | 6299 | 6300 | 6310 | 6312 | 6314 | 6319 | 6320 |
| 6322 | 6333 | 6335 | 6338 | 6343 | 6347 | 6354 | 6355 | 6357 | 6360 | 6361 | |
| 6368 | 6369 | 6374 | 6376 | 6378 | 6381 | 6382 | 6386 | 6387 | 6406 | 6408 | 6410 |
| 6412 | 6413 | 6421 | 6428 | 6430 | 6431 | 6433 | 6435 | 6437 | 6441 | 6442 | 6443 |
| 6446 | 6449 | 6455 | 6456 | 6463 | 6464 | 6466 | 6467 | 6470 | 6475 | 6477 | 6484 |
| 6485 | 6486 | 6487 | 6491 | 6503 | 6504 | 6509 | 6510 | 6511 | 6515 | 6518 | 6520 |
| 6521 | 6522 | 6523 | 6524 | 6525 | 6531 | 6532 | 6535 | 6536 | 6537 | 6540 | 6541 |
| 6542 | 6544 | 6545 | 6546 | 6549 | 6550 | 6551 | 6557 | 6558 | 6561 | 6567 | 6574 |
| 6575 | 6578 | 6579 | 6580 | 6586 | 6594 | 6596 | 6598 | 6599 | 6602 | 6606 | 6615 |
| 6616 | 6617 | 6625 | 6630 | 6634 | 6636 | 6637 | 6646 | 6647 | 6648 | 6649 | 6654 |
| 6655 | 6656 | 6657 | 6658 | 6659 | 6660 | 6661 | 6662 | 6666 | 6668 | 6670 | 6671 |
| 6673 | 6674 | 6682 | 6683 | 6684 | 6685 | 6687 | 6689 | 6690 | 6692 | 6693 | 6695 |
| 6701 | 6702 | 6703 | 6704 | 6705 | 6706 | 6714 | 6715 | 6716 | 6719 | 6728 | 6730 |
| 6732 | 6733 | 6734 | 6736 | 6737 | 6739 | 6741 | 6747 | 6749 | 6750 | 6753 | 6756 |
| 6759 | 6760 | 6768 | 6771 | 6773 | 6776 | 6779 | 6780 | 6788 | 6797 | 6804 | 6806 |
| 6807 | 6814 | 6819 | 6820 | 6821 | 6826 | 6828 | 6829 | 6830 | 6836 | 6839 | 6845 |
| 6847 | 6849 | 6851 | 6854 | 6855 | 6862 | 6865 | 6870 | 6879 | 6880 | 6884 | 6885 |
| 6890 | 6893 | 6907 | 6917 | 6918 | 6919 | 6922 | 6927 | 6939 | 6961 | 6970 | 6971 |
| 6977 | 6985 | 6986 | 6991 | 7000 | 7001 | 7005 | 7008 | 7009 | 7018 | 7023 | 7025 |
| 7026 | 7027 | 7033 | 7034 | 7035 | 7037 | 7038 | 7039 | 7040 | 7043 | 7045 | 7046 |
| 7047 | 7049 | 7050 | 7051 | 7053 | 7057 | 7058 | 7061 | 7062 | 7063 | 7064 | 7065 |
| 7067 | 7068 | 7069 | 7070 | 7071 | 7072 | 7074 | 7076 | 7078 | 7083 | 7086 | 7087 |
| 7088 | 7090 | 7093 | 7094 | 7096 | 7098 | 7099 | 7102 | 7105 | 7106 | 7107 | 7108 |
| 7110 | 7112 | 7114 | 7116 | 7117 | 7119 | 7120 | 7121 | 7127 | 7130 | 7133 | 7134 |
| 7135 | 7136 | 7138 | 7139 | 7140 | 7142 | 7143 | 7145 | 7146 | 7153 | 7154 | 7155 |
| 7156 | 7158 | 7161 | 7167 | 7172 | 7174 | 7179 | 7182 | 7183 | 7185 | 7186 | 7187 |
| 7188 | 7190 | 7191 | 7193 | 7207 | 7213 | 7214 | 7220 | 7221 | 7222 | 7223 | 7224 |
| 7226 | 7227 | 7231 | 7233 | 7236 | 7238 | 7242 | 7243 | 7245 | 7246 | 7249 | 7250 |
| 7255 | 7256 | 7258 | 7259 | 7261 | 7262 | 7263 | 7264 | 7265 | 7266 | 7272 | 7280 |
| 7283 | 7284 | 7285 | 7286 | 7287 | 7288 | 7292 | 7294 | 7297 | 7299 | 7300 | 7304 |
| 7307 | 7310 | 7312 | 7313 | 7314 | 7315 | 7317 | 7319 | 7320 | 7321 | 7324 | 7325 |
| 7326 | 7329 | 7333 | 7337 | 7338 | 7339 | 7341 | 7347 | 7348 | 7353 | 7356 | 7358 |
| 7359 | 7361 | 7362 | 7363 | 7364 | 7365 | 7368 | 7370 | 7371 | 7375 | 7376 | 7379 |
| 7383 | 7384 | 7386 | 7387 | 7388 | 7389 | 7390 | 7391 | 7392 | 7393 | 7395 | 7396 |
| 7397 | 7399 | 7400 | 7403 | 7409 | 7410 | 7412 | 7414 | 7415 | 7417 | 7426 | 7427 |
| 7432 | 7433 | 7435 | 7440 | 7442 | 7443 | 7445 | 7447 | 7449 | 7450 | 7454 | 7457 |
| 7458 | 7459 | 7460 | 7462 | 7463 | 7467 | 7468 | 7471 | 7472 | 7474 | 7475 | 7480 |
| 7484 | 7485 | 7486 | 7488 | 7491 | 7492 | 7493 | 7495 | 7498 | 7499 | 7501 | 7502 |
| 7504 | 7505 | 7506 | 7507 | 7508 | 7510 | 7511 | 7512 | 7514 | 7517 | 7521 | 7523 |
| 7529 | 7530 | 7531 | 7532 | 7533 | 7536 | 7537 | 7541 | 7543 | 7545 | 7547 | 7549 |
| 7552 | 7553 | 7554 | 7555 | 7557 | 7558 | 7559 | 7561 | 7564 | 7565 | 7566 | 7568 |
| 7570 | 7571 | 7572 | 7574 | 7577 | 7580 | 7585 | 7588 | 7589 | 7592 | 7593 | 7595 |
| 7597 | 7602 | 7604 | 7605 | 7606 | 7609 | 7613 | 7614 | 7619 | 7624 | 7625 | 7629 |
| 7630 | 7634 | 7637 | 7643 | 7644 | 7646 | 7647 | 7652 | 7653 | 7655 | 7656 | 7657 |
| 7659 | 7660 | 7661 | 7663 | 7665 | 7667 | 7668 | 7669 | 7670 | 7672 | 7675 | 7676 |
| 7678 | 7681 | 7682 | 7684 | 7687 | 7688 | 7691 | 7695 | 7697 | 7702 | 7704 | 7705 |
| 7706 | 7708 | 7709 | 7710 | 7712 | 7715 | 7716 | 7720 | 7727 | 7729 | 7730 | 7733 |
| 7734 | 7737 | 7738 | 7743 | 7745 | 7747 | 7752 | 7753 | 7754 | 7755 | 7759 | 7760 |
| 7762 | 7764 | 7765 | 7766 | 7768 | 7769 | 7771 | 7772 | 7773 | 7777 | 7778 | 7782 |
| 7783 | 7784 | 7786 | 7789 | 7791 | 7794 | 7795 | 7805 | 7806 | 7807 | 7808 | 7809 |
| 7810 | 7813 | 7814 | 7815 | 7818 | 7822 | 7824 | 7827 | 7832 | 7833 | 7834 | 7836 |
| 7837 | 7839 | 7840 | 7844 | 7845 | 7846 | 7848 | 7852 | 7858 | 7859 | 7860 | 7868 |
| 7869 | 7870 | 7873 | 7875 | 7881 | 7882 | 7883 | 7884 | 7885 | 7892 | 7894 | 7896 |
| 7897 | 7905 | 7906 | 7912 | 7913 | 7919 | 7920 | 7922 | 7923 | 7925 | 7927 | 7929 |
| 7933 | 7936 | 7938 | 7939 | 7940 | 7944 | 7945 | 7946 | 7949 | 7951 | 7963 | 7964 |
| 7966 | 7967 | 7969 | 7970 | 7972 | 7973 | 7974 | 7976 | 7977 | 7979 | 7982 | 7985 |
| 7993 | 7995 | 7998 | 8001 | 8002 | 8003 | 8004 | 8007 | 8009 | 8011 | 8012 | 8013 |

TABLE 13A-continued

| Seed Oil Yield/Content | | | | | | | | | | | |
|---|---|---|---|---|---|---|---|---|---|---|---|
| 8015 | 8017 | 8019 | 8024 | 8026 | 8027 | 8030 | 8031 | 8032 | 8038 | 8039 | 8041 |
| 8045 | 8046 | 8047 | 8048 | 8051 | 8053 | 8054 | 8055 | 8057 | 8058 | 8063 | 8070 |
| 8071 | 8072 | 8073 | 8074 | 8080 | 8083 | 8084 | 8086 | 8088 | 8092 | 8093 | 8097 |
| 8105 | 8107 | 8108 | 8109 | 8110 | 8111 | 8112 | 8114 | 8115 | 8117 | 8119 | 8122 |
| 8125 | 8128 | 8132 | 8133 | 8141 | 8143 | 8144 | 8145 | 8146 | 8148 | 8149 | 8150 |
| 8155 | 8156 | 8157 | 8159 | 8162 | 8163 | 8164 | 8167 | 8169 | 8170 | 8179 | 8180 |
| 8181 | 8182 | 8183 | 8184 | 8187 | 8188 | 8189 | 8194 | 8195 | 8196 | 8198 | 8202 |
| 8203 | 8206 | 8209 | 8210 | 8211 | 8213 | 8216 | 8218 | 8219 | 8220 | 8223 | 8224 |
| 8226 | 8227 | 8228 | 8234 | 8237 | 8238 | 8241 | 8243 | 8245 | 8248 | 8249 | 8250 |
| 8252 | 8253 | 8255 | 8256 | 8259 | 8261 | 8262 | 8263 | 8264 | 8265 | 8266 | 8269 |
| 8270 | 8271 | 8272 | 8274 | 8275 | 8276 | 8277 | 8279 | 8281 | 8282 | 8283 | 8286 |
| 8287 | 8288 | 8290 | 8291 | 8297 | 8298 | 8304 | 8305 | 8306 | 8307 | 8309 | 8312 |
| 8314 | 8319 | 8323 | 8324 | 8326 | 8328 | 8330 | 8338 | 8340 | 8342 | 8344 | 8345 |
| 8346 | 8349 | 8354 | 8355 | 8356 | 8361 | 8362 | 8364 | 8365 | 8370 | 8371 | 8372 |
| 8374 | 8375 | 8378 | 8382 | 8383 | 8384 | 8386 | 8387 | 8392 | 8394 | 8397 | 8398 |
| 8402 | 8404 | 8405 | 8406 | 8408 | 8410 | 8411 | 8413 | 8416 | 8417 | 8430 | 8431 |
| 8432 | 8438 | 8439 | 8440 | 8441 | 8442 | 8443 | 8444 | 8446 | 8447 | 8448 | 8449 |
| 8452 | 8453 | 8457 | 8458 | 8464 | 8466 | 8467 | 8468 | 8471 | 8472 | 8473 | 8479 |
| 8483 | 8484 | 8485 | 8488 | 8490 | 8493 | 8494 | 8496 | 8498 | 8499 | 8501 | 8502 |
| 8503 | 8509 | 8513 | 8514 | 8515 | 8516 | 8517 | 8518 | 8520 | 8521 | 8522 | 8523 |
| 8524 | 8525 | 8529 | 8530 | 8531 | 8532 | 8533 | 8534 | 8535 | 8537 | 8538 | 8539 |
| 8545 | 8551 | 8553 | 8556 | 8561 | 8562 | 8563 | 8564 | 8567 | 8568 | 8569 | 8571 |
| 8572 | 8576 | 8578 | 8579 | 8580 | 8581 | 8582 | 8584 | 8585 | 8586 | 8587 | 8588 |
| 8589 | 8590 | 8591 | 8592 | 8595 | 8600 | 8603 | 8604 | 8606 | 8607 | 8608 | 8609 |
| 8610 | 8611 | 8614 | 8621 | 8622 | 8625 | 8626 | 8627 | 8631 | 8645 | 8646 | 8648 |
| 8649 | 8650 | 8652 | 8653 | 8658 | 8659 | 8660 | 8663 | 8664 | 8665 | 8666 | 8667 |
| 8671 | 8672 | 8673 | 8674 | 8675 | 8676 | 8678 | 8680 | 8683 | 8685 | 8688 | 8691 |
| 8692 | 8695 | 8697 | 8698 | 8699 | 8701 | 8702 | 8706 | 8707 | 8710 | 8711 | 8712 |
| 8713 | 8717 | 8718 | 8719 | 8720 | 8721 | 8723 | 8724 | 8725 | 8726 | 8727 | 8728 |
| 8729 | 8730 | 8731 | 8738 | 8741 | 8742 | 8747 | 8748 | 8750 | 8755 | 8757 | 8759 |
| 8760 | 8763 | 8765 | 8766 | 8767 | 8768 | 8769 | 8770 | 8771 | 8774 | 8775 | 8777 |
| 8780 | 8781 | 8783 | 8786 | 8789 | 8793 | 8795 | 8796 | 8797 | 8800 | 8801 | 8803 |
| 8806 | 8807 | 8813 | 8814 | 8815 | 8816 | 8817 | 8822 | 8823 | 8826 | 8827 | 8828 |
| 8832 | 8833 | 8834 | 8835 | 8836 | 8839 | 8843 | 8844 | 8847 | 8852 | 8855 | 8856 |
| 8859 | 8860 | 8861 | 8862 | 8864 | 8865 | 8866 | 8868 | 8869 | 8872 | 8873 | 8876 |
| 8880 | 8885 | 8893 | 8894 | 8896 | 8899 | 8901 | 8903 | 8906 | 8909 | 8911 | 8913 |
| 8914 | 8916 | 8917 | 8918 | 8919 | 8921 | 8922 | 8923 | 8924 | 8927 | 8928 | 8933 |
| 8934 | 8936 | 8938 | 8939 | 8940 | 8945 | 8953 | 8958 | 8959 | 8960 | 8966 | 8970 |
| 8973 | 8974 | 8977 | 8980 | 8981 | 8984 | 8994 | 8998 | 8999 | 9000 | 9005 | 9006 |
| 9012 | 9013 | 9014 | 9015 | 9017 | 9018 | 9019 | 9020 | 9021 | 9022 | 9023 | 9026 |
| 9028 | 9029 | 9031 | 9035 | 9036 | 9037 | 9042 | 9045 | 9046 | 9048 | 9049 | 9051 |
| 9056 | 9061 | 9067 | 9068 | 9072 | 9073 | 9076 | 9080 | 9081 | 9082 | 9083 | 9086 |
| 9088 | 9089 | 9103 | 9104 | 9105 | 9106 | 9107 | 9108 | 9109 | 9110 | 9111 | 9114 |
| 9116 | 9118 | 9119 | 9123 | 9126 | 9127 | 9130 | 9132 | 9134 | 9135 | 9136 | 9142 |
| 9145 | 9148 | 9151 | 9153 | 9156 | 9164 | 9165 | 9167 | 9175 | 9182 | 9186 | 9189 |
| 9190 | 9192 | 9193 | 9194 | 9195 | 9197 | 9198 | 9201 | 9202 | 9212 | 9213 | 9216 |
| 9218 | 9220 | 9221 | 9222 | 9223 | 9227 | 9228 | 9235 | 9236 | 9239 | 9240 | 9241 |
| 9242 | 9243 | 9244 | 9245 | 9251 | 9253 | 9254 | 9255 | 9257 | 9264 | 9265 | 9266 |
| 9269 | 9270 | 9271 | 9273 | 9274 | 9276 | 9279 | 9280 | 9282 | 9288 | 9289 | 9291 |
| 9292 | 9293 | 9294 | 9296 | 9300 | 9302 | 9303 | 9304 | 9310 | 9320 | 9321 | 9323 |
| 9324 | 9329 | 9330 | 9333 | 9334 | 9335 | 9336 | 9348 | 9352 | 9354 | 9358 | 9362 |
| 9364 | 9368 | 9369 | 9371 | 9372 | 9373 | 9376 | 9381 | 9383 | 9385 | 9386 | 9387 |
| 9389 | 9390 | 9395 | 9404 | 9405 | 9409 | 9419 | 9420 | 9423 | 9424 | 9425 | 9429 |
| 9435 | 9439 | 9440 | 9443 | 9453 | 9456 | 9457 | 9458 | 9460 | 9461 | 9462 | 9463 |
| 9464 | 9465 | 9468 | 9469 | 9470 | 9472 | 9475 | 9476 | 9477 | 9484 | 9485 | 9489 |
| 9490 | 9492 | 9498 | 9499 | 9507 | 9508 | 9511 | 9512 | 9514 | 9515 | 9516 | 9517 |
| 9520 | 9521 | 9524 | 9530 | 9531 | 9534 | 9535 | 9537 | 9539 | 9547 | 9549 | 9551 |
| 9558 | 9559 | 9561 | 9563 | 9568 | 9569 | 9573 | 9574 | 9575 | 9576 | 9578 | 9580 |
| 9586 | 9587 | 9588 | 9589 | 9592 | 9594 | 9595 | 9598 | 9599 | 9602 | 9603 | 9604 |
| 9605 | 9611 | 9612 | 9613 | 9614 | 9619 | 9620 | 9624 | 9625 | 9627 | 9630 | 9632 |
| 9633 | 9635 | 9636 | 9645 | 9646 | 9649 | 9650 | 9652 | 9653 | 9658 | 9659 | 9669 |
| 9678 | 9679 | 9685 | 9689 | 9690 | 9701 | 9703 | 9704 | 9709 | 9710 | 9712 | 9713 |
| 9714 | 9715 | 9718 | 9725 | 9732 | 9734 | 9743 | 9745 | 9746 | 9747 | 9750 | 9751 |
| 9754 | 9758 | 9759 | 9765 | 9766 | 9771 | 9772 | 9773 | 9788 | 9789 | 9790 |
| 9798 | 9814 | 9815 | 9818 | 9826 | 9827 | 9828 | 9829 | 9830 | 9831 | 9832 | 9833 |
| 9834 | 9839 | 9840 | 9841 | 9852 | 9853 | 9855 | 9856 | 9858 | 9859 | 9860 | 9861 |
| 9862 | 9863 | 9864 | 9866 | 9868 | 9869 | 9874 | 9876 | 9877 | 9878 | 9879 | 9888 |
| 9891 | 9892 | 9893 | 9894 | 9897 | 9898 | 9902 | 9916 | 9922 | 9926 | 9927 | 9928 |
| 9929 | 9931 | 9934 | 9935 | 9936 | 9945 | 9946 | 9950 | 9958 | 9960 | 9963 | 9964 |
| 9970 | 9974 | 9976 | 9977 | 9981 | 9984 | 9987 | 9989 | 9991 | 9993 | 9995 | 9997 |
| 10002 | 10003 | 10004 | 10005 | 10007 | 10011 | 10019 | 10020 | 10021 | 10023 | 10026 | 10029 |
| 10034 | 10038 | 10044 | 10045 | 10047 | 10049 | 10050 | 10052 | 10053 | 10055 | 10059 | 10060 |
| 10061 | 10079 | 10084 | 10097 | 10098 | 10099 | 10100 | 10102 | 10104 | 10109 | 10114 | 10115 |
| 10121 | 10122 | 10132 | 10135 | 10136 | 10141 | 10142 | 10143 | 10144 | 10147 | 10151 | 10154 |
| 10158 | 10159 | 10163 | 10164 | 10165 | 10174 | 10175 | 10179 | 10181 | 10182 | 10185 | 10187 |
| 10190 | 10197 | 10198 | 10201 | 10204 | 10205 | 10207 | 10209 | 10210 | 10213 | 10214 | 10223 |
| 10225 | 10226 | 10227 | 10231 | 10232 | 10234 | 10235 | 10245 | 10248 | 10250 | 10253 | 10256 |

TABLE 13A-continued

Seed Oil Yield/Content

| | | | | | | | | | | | |
|---|---|---|---|---|---|---|---|---|---|---|---|
| 10259 | 10260 | 10261 | 10262 | 10263 | 10265 | 10266 | 10267 | 10268 | 10282 | 10283 | 10285 |
| 10293 | 10296 | 10301 | 10302 | 10303 | 10304 | 10305 | 10307 | 10309 | 10310 | 10311 | 10312 |
| 10318 | 10319 | 10322 | 10325 | 10327 | 10330 | 10336 | 10338 | 10339 | 10343 | 10346 | 10348 |
| 10351 | 10352 | 10354 | 10355 | 10357 | 10360 | 10361 | 10364 | 10365 | 10367 | 10368 | 10369 |
| 10370 | 10374 | 10375 | 10381 | 10382 | 10383 | 10384 | 10385 | 10386 | 10388 | 10395 | 10397 |
| 10399 | 10403 | 10404 | 10406 | 10410 | 10411 | 10412 | 10413 | 10415 | 10417 | 10418 | 10420 |
| 10424 | 10425 | 10427 | 10430 | 10431 | 10432 | 10433 | 10434 | 10435 | 10437 | 10438 | 10439 |
| 10442 | 10445 | 10453 | 10456 | 10457 | 10459 | 10462 | 10465 | 10468 | 10471 | 10473 | 10474 |
| 10476 | 10478 | 10479 | 10481 | 10484 | 10486 | 10487 | 10488 | 10489 | 10490 | 10493 | 10500 |
| 10501 | 10502 | 10503 | 10504 | 10505 | 10506 | 10509 | 10511 | 10514 | 10516 | 10520 | 10521 |
| 10522 | 10523 | 10524 | 10526 | 10528 | 10530 | 10531 | 10534 | 10537 | 10540 | 10541 | 10542 |
| 10543 | 10545 | 10546 | 10551 | 10555 | 10556 | 10557 | 10560 | 10564 | 10566 | 10567 | 10568 |
| 10569 | 10570 | 10571 | 10572 | 10574 | 10575 | 10577 | 10582 | 10589 | 10591 | 10593 | 10594 |
| 10596 | 10599 | 10600 | 10602 | 10603 | 10605 | 10607 | 10611 | 10612 | 10613 | 10615 | 10617 |
| 10619 | 10620 | 10622 | 10627 | 10628 | 10629 | 10630 | 10632 | 10638 | 10644 | 10646 | 10650 |
| 10651 | 10652 | 10654 | 10655 | 10657 | 10659 | 10660 | 10662 | 10663 | 10664 | 10667 | 10668 |
| 10671 | 10672 | 10674 | 10677 | 10679 | 10681 | 10683 | 10684 | 10685 | 10686 | 10687 | 10689 |
| 10690 | 10691 | 10694 | 10697 | 10698 | 10699 | 10700 | 10702 | 10705 | 10707 | 10708 | 10710 |
| 10711 | 10718 | 10721 | 10722 | 10723 | 10726 | 10729 | 10736 | 10739 | 10740 | 10744 | 10747 |
| 10748 | 10749 | 10750 | 10751 | 10752 | 10753 | 10754 | 10755 | 10757 | 10759 | 10760 | 10764 |
| 10765 | 10766 | 10774 | 10776 | 10781 | 10782 | 10783 | 10785 | 10786 | 10787 | 10788 | 10789 |
| 10796 | 10797 | 10798 | 10805 | 10807 | 10808 | 10810 | 10811 | 10813 | 10815 | 10816 | 10817 |
| 10818 | 10819 | 10820 | 10821 | 10824 | 10826 | 10828 | 10829 | 10830 | 10836 | 10838 | 10840 |
| 10841 | 10843 | 10844 | 10849 | 10850 | 10855 | 10859 | 10861 | 10866 | 10872 | 10879 | 10880 |
| 10881 | 10882 | 10888 | 10890 | 10891 | 10897 | 10898 | 10901 | 10902 | 10904 | 10907 | 10909 |
| 10910 | 10912 | 10913 | 10916 | 10920 | 10921 | 10926 | 10927 | 10928 | 10930 | 10931 | 10932 |
| 10933 | 10934 | 10935 | 10936 | 10937 | 10939 | 10940 | 10949 | 10950 | 10951 | 10952 | 10961 |
| 10962 | 10966 | 10968 | 10969 | 10970 | 10971 | 10977 | 10981 | 10982 | 10989 | 10990 | 10992 |
| 10995 | 10996 | 10997 | 10998 | 10999 | 11000 | 11001 | 11003 | 11004 | 11005 | 11008 | 11012 |
| 11013 | 11014 | 11017 | 11018 | 11021 | 11022 | 11028 | 11035 | 11036 | 11037 | 11041 | 11042 |
| 11045 | 11050 | 11051 | 11056 | 11057 | 11058 | 11061 | 11063 | 11064 | 11066 | 11073 | 11076 |
| 11079 | 11084 | 11085 | 11089 | 11090 | 11091 | 11093 | 11097 | 11102 | 11103 | 11105 | 11117 |
| 11119 | 11121 | 11136 | 11137 | 11153 | 11160 | 11163 | 11167 | 11169 | 11170 | 11174 | 11176 |
| 11180 | 11184 | 11185 | 11186 | 11188 | 11192 | 11195 | 11197 | 11216 | 11218 | 11219 | 11226 |
| 11233 | 11237 | 11240 | 11242 | 11245 | 11247 | 11248 | 11249 | 11251 | 11252 | 11253 | 11257 |
| 11259 | 11262 | 11274 | 11277 | 11285 | 11286 | 11297 | 11301 | 11303 | 11308 | 11309 | 11312 |
| 11317 | 11318 | 11320 | 11321 | 11327 | 11329 | 11332 | 11336 | 11338 | 11343 | 11344 | 11345 |
| 11349 | 11350 | 11353 | 11360 | 11362 | 11364 | 11369 | 11371 | 11373 | 11374 | 11376 | 11377 |
| 11381 | 11382 | 11384 | 11386 | 11387 | 11388 | 11394 | 11396 | 11397 | 11402 | 11407 | 11408 |
| 11413 | 11415 | 11416 | 11420 | 11422 | 11426 | 11427 | 11432 | 11433 | 11437 | 11439 | 11442 |
| 11443 | 11449 | 11450 | 11453 | 11455 | 11456 | 11463 | 11464 | 11465 | 11466 | 11467 | 11468 |
| 11469 | 11471 | 11472 | 11473 | 11474 | 11475 | 11478 | 11480 | 11485 | 11488 | 11490 | 11492 |
| 11493 | 11494 | 11495 | 11497 | 11498 | 11502 | 11503 | 11504 | 11506 | 11509 | 11511 | 11513 |
| 11514 | 11516 | 11517 | 11518 | 11520 | 11525 | 11526 | 11528 | 11531 | 11537 | 11538 | 11539 |
| 11540 | 11542 | 11546 | 11547 | 11548 | 11550 | 11551 | 11553 | 11554 | 11555 | 11558 | 11559 |
| 11562 | 11563 | 11564 | 11565 | 11566 | 11572 | 11578 | 11579 | 11583 | 11589 | 11591 | 11594 |
| 11595 | 11596 | 11597 | 11598 | 11602 | 11606 | 11608 | 11609 | 11610 | 11614 | 11615 | 11619 |
| 11623 | 11625 | 11628 | 11629 | 11630 | 11631 | 11633 | 11634 | 11635 | 11636 | 11637 | 11638 |
| 11639 | 11640 | 11641 | 11642 | 11643 | 11644 | 11645 | 11647 | 11649 | 11651 | 11652 | 11653 |
| 11655 | 11659 | 11661 | 11663 | 11665 | 11666 | 11667 | 11672 | 11673 | 11675 | 11676 | 11678 |
| 11679 | 11680 | 11688 | 11693 | 11694 | 11695 | 11696 | 11697 | 11698 | 11699 | 11701 | 11703 |
| 11705 | 11706 | 11707 | 11709 | 11717 | 11719 | 11721 | 11722 | 11723 | 11724 | 11725 | 11726 |
| 11730 | 11731 | 11735 | 11744 | 11745 | 11747 | 11749 | 11750 | 11754 | 11762 | 11766 | 11768 |
| 11769 | 11772 | 11773 | 11774 | 11779 | 11780 | 11782 | 11783 | 11786 | 11788 | 11793 | 11794 |
| 11795 | 11796 | 11799 | 11800 | 11803 | 11806 | 11808 | 11809 | 11810 | 11813 | 11814 | 11817 |
| 11819 | 11820 | 11821 | 11822 | 11824 | 11828 | 11829 | 11830 | 11833 | 11838 | 11839 | 11840 |
| 11842 | 11845 | 11847 | 11848 | 11850 | 11855 | 11856 | 11857 | 11859 | 11862 | 11863 | 11864 |
| 11866 | 11874 | 11875 | 11876 | 11880 | 11881 | 11883 | 11886 | 11887 | 11889 | 11895 | 11896 |
| 11897 | 11899 | 11900 | 11906 | 11907 | 11911 | 11915 | 11918 | 11919 | 11923 | 11924 | 11932 |
| 11936 | 11943 | 11945 | 11948 | 11949 | 11950 | 11951 | 11952 | 11956 | 11957 | 11958 | 11960 |
| 11961 | 11962 | 11963 | 11966 | 11969 | 11971 | 11977 | 11986 | 11988 | 11990 | 11993 | 11997 |
| 11998 | 11999 | 12000 | 12008 | 12010 | 12011 | 12012 | 12013 | 12014 | 12015 | 12017 | 12018 |
| 12019 | 12021 | 12027 | 12030 | 12031 | 12032 | 12033 | 12034 | 12040 | 12041 | 12044 | 12046 |
| 12052 | 12053 | 12055 | 12056 | 12058 | 12062 | 12068 | 12069 | 12070 | 12071 | 12072 | 12078 |
| 12079 | 12083 | 12086 | 12089 | 12091 | 12092 | 12096 | 12097 | 12098 | 12099 | 12100 | 12101 |
| 12102 | 12104 | 12106 | 12107 | 12109 | 12110 | 12111 | 12112 | 12116 | 12118 | 12119 | 12121 |
| 12124 | 12127 | 12128 | 12130 | 12135 | 12137 | 12138 | 12139 | 12140 | 12141 | 12142 | 12149 |
| 12151 | 12152 | 12154 | 12155 | 12159 | 12162 | 12163 | 12165 | 12167 | 12169 | 12172 | 12173 |
| 12176 | 12177 | 12178 | 12180 | 12186 | 12191 | 12192 | 12193 | 12195 | 12199 | 12200 | 12201 |
| 12206 | 12208 | 12212 | 12213 | 12214 | 12215 | 12218 | 12219 | 12225 | 12227 | 12228 | 12234 |
| 12237 | 12241 | 12242 | 12245 | 12247 | 12251 | 12253 | 12254 | 12255 | 12269 | 12270 | 12271 |
| 12272 | 12274 | 12275 | 12277 | 12278 | 12280 | 12282 | 12284 | 12286 | 12287 | 12293 | 12294 |
| 12297 | 12298 | 12299 | 12300 | 12302 | 12303 | 12304 | 12308 | 12310 | 12311 | 12312 | 12316 |
| 12319 | 12320 | 12321 | 12322 | 12324 | 12337 | 12338 | 12341 | 12343 | 12350 | 12351 | 12353 |
| 12358 | 12361 | 12363 | 12368 | 12373 | 12374 | 12376 | 12383 | 12387 | 12388 | 12394 | 12398 |
| 12400 | 12403 | 12404 | 12408 | 12418 | 12419 | 12425 | 12427 | 12428 | 12436 | 12437 | 12439 |
| 12440 | 12445 | 12446 | 12447 | 12448 | 12449 | 12450 | 12454 | 12455 | 12461 | 12471 | 12472 |

TABLE 13A-continued

Seed Oil Yield/Content

| | | | | | | | | | | | |
|---|---|---|---|---|---|---|---|---|---|---|---|
| 12473 | 12480 | 12481 | 12482 | 12483 | 12486 | 12488 | 12492 | 12494 | 12496 | 12500 | 12501 |
| 12509 | 12513 | 12517 | 12520 | 12524 | 12525 | 12526 | 12527 | 12535 | 12536 | 12537 | 12538 |
| 12541 | 12548 | 12553 | 12554 | 12558 | 12559 | 12566 | 12569 | 12572 | 12573 | 12575 | 12577 |
| 12589 | 12590 | 12592 | 12593 | 12596 | 12598 | 12600 | 12601 | 12602 | 12605 | 12610 | 12611 |
| 12614 | 12621 | 12623 | 12626 | 12629 | 12630 | 12638 | 12640 | 12644 | 12645 | 12652 | 12657 |
| 12661 | 12664 | 12666 | 12668 | 12671 | 12672 | 12673 | 12675 | 12678 | 12682 | 12688 | 12691 |
| 12692 | 12694 | 12695 | 12697 | 12698 | 12700 | 12703 | 12709 | 12712 | 12715 | 12720 | 12722 |
| 12723 | 12728 | 12730 | 12733 | 12734 | 12736 | 12738 | 12742 | 12743 | 12744 | 12751 | 12757 |
| 12762 | 12763 | 12764 | 12765 | 12768 | 12771 | 12772 | 12773 | 12774 | 12777 | 12783 | 12786 |
| 12791 | 12792 | 12793 | 12803 | 12806 | 12810 | 12812 | 12814 | 12817 | 12821 | 12824 | 12827 |
| 12829 | 12830 | 12835 | 12836 | 12840 | 12843 | 12845 | 12846 | 12848 | 12855 | 12868 | 12869 |
| 12876 | 12886 | 12889 | 12891 | 12897 | 12903 | 12908 | 12911 | 12912 | 12920 | 12922 | 12924 |
| 12925 | 12926 | 12932 | 12933 | 12936 | 12939 | 12941 | 12942 | 12943 | 12947 | 12949 | 12956 |
| 12957 | 12958 | 12962 | 12963 | 12968 | 12969 | 12976 | 12977 | 12978 | 12984 | 12986 | 12987 |
| 12989 | 12997 | 12999 | 13002 | 13013 | 13018 | 13020 | 13022 | 13023 | 13028 | 13029 | 13030 |
| 13033 | 13035 | 13037 | 13040 | 13042 | 13044 | 13045 | 13051 | 13053 | 13056 | 13063 | 13064 |
| 13065 | 13067 | 13068 | 13069 | 13073 | 13076 | 13078 | 13080 | 13086 | 13087 | 13090 | 13091 |
| 13098 | 13100 | 13103 | 13106 | 13108 | 13109 | 13111 | 13114 | 13119 | 13121 | 13124 | 13126 |
| 13128 | 13129 | 13136 | 13139 | 13142 | 13152 | 13154 | 13155 | 13159 | 13166 | 13168 | 13169 |
| 13171 | 13173 | 13177 | 13179 | 13185 | 13192 | 13195 | 13206 | 13212 | 13221 | 13222 | 13225 |
| 13229 | 13235 | 13241 | 13247 | 13249 | 13250 | 13251 | 13252 | 13253 | 13255 | 13257 | 13259 |
| 13260 | 13262 | 13263 | 13267 | 13274 | 13275 | 13276 | 13279 | 13281 | 13289 | 13291 | |
| 13295 | 13301 | 13303 | 13307 | 13308 | 13310 | 13313 | 13317 | 13319 | 13325 | 13328 | 13336 |
| 13340 | 13344 | 13346 | 13347 | 13348 | 13350 | 13351 | 13353 | 13354 | 13355 | 13357 | 13360 |
| 13366 | 13375 | 13380 | 13387 | 13395 | 13397 | 13401 | 13410 | 13416 | 13418 | 13422 | 13423 |
| 13424 | 13430 | 13433 | 13439 | 13441 | 13442 | 13444 | 13447 | 13453 | 13454 | 13455 | 13458 |
| 13459 | 13461 | 13462 | 13463 | 13464 | 13465 | 13466 | 13467 | 13470 | 13473 | 13476 | 13479 |
| 13480 | 13484 | 13485 | 13492 | 13493 | 13496 | 13497 | 13498 | 13499 | 13502 | 13505 | 13507 |
| 13509 | 13522 | 13523 | 13525 | 13527 | 13534 | 13535 | 13536 | 13538 | 13539 | 13543 | 13546 |
| 13547 | 13548 | 13550 | 13551 | 13554 | 13556 | 13557 | 13560 | 13561 | 13562 | 13563 | 13568 |
| 13570 | 13571 | 13573 | 13575 | 13578 | 13584 | 13585 | 13586 | 13588 | 13592 | 13593 | 13596 |
| 13597 | 13598 | 13599 | 13600 | 13605 | 13606 | 13607 | 13608 | 13610 | 13611 | 13612 | 13615 |
| 13617 | 13618 | 13619 | 13620 | 13621 | 13623 | 13624 | 13625 | 13627 | 13628 | 13630 | 13633 |
| 13636 | 13638 | 13640 | 13643 | 13645 | 13648 | 13650 | 13651 | 13653 | 13654 | 13655 | 13664 |
| 13667 | 13669 | 13671 | 13672 | 13673 | 13675 | 13676 | 13677 | 13678 | 13679 | 13685 | 13686 |
| 13688 | 13689 | 13692 | 13694 | 13695 | 13696 | 13697 | 13698 | 13700 | 13702 | 13703 | 13705 |
| 13706 | 13717 | 13718 | 13719 | 13720 | 13723 | 13724 | 13725 | 13726 | 13728 | 13733 | 13735 |
| 13736 | 13737 | 13738 | 13740 | 13741 | 13743 | 13747 | 13748 | 13749 | 13751 | 13752 | 13755 |
| 13757 | 13758 | 13761 | 13763 | 13769 | 13773 | 13774 | 13777 | 13778 | 13779 | 13781 | 13783 |
| 13784 | 13785 | 13786 | 13787 | 13788 | 13790 | 13791 | 13796 | 13797 | 13798 | 13801 | 13806 |
| 13810 | 13811 | 13813 | 13815 | 13817 | 13818 | 13822 | 13824 | 13828 | 13831 | 13837 | 13839 |
| 13841 | 13842 | 13845 | 13846 | 13848 | 13849 | 13851 | 13853 | 13856 | 13861 | 13862 | 13865 |
| 13866 | 13868 | 13869 | 13871 | 13873 | 13874 | 13877 | 13878 | 13880 | 13881 | 13885 | 13887 |
| 13889 | 13890 | 13892 | 13901 | 13903 | 13904 | 13906 | 13907 | 13912 | 13913 | 13915 | 13919 |
| 13920 | 13921 | 13925 | 13927 | 13928 | 13932 | 13934 | 13938 | 13939 | 13944 | 13945 | 13948 |
| 13949 | 13950 | 13953 | 13957 | 13962 | 13963 | 13966 | 13967 | 13969 | 13971 | 13974 | 13981 |
| 13982 | 13983 | 13984 | 13985 | 13986 | 13992 | 13996 | 14000 | 14005 | 14010 | 14014 | 14015 |
| 14017 | 14019 | 14030 | 14033 | 14034 | 14035 | 14036 | 14038 | 14039 | 14045 | 14046 | 14048 |
| 14049 | 14052 | 14053 | 14062 | 14064 | 14065 | 14067 | 14068 | 14071 | 14073 | 14078 | 14079 |
| 14082 | 14083 | 14084 | 14085 | 14086 | 14087 | 14088 | 14089 | 14092 | 14095 | 14096 | 14098 |
| 14101 | 14102 | 14103 | 14104 | 14105 | 14107 | 14113 | 14114 | 14120 | 14121 | 14132 | 14135 |
| 14143 | 14145 | 14149 | 14151 | 14152 | 14153 | 14157 | 14172 | 14173 | 14175 | 14177 | |
| 14181 | 14182 | 14184 | 14185 | 14195 | 14197 | 14199 | 14201 | 14202 | 14204 | 14205 | 14209 |
| 14211 | 14214 | 14216 | 14220 | 14221 | 14225 | 14230 | 14231 | 14232 | 14233 | 14234 | 14238 |
| 14242 | 14245 | 14246 | 14247 | 14248 | 14251 | 14252 | 14254 | 14255 | 14256 | 14257 | 14258 |
| 14259 | 14260 | 14261 | 14262 | 14266 | 14267 | 14268 | 14273 | 14274 | 14276 | 14277 | |
| 14279 | 14281 | 14283 | 14285 | 14286 | 14287 | 14288 | 14291 | 14293 | 14295 | 14296 | 14298 |
| 14299 | 14300 | 14304 | 14306 | 14308 | 14309 | 14312 | 14313 | 14317 | 14319 | 14320 | 14321 |
| 14322 | 14324 | 14327 | 14328 | 14331 | 14332 | 14333 | 14336 | 14337 | 14342 | 14343 | 14344 |
| 14346 | 14348 | 14349 | 14352 | 14354 | 14355 | 14356 | 14359 | 14364 | 14365 | 14369 | 14370 |
| 14374 | 14376 | 14377 | 14379 | 14381 | 14382 | 14383 | 14389 | 14392 | 14393 | 14394 | 14396 |
| 14398 | 14399 | 14400 | 14406 | 14410 | 14412 | 14413 | 14421 | 14423 | 14424 | 14425 | 14428 |
| 14430 | 14431 | 14432 | 14439 | 14444 | 14450 | 14452 | 14453 | 14454 | 14455 | 14456 | 14462 |
| 14469 | 14470 | 14472 | 14473 | 14474 | 14476 | 14478 | 14484 | 14486 | 14487 | 14488 | |
| 14491 | 14496 | 14498 | 14499 | 14501 | 14502 | 14506 | 14510 | 14517 | 14520 | 14522 | 14523 |
| 14524 | 14526 | 14528 | 14529 | 14530 | 14534 | 14535 | 14537 | 14538 | 14540 | 14542 | 14547 |
| 14551 | 14555 | 14560 | 14561 | 14563 | 14564 | 14565 | 14566 | 14568 | 14569 | 14571 | 14575 |
| 14576 | 14577 | 14578 | 14586 | 14588 | 14589 | 14591 | 14592 | 14594 | 14596 | 14598 | 14599 |
| 14603 | 14608 | 14613 | 14615 | 14616 | 14617 | 14618 | 14619 | 14620 | 14622 | 14623 | 14624 |
| 14628 | 14631 | 14633 | 14634 | 14636 | 14637 | 14638 | 14639 | 14643 | 14649 | 14650 | 14651 |
| 14652 | 14654 | 14657 | 14659 | 14662 | 14663 | 14664 | 14665 | 14667 | 14668 | 14678 | 14679 |
| 14681 | 14682 | 14683 | 14684 | 14685 | 14687 | 14688 | 14689 | 14691 | 14693 | 14694 | 14695 |
| 14697 | 14699 | 14700 | 14702 | 14704 | 14705 | 14706 | 14707 | 14708 | 14709 | 14710 | 14711 |
| 14712 | 14715 | 14717 | 14718 | 14719 | 14720 | 14723 | 14731 | 14733 | 14734 | 14736 | 14737 |
| 14738 | 14739 | 14740 | 14741 | 14743 | 14744 | 14746 | 14748 | 14749 | 14752 | 14753 | 14755 |
| 14757 | 14761 | 14762 | 14766 | 14774 | 14777 | 14778 | 14780 | 14781 | 14783 | 14790 | 14791 |
| 14795 | 14806 | 14807 | 14809 | 14810 | 14812 | 14814 | 14815 | 14816 | 14817 | 14820 | 14825 |

TABLE 13A-continued

Seed Oil Yield/Content

| | | | | | | | | | | | |
|---|---|---|---|---|---|---|---|---|---|---|---|
| 14829 | 14830 | 14831 | 14838 | 14840 | 14841 | 14842 | 14845 | 14847 | 14852 | 14858 | 14860 |
| 14861 | 14863 | 14864 | 14867 | 14869 | 14870 | 14871 | 14872 | 14873 | 14876 | 14879 | 14880 |
| 14882 | 14883 | 14885 | 14886 | 14888 | 14891 | 14892 | 14894 | 14895 | 14896 | 14901 | 14904 |
| 14905 | 14908 | 14909 | 14910 | 14920 | 14926 | 14931 | 14932 | 14934 | 14935 | 14938 | 14940 |
| 14943 | 14954 | 14955 | 14957 | 14958 | 14962 | 14963 | 14964 | 14968 | 14977 | 14978 | 14982 |
| 14983 | 14985 | 14986 | 14989 | 14990 | 14991 | 14994 | 14996 | 14999 | 15003 | 15006 | 15008 |
| 15011 | 15015 | 15016 | 15017 | 15018 | 15019 | 15022 | 15025 | 15026 | 15027 | 15029 | 15033 |
| 15036 | 15037 | 15047 | 15048 | 15051 | 15052 | 15055 | 15056 | 15058 | 15059 | 15060 | 15063 |
| 15064 | 15066 | 15067 | 15070 | 15071 | 15072 | 15073 | 15074 | 15075 | 15079 | 15081 | 15082 |
| 15084 | 15085 | 15088 | 15092 | 15093 | 15095 | 15096 | 15100 | 15101 | 15102 | 15103 | 15105 |
| 15107 | 15111 | 15115 | 15120 | 15123 | 15124 | 15125 | 15127 | 15131 | 15132 | 15136 | 15140 |
| 15141 | 15142 | 15143 | 15147 | 15151 | 15157 | 15158 | 15160 | 15162 | 15163 | 15164 | 15165 |
| 15166 | 15167 | 15168 | 15169 | 15170 | 15172 | 15174 | 15175 | 15176 | 15179 | 15180 | 15182 |
| 15183 | 15184 | 15187 | 15188 | 15189 | 15190 | 15191 | 15192 | 15193 | 15196 | 15198 | 15202 |
| 15211 | 15213 | 15214 | 15215 | 15216 | 15217 | 15219 | 15220 | 15221 | 15222 | 15223 | 15224 |
| 15226 | 15229 | 15232 | 15234 | 15236 | 15238 | 15239 | 15242 | 15256 | 15257 | 15268 | 15269 |
| 15271 | 15272 | 15273 | 15287 | 15288 | 15289 | 15292 | 15293 | 15295 | 15300 | 15301 | 15302 |
| 15305 | 15306 | 15310 | 15313 | 15316 | 15317 | 15322 | 15334 | 15335 | 15336 | 15337 | 15342 |
| 15343 | 15344 | 15350 | 15351 | 15357 | 15358 | 15360 | 15365 | 15366 | 15367 | 15370 | 15372 |
| 15375 | 15376 | 15377 | 15379 | 15380 | 15383 | 15388 | 15391 | 15392 | 15397 | 15398 | 15401 |
| 15406 | 15408 | 15409 | 15413 | 15415 | 15416 | 15417 | 15422 | 15423 | 15425 | 15426 | 15427 |
| 15428 | 15441 | 15442 | 15446 | 15448 | 15450 | 15454 | 15456 | 15459 | 15461 | 15462 | 15466 |
| 15467 | 15471 | 15480 | 15481 | 15482 | 15485 | 15490 | 15492 | 15498 | 15500 | 15510 | 15511 |
| 15512 | 15513 | 15518 | 15519 | 15521 | 15523 | 15525 | 15526 | 15530 | 15531 | 15532 | 15533 |
| 15534 | 15535 | 15536 | 15538 | 15541 | 15545 | 15546 | 15547 | 15548 | 15550 | 15551 | 15553 |
| 15555 | 15557 | 15558 | 15561 | 15562 | 15563 | 15564 | 15565 | 15567 | 15569 | 15570 | 15571 |
| 15575 | 15576 | 15577 | 15578 | 15582 | 15583 | 15585 | 15587 | 15593 | 15596 | 15601 | 15603 |
| 15607 | 15608 | 15609 | 15611 | 15612 | 15613 | 15614 | 15615 | 15616 | 15617 | 15621 | 15622 |
| 15623 | 15624 | 15625 | 15626 | 15629 | 15630 | 15633 | 15634 | 15639 | 15642 | 15646 | 15647 |
| 15648 | 15649 | 15650 | 15651 | 15652 | 15654 | 15655 | 15656 | 15657 | 15658 | 15659 | 15661 |
| 15666 | 15667 | 15668 | 15671 | 15672 | 15676 | 15679 | 15682 | 15683 | 15688 | 15702 | 15703 |
| 15704 | 15708 | 15709 | 15710 | 15711 | 15717 | 15718 | 15724 | 15725 | 15727 | 15732 | 15734 |
| 15737 | 15739 | 15742 | 15744 | 15745 | 15747 | 15748 | 15751 | 15756 | 15759 | 15760 | 15765 |
| 15766 | 15769 | 15774 | 15776 | 15777 | 15781 | 15783 | 15784 | 15785 | 15790 | 15791 | 15793 |
| 15794 | 15795 | 15796 | 15799 | 15808 | 15810 | 15811 | 15814 | 15816 | 15818 | 15822 | 15823 |
| 15824 | 15827 | 15829 | 15831 | 15836 | 15837 | 15841 | 15850 | 15852 | 15853 | 15856 | 15862 |
| 15863 | 15869 | 15871 | 15882 | 15883 | 15884 | 15885 | 15890 | 15891 | 15892 | 15894 | 15896 |
| 15897 | 15901 | 15902 | 15903 | 15904 | 15905 | 15906 | 15907 | 15909 | 15912 | 15917 | 15918 |
| 15919 | 15920 | 15923 | 15924 | 15926 | 15928 | 15930 | 15931 | 15934 | 15935 | 15936 | 15937 |
| 15938 | 15940 | 15942 | 15943 | 15944 | 15949 | 15951 | 15952 | 15953 | 15954 | 15958 | 15959 |
| 15961 | 15963 | 15969 | 15973 | 15978 | 15982 | 15983 | 15984 | 15985 | 15987 | 15988 | 15989 |
| 15990 | 15991 | 15992 | 15996 | 15997 | 15998 | 15999 | 16000 | 16001 | 16004 | 16005 | 16008 |
| 16009 | 16014 | 16017 | 16021 | 16023 | 16024 | 16025 | 16026 | 16028 | 16029 | 16030 | |
| 16031 | 16032 | 16033 | 16034 | 16035 | 16036 | 16037 | 16039 | 16041 | 16042 | 16045 | 16046 |
| 16047 | 16048 | 16049 | 16052 | 16056 | 16057 | 16058 | 16061 | 16062 | 16067 | 16069 | 16073 |
| 16074 | 16079 | 16092 | 16093 | 16094 | 16095 | 16098 | 16099 | 16105 | 16109 | 16110 | 16111 |
| 16117 | 16118 | 16122 | 16125 | 16127 | 16128 | 16129 | 16131 | 16132 | 16135 | 16138 | 16139 |
| 16143 | 16145 | 16149 | 16150 | 16153 | 16157 | 16160 | 16163 | 16164 | 16166 | 16167 | 16172 |
| 16173 | 16175 | 16176 | 16177 | 16178 | 16181 | 16189 | 16190 | 16192 | 16196 | 16198 | 16199 |
| 16203 | 16204 | 16205 | 16209 | 16210 | 16212 | 16218 | 16227 | 16228 | 16231 | 16233 | 16236 |
| 16238 | 16242 | 16246 | 16254 | 16256 | 16257 | 16258 | 16263 | 16264 | 16265 | 16267 | 16269 |
| 16272 | 16273 | 16274 | 16275 | 16276 | 16278 | 16280 | 16282 | 16284 | 16285 | 16289 | 16290 |
| 16291 | 16294 | 16295 | 16296 | 16298 | 16301 | 16302 | 16303 | 16304 | 16306 | 16308 | 16311 |
| 16312 | 16314 | 16315 | 16316 | 16317 | 16318 | 16322 | 16324 | 16328 | 16331 | 16335 | 16337 |
| 16341 | 16342 | 16344 | 16345 | 16346 | 16347 | 16348 | 16349 | 16351 | 16352 | 16353 | 16354 |
| 16356 | 16357 | 16359 | 16362 | 16363 | 16367 | 16370 | 16373 | 16376 | 16383 | 16385 | 16386 |
| 16388 | 16389 | 16391 | 16392 | 16402 | 16404 | 16407 | 16416 | 16418 | 16420 | 16421 | 16423 |
| 16428 | 16429 | 16430 | 16433 | 16434 | 16437 | 16441 | 16442 | 16445 | 16446 | 16449 | 16454 |
| 16457 | 16458 | 16463 | 16464 | 16465 | 16466 | 16470 | 16474 | 16476 | 16478 | 16480 | 16481 |
| 16483 | 16488 | 16489 | 16491 | 16494 | 16496 | 16497 | 16499 | 16506 | 16508 | 16512 | 16513 |
| 16514 | 16519 | 16521 | 16524 | 16525 | 16532 | 16533 | 16536 | 16537 | 16539 | 16545 | 16549 |
| 16550 | 16552 | 16555 | 16558 | 16560 | 16561 | 16563 | 16564 | 16571 | 16576 | 16580 | 16581 |
| 16583 | 16586 | 16590 | 16592 | 16594 | 16595 | 16596 | 16597 | 16598 | 16600 | 16601 | 16603 |
| 16604 | 16606 | 16608 | 16610 | 16612 | 16613 | 16614 | 16615 | 16619 | 16632 | 16639 | 16640 |
| 16641 | 16646 | 16647 | 16650 | 16662 | 16663 | 16664 | 16669 | 16670 | 16675 | 16677 | 16678 |
| 16679 | 16681 | 16687 | 16688 | 16690 | 16691 | 16692 | 16693 | 16694 | 16700 | 16702 | 16703 |
| 16704 | 16705 | 16706 | 16707 | 16708 | 16709 | 16720 | 16721 | 16726 | 16731 | 16734 | 16735 |
| 16736 | 16743 | 16747 | 16748 | 16749 | 16751 | 16752 | 16756 | 16757 | 16759 | 16760 | 16761 |
| 16763 | 16766 | 16773 | 16774 | 16776 | 16777 | 16778 | 16779 | 16783 | 16785 | 16787 | 16789 |
| 16792 | 16793 | 16794 | 16795 | 16799 | 16804 | 16805 | 16808 | 16809 | 16812 | 16815 | 16819 |
| 16821 | 16823 | 16824 | 16827 | 16828 | 16830 | 16835 | 16837 | 16839 | 16841 | 16844 | 16846 |
| 16850 | 16851 | 16854 | 16860 | 16863 | 16864 | 16865 | 16866 | 16867 | 16869 | 16870 | 16871 |
| 16873 | 16876 | 16878 | 16882 | 16883 | 16888 | 16890 | 16892 | 16893 | 16895 | 16897 | 16900 |
| 16901 | 16902 | 16905 | 16906 | 16907 | 16908 | 16909 | 16910 | 16911 | 16912 | 16913 | 16914 |
| 16915 | 16918 | 16920 | 16921 | 16922 | 16924 | 16926 | 16927 | 16928 | 16929 | 16932 | 16933 |
| 16935 | 16938 | 16939 | 16940 | 16941 | 16943 | 16944 | 16945 | 16946 | 16949 | 16950 | 16954 |
| 16955 | 16956 | 16959 | 16965 | 16968 | 16970 | 16972 | 16973 | 16975 | 16977 | 16980 | 16981 |

TABLE 13A-continued

Seed Oil Yield/Content

| | | | | | | | | | | | |
|---|---|---|---|---|---|---|---|---|---|---|---|
| 16983 | 16984 | 16985 | 16987 | 16991 | 16992 | 16995 | 16996 | 16997 | 16998 | 17000 | 17003 |
| 17009 | 17011 | 17012 | 17014 | 17015 | 17016 | 17017 | 17021 | 17023 | 17024 | 17027 | 17028 |
| 17031 | 17032 | 17037 | 17039 | 17040 | 17043 | 17044 | 17047 | 17050 | 17051 | 17053 | 17058 |
| 17059 | 17062 | 17063 | 17065 | 17067 | 17068 | 17069 | 17072 | 17073 | 17074 | 17085 | 17086 |
| 17088 | 17089 | 17093 | 17103 | 17104 | 17106 | 17109 | 17110 | 17111 | 17112 | 17113 | 17114 |
| 17115 | 17116 | 17123 | 17125 | 17126 | 17128 | 17129 | 17141 | 17144 | 17145 | 17146 |
| 17147 | 17152 | 17155 | 17156 | 17157 | 17158 | 17161 | 17164 | 17165 | 17169 | 17171 | 17176 |
| 17178 | 17180 | 17181 | 17182 | 17183 | 17184 | 17188 | 17190 | 17192 | 17196 | 17198 | 17201 |
| 17204 | 17206 | 17220 | 17225 | 17226 | 17228 | 17231 | 17234 | 17235 | 17237 | 17239 | 17240 |
| 17242 | 17244 | 17249 | 17251 | 17252 | 17253 | 17255 | 17256 | 17257 | 17258 | 17260 | 17261 |
| 17263 | 17264 | 17265 | 17268 | 17270 | 17272 | 17273 | 17276 | 17277 | 17278 | 17279 | 17281 |
| 17282 | 17284 | 17288 | 17290 | 17291 | 17292 | 17293 | 17296 | 17298 | 17299 | 17300 | 17301 |
| 17307 | 17308 | 17319 | 17321 | 17324 | 17325 | 17328 | 17330 | 17338 | 17340 | 17341 | 17343 |
| 17345 | 17347 | 17348 | 17351 | 17352 | 17353 | 17354 | 17355 | 17358 | 17359 | 17360 | 17361 |
| 17362 | 17364 | 17366 | 17367 | 17375 | 17388 | 17389 | 17391 | 17392 | 17394 | 17398 | 17399 |
| 17400 | 17403 | 17405 | 17407 | 17408 | 17409 | 17410 | 17411 | 17412 | 17413 | 17414 | 17422 |
| 17423 | 17426 | 17427 | 17429 | 17430 | 17431 | 17432 | 17433 | 17434 | 17435 | 17436 | 17437 |
| 17439 | 17440 | 17442 | 17447 | 17449 | 17450 | 17451 | 17454 | 17457 | 17459 | 17460 | 17461 |
| 17463 | 17466 | 17467 | 17470 | 17475 | 17476 | 17486 | 17487 | 17488 | 17489 | 17498 | 17502 |
| 17507 | 17509 | 17510 | 17511 | 17513 | 17515 | 17516 | 17518 | 17519 | 17522 | 17523 | 17525 |
| 17526 | 17528 | 17529 | 17530 | 17531 | 17536 | 17537 | 17538 | 17542 | 17545 | 17551 | 17552 |
| 17553 | 17554 | 17555 | 17556 | 17564 | 17565 | 17567 | 17568 | 17570 | 17571 | 17572 | 17573 |
| 17577 | 17578 | 17579 | 17580 | 17587 | 17594 | 17602 | 17605 | 17606 | 17607 | 17609 | 17610 |
| 17613 | 17614 | 17615 | 17616 | 17619 | 17622 | 17623 | 17625 | 17626 | 17632 | 17633 | 17635 |
| 17636 | 17645 | 17646 | 17647 | 17648 | 17650 | 17652 | 17653 | 17656 | 17658 | 17660 | 17661 |
| 17664 | 17665 | 17670 | 17671 | 17674 | 17675 | 17676 | 17678 | 17679 | 17680 | 17681 | 17694 |
| 17695 | 17696 | 17700 | 17701 | 17705 | 17711 | 17715 | 17716 | 17719 | 17720 | 17722 | 17724 |
| 17725 | 17729 | 17730 | 17731 | 17736 | 17738 | 17739 | 17741 | 17742 | 17745 | 17749 | 17762 |
| 17764 | 17770 | 17771 | 17779 | 17780 | 17783 | 17784 | 17786 | 17788 | 17790 | 17792 | 17795 |
| 17796 | 17798 | 17801 | 17807 | 17809 | 17813 | 17819 | 17820 | 17822 | 17832 | 17835 | 17837 |
| 17838 | 17840 | 17841 | 17846 | 17847 | 17848 | 17849 | 17850 | 17854 | 17860 | 17861 | 17863 |
| 17864 | 17865 | 17866 | 17867 | 17868 | 17869 | 17870 | 17872 | 17876 | 17881 | 17882 | 17884 |
| 17885 | 17886 | 17887 | 17888 | 17889 | 17892 | 17893 | 17898 | 17899 | 17901 | 17904 | 17909 |
| 17913 | 17914 | 17918 | 17921 | 17923 | 17926 | 17927 | 17929 | 17934 | 17935 | 17948 | 17949 |
| 17951 | 17955 | 17956 | 17958 | 17960 | 17961 | 17966 | 17968 | 17971 | 17974 | 17981 | 17982 |
| 17984 | 17985 | 17986 | 17987 | 17988 | 17989 | 17991 | 17993 | 17994 | 17995 | 17996 | 17997 |
| 17999 | 18002 | 18003 | 18006 | 18008 | 18010 | 18012 | 18013 | 18015 | 18018 | 18020 | 18021 |
| 18025 | 18026 | 18029 | 18030 | 18031 | 18034 | 18036 | 18039 | 18041 | 18043 | 18045 | 18049 |
| 18050 | 18051 | 18054 | 18055 | 18056 | 18059 | 18060 | 18062 | 18063 | 18066 | 18067 |
| 18069 | 18070 | 18071 | 18073 | 18074 | 18075 | 18076 | 18077 | 18078 | 18079 | 18080 | 18081 |
| 18082 | 18087 | 18089 | 18092 | 18099 | 18100 | 18101 | 18104 | 18105 | 18108 | 18113 | 18114 |
| 18116 | 18117 | 18119 | 18120 | 18121 | 18124 | 18125 | 18126 | 18127 | 18129 | 18130 | 18131 |
| 18133 | 18135 | 18138 | 18139 | 18140 | 18141 | 18143 | 18144 | 18148 | 18149 | 18151 |
| 18152 | 18154 | 18155 | 18156 | 18157 | 18158 | 18159 | 18170 | 18171 | 18173 | 18175 | 18176 |
| 18179 | 18180 | 18183 | 18185 | 18186 | 18187 | 18188 | 18189 | 18190 | 18191 | 18192 | 18193 |
| 18195 | 18199 | 18201 | 18204 | 18205 | 18209 | 18210 | 18211 | 18213 | 18219 | 18220 | 18221 |
| 18223 | 18226 | 18227 | 18228 | 18233 | 18235 | 18237 | 18241 | 18242 | 18245 | 18248 | 18259 |
| 18265 | 18266 | 18267 | 18270 | 18271 | 18274 | 18275 | 18276 | 18277 | 18278 | 18280 | 18281 |
| 18282 | 18285 | 18288 | 18293 | 18294 | 18295 | 18298 | 18299 | 18304 | 18308 | 18310 | 18311 |
| 18313 | 18314 | 18318 | 18322 | 18325 | 18327 | 18328 | 18329 | 18330 | 18338 | 18343 | 18344 |
| 18345 | 18349 | 18351 | 18356 | 18357 | 18359 | 18365 | 18367 | 18368 | 18369 | 18370 | 18371 |
| 18372 | 18373 | 18374 | 18377 | 18384 | 18390 | 18394 | 18395 | 18397 | 18401 | 18402 | 18403 |
| 18405 | 18410 | 18411 | 18417 | 18418 | 18419 | 18424 | 18425 | 18429 | 18430 | 18431 | 18432 |
| 18435 | 18442 | 18443 | 18444 | 18447 | 18449 | 18451 | 18453 | 18455 | 18464 | 18467 | 18468 |
| 18470 | 18473 | 18474 | 18475 | 18482 | 18484 | 18485 | 18486 | 18487 | 18489 | 18490 | 18491 |
| 18494 | 18500 | 18508 | 18512 | 18515 | 18516 | 18517 | 18519 | 18522 | 18528 | 18529 | 18535 |
| 18537 | 18544 | 18545 | 18548 | 18549 | 18550 | 18551 | 18556 | 18559 | 18569 | 18572 | 18573 |
| 18575 | 18576 | 18580 | 18581 | 18583 | 18588 | 18592 | 18593 | 18594 | 18595 | 18598 | 18600 |
| 18604 | 18608 | 18611 | 18612 | 18614 | 18616 | 18617 | 18618 | 18619 | 18621 | 18625 | 18630 |
| 18633 | 18634 | 18636 | 18640 | 18652 | 18655 | 18656 | 18658 | 18660 | 18661 | 18662 | 18668 |
| 18669 | 18672 | 18673 | 18681 | 18682 | 18683 | 18688 | 18692 | 18697 | 18699 | 18709 | 18710 |
| 18711 | 18718 | 18719 | 18726 | 18730 | 18731 | 18732 | 18733 | 18735 | 18740 | 18741 | 18743 |
| 18744 | 18748 | 18749 | 18751 | 18752 | 18759 | 18760 | 18761 | 18766 | 18767 | 18768 | 18771 |
| 18775 | 18779 | 18781 | 18782 | 18783 | 18785 | 18788 | 18790 | 18792 | 18802 | 18804 | 18822 |
| 18824 | 18825 | 18827 | 18828 | 18829 | 18834 | 18835 | 18837 | 18838 | 18839 | 18846 | 18858 |
| 18860 | 18861 | 18862 | 18863 | 18869 | 18879 | 18884 | 18896 | 18897 | 18904 | 18908 | 18910 |
| 18912 | 18915 | 18916 | 18920 | 18922 | 18924 | 18925 | 18926 | 18929 | 18930 | 18933 | 18937 |
| 18941 | 18945 | 18952 | 18953 | 18958 | 18959 | 18961 | 18964 | 18968 | 18977 | 18978 |
| 18980 | 18981 | 18986 | 18987 | 18990 | 18995 | 19000 | 19005 | 19007 | 19008 | 19009 | 19010 |
| 19019 | 19020 | 19022 | 19023 | 19026 | 19038 | 19042 | 19049 | 19051 | 19055 | 19059 | 19067 |
| 19069 | 19070 | 19073 | 19074 | 19075 | 19076 | 19077 | 19078 | 19080 | 19083 | 19084 | 19085 |
| 19088 | 19090 | 19091 | 19093 | 19099 | 19102 | 19104 | 19107 | 19115 | 19117 | 19118 | 19120 |
| 19122 | 19124 | 19127 | 19130 | 19131 | 19137 | 19139 | 19155 | 19156 | 19158 | 19160 | 19163 |
| 19169 | 19171 | 19173 | 19174 | 19176 | 19178 | 19181 | 19183 | 19184 | 19191 | 19195 | 19197 |
| 19198 | 19199 | 19200 | 19201 | 19202 | 19203 | 19205 | 19212 | 19214 | 19216 | 19221 | 19222 |
| 19228 | 19230 | 19231 | 19233 | 19234 | 19238 | 19239 | 19240 | 19242 | 19243 | 19245 | 19246 |
| 19250 | 19253 | 19255 | 19257 | 19258 | 19259 | 19260 | 19261 | 19262 | 19263 | 19264 | 19271 |

TABLE 13A-continued

Seed Oil Yield/Content

| | | | | | | | | | | | |
|---|---|---|---|---|---|---|---|---|---|---|---|
| 19273 | 19276 | 19277 | 19280 | 19282 | 19292 | 19294 | 19295 | 19300 | 19301 | 19306 | 19307 |
| 19309 | 19312 | 19316 | 19317 | 19325 | 19326 | 19330 | 19332 | 19333 | 19334 | 19338 | 19341 |
| 19342 | 19344 | 19346 | 19348 | 19351 | 19352 | 19355 | 19363 | 19364 | 19365 | 19366 | 19367 |
| 19368 | 19369 | 19370 | 19372 | 19376 | 19377 | 19378 | 19381 | 19387 | 19388 | 19389 | 19390 |
| 19391 | 19393 | 19394 | 19409 | 19412 | 19414 | 19416 | 19420 | 19422 | 19424 | 19433 | 19438 |
| 19441 | 19444 | 19445 | 19446 | 19447 | 19448 | 19449 | 19450 | 19461 | 19464 | 19465 | 19469 |
| 19470 | 19472 | 19477 | 19483 | 19486 | 19491 | 19493 | 19495 | 19496 | 19498 | 19501 | 19502 |
| 19503 | 19505 | 19511 | 19517 | 19522 | 19523 | 19524 | 19525 | 19528 | 19530 | 19532 | 19533 |
| 19534 | 19539 | 19540 | 19545 | 19549 | 19550 | 19552 | 19553 | 19554 | 19555 | 19557 | 19562 |
| 19566 | 19567 | 19572 | 19573 | 19574 | 19575 | 19578 | 19580 | 19581 | 19582 | 19583 | 19584 |
| 19585 | 19589 | 19590 | 19593 | 19594 | 19595 | 19597 | 19599 | 19612 | 19614 | 19615 | 19616 |
| 19617 | 19620 | 19623 | 19628 | 19633 | 19639 | 19644 | 19645 | 19649 | 19652 | 19655 | 19656 |
| 19658 | 19661 | 19663 | 19664 | 19666 | 19667 | 19671 | 19672 | 19681 | 19683 | 19684 | 19686 |
| 19688 | 19689 | 19690 | 19698 | 19699 | 19701 | 19702 | 19703 | 19704 | 19708 | 19711 | 19712 |
| 19713 | 19714 | 19715 | 19716 | 19717 | 19719 | 19735 | 19738 | 19739 | 19740 | 19741 | 19742 |
| 19743 | 19747 | 19751 | 19752 | 19754 | 19757 | 19763 | 19768 | 19769 | 19771 | 19772 | 19777 |
| 19781 | 19787 | 19791 | 19795 | 19796 | 19797 | 19799 | 19801 | 19802 | 19804 | 19806 | 19807 |
| 19808 | 19809 | 19810 | 19811 | 19812 | 19813 | 19814 | 19816 | 19817 | 19818 | 19820 | 19822 |
| 19825 | 19828 | 19831 | 19835 | 19838 | 19844 | 19846 | 19847 | 19848 | 19850 | 19852 | 19853 |
| 19854 | 19856 | 19857 | 19859 | 19860 | 19863 | 19866 | 19867 | 19876 | 19879 | 19881 | 19884 |
| 19889 | 19893 | 19900 | 19901 | 19905 | 19907 | 19908 | 19910 | 19912 | 19913 | 19915 | 19918 |
| 19919 | 19921 | 19922 | 19925 | 19926 | 19929 | 19930 | 19935 | 19946 | 19956 | 19957 | 19958 |
| 19966 | 19970 | 19973 | 19979 | 19981 | 19990 | 19997 | 19998 | 19999 | 20001 | 20007 | 20011 |
| 20014 | 20030 | 20032 | 20034 | 20035 | 20037 | 20039 | 20040 | 20041 | 20042 | 20043 | 20044 |
| 20045 | 20050 | 20051 | 20053 | 20054 | 20055 | 20056 | 20060 | 20068 | 20070 | 20071 | 20074 |
| 20076 | 20080 | 20082 | 20083 | 20086 | 20089 | 20090 | 20092 | 20093 | 20097 | 20099 | 20100 |
| 20101 | 20103 | 20106 | 20108 | 20109 | 20110 | 20118 | 20119 | 20121 | 20123 | 20126 | 20131 |
| 20133 | 20136 | 20140 | 20151 | 20152 | 20153 | 20154 | 20155 | 20156 | 20159 | 20160 | 20162 |
| 20169 | 20180 | 20181 | 20190 | 20191 | 20192 | 20195 | 20207 | 20216 | 20218 | 20220 | 20221 |
| 20222 | 20228 | 20229 | 20240 | 20241 | 20244 | 20245 | 20249 | 20253 | 20262 | 20263 | 20272 |
| 20275 | 20278 | 20280 | 20286 | 20290 | 20297 | 20298 | 20300 | 20301 | 20307 | 20308 | 20312 |
| 20313 | 20317 | 20319 | 20322 | 20326 | 20340 | 20342 | 20349 | 20350 | 20357 | 20358 | 20365 |
| 20369 | 20370 | 20374 | 20375 | 20377 | 20378 | 20386 | 20398 | 20400 | 20402 | 20404 | 20405 |
| 20409 | 20410 | 20412 | 20417 | 20418 | 20419 | 20420 | 20422 | 20423 | 20424 | 20425 | 20428 |
| 20429 | 20430 | 20437 | 20441 | 20444 | 20451 | 20452 | 20454 | 20457 | 20460 | 20461 | 20463 |
| 20464 | 20465 | 20466 | 20467 | 20468 | 20470 | 20473 | 20474 | 20476 | 20477 | 20480 | 20481 |
| 20482 | 20486 | 20489 | 20490 | 20491 | 20494 | 20495 | 20496 | 20500 | 20501 | 20503 | 20504 |
| 20505 | 20506 | 20508 | 20511 | 20512 | 20513 | 20515 | 20519 | 20523 | 20524 | 20525 | 20526 |
| 20529 | 20531 | 20532 | 20533 | 20534 | 20535 | 20536 | 20537 | 20539 | 20540 | 20543 | 20545 |
| 20548 | 20553 | 20554 | 20555 | 20556 | 20563 | 20564 | 20565 | 20567 | 20568 | 20570 | 20573 |
| 20576 | 20577 | 20578 | 20579 | 20580 | 20583 | 20584 | 20586 | 20588 | 20592 | 20593 | 20594 |
| 20598 | 20599 | 20600 | 20601 | 20602 | 20603 | 20605 | 20610 | 20612 | 20614 | 20615 | 20616 |
| 20617 | 20618 | 20619 | 20624 | 20627 | 20631 | 20636 | 20637 | 20639 | 20643 | 20646 | 20647 |
| 20648 | 20650 | 20655 | 20656 | 20661 | 20662 | 20663 | 20664 | 20665 | 20668 | 20670 | 20671 |
| 20673 | 20674 | 20677 | 20682 | 20688 | 20689 | 20690 | 20691 | 20692 | 20701 | 20703 | 20706 |
| 20707 | 20708 | 20709 | 20713 | 20715 | 20716 | 20718 | 20719 | 20720 | 20722 | 20725 | 20726 |
| 20730 | 20731 | 20736 | 20737 | 20739 | 20743 | 20744 | 20745 | 20746 | 20748 | 20749 | 20750 |
| 20752 | 20753 | 20757 | 20758 | 20761 | 20762 | 20765 | 20766 | 20768 | 20769 | 20771 | 20772 |
| 20773 | 20774 | 20775 | 20777 | 20778 | 20779 | 20780 | 20784 | 20785 | 20787 | 20789 | 20791 |
| 20797 | 20800 | 20801 | 20802 | 20803 | 20805 | 20806 | 20809 | 20811 | 20817 | 20821 | 20822 |
| 20826 | 20827 | 20828 | 20829 | 20831 | 20835 | 20836 | 20838 | 20839 | 20840 | 20848 | 20849 |
| 20850 | 20852 | 20854 | 20856 | 20857 | 20858 | 20859 | 20860 | 20865 | 20866 | 20868 | 20871 |
| 20874 | 20875 | 20876 | 20878 | 20886 | 20887 | 20889 | 20892 | 20893 | 20894 | 20895 | 20899 |
| 20903 | 20910 | 20912 | 20917 | 20919 | 20920 | 20921 | 20924 | 20928 | 20931 | 20936 | 20939 |
| 20942 | 20944 | 20946 | 20948 | 20951 | 20952 | 20959 | 20961 | 20963 | 20968 | 20970 | 20973 |
| 20980 | 20985 | 20987 | 20988 | 20989 | 20990 | 20991 | 20992 | 20993 | 20998 | 20999 | 21003 |
| 21004 | 21006 | 21008 | 21010 | 21017 | 21019 | 21021 | 21025 | 21026 | 21031 | 21032 | 21034 |
| 21035 | 21037 | 21042 | 21044 | 21045 | 21046 | 21054 | 21057 | 21059 | 21062 | 21063 | 21064 |
| 21068 | 21070 | 21071 | 21072 | 21073 | 21074 | 21075 | 21077 | 21084 | 21086 | 21091 | 21093 |
| 21101 | 21102 | 21103 | 21106 | 21111 | 21114 | 21119 | 21120 | 21124 | 21125 | 21129 | 21130 |
| 21131 | 21133 | 21134 | 21142 | 21143 | 21144 | 21147 | 21148 | 21149 | 21152 | 21154 | 21156 |
| 21159 | 21160 | 21161 | 21162 | 21164 | 21166 | 21167 | 21168 | 21170 | 21171 | 21173 | 21180 |
| 21183 | 21185 | 21186 | 21191 | 21193 | 21194 | 21196 | 21200 | 21204 | 21205 | 21206 | 21209 |
| 21210 | 21211 | 21214 | 21215 | 21216 | 21219 | 21220 | 21232 | 21235 | 21236 | 21243 | 21244 |
| 21245 | 21249 | 21252 | 21254 | 21256 | 21257 | 21260 | 21261 | 21263 | 21267 | 21271 | 21273 |
| 21280 | 21281 | 21283 | 21284 | 21285 | 21291 | 21293 | 21294 | 21295 | 21296 | 21297 | 21298 |
| 21301 | 21302 | 21304 | 21307 | 21312 | 21313 | 21314 | 21315 | 21320 | 21323 | 21324 | 21328 |
| 21329 | 21331 | 21332 | 21333 | 21334 | 21335 | 21338 | 21339 | 21340 | 21348 | 21349 | 21350 |
| 21354 | 21361 | 21363 | 21364 | 21366 | 21368 | 21371 | 21373 | 21374 | 21375 | 21376 | 21377 |
| 21379 | 21380 | 21381 | 21384 | 21387 | 21389 | 21395 | 21396 | 21398 | 21399 | 21400 | 21402 |
| 21403 | 21410 | 21411 | 21416 | 21417 | 21420 | 21421 | 21425 | 21426 | 21428 | 21430 | 21432 |
| 21434 | 21436 | 21441 | 21443 | 21445 | 21446 | 21447 | 21449 | 21459 | 21460 | 21462 | 21464 |
| 21466 | 21468 | 21470 | 21471 | 21479 | 21481 | 21483 | 21485 | 21489 | 21492 | 21503 | 21507 |
| 21512 | 21513 | 21521 | 21527 | 21532 | 21535 | 21546 | 21551 | 21552 | 21553 | 21557 | 21560 |
| 21562 | 21568 | 21569 | 21570 | 21571 | 21572 | 21574 | 21576 | 21582 | 21585 | 21586 | 21588 |
| 21590 | 21596 | 21597 | 21607 | 21608 | 21620 | 21624 | 21628 | 21631 | 21637 | 21639 | 21642 |
| 21646 | 21651 | 21655 | 21657 | 21661 | 21662 | 21664 | 21666 | 21670 | 21672 | 21674 | 21676 |

TABLE 13A-continued

Seed Oil Yield/Content

| | | | | | | | | | | | |
|---|---|---|---|---|---|---|---|---|---|---|---|
| 21677 | 21678 | 21680 | 21681 | 21682 | 21683 | 21686 | 21687 | 21689 | 21691 | 21692 | 21694 |
| 21695 | 21697 | 21700 | 21701 | 21702 | 21704 | 21705 | 21706 | 21707 | 21709 | 21710 | 21711 |
| 21712 | 21713 | 21714 | 21716 | 21717 | 21718 | 21720 | 21722 | 21723 | 21726 | 21729 | 21730 |
| 21731 | 21732 | 21733 | 21734 | 21735 | 21736 | 21737 | 21738 | 21739 | 21740 | 21741 | 21742 |
| 21745 | 21748 | 21749 | 21754 | 21757 | 21758 | 21759 | 21760 | 21763 | 21766 | 21768 | 21769 |
| 21774 | 21776 | 21778 | 21779 | 21781 | 21783 | 21784 | 21791 | 21794 | 21795 | 21800 | 21801 |
| 21803 | 21809 | 21813 | 21816 | 21817 | 21819 | 21820 | 21822 | 21824 | 21825 | 21828 | 21833 |
| 21835 | 21841 | 21844 | 21845 | 21847 | 21855 | 21860 | 21864 | 21872 | 21873 | 21883 | 21891 |
| 21893 | 21895 | 21896 | 21900 | 21908 | 21911 | 21929 | 21930 | 21937 | 21939 | 21941 | 21960 |
| 21963 | 21968 | 21972 | 21973 | 21975 | 21987 | 21988 | 21991 | 21992 | 21993 | 21994 | 21998 |
| 21999 | 22001 | 22006 | 22011 | 22012 | 22013 | 22014 | 22015 | 22017 | 22020 | 22021 | 22032 |
| 22033 | 22034 | 22035 | 22036 | 22038 | 22046 | 22047 | 22048 | 22053 | 22061 | 22066 | 22071 |
| 22072 | 22075 | 22078 | 22088 | 22094 | 22101 | 22102 | 22106 | 22107 | 22115 | 22116 | 22124 |
| 22125 | 22126 | 22127 | 22132 | 22134 | 22138 | 22146 | 22147 | 22163 | 22165 | 22170 | 22180 |
| 22186 | 22200 | 22205 | 22206 | 22210 | 22212 | 22213 | 22214 | 22215 | 22219 | 22220 | 22221 |
| 22222 | 22225 | 22231 | 22232 | 22238 | 22240 | 22245 | 22248 | 22253 | 22260 | 22261 | 22263 |
| 22269 | 22273 | 22275 | 22277 | 22279 | 22286 | 22290 | 22291 | 22295 | 22309 | 22313 | 22321 |
| 22325 | 22326 | 22327 | 22331 | 22332 | 22335 | 22345 | 22347 | 22366 | 22368 | 22370 | 22376 |
| 22378 | 22379 | 22386 | 22389 | 22391 | 22398 | 22402 | 22406 | 22417 | 22418 | 22419 | 22425 |
| 22428 | 22430 | 22431 | 22436 | 22438 | 22439 | 22440 | 22441 | 22442 | 22446 | 22447 | 22455 |
| 22458 | 22459 | 22464 | 22472 | 22492 | 22495 | 22499 | 22503 | 22509 | 22510 | 22522 | 22529 |
| 22533 | 22536 | 22538 | 22542 | 22544 | 22545 | 22549 | 22552 | 22565 | 22571 | 22572 | 22582 |
| 22583 | 22585 | 22593 | 22594 | 22598 | 22602 | 22608 | 22609 | 22610 | 22617 | 22630 | 22631 |
| 22632 | 22633 | 22635 | 22636 | 22642 | 22648 | 22653 | 22655 | 22666 | 22670 | 22675 | 22685 |
| 22700 | 22709 | 22717 | 22737 | 22738 | 22747 | 22748 | 22751 | 22753 | 22754 | 22756 | 22759 |
| 22765 | 22770 | 22773 | 22780 | 22782 | 22792 | 22796 | 22799 | 22801 | 22802 | 22817 | 22819 |
| 22822 | 22823 | 22824 | 22830 | 22831 | 22834 | 22837 | 22838 | 22839 | 22840 | 22843 | 22846 |
| 22850 | 22851 | 22852 | 22853 | 22854 | 22855 | 22859 | 22861 | 22862 | 22864 | 22865 | 22870 |
| 22872 | 22873 | 22879 | 22890 | 22892 | 22895 | 22896 | 22904 | 22905 | 22916 | 22917 | 22918 |
| 22920 | 22922 | 22928 | 22931 | 22934 | 22940 | 22945 | 22946 | 22947 | 22949 | 22952 | 22959 |
| 22962 | 22965 | 22967 | 22972 | 22974 | 22975 | 22976 | 22980 | 22981 | 22984 | 22991 | |
| 22993 | 22994 | 23000 | 23008 | 23013 | 23014 | 23015 | 23016 | 23019 | 23022 | 23023 | 23024 |
| 23026 | 23030 | 23031 | 23034 | 23035 | 23036 | 23039 | 23042 | 23052 | 23053 | 23057 | 23058 |
| 23059 | 23061 | 23063 | 23064 | 23067 | 23068 | 23070 | 23071 | 23073 | 23075 | 23080 | 23081 |
| 23084 | 23086 | 23087 | 23088 | 23091 | 23095 | 23096 | 23099 | 23103 | 23106 | 23107 | |
| 23109 | 23110 | 23112 | 23122 | 23123 | 23125 | 23126 | 23127 | 23133 | 23139 | 23140 | 23143 |
| 23144 | 23145 | 23146 | 23147 | 23148 | 23154 | 23156 | 23158 | 23161 | 23162 | 23164 | 23169 |
| 23170 | 23172 | 23174 | 23176 | 23177 | 23179 | 23181 | 23182 | 23183 | 23184 | 23185 | 23191 |
| 23192 | 23193 | 23196 | 23197 | 23198 | 23202 | 23203 | 23204 | 23208 | 23212 | 23213 | 23214 |
| 23217 | 23226 | 23227 | 23233 | 23235 | 23237 | 23240 | 23241 | 23242 | 23244 | 23247 | 23249 |
| 23251 | 23252 | 23253 | 23257 | 23258 | 23259 | 23260 | 23261 | 23263 | 23265 | 23267 | 23268 |
| 23269 | 23270 | 23271 | 23272 | 23273 | 23274 | 23276 | 23277 | 23282 | 23285 | 23286 | 23287 |
| 23289 | 23290 | 23291 | 23299 | 23300 | 23301 | 23302 | 23303 | 23304 | 23305 | 23310 | 23311 |
| 23312 | 23313 | 23318 | 23319 | 23321 | 23322 | 23324 | 23325 | 23326 | 23327 | 23328 | 23329 |
| 23333 | 23335 | 23337 | 23347 | 23348 | 23349 | 23350 | 23352 | 23354 | 23356 | 23358 | 23362 |
| 23363 | 23367 | 23369 | 23370 | 23371 | 23374 | 23376 | 23378 | 23382 | 23385 | 23388 | 23389 |
| 23390 | 23392 | 23393 | 23396 | 23399 | 23400 | 23401 | 23404 | 23408 | 23409 | 23412 | 23413 |
| 23421 | 23423 | 23426 | 23428 | 23433 | 23434 | 23442 | 23446 | 23447 | 23451 | 23455 | 23456 |
| 23457 | 23459 | 23462 | 23464 | 23466 | 23467 | 23468 | 23469 | 23474 | 23476 | 23477 | 23479 |
| 23480 | 23482 | 23484 | 23485 | 23490 | 23492 | 23495 | 23497 | 23498 | 23502 | 23505 | 23509 |
| 23510 | 23511 | 23513 | 23514 | 23516 | 23520 | 23524 | 23525 | 23526 | 23527 | 23529 | 23530 |
| 23531 | 23535 | 23536 | 23537 | 23538 | 23542 | 23546 | 23547 | 23551 | 23552 | 23557 | 23559 |
| 23562 | 23571 | 23572 | 23573 | 23574 | 23576 | 23577 | 23578 | 23579 | 23581 | 23582 | 23583 |
| 23584 | 23586 | 23587 | 23588 | 23595 | 23598 | 23601 | 23602 | 23603 | 23604 | 23605 | 23608 |
| 23609 | 23610 | 23612 | 23613 | 23616 | 23619 | 23621 | 23626 | 23627 | 23630 | 23631 | 23632 |
| 23635 | 23637 | 23638 | 23639 | 23640 | 23644 | 23646 | 23650 | 23651 | 23652 | 23653 | 23655 |
| 23656 | 23657 | 23658 | 23659 | 23663 | 23666 | 23667 | 23670 | 23671 | 23672 | 23673 | 23679 |
| 23684 | | | | | | | | | | | |

Table 13B SEQ ID NOs of Polynucleotides useful for improving Seed Oil Yield/Content

| | | | | | | | | | | | |
|---|---|---|---|---|---|---|---|---|---|---|---|
| 23688 | 23689 | 23691 | 23692 | 23693 | 23694 | 23695 | 23698 | 23699 | 23700 | 23704 | 23706 |
| 23713 | 23714 | 23718 | 23719 | 23721 | 23723 | 23724 | 23726 | 23737 | 23739 | 23742 | 23743 |
| 23747 | 23749 | 23750 | 23751 | 23760 | 23764 | 23768 | 23773 | 23775 | 23777 | 23778 | |
| 23786 | 23787 | 23788 | 23795 | 23796 | 23798 | 23799 | 23800 | 23801 | 23804 | 23805 | 23806 |
| 23807 | 23808 | 23809 | 23811 | 23812 | 23815 | 23818 | 23819 | 23820 | 23825 | 23832 | 23833 |
| 23834 | 23838 | 23840 | 23841 | 23843 | 23844 | 23847 | 23850 | 23856 | 23862 | 23865 | 23870 |
| 23871 | 23874 | 23875 | 23878 | 23879 | 23880 | 23881 | 23882 | 23884 | 23889 | 23891 | 23894 |
| 23895 | 23898 | 23899 | 23902 | 23910 | 23911 | 23912 | 23913 | 23914 | 23915 | 23917 | 23924 |
| 23925 | 23929 | 23931 | 23933 | 23934 | 23943 | 23944 | 23945 | 23953 | 23959 | 23960 | 23961 |
| 23962 | 23963 | 23964 | 23965 | 23966 | 23968 | 23969 | 23974 | 23976 | 23977 | 23978 | 23979 |
| 23982 | 23984 | 23989 | 23997 | 23998 | 24005 | 24007 | 24008 | 24012 | 24014 | 24016 | 24019 |
| 24022 | 24025 | 24027 | 24028 | 24029 | 24037 | 24043 | 24044 | 24050 | 24053 | 24054 | 24057 |
| 24058 | 24062 | 24063 | 24064 | 24065 | 24066 | 24071 | 24072 | 24075 | 24078 | 24079 | 24080 |
| 24082 | 24083 | 24085 | 24087 | 24090 | 24093 | 24097 | 24100 | 24105 | 24111 | 24114 | 24115 |
| 24119 | 24120 | 24123 | 24124 | 24126 | 24129 | 24130 | 24131 | 24132 | 24136 | 24143 | 24146 |
| 24147 | 24148 | 24150 | 24153 | 24161 | 24164 | 24165 | 24166 | 24167 | 24171 | 24177 | 24178 |

TABLE 13A-continued

Seed Oil Yield/Content

| | | | | | | | | | | | |
|---|---|---|---|---|---|---|---|---|---|---|---|
| 24180 | 24181 | 24182 | 24184 | 24185 | 24187 | 24188 | 24189 | 24191 | 24192 | 24195 | 24197 |
| 24202 | 24203 | 24206 | 24212 | 24213 | 24216 | 24218 | 24221 | 24222 | 24224 | 24225 | 24226 |
| 24228 | 24230 | 24231 | 24233 | 24235 | 24236 | 24239 | 24241 | 24242 | 24246 | 24247 | 24248 |
| 24249 | 24250 | 24257 | 24258 | 24259 | 24260 | 24261 | 24262 | 24263 | 24264 | 24266 | 24267 |
| 24268 | 24269 | 24270 | 24272 | 24274 | 24280 | 24286 | 24287 | 24289 | 24291 | 24292 | 24296 |
| 24300 | 24309 | 24310 | 24316 | 24317 | 24318 | 24319 | 24323 | 24324 | 24325 | 24326 | 24327 |
| 24328 | 24329 | 24330 | 24331 | 24333 | 24335 | 24349 | 24351 | 24352 | 24357 | 24358 | 24359 |
| 24360 | 24361 | 24362 | 24366 | 24368 | 24369 | 24371 | 24372 | 24380 | 24381 | 24382 | 24383 |
| 24387 | 24388 | 24390 | 24394 | 24400 | 24401 | 24407 | 24410 | 24412 | 24416 | 24419 | 24429 |
| 24431 | 24432 | 24433 | 24435 | 24436 | 24440 | 24443 | 24444 | 24446 | 24448 | 24449 | 24454 |
| 24468 | 24469 | 24470 | 24472 | 24474 | 24475 | 24479 | 24480 | 24481 | 24482 | 24483 | 24487 |
| 24499 | 24500 | 24502 | 24505 | 24506 | 24507 | 24510 | 24512 | 24513 | 24521 | 24522 | 24524 |
| 24526 | 24531 | 24532 | 24533 | 24534 | 24535 | 24536 | 24537 | 24538 | 24539 | 24540 | 24541 |
| 24542 | 24543 | 24546 | 24548 | 24550 | 24554 | 24557 | 24558 | 24559 | 24563 | 24566 | 24570 |
| 24572 | 24577 | 24581 | 24582 | 24584 | 24585 | 24586 | 24587 | 24589 | 24590 | 24591 | 24592 |
| 24593 | 24594 | 24595 | 24596 | 24607 | 24608 | 24609 | 24610 | 24611 | 24613 | 24615 | 24618 |
| 24620 | 24621 | 24622 | 24624 | 24625 | 24627 | 24628 | 24629 | 24630 | 24633 | 24635 | 24636 |
| 24637 | 24638 | 24640 | 24651 | 24652 | 24659 | 24661 | 24662 | 24663 | 24664 | 24666 | 24667 |
| 24670 | 24672 | 24674 | 24676 | 24678 | 24679 | 24680 | 24682 | 24684 | 24685 | 24690 | 24691 |
| 24692 | 24693 | 24694 | 24695 | 24698 | 24699 | 24700 | 24701 | 24702 | 24704 | 24707 | 24708 |
| 24711 | 24712 | 24714 | 24715 | 24716 | 24722 | 24723 | 24724 | 24725 | 24728 | 24730 | 24734 |
| 24739 | 24740 | 24742 | 24744 | 24747 | 24757 | 24760 | 24766 | 24768 | 24772 | 24773 | 24774 |
| 24780 | 24781 | 24786 | 24788 | 24792 | 24794 | 24800 | 24803 | 24809 | 24810 | 24814 | 24816 |
| 24817 | 24819 | 24820 | 24822 | 24823 | 24829 | 24832 | 24833 | 24836 | 24837 | 24842 | 24845 |
| 24847 | 24851 | 24853 | 24854 | 24860 | 24861 | 24870 | 24871 | 24872 | 24873 | 24875 | 24876 |
| 24881 | 24885 | 24886 | 24887 | 24890 | 24891 | 24894 | 24901 | 24904 | 24907 | 24916 | 24923 |
| 24927 | 24928 | 24932 | 24933 | 24937 | 24939 | 24942 | 24946 | 24961 | 24963 | 24970 | 24971 |
| 24978 | 24979 | 24986 | 24990 | 24991 | 24996 | 24997 | 24999 | 25000 | 25008 | 25019 | 25021 |
| 25024 | 25026 | 25028 | 25029 | 25033 | 25034 | 25036 | 25045 | 25048 | 25062 | 25084 | 25089 |
| 25090 | 25099 | 25104 | 25115 | 25121 | 25124 | 25125 | 25130 | 25131 | 25145 | 25146 | 25151 |
| 25152 | 25161 | 25164 | 25165 | 25169 | 25171 | 25176 | 25178 | 25179 | 25180 | 25181 | 25182 |
| 25184 | 25187 | 25188 | 25193 | 25194 | 25197 | 25200 | 25208 | 25212 | 25213 | 25228 | 25230 |
| 25239 | 25243 | 25251 | 25252 | 25261 | 25267 | 25269 | 25271 | 25276 | 25284 | 25291 | 25297 |
| 25302 | 25303 | 25304 | 25305 | 25314 | 25319 | 25322 | 25323 | 25328 | 25329 | 25332 | 25351 |
| 25357 | 25366 | 25367 | 25368 | 25372 | 25375 | 25376 | 25385 | 25386 | 25388 | 25389 | 25391 |
| 25393 | 25394 | 25398 | 25399 | 25406 | 25407 | 25408 | 25415 | 25418 | 25421 | 25423 | 25427 |
| 25429 | 25432 | 25433 | 25435 | 25436 | 25468 | 25470 | 25471 | 25472 | 25476 | 25482 | 25484 |
| 25503 | 25510 | 25511 | 25521 | 25525 | 25526 | 25528 | 25534 | 25537 | 25544 | 25552 | 25553 |
| 25554 | 25565 | 25570 | 25571 | 25577 | 25582 | 25583 | 25584 | 25586 | 25590 | 25591 | 25592 |
| 25599 | 25603 | 25604 | 25608 | 25615 | 25620 | 25621 | 25623 | 25633 | 25634 | 25635 | 25639 |
| 25640 | 25653 | 25658 | 25660 | 25662 | 25670 | 25679 | 25680 | 25681 | 25685 | 25693 | 25694 |
| 25695 | 25700 | 25701 | 25704 | 25706 | 25710 | 25713 | 25714 | 25715 | 25718 | 25729 | 25730 |
| 25731 | 25732 | 25738 | 25749 | 25750 | 25751 | 25753 | 25755 | 25771 | 25784 | 25791 |
| 25792 | 25794 | 25796 | 25797 | 25805 | 25806 | 25807 | 25809 | 25811 | 25817 | 25826 | 25827 |
| 25833 | 25834 | 25835 | 25842 | 25850 | 25861 | 25869 | 25871 | 25873 | 25878 | 25881 | 25885 |
| 25889 | 25890 | 25895 | 25899 | 25907 | 25912 | 25916 | 25917 | 25920 | 25941 | 25946 | 25950 |
| 25952 | 25954 | 25957 | 25967 | 25968 | 25970 | 25973 | 25981 | 25989 | 25990 | 25991 | 25992 |
| 25993 | 26002 | 26003 | 26006 | 26008 | 26009 | 26012 | 26014 | 26020 | 26037 | 26046 | 26051 |
| 26064 | 26081 | 26090 | 26100 | 26101 | 26105 | 26109 | 26112 | 26117 | 26125 | 26132 | 26137 |
| 26140 | 26142 | 26144 | 26153 | 26167 | 26172 | 26175 | 26176 | 26183 | 26184 | 26190 | 26191 |
| 26195 | 26204 | 26205 | 26211 | 26224 | 26233 | 26234 | 26238 | 26249 | 26253 | 26254 | 26255 |
| 26265 | 26267 | 26276 | 26279 | 26283 | 26286 | 26289 | 26293 | 26295 | 26296 | 26299 | 26309 |
| 26312 | 26313 | 26318 | 26319 | 26321 | 26326 | 26327 | 26329 | 26336 | 26338 | 26341 | 26345 |
| 26352 | 26353 | 26355 | 26359 | 26362 | 26363 | 26366 | 26374 | 26375 | 26376 | 26378 | 26379 |
| 26381 | 26382 | 26385 | 26390 | 26393 | 26395 | 26402 | 26406 | 26409 | 26413 | 26417 | 26418 |
| 26421 | 26424 | 26425 | 26426 | 26432 | 26433 | 26435 | 26436 | 26437 | 26439 | 26442 | 26443 |
| 26447 | 26448 | 26453 | 26454 | 26455 | 26458 | 26460 | 26461 | 26462 | 26467 | 26468 | 26469 |
| 26472 | 26474 | 26475 | 26477 | 26484 | 26494 | 26505 | 26509 | 26510 | 26511 | 26515 | 26519 |
| 26520 | 26522 | 26527 | 26529 | 26533 | 26534 | 26535 | 26538 | 26539 | 26540 | 26547 | 26550 |
| 26551 | 26557 | 26560 | 26565 | 26566 | 26569 | 26572 | 26574 | 26578 | 26579 | 26581 |
| 26582 | 26583 | 26585 | 26587 | 26591 | 26592 | 26594 | 26596 | 26597 | 26599 | 26603 | 26606 |
| 26609 | 26610 | 26612 | 26615 | 26616 | 26617 | 26618 | 26619 | 26621 | 26622 | 26623 | 26628 |
| 26629 | 26631 | 26632 | 26634 | 26646 | 26647 | 26648 | 26650 | 26651 | 26652 | 26653 | 26654 |
| 26655 | 26657 | 26658 | 26659 | 26660 | 26661 | 26664 | 26672 | 26674 | 26677 |
| 26678 | 26683 | 26689 | 26691 | 26692 | 26699 | 26703 | 26707 | 26708 | 26714 | 26717 | 26718 |
| 26719 | 26721 | 26722 | 26729 | 26730 | 26731 | 26732 | 26734 | 26739 | 26741 | 26744 | 26751 |
| 26753 | 26754 | 26756 | 26757 | 26762 | 26764 | 26774 | 26784 | 26787 | 26790 | 26794 | 26797 |
| 26800 | 26802 | 26811 | 26812 | 26817 | 26824 | 26825 | 26826 | 26832 | 26841 | 26843 | 26844 |
| 26852 | 26863 | 26865 | 26867 | 26871 | 26873 | 26875 | 26876 | 26885 | 26886 | 26887 | 26888 |
| 26893 | 26898 | 26906 | 26918 | 26919 | 26921 | 26922 | 26924 | 26927 | 26931 | 26933 | 26936 |
| 26937 | 26947 | 26957 | 26958 | 26963 | 26972 | 26973 | 26975 | 26977 | 26978 | 26982 | 26986 |
| 26988 | 26991 | 26992 | 26996 | 26998 | 27002 | 27005 | 27007 | 27009 | 27010 | 27011 | 27012 |
| 27013 | 27015 | 27018 | 27021 | 27025 | 27026 | 27030 | 27035 | 27044 | 27050 | 27053 | 27059 |
| 27068 | 27076 | 27079 | 27080 | 27082 | 27084 | 27098 | 27102 | 27106 | 27108 | 27110 | 27111 |
| 27123 | 27124 | 27127 | 27128 | 27129 | 27140 | 27142 | 27145 | 27153 | 27155 | 27156 | 27160 |
| 27161 | 27163 | 27165 | 27168 | 27169 | 27171 | 27172 | 27175 | 27177 | 27194 | 27198 | 27200 |
| 27201 | 27202 | 27205 | 27209 | 27216 | 27228 | 27231 | 27242 | 27246 | 27247 | 27250 | 27257 |

TABLE 13A-continued

Seed Oil Yield/Content

| | | | | | | | | | | | |
|---|---|---|---|---|---|---|---|---|---|---|---|
| 27258 | 27260 | 27262 | 27267 | 27277 | 27278 | 27279 | 27280 | 27284 | 27288 | 27292 | 27296 |
| 27303 | 27308 | 27310 | 27316 | 27322 | 27324 | 27326 | 27327 | 27334 | 27339 | 27341 | 27345 |
| 27349 | 27350 | 27354 | 27365 | 27369 | 27370 | 27373 | 27375 | 27376 | 27384 | 27385 | 27386 |
| 27387 | 27388 | 27389 | 27390 | 27392 | 27398 | 27400 | 27401 | 27402 | 27404 | 27409 | 27411 |
| 27412 | 27420 | 27422 | 27423 | 27426 | 27428 | 27432 | 27433 | 27434 | 27438 | 27444 | 27448 |
| 27449 | 27459 | 27461 | 27462 | 27464 | 27467 | 27479 | 27481 | 27487 | 27492 | 27498 |
| 27502 | 27506 | 27517 | 27521 | 27522 | 27523 | 27527 | 27532 | 27533 | 27537 | 27552 | 27553 |
| 27554 | 27558 | 27563 | 27565 | 27568 | 27571 | 27574 | 27575 | 27577 | 27579 | 27585 | 27591 |
| 27595 | 27602 | 27607 | 27611 | 27612 | 27618 | 27619 | 27624 | 27625 | 27635 | 27641 | 27643 |
| 27644 | 27645 | 27651 | 27653 | 27654 | 27655 | 27656 | 27663 | 27665 | 27669 | 27671 | 27673 |
| 27674 | 27682 | 27686 | 27690 | 27692 | 27693 | 27700 | 27706 | 27708 | 27709 | 27710 | 27712 |
| 27717 | 27720 | 27728 | 27731 | 27732 | 27734 | 27735 | 27739 | 27744 | 27748 | 27753 | 27761 |
| 27762 | 27763 | 27764 | 27765 | 27766 | 27767 | 27771 | 27780 | 27785 | 27787 | 27793 | 27797 |
| 27798 | 27804 | 27805 | 27809 | 27810 | 27813 | 27814 | 27818 | 27821 | 27824 | 27827 | 27829 |
| 27830 | 27832 | 27839 | 27841 | 27847 | 27851 | 27853 | 27855 | 27863 | 27865 | 27867 | 27868 |
| 27870 | 27873 | 27875 | 27876 | 27879 | 27882 | 27885 | 27887 | 27888 | 27889 | 27892 | 27905 |
| 27907 | 27909 | 27914 | 27919 | 27920 | 27921 | 27925 | 27929 | 27930 | 27935 | 27937 | 27938 |
| 27939 | 27941 | 27943 | 27945 | 27946 | 27948 | 27949 | 27950 | 27951 | 27952 | 27953 | 27958 |
| 27959 | 27961 | 27962 | 27964 | 27965 | 27966 | 27967 | 27969 | 27970 | 27971 | 27972 | 27974 |
| 27976 | 27977 | 27978 | 27980 | 27981 | 27982 | 27984 | 27988 | 27989 | 27991 | 27992 | 27993 |
| 27994 | 27995 | 27996 | 27998 | 27999 | 28000 | 28001 | 28002 | 28003 | 28005 | 28009 | 28013 |
| 28014 | 28017 | 28018 | 28019 | 28021 | 28025 | 28026 | 28028 | 28030 | 28031 | 28034 | 28037 |
| 28038 | 28039 | 28040 | 28041 | 28043 | 28045 | 28047 | 28049 | 28050 | 28052 | 28053 | 28054 |
| 28060 | 28063 | 28066 | 28067 | 28068 | 28070 | 28071 | 28074 | 28075 | 28077 | 28078 | 28085 |
| 28086 | 28087 | 28088 | 28092 | 28098 | 28103 | 28105 | 28109 | 28111 | 28112 | 28114 | 28115 |
| 28116 | 28117 | 28119 | 28120 | 28140 | 28141 | 28142 | 28147 | 28148 | 28149 | 28150 | 28151 |
| 28153 | 28154 | 28158 | 28161 | 28164 | 28166 | 28170 | 28171 | 28173 | 28174 | 28177 | 28178 |
| 28183 | 28184 | 28186 | 28187 | 28189 | 28190 | 28191 | 28192 | 28193 | 28194 | 28201 | 28208 |
| 28211 | 28213 | 28214 | 28215 | 28217 | 28221 | 28223 | 28226 | 28228 | 28229 | 28235 | 28236 |
| 28237 | 28240 | 28242 | 28243 | 28244 | 28245 | 28248 | 28249 | 28250 | 28254 | 28255 | 28256 |
| 28259 | 28263 | 28267 | 28268 | 28269 | 28271 | 28277 | 28278 | 28283 | 28286 | 28288 | 28289 |
| 28291 | 28292 | 28293 | 28294 | 28295 | 28296 | 28298 | 28301 | 28305 | 28306 | 28308 | 28309 |
| 28312 | 28313 | 28315 | 28316 | 28317 | 28318 | 28319 | 28320 | 28321 | 28322 | 28324 | 28325 |
| 28326 | 28328 | 28329 | 28332 | 28338 | 28341 | 28343 | 28344 | 28345 | 28354 | 28355 | 28361 |
| 28363 | 28368 | 28371 | 28373 | 28375 | 28377 | 28378 | 28383 | 28386 | 28387 | 28388 |
| 28389 | 28391 | 28392 | 28395 | 28396 | 28398 | 28399 | 28402 | 28403 | 28408 | 28412 | 28413 |
| 28414 | 28416 | 28418 | 28419 | 28420 | 28423 | 28426 | 28427 | 28429 | 28431 | 28432 | 28433 |
| 28434 | 28435 | 28436 | 28438 | 28439 | 28440 | 28442 | 28445 | 28449 | 28450 | 28456 | 28457 |
| 28458 | 28459 | 28460 | 28463 | 28464 | 28468 | 28470 | 28472 | 28474 | 28476 | 28479 | 28480 |
| 28481 | 28482 | 28485 | 28486 | 28489 | 28492 | 28493 | 28494 | 28496 | 28498 | 28499 | 28500 |
| 28502 | 28505 | 28508 | 28513 | 28516 | 28520 | 28521 | 28523 | 28524 | 28530 | 28532 | 28533 |
| 28534 | 28537 | 28541 | 28542 | 28547 | 28552 | 28553 | 28556 | 28557 | 28561 | 28565 | 28572 |
| 28573 | 28575 | 28576 | 28581 | 28582 | 28584 | 28585 | 28586 | 28588 | 28589 | 28590 | 28592 |
| 28594 | 28596 | 28597 | 28598 | 28599 | 28601 | 28604 | 28605 | 28607 | 28610 | 28611 | 28613 |
| 28616 | 28617 | 28620 | 28622 | 28626 | 28631 | 28633 | 28634 | 28635 | 28637 | 28638 | 28639 |
| 28641 | 28644 | 28645 | 28649 | 28656 | 28672 | 28674 | 28677 | 28678 | 28685 | 28689 | 28692 |
| 28693 | 28694 | 28699 | 28708 | 28709 | 28714 | 28720 | 28721 | 28722 | 28725 | 28732 | 28744 |
| 28747 | 28752 | 28765 | 28767 | 28770 | 28775 | 28776 | 28777 | 28780 | 28782 | 28784 | 28792 |
| 28802 | 28803 | 28804 | 28805 | 28807 | 28812 | 28822 | 28827 | 28834 | 28840 | 28841 | 28845 |
| 28848 | 28852 | 28857 | 28858 | 28859 | 28860 | 28867 | 28868 | 28870 | 28891 | 28895 | 28896 |
| 28899 | 28903 | 28913 | 28916 | 28917 | 28920 | 28925 | 28926 | 28927 | 28928 | 28934 | 28935 |
| 28936 | 28937 | 28938 | 28939 | 28941 | 28942 | 28944 | 28945 | 28946 | 28947 | 28950 | 28951 |
| 28952 | 28953 | 28955 | 28956 | 28957 | 28962 | 28965 | 28966 | 28968 | 28969 | 28970 | 28971 |
| 28985 | 28986 | 28993 | 28996 | 28997 | 28998 | 28999 | 29003 | 29005 | 29007 | 29009 | 29010 |
| 29013 | 29014 | 29016 | 29017 | 29018 | 29021 | 29023 | 29024 | 29032 | 29033 | 29050 | 29051 |
| 29057 | 29059 | 29060 | 29065 | 29066 | 29067 | 29074 | 29081 | 29084 | 29086 | 29089 | 29094 |
| 29095 | 29103 | 29110 | 29113 | 29115 | 29116 | 29120 | 29124 | 29126 | 29127 | 29128 | 29129 |
| 29131 | 29137 | 29138 | 29152 | 29155 | 29157 | 29167 | 29168 | 29172 | 29173 | 29174 | 29175 |
| 29180 | 29183 | 29184 | 29188 | 29194 | 29200 | 29203 | 29205 | 29214 | 29223 | 29224 | 29226 |
| 29228 | 29230 | 29231 | 29234 | 29235 | 29236 | 29237 | 29240 | 29254 | 29262 | 29265 | 29266 |
| 29271 | 29275 | 29276 | 29282 | 29286 | 29289 | 29291 | 29297 | 29299 | 29300 | 29301 | 29302 |
| 29303 | 29304 | 29305 | 29314 | 29318 | 29321 | 29325 | 29327 | 29329 | 29331 | 29333 | 29337 |
| 29339 | 29346 | 29347 | 29352 | 29356 | 29367 | 29373 | 29375 | 29380 | 29382 | 29385 | 29386 |
| 29387 | 29393 | 29396 | 29397 | 29400 | 29401 | 29402 | 29403 | 29404 | 29405 | 29410 | 29413 |
| 29414 | 29416 | 29421 | 29422 | 29423 | 29428 | 29432 | 29439 | 29445 | 29456 | 29457 | 29459 |
| 29460 | 29461 | 29464 | 29466 | 29471 | 29472 | 29474 | 29476 | 29482 | 29487 | 29490 | 29492 |
| 29499 | 29501 | 29504 | 29510 | 29512 | 29514 | 29515 | 29516 | 29517 | 29518 | 29521 | 29523 |
| 29531 | 29542 | 29544 | 29545 | 29553 | 29554 | 29558 | 29559 | 29560 | 29564 | 29571 | 29573 |
| 29598 | 29599 | 29601 | 29606 | 29609 | 29610 | 29619 | 29620 | 29621 | 29622 | 29623 | 29624 |
| 29625 | 29628 | 29634 | 29638 | 29645 | 29653 | 29655 | 29661 | 29663 | 29667 | 29669 | 29678 |
| 29679 | 29686 | 29687 | 29688 | 29689 | 29694 | 29697 | 29698 | 29704 | 29708 | 29709 | 29711 |
| 29715 | 29716 | 29719 | 29721 | 29723 | 29728 | 29729 | 29732 | 29739 | 29744 | 29745 |
| 29746 | 29753 | 29759 | 29760 | 29763 | 29764 | 29771 | 29772 | 29773 | 29776 | 29777 | 29780 |
| 29781 | 29782 | 29783 | 29785 | 29790 | 29791 | 29794 | 29795 | 29799 | 29800 | 29801 | 29802 |
| 29803 | 29807 | 29809 | 29810 | 29816 | 29817 | 29820 | 29821 | 29824 | 29825 | 29826 | 29827 |
| 29828 | 29831 | 29835 | 29836 | 29843 | 29845 | 29846 | 29847 | 29850 | 29855 | 29856 | 29860 |
| 29861 | 29862 | 29864 | 29875 | 29877 | 29878 | 29879 | 29880 | 29881 | 29883 | 29884 | 29887 |

TABLE 13A-continued

Seed Oil Yield/Content

| | | | | | | | | | | | |
|---|---|---|---|---|---|---|---|---|---|---|---|
| 29893 | 29894 | 29901 | 29906 | 29907 | 29908 | 29909 | 29910 | 29914 | 29918 | 29921 | 29922 |
| 29930 | 29931 | 29939 | 29943 | 29947 | 29949 | 29950 | 29955 | 29958 | 29959 | 29961 | 29966 |
| 29967 | 29968 | 29970 | 29974 | 29976 | 29986 | 29987 | 29997 | 29999 | 30001 | 30006 | 30007 |
| 30009 | 30020 | 30022 | 30025 | 30030 | 30034 | 30041 | 30042 | 30043 | 30044 | 30047 | 30048 |
| 30055 | 30056 | 30061 | 30063 | 30065 | 30068 | 30069 | 30073 | 30074 | 30093 | 30095 | 30097 |
| 30099 | 30100 | 30108 | 30115 | 30117 | 30118 | 30120 | 30122 | 30124 | 30128 | 30129 | 30130 |
| 30133 | 30136 | 30142 | 30143 | 30150 | 30151 | 30153 | 30154 | 30157 | 30162 | 30164 | 30171 |
| 30172 | 30173 | 30174 | 30178 | 30190 | 30191 | 30196 | 30197 | 30198 | 30202 | 30205 | 30207 |
| 30208 | 30209 | 30210 | 30211 | 30212 | 30218 | 30219 | 30222 | 30223 | 30224 | 30227 | 30228 |
| 30229 | 30231 | 30232 | 30233 | 30236 | 30237 | 30238 | 30244 | 30245 | 30248 | 30254 | 30261 |
| 30262 | 30265 | 30266 | 30267 | 30273 | 30281 | 30283 | 30285 | 30286 | 30289 | 30293 | 30302 |
| 30303 | 30304 | 30312 | 30317 | 30321 | 30323 | 30324 | 30333 | 30334 | 30335 | 30336 | 30341 |
| 30342 | 30343 | 30344 | 30345 | 30346 | 30347 | 30348 | 30349 | 30353 | 30355 | 30357 | 30358 |
| 30360 | 30361 | 30369 | 30370 | 30371 | 30372 | 30374 | 30377 | 30379 | 30380 | 30382 | |
| 30388 | 30389 | 30390 | 30391 | 30392 | 30393 | 30401 | 30402 | 30403 | 30406 | 30415 | 30417 |
| 30419 | 30420 | 30421 | 30423 | 30424 | 30426 | 30428 | 30434 | 30436 | 30437 | 30440 | 30443 |
| 30446 | 30447 | 30455 | 30458 | 30460 | 30463 | 30466 | 30467 | 30475 | 30484 | 30491 | 30493 |
| 30494 | 30501 | 30506 | 30507 | 30508 | 30513 | 30515 | 30516 | 30517 | 30523 | 30526 | 30532 |
| 30534 | 30536 | 30538 | 30541 | 30542 | 30549 | 30552 | 30557 | 30566 | 30567 | 30571 | 30572 |
| 30577 | 30580 | 30594 | 30604 | 30605 | 30606 | 30609 | 30614 | 30626 | 30648 | 30657 | 30658 |
| 30664 | 30672 | 30673 | 30678 | 30687 | 30688 | 30692 | 30695 | 30696 | 30705 | 30710 | 30712 |
| 30713 | 30714 | 30720 | 30721 | 30722 | 30724 | 30725 | 30726 | 30727 | 30730 | 30732 | 30733 |
| 30734 | 30736 | 30737 | 30738 | 30740 | 30744 | 30745 | 30748 | 30749 | 30750 | 30751 | 30752 |
| 30754 | 30755 | 30756 | 30757 | 30758 | 30759 | 30761 | 30763 | 30765 | 30770 | 30773 | 30774 |
| 30775 | 30777 | 30780 | 30781 | 30783 | 30785 | 30786 | 30789 | 30792 | 30793 | 30794 | 30795 |
| 30797 | 30799 | 30801 | 30803 | 30804 | 30806 | 30807 | 30808 | 30814 | 30817 | 30820 | 30821 |
| 30822 | 30823 | 30825 | 30826 | 30827 | 30829 | 30830 | 30832 | 30833 | 30840 | 30841 | 30842 |
| 30843 | 30845 | 30848 | 30854 | 30859 | 30861 | 30866 | 30869 | 30870 | 30872 | 30873 | 30874 |
| 30875 | 30877 | 30878 | 30880 | 30894 | 30900 | 30901 | 30907 | 30908 | 30909 | 30910 | 30911 |
| 30913 | 30914 | 30918 | 30920 | 30923 | 30925 | 30929 | 30930 | 30932 | 30933 | 30936 | 30937 |
| 30942 | 30943 | 30945 | 30946 | 30948 | 30949 | 30950 | 30951 | 30952 | 30953 | 30959 | 30967 |
| 30970 | 30971 | 30972 | 30973 | 30974 | 30975 | 30979 | 30981 | 30984 | 30986 | 30987 | 30991 |
| 30994 | 30997 | 30999 | 31000 | 31001 | 31002 | 31004 | 31006 | 31007 | 31008 | 31011 | 31012 |
| 31013 | 31016 | 31020 | 31024 | 31025 | 31026 | 31028 | 31034 | 31035 | 31040 | 31043 | 31045 |
| 31046 | 31048 | 31049 | 31050 | 31051 | 31052 | 31055 | 31057 | 31058 | 31062 | 31063 | 31066 |
| 31070 | 31071 | 31073 | 31074 | 31075 | 31076 | 31077 | 31078 | 31079 | 31080 | 31082 | 31083 |
| 31084 | 31086 | 31087 | 31090 | 31096 | 31097 | 31099 | 31101 | 31102 | 31104 | 31113 | 31114 |
| 31119 | 31120 | 31122 | 31127 | 31129 | 31130 | 31132 | 31134 | 31136 | 31137 | 31141 | 31144 |
| 31145 | 31146 | 31147 | 31149 | 31150 | 31154 | 31155 | 31159 | 31161 | 31162 | 31165 | 31167 |
| 31171 | 31172 | 31173 | 31175 | 31178 | 31179 | 31180 | 31182 | 31185 | 31186 | 31188 | 31189 |
| 31191 | 31192 | 31193 | 31194 | 31195 | 31197 | 31198 | 31199 | 31201 | 31204 | 31208 | 31210 |
| 31216 | 31217 | 31218 | 31219 | 31220 | 31223 | 31224 | 31228 | 31230 | 31232 | 31234 | 31236 |
| 31239 | 31240 | 31241 | 31242 | 31244 | 31245 | 31246 | 31248 | 31251 | 31252 | 31253 | 31255 |
| 31257 | 31258 | 31259 | 31261 | 31264 | 31267 | 31272 | 31275 | 31276 | 31279 | 31280 | 31282 |
| 31284 | 31289 | 31291 | 31292 | 31293 | 31296 | 31300 | 31301 | 31306 | 31311 | 31312 | 31316 |
| 31317 | 31321 | 31324 | 31330 | 31331 | 31333 | 31334 | 31339 | 31340 | 31342 | 31343 | 31344 |
| 31346 | 31347 | 31348 | 31350 | 31352 | 31354 | 31355 | 31356 | 31357 | 31359 | 31362 | 31363 |
| 31365 | 31368 | 31369 | 31371 | 31374 | 31375 | 31378 | 31382 | 31384 | 31389 | 31391 | 31392 |
| 31393 | 31395 | 31396 | 31397 | 31399 | 31402 | 31403 | 31407 | 31414 | 31416 | 31417 | 31420 |
| 31421 | 31424 | 31425 | 31430 | 31432 | 31434 | 31439 | 31440 | 31441 | 31442 | 31446 | 31447 |
| 31449 | 31451 | 31452 | 31453 | 31455 | 31456 | 31458 | 31459 | 31460 | 31464 | 31465 | 31469 |
| 31470 | 31471 | 31473 | 31476 | 31478 | 31481 | 31482 | 31492 | 31493 | 31494 | 31495 | 31496 |
| 31497 | 31500 | 31501 | 31502 | 31505 | 31509 | 31511 | 31514 | 31519 | 31520 | 31521 | 31523 |
| 31524 | 31526 | 31527 | 31531 | 31532 | 31533 | 31535 | 31539 | 31545 | 31546 | 31547 | 31555 |
| 31556 | 31557 | 31560 | 31562 | 31568 | 31569 | 31570 | 31571 | 31572 | 31579 | 31581 | 31583 |
| 31584 | 31592 | 31593 | 31599 | 31600 | 31606 | 31607 | 31609 | 31610 | 31612 | 31614 | 31616 |
| 31620 | 31623 | 31625 | 31626 | 31627 | 31631 | 31632 | 31633 | 31636 | 31638 | 31650 | 31651 |
| 31653 | 31654 | 31656 | 31657 | 31659 | 31660 | 31661 | 31663 | 31664 | 31666 | 31669 | 31672 |
| 31680 | 31682 | 31685 | 31688 | 31689 | 31690 | 31691 | 31694 | 31696 | 31698 | 31699 | 31700 |
| 31702 | 31704 | 31706 | 31711 | 31713 | 31714 | 31717 | 31718 | 31719 | 31725 | 31726 | 31728 |
| 31732 | 31733 | 31734 | 31735 | 31738 | 31740 | 31741 | 31742 | 31744 | 31745 | 31750 | 31757 |
| 31758 | 31759 | 31760 | 31761 | 31767 | 31770 | 31771 | 31773 | 31775 | 31779 | 31780 | 31784 |
| 31792 | 31794 | 31795 | 31796 | 31797 | 31798 | 31799 | 31801 | 31802 | 31804 | 31806 | 31809 |
| 31812 | 31815 | 31819 | 31820 | 31828 | 31830 | 31831 | 31832 | 31833 | 31835 | 31836 | 31837 |
| 31842 | 31843 | 31844 | 31846 | 31849 | 31850 | 31851 | 31854 | 31856 | 31857 | 31866 | 31867 |
| 31868 | 31869 | 31870 | 31871 | 31874 | 31875 | 31876 | 31881 | 31882 | 31883 | 31885 | 31889 |
| 31890 | 31893 | 31896 | 31897 | 31898 | 31900 | 31903 | 31905 | 31906 | 31907 | 31910 | 31911 |
| 31913 | 31914 | 31915 | 31921 | 31924 | 31925 | 31928 | 31930 | 31932 | 31935 | 31936 | 31937 |
| 31939 | 31940 | 31942 | 31943 | 31946 | 31948 | 31949 | 31950 | 31951 | 31952 | 31953 | 31956 |
| 31957 | 31958 | 31959 | 31961 | 31962 | 31963 | 31964 | 31966 | 31968 | 31969 | 31970 | 31973 |
| 31974 | 31975 | 31977 | 31978 | 31984 | 31985 | 31991 | 31992 | 31993 | 31994 | 31996 | 31999 |
| 32001 | 32006 | 32010 | 32011 | 32013 | 32015 | 32017 | 32025 | 32027 | 32029 | 32031 | 32032 |
| 32033 | 32036 | 32041 | 32042 | 32043 | 32048 | 32049 | 32051 | 32052 | 32057 | 32058 | 32059 |
| 32061 | 32062 | 32065 | 32069 | 32070 | 32071 | 32073 | 32074 | 32079 | 32081 | 32084 | 32085 |
| 32089 | 32091 | 32092 | 32093 | 32095 | 32097 | 32098 | 32100 | 32103 | 32104 | 32117 | 32118 |
| 32119 | 32125 | 32126 | 32127 | 32128 | 32129 | 32130 | 32131 | 32133 | 32134 | 32135 | 32136 |
| 32139 | 32140 | 32144 | 32145 | 32151 | 32153 | 32154 | 32155 | 32158 | 32159 | 32160 | 32166 |

TABLE 13A-continued

Seed Oil Yield/Content

| | | | | | | | | | | | |
|---|---|---|---|---|---|---|---|---|---|---|---|
| 32170 | 32171 | 32172 | 32175 | 32177 | 32180 | 32181 | 32183 | 32185 | 32186 | 32188 | 32189 |
| 32190 | 32196 | 32200 | 32201 | 32202 | 32203 | 32204 | 32205 | 32207 | 32208 | 32209 | 32210 |
| 32211 | 32212 | 32216 | 32217 | 32218 | 32219 | 32220 | 32221 | 32222 | 32224 | 32225 | 32226 |
| 32232 | 32238 | 32240 | 32243 | 32248 | 32249 | 32250 | 32251 | 32254 | 32255 | 32256 | 32258 |
| 32259 | 32263 | 32265 | 32266 | 32267 | 32268 | 32269 | 32271 | 32272 | 32273 | 32274 | 32275 |
| 32276 | 32277 | 32278 | 32279 | 32282 | 32287 | 32290 | 32291 | 32293 | 32294 | 32295 | 32296 |
| 32297 | 32298 | 32301 | 32308 | 32309 | 32312 | 32313 | 32314 | 32318 | 32332 | 32333 | 32335 |
| 32336 | 32337 | 32339 | 32340 | 32345 | 32346 | 32347 | 32350 | 32351 | 32352 | 32353 | 32354 |
| 32358 | 32359 | 32360 | 32361 | 32362 | 32363 | 32365 | 32367 | 32370 | 32372 | 32375 | 32378 |
| 32379 | 32382 | 32384 | 32385 | 32386 | 32388 | 32389 | 32393 | 32394 | 32397 | 32398 | 32399 |
| 32400 | 32404 | 32405 | 32406 | 32407 | 32408 | 32410 | 32411 | 32412 | 32413 | 32414 | 32415 |
| 32416 | 32417 | 32418 | 32425 | 32428 | 32429 | 32434 | 32435 | 32437 | 32442 | 32444 | 32446 |
| 32447 | 32450 | 32452 | 32453 | 32454 | 32455 | 32456 | 32457 | 32458 | 32461 | 32462 | 32464 |
| 32467 | 32468 | 32470 | 32473 | 32476 | 32480 | 32482 | 32483 | 32484 | 32487 | 32488 | 32490 |
| 32493 | 32494 | 32500 | 32501 | 32502 | 32503 | 32504 | 32509 | 32510 | 32513 | 32514 | 32515 |
| 32519 | 32520 | 32521 | 32522 | 32523 | 32526 | 32530 | 32531 | 32534 | 32539 | 32542 | 32543 |
| 32546 | 32547 | 32548 | 32549 | 32551 | 32552 | 32553 | 32555 | 32556 | 32559 | 32560 | 32563 |
| 32567 | 32572 | 32580 | 32581 | 32583 | 32586 | 32588 | 32590 | 32593 | 32596 | 32598 | 32600 |
| 32601 | 32603 | 32604 | 32605 | 32606 | 32608 | 32609 | 32610 | 32611 | 32614 | 32615 | 32620 |
| 32621 | 32623 | 32625 | 32626 | 32627 | 32632 | 32640 | 32645 | 32646 | 32647 | 32653 | 32657 |
| 32660 | 32661 | 32664 | 32667 | 32668 | 32671 | 32681 | 32685 | 32686 | 32687 | 32692 | 32693 |
| 32699 | 32700 | 32701 | 32702 | 32704 | 32705 | 32706 | 32707 | 32708 | 32709 | 32710 | 32713 |
| 32715 | 32716 | 32718 | 32722 | 32723 | 32724 | 32729 | 32732 | 32733 | 32735 | 32736 | 32738 |
| 32743 | 32748 | 32754 | 32755 | 32759 | 32760 | 32763 | 32767 | 32768 | 32769 | 32770 | 32773 |
| 32775 | 32776 | 32790 | 32791 | 32792 | 32793 | 32794 | 32795 | 32796 | 32797 | 32798 | 32801 |
| 32803 | 32805 | 32806 | 32810 | 32813 | 32814 | 32817 | 32819 | 32821 | 32822 | 32823 | 32829 |
| 32832 | 32835 | 32838 | 32840 | 32843 | 32851 | 32852 | 32854 | 32862 | 32869 | 32873 | 32876 |
| 32877 | 32879 | 32880 | 32881 | 32882 | 32884 | 32885 | 32888 | 32889 | 32899 | 32900 | 32903 |
| 32905 | 32907 | 32908 | 32909 | 32910 | 32914 | 32915 | 32922 | 32923 | 32926 | 32927 | 32928 |
| 32929 | 32930 | 32931 | 32932 | 32938 | 32940 | 32941 | 32942 | 32944 | 32951 | 32952 | 32953 |
| 32956 | 32957 | 32958 | 32960 | 32961 | 32963 | 32966 | 32969 | 32975 | 32976 | 32978 |
| 32979 | 32980 | 32981 | 32983 | 32987 | 32989 | 32990 | 32991 | 32997 | 33007 | 33008 | 33010 |
| 33011 | 33016 | 33017 | 33020 | 33021 | 33022 | 33023 | 33035 | 33039 | 33041 | 33045 | 33049 |
| 33051 | 33055 | 33056 | 33058 | 33059 | 33060 | 33063 | 33068 | 33070 | 33072 | 33073 | 33074 |
| 33076 | 33077 | 33082 | 33091 | 33092 | 33096 | 33106 | 33107 | 33110 | 33111 | 33112 | 33116 |
| 33122 | 33126 | 33127 | 33130 | 33140 | 33143 | 33144 | 33145 | 33147 | 33148 | 33149 | 33150 |
| 33151 | 33152 | 33155 | 33156 | 33157 | 33159 | 33162 | 33163 | 33164 | 33171 | 33172 | 33176 |
| 33177 | 33179 | 33185 | 33186 | 33194 | 33195 | 33198 | 33199 | 33201 | 33202 | 33203 | 33204 |
| 33207 | 33208 | 33211 | 33217 | 33218 | 33221 | 33222 | 33224 | 33234 | 33236 | 33238 |
| 33245 | 33246 | 33248 | 33250 | 33255 | 33256 | 33260 | 33261 | 33262 | 33263 | 33265 | 33267 |
| 33273 | 33274 | 33275 | 33276 | 33279 | 33281 | 33282 | 33285 | 33286 | 33289 | 33290 | 33291 |
| 33292 | 33298 | 33299 | 33300 | 33301 | 33306 | 33307 | 33311 | 33312 | 33314 | 33317 | 33319 |
| 33320 | 33322 | 33323 | 33332 | 33333 | 33336 | 33337 | 33339 | 33345 | 33346 | 33356 |
| 33365 | 33366 | 33372 | 33376 | 33377 | 33388 | 33390 | 33391 | 33396 | 33397 | 33399 | 33400 |
| 33401 | 33402 | 33405 | 33412 | 33419 | 33421 | 33430 | 33432 | 33433 | 33434 | 33437 | 33438 |
| 33441 | 33445 | 33446 | 33452 | 33453 | 33458 | 33459 | 33460 | 33461 | 33475 | 33476 | 33477 |
| 33485 | 33501 | 33502 | 33505 | 33513 | 33514 | 33515 | 33516 | 33517 | 33518 | 33519 | 33520 |
| 33521 | 33526 | 33527 | 33528 | 33539 | 33540 | 33542 | 33543 | 33545 | 33546 | 33547 | 33548 |
| 33549 | 33550 | 33551 | 33553 | 33555 | 33556 | 33561 | 33563 | 33564 | 33565 | 33566 | 33575 |
| 33578 | 33579 | 33580 | 33581 | 33584 | 33585 | 33589 | 33603 | 33609 | 33613 | 33614 | 33615 |
| 33616 | 33618 | 33621 | 33622 | 33623 | 33632 | 33633 | 33637 | 33645 | 33647 | 33650 | 33651 |
| 33657 | 33661 | 33663 | 33664 | 33668 | 33671 | 33674 | 33676 | 33678 | 33680 | 33682 | 33684 |
| 33689 | 33690 | 33691 | 33692 | 33694 | 33698 | 33706 | 33707 | 33708 | 33710 | 33713 | 33716 |
| 33721 | 33725 | 33731 | 33732 | 33734 | 33736 | 33737 | 33739 | 33740 | 33742 | 33746 | 33747 |
| 33748 | 33766 | 33771 | 33784 | 33785 | 33786 | 33787 | 33789 | 33791 | 33796 | 33801 | 33802 |
| 33808 | 33809 | 33819 | 33822 | 33823 | 33828 | 33829 | 33830 | 33831 | 33834 | 33838 | 33841 |
| 33845 | 33846 | 33850 | 33851 | 33852 | 33861 | 33862 | 33866 | 33868 | 33869 | 33872 | 33874 |
| 33877 | 33884 | 33885 | 33888 | 33891 | 33892 | 33894 | 33896 | 33897 | 33900 | 33901 | 33910 |
| 33912 | 33913 | 33914 | 33918 | 33919 | 33921 | 33922 | 33932 | 33935 | 33937 | 33940 | 33943 |
| 33946 | 33947 | 33948 | 33949 | 33950 | 33952 | 33953 | 33954 | 33955 | 33969 | 33970 | 33972 |
| 33980 | 33983 | 33988 | 33989 | 33990 | 33991 | 33992 | 33994 | 33996 | 33997 | 33998 | 33999 |
| 34005 | 34006 | 34009 | 34012 | 34014 | 34017 | 34023 | 34025 | 34026 | 34030 | 34033 | 34035 |
| 34038 | 34039 | 34041 | 34042 | 34044 | 34047 | 34048 | 34051 | 34052 | 34054 | 34055 | 34056 |
| 34057 | 34061 | 34062 | 34068 | 34069 | 34070 | 34071 | 34072 | 34073 | 34075 | 34082 | 34084 |
| 34086 | 34090 | 34091 | 34093 | 34097 | 34098 | 34099 | 34100 | 34102 | 34104 | 34105 | 34107 |
| 34111 | 34112 | 34114 | 34117 | 34118 | 34119 | 34120 | 34121 | 34122 | 34124 | 34125 | 34126 |
| 34129 | 34132 | 34140 | 34143 | 34144 | 34146 | 34149 | 34152 | 34155 | 34158 | 34160 | 34161 |
| 34163 | 34165 | 34166 | 34168 | 34171 | 34173 | 34174 | 34175 | 34177 | 34180 | 34187 |
| 34188 | 34189 | 34190 | 34191 | 34192 | 34193 | 34196 | 34198 | 34201 | 34203 | 34207 | 34208 |
| 34209 | 34210 | 34211 | 34213 | 34215 | 34217 | 34218 | 34221 | 34224 | 34227 | 34228 | 34229 |
| 34230 | 34232 | 34233 | 34238 | 34242 | 34243 | 34244 | 34247 | 34251 | 34253 | 34254 | 34255 |
| 34256 | 34257 | 34258 | 34259 | 34261 | 34262 | 34264 | 34269 | 34276 | 34278 | 34280 | 34281 |
| 34283 | 34286 | 34287 | 34289 | 34290 | 34292 | 34294 | 34298 | 34299 | 34300 | 34302 | 34304 |
| 34306 | 34307 | 34309 | 34314 | 34315 | 34316 | 34317 | 34319 | 34325 | 34331 | 34333 | 34337 |
| 34338 | 34339 | 34341 | 34342 | 34344 | 34346 | 34347 | 34349 | 34350 | 34351 | 34354 | 34355 |
| 34358 | 34359 | 34361 | 34364 | 34366 | 34368 | 34370 | 34371 | 34372 | 34373 | 34374 | 34376 |
| 34377 | 34378 | 34381 | 34384 | 34385 | 34386 | 34387 | 34389 | 34392 | 34394 | 34395 | 34397 |

TABLE 13A-continued

Seed Oil Yield/Content

| | | | | | | | | | | | |
|---|---|---|---|---|---|---|---|---|---|---|---|
| 34398 | 34405 | 34408 | 34409 | 34410 | 34413 | 34416 | 34423 | 34426 | 34427 | 34431 | 34434 |
| 34435 | 34436 | 34437 | 34438 | 34439 | 34440 | 34441 | 34442 | 34444 | 34446 | 34447 | 34451 |
| 34452 | 34453 | 34461 | 34463 | 34468 | 34469 | 34470 | 34472 | 34473 | 34474 | 34475 | 34476 |
| 34483 | 34484 | 34485 | 34492 | 34494 | 34495 | 34497 | 34498 | 34500 | 34502 | 34503 | 34504 |
| 34505 | 34506 | 34507 | 34508 | 34511 | 34513 | 34515 | 34516 | 34517 | 34523 | 34525 | 34527 |
| 34528 | 34530 | 34531 | 34536 | 34537 | 34542 | 34546 | 34548 | 34553 | 34559 | 34566 | 34567 |
| 34568 | 34569 | 34575 | 34577 | 34578 | 34584 | 34585 | 34588 | 34589 | 34591 | 34594 | 34596 |
| 34597 | 34599 | 34600 | 34603 | 34607 | 34608 | 34613 | 34614 | 34615 | 34617 | 34618 | 34619 |
| 34620 | 34621 | 34622 | 34623 | 34624 | 34626 | 34627 | 34636 | 34637 | 34638 | 34639 | 34648 |
| 34649 | 34653 | 34655 | 34656 | 34657 | 34658 | 34664 | 34668 | 34669 | 34676 | 34677 | 34679 |
| 34682 | 34683 | 34684 | 34685 | 34686 | 34687 | 34688 | 34690 | 34691 | 34692 | 34695 | 34699 |
| 34700 | 34701 | 34704 | 34705 | 34708 | 34709 | 34715 | 34722 | 34723 | 34724 | 34728 | 34729 |
| 34732 | 34737 | 34738 | 34743 | 34744 | 34745 | 34748 | 34750 | 34751 | 34753 | 34760 | 34763 |
| 34766 | 34771 | 34772 | 34776 | 34777 | 34778 | 34780 | 34784 | 34789 | 34790 | 34792 | 34804 |
| 34806 | 34808 | 34823 | 34824 | 34840 | 34847 | 34850 | 34854 | 34856 | 34857 | 34861 | 34863 |
| 34867 | 34871 | 34872 | 34873 | 34875 | 34879 | 34882 | 34884 | 34903 | 34905 | 34906 | 34913 |
| 34920 | 34924 | 34927 | 34929 | 34932 | 34934 | 34935 | 34936 | 34938 | 34939 | 34940 | 34944 |
| 34946 | 34949 | 34961 | 34964 | 34972 | 34973 | 34984 | 34990 | 34995 | 34996 | 34999 |
| 35004 | 35005 | 35007 | 35008 | 35014 | 35016 | 35019 | 35023 | 35025 | 35030 | 35031 | 35032 |
| 35036 | 35037 | 35040 | 35047 | 35049 | 35051 | 35056 | 35058 | 35060 | 35061 | 35063 | 35064 |
| 35068 | 35069 | 35071 | 35073 | 35074 | 35075 | 35081 | 35083 | 35084 | 35089 | 35094 | 35095 |
| 35100 | 35102 | 35103 | 35107 | 35109 | 35113 | 35114 | 35119 | 35120 | 35124 | 35126 | 35129 |
| 35130 | 35136 | 35137 | 35140 | 35142 | 35143 | 35150 | 35151 | 35152 | 35153 | 35154 | 35155 |
| 35156 | 35158 | 35159 | 35160 | 35161 | 35162 | 35165 | 35167 | 35172 | 35175 | 35177 | 35179 |
| 35180 | 35181 | 35182 | 35184 | 35185 | 35189 | 35190 | 35191 | 35193 | 35196 | 35198 | 35200 |
| 35201 | 35203 | 35204 | 35205 | 35207 | 35212 | 35213 | 35215 | 35218 | 35224 | 35225 | 35226 |
| 35227 | 35229 | 35233 | 35234 | 35235 | 35237 | 35238 | 35240 | 35241 | 35242 | 35245 | 35246 |
| 35249 | 35250 | 35251 | 35252 | 35253 | 35259 | 35265 | 35266 | 35270 | 35276 | 35278 | 35281 |
| 35282 | 35283 | 35284 | 35285 | 35289 | 35293 | 35295 | 35296 | 35297 | 35301 | 35302 | 35306 |
| 35310 | 35312 | 35315 | 35316 | 35317 | 35318 | 35320 | 35321 | 35322 | 35323 | 35324 | 35325 |
| 35326 | 35327 | 35328 | 35329 | 35330 | 35331 | 35332 | 35334 | 35336 | 35338 | 35339 | 35340 |
| 35342 | 35346 | 35348 | 35350 | 35352 | 35353 | 35354 | 35359 | 35360 | 35362 | 35363 | 35365 |
| 35366 | 35367 | 35375 | 35380 | 35381 | 35382 | 35383 | 35384 | 35385 | 35386 | 35388 | 35390 |
| 35392 | 35393 | 35394 | 35396 | 35404 | 35406 | 35408 | 35409 | 35410 | 35411 | 35412 | 35413 |
| 35417 | 35418 | 35422 | 35431 | 35432 | 35434 | 35436 | 35437 | 35441 | 35449 | 35453 | 35455 |
| 35456 | 35459 | 35460 | 35461 | 35466 | 35467 | 35469 | 35470 | 35473 | 35475 | 35480 | 35481 |
| 35482 | 35483 | 35486 | 35487 | 35490 | 35493 | 35495 | 35496 | 35497 | 35500 | 35501 | 35504 |
| 35506 | 35507 | 35508 | 35509 | 35511 | 35515 | 35516 | 35517 | 35520 | 35525 | 35526 | 35527 |
| 35529 | 35532 | 35534 | 35535 | 35537 | 35542 | 35543 | 35544 | 35549 | 35550 | 35551 |
| 35553 | 35561 | 35562 | 35563 | 35567 | 35568 | 35570 | 35573 | 35574 | 35576 | 35582 | 35583 |
| 35584 | 35586 | 35587 | 35593 | 35594 | 35598 | 35602 | 35605 | 35606 | 35610 | 35611 | 35619 |
| 35623 | 35630 | 35632 | 35635 | 35636 | 35637 | 35638 | 35639 | 35643 | 35644 | 35645 | 35647 |
| 35648 | 35649 | 35650 | 35653 | 35656 | 35658 | 35664 | 35673 | 35675 | 35677 | 35680 | 35684 |
| 35685 | 35686 | 35687 | 35695 | 35697 | 35698 | 35699 | 35700 | 35701 | 35702 | 35704 | 35705 |
| 35706 | 35708 | 35714 | 35717 | 35718 | 35719 | 35720 | 35721 | 35727 | 35728 | 35731 | 35733 |
| 35739 | 35740 | 35742 | 35743 | 35745 | 35749 | 35755 | 35756 | 35757 | 35758 | 35759 | 35765 |
| 35766 | 35770 | 35773 | 35776 | 35778 | 35779 | 35783 | 35784 | 35785 | 35786 | 35787 | 35788 |
| 35789 | 35791 | 35793 | 35794 | 35796 | 35797 | 35798 | 35799 | 35803 | 35805 | 35806 | 35808 |
| 35811 | 35814 | 35815 | 35817 | 35822 | 35824 | 35825 | 35826 | 35827 | 35828 | 35829 | 35836 |
| 35838 | 35839 | 35841 | 35842 | 35846 | 35849 | 35850 | 35852 | 35854 | 35856 | 35859 | 35860 |
| 35863 | 35864 | 35865 | 35867 | 35873 | 35878 | 35879 | 35880 | 35882 | 35886 | 35887 | 35888 |
| 35893 | 35895 | 35899 | 35900 | 35901 | 35902 | 35905 | 35906 | 35912 | 35914 | 35915 | 35921 |
| 35924 | 35928 | 35929 | 35932 | 35934 | 35938 | 35940 | 35941 | 35942 | 35956 | 35957 | 35958 |
| 35959 | 35961 | 35962 | 35964 | 35965 | 35967 | 35969 | 35971 | 35973 | 35974 | 35980 | 35981 |
| 35984 | 35985 | 35986 | 35987 | 35989 | 35990 | 35991 | 35995 | 35997 | 35998 | 35999 | 36003 |
| 36006 | 36007 | 36008 | 36009 | 36011 | 36024 | 36025 | 36028 | 36030 | 36037 | 36038 | 36040 |
| 36045 | 36048 | 36050 | 36055 | 36060 | 36061 | 36063 | 36070 | 36074 | 36075 | 36081 | 36085 |
| 36087 | 36090 | 36091 | 36095 | 36105 | 36106 | 36112 | 36114 | 36115 | 36123 | 36124 | 36126 |
| 36127 | 36132 | 36133 | 36134 | 36135 | 36136 | 36137 | 36141 | 36142 | 36148 | 36158 | 36159 |
| 36160 | 36167 | 36168 | 36169 | 36170 | 36173 | 36175 | 36179 | 36181 | 36183 | 36187 | 36188 |
| 36196 | 36200 | 36204 | 36207 | 36211 | 36212 | 36213 | 36214 | 36222 | 36223 | 36224 | 36225 |
| 36228 | 36235 | 36240 | 36241 | 36245 | 36246 | 36253 | 36256 | 36259 | 36260 | 36262 | 36264 |
| 36276 | 36277 | 36279 | 36280 | 36283 | 36285 | 36287 | 36288 | 36289 | 36292 | 36297 | 36298 |
| 36301 | 36308 | 36310 | 36313 | 36316 | 36317 | 36325 | 36327 | 36331 | 36332 | 36339 | 36344 |
| 36348 | 36351 | 36353 | 36355 | 36358 | 36359 | 36360 | 36362 | 36365 | 36369 | 36375 | 36378 |
| 36379 | 36381 | 36382 | 36384 | 36385 | 36387 | 36390 | 36396 | 36399 | 36402 | 36407 | 36409 |
| 36410 | 36415 | 36417 | 36420 | 36421 | 36423 | 36425 | 36429 | 36430 | 36431 | 36438 | 36444 |
| 36449 | 36450 | 36451 | 36452 | 36455 | 36458 | 36459 | 36460 | 36461 | 36464 | 36470 | 36473 |
| 36478 | 36479 | 36480 | 36490 | 36493 | 36497 | 36499 | 36501 | 36504 | 36508 | 36511 | 36514 |
| 36516 | 36517 | 36522 | 36523 | 36527 | 36530 | 36532 | 36533 | 36535 | 36542 | 36555 | 36556 |
| 36563 | 36573 | 36576 | 36578 | 36584 | 36590 | 36595 | 36598 | 36599 | 36607 | 36609 | 36611 |
| 36612 | 36613 | 36619 | 36620 | 36623 | 36626 | 36628 | 36629 | 36630 | 36634 | 36636 | 36643 |
| 36644 | 36645 | 36649 | 36650 | 36655 | 36656 | 36663 | 36664 | 36665 | 36671 | 36673 | 36674 |
| 36676 | 36684 | 36686 | 36689 | 36700 | 36705 | 36707 | 36709 | 36710 | 36715 | 36716 | 36717 |
| 36720 | 36722 | 36724 | 36727 | 36729 | 36731 | 36732 | 36738 | 36740 | 36743 | 36750 | 36751 |
| 36752 | 36754 | 36755 | 36756 | 36760 | 36763 | 36765 | 36767 | 36773 | 36774 | 36777 | 36778 |
| 36785 | 36787 | 36790 | 36793 | 36795 | 36796 | 36798 | 36801 | 36806 | 36808 | 36811 | 36813 |

TABLE 13A-continued

Seed Oil Yield/Content

| | | | | | | | | | | | |
|---|---|---|---|---|---|---|---|---|---|---|---|
| 36815 | 36816 | 36823 | 36826 | 36829 | 36839 | 36841 | 36842 | 36846 | 36853 | 36855 | 36856 |
| 36858 | 36860 | 36864 | 36866 | 36872 | 36879 | 36882 | 36893 | 36899 | 36908 | 36909 | 36912 |
| 36916 | 36922 | 36928 | 36934 | 36936 | 36937 | 36938 | 36939 | 36940 | 36942 | 36944 | 36946 |
| 36947 | 36949 | 36950 | 36954 | 36961 | 36962 | 36963 | 36966 | 36967 | 36968 | 36976 | 36978 |
| 36982 | 36988 | 36990 | 36994 | 36995 | 36997 | 37000 | 37004 | 37006 | 37012 | 37015 | 37023 |
| 37027 | 37031 | 37033 | 37034 | 37035 | 37037 | 37038 | 37040 | 37041 | 37042 | 37044 | 37047 |
| 37053 | 37062 | 37067 | 37074 | 37082 | 37084 | 37088 | 37097 | 37103 | 37105 | 37109 | 37110 |
| 37111 | 37117 | 37120 | 37126 | 37128 | 37129 | 37131 | 37134 | 37140 | 37141 | 37142 | 37145 |
| 37146 | 37148 | 37149 | 37150 | 37151 | 37152 | 37153 | 37154 | 37157 | 37160 | 37163 | 37166 |
| 37167 | 37171 | 37172 | 37179 | 37180 | 37183 | 37184 | 37185 | 37186 | 37189 | 37192 | 37194 |
| 37196 | 37209 | 37210 | 37212 | 37214 | 37221 | 37222 | 37223 | 37225 | 37226 | 37230 | 37233 |
| 37234 | 37235 | 37237 | 37238 | 37241 | 37243 | 37244 | 37247 | 37248 | 37249 | 37250 | 37255 |
| 37257 | 37258 | 37260 | 37262 | 37265 | 37271 | 37272 | 37273 | 37275 | 37279 | 37280 | 37283 |
| 37284 | 37285 | 37286 | 37287 | 37292 | 37293 | 37294 | 37295 | 37297 | 37298 | 37299 | 37302 |
| 37304 | 37305 | 37306 | 37307 | 37308 | 37310 | 37311 | 37312 | 37314 | 37315 | 37317 | 37320 |
| 37323 | 37325 | 37327 | 37330 | 37332 | 37335 | 37337 | 37338 | 37340 | 37341 | 37342 | 37351 |
| 37354 | 37356 | 37358 | 37359 | 37360 | 37362 | 37363 | 37364 | 37365 | 37366 | 37372 | 37373 |
| 37375 | 37376 | 37379 | 37381 | 37382 | 37383 | 37384 | 37385 | 37387 | 37389 | 37390 | 37392 |
| 37393 | 37404 | 37405 | 37406 | 37407 | 37410 | 37411 | 37412 | 37413 | 37415 | 37420 | 37422 |
| 37423 | 37424 | 37425 | 37427 | 37428 | 37430 | 37434 | 37435 | 37436 | 37438 | 37439 | 37442 |
| 37444 | 37445 | 37448 | 37450 | 37456 | 37460 | 37461 | 37464 | 37465 | 37466 | 37468 | 37470 |
| 37471 | 37472 | 37473 | 37474 | 37475 | 37477 | 37478 | 37483 | 37484 | 37485 | 37488 | 37493 |
| 37497 | 37498 | 37500 | 37502 | 37504 | 37505 | 37509 | 37511 | 37515 | 37518 | 37524 | 37526 |
| 37528 | 37529 | 37532 | 37533 | 37535 | 37536 | 37538 | 37540 | 37543 | 37548 | 37549 | 37552 |
| 37553 | 37555 | 37556 | 37558 | 37560 | 37561 | 37564 | 37565 | 37567 | 37568 | 37572 | 37574 |
| 37576 | 37577 | 37579 | 37588 | 37590 | 37591 | 37593 | 37594 | 37599 | 37600 | 37602 | 37606 |
| 37607 | 37608 | 37612 | 37614 | 37615 | 37619 | 37621 | 37625 | 37626 | 37631 | 37632 | 37635 |
| 37636 | 37637 | 37640 | 37644 | 37649 | 37650 | 37653 | 37654 | 37656 | 37658 | 37661 | 37668 |
| 37669 | 37670 | 37671 | 37672 | 37673 | 37679 | 37683 | 37687 | 37692 | 37697 | 37701 | 37702 |
| 37704 | 37706 | 37717 | 37720 | 37721 | 37722 | 37723 | 37725 | 37726 | 37732 | 37733 | 37735 |
| 37736 | 37739 | 37740 | 37749 | 37751 | 37752 | 37754 | 37755 | 37758 | 37760 | 37765 | 37766 |
| 37769 | 37770 | 37771 | 37772 | 37773 | 37774 | 37775 | 37776 | 37779 | 37782 | 37783 | 37785 |
| 37788 | 37789 | 37790 | 37791 | 37792 | 37794 | 37800 | 37801 | 37807 | 37808 | 37819 | 37822 |
| 37830 | 37832 | 37836 | 37838 | 37839 | 37840 | 37844 | 37852 | 37859 | 37860 | 37862 | 37864 |
| 37868 | 37869 | 37871 | 37872 | 37882 | 37884 | 37886 | 37888 | 37891 | 37892 | 37896 |
| 37898 | 37901 | 37903 | 37907 | 37908 | 37912 | 37917 | 37918 | 37919 | 37920 | 37921 | 37925 |
| 37929 | 37932 | 37933 | 37934 | 37935 | 37938 | 37939 | 37941 | 37942 | 37943 | 37944 | 37945 |
| 37946 | 37947 | 37948 | 37949 | 37953 | 37954 | 37955 | 37956 | 37960 | 37961 | 37963 | 37964 |
| 37966 | 37968 | 37970 | 37972 | 37973 | 37974 | 37975 | 37978 | 37980 | 37982 | 37983 | 37985 |
| 37986 | 37987 | 37991 | 37993 | 37995 | 37996 | 37999 | 38000 | 38004 | 38006 | 38007 | 38008 |
| 38009 | 38011 | 38014 | 38015 | 38018 | 38019 | 38020 | 38023 | 38024 | 38029 | 38030 | 38031 |
| 38033 | 38035 | 38036 | 38039 | 38041 | 38042 | 38043 | 38046 | 38051 | 38052 | 38056 | 38057 |
| 38061 | 38063 | 38064 | 38066 | 38068 | 38069 | 38070 | 38076 | 38079 | 38080 | 38081 | 38083 |
| 38085 | 38086 | 38087 | 38093 | 38097 | 38099 | 38100 | 38108 | 38110 | 38111 | 38112 | 38115 |
| 38117 | 38118 | 38119 | 38126 | 38131 | 38137 | 38139 | 38140 | 38141 | 38142 | 38143 | 38149 |
| 38156 | 38157 | 38159 | 38160 | 38161 | 38163 | 38165 | 38169 | 38171 | 38173 | 38174 | 38175 |
| 38178 | 38183 | 38185 | 38186 | 38188 | 38189 | 38193 | 38197 | 38204 | 38207 | 38209 | 38210 |
| 38211 | 38213 | 38215 | 38216 | 38217 | 38221 | 38222 | 38224 | 38225 | 38227 | 38229 | 38234 |
| 38238 | 38242 | 38247 | 38248 | 38250 | 38251 | 38252 | 38253 | 38255 | 38256 | 38258 | 38262 |
| 38263 | 38264 | 38265 | 38273 | 38275 | 38276 | 38278 | 38279 | 38281 | 38283 | 38285 | 38286 |
| 38290 | 38295 | 38300 | 38302 | 38303 | 38304 | 38305 | 38306 | 38309 | 38310 | 38311 |
| 38315 | 38318 | 38320 | 38321 | 38323 | 38324 | 38325 | 38326 | 38330 | 38336 | 38337 | 38338 |
| 38339 | 38341 | 38344 | 38346 | 38349 | 38350 | 38351 | 38352 | 38354 | 38355 | 38365 | 38366 |
| 38368 | 38369 | 38370 | 38371 | 38372 | 38374 | 38375 | 38376 | 38378 | 38380 | 38381 | 38382 |
| 38384 | 38386 | 38387 | 38389 | 38391 | 38392 | 38393 | 38394 | 38395 | 38396 | 38397 | 38398 |
| 38399 | 38402 | 38404 | 38405 | 38406 | 38407 | 38410 | 38418 | 38420 | 38421 | 38423 | 38424 |
| 38425 | 38426 | 38427 | 38428 | 38430 | 38431 | 38433 | 38435 | 38436 | 38439 | 38440 | 38442 |
| 38444 | 38448 | 38449 | 38453 | 38461 | 38464 | 38465 | 38467 | 38468 | 38470 | 38477 | 38478 |
| 38482 | 38493 | 38494 | 38496 | 38497 | 38499 | 38501 | 38502 | 38503 | 38504 | 38507 | 38512 |
| 38516 | 38517 | 38518 | 38525 | 38527 | 38528 | 38529 | 38532 | 38534 | 38539 | 38545 | 38547 |
| 38548 | 38550 | 38551 | 38554 | 38556 | 38557 | 38558 | 38559 | 38560 | 38563 | 38566 | 38567 |
| 38569 | 38570 | 38572 | 38573 | 38575 | 38578 | 38579 | 38581 | 38582 | 38583 | 38588 | 38591 |
| 38592 | 38595 | 38596 | 38597 | 38607 | 38613 | 38618 | 38619 | 38621 | 38622 | 38625 | 38627 |
| 38630 | 38641 | 38642 | 38644 | 38645 | 38649 | 38650 | 38651 | 38655 | 38664 | 38665 | 38669 |
| 38670 | 38672 | 38673 | 38676 | 38677 | 38678 | 38681 | 38683 | 38686 | 38690 | 38693 | 38695 |
| 38698 | 38702 | 38703 | 38704 | 38705 | 38706 | 38709 | 38712 | 38713 | 38714 | 38716 | 38720 |
| 38723 | 38724 | 38734 | 38735 | 38738 | 38739 | 38742 | 38743 | 38745 | 38746 | 38747 | 38750 |
| 38751 | 38753 | 38754 | 38757 | 38758 | 38759 | 38760 | 38761 | 38762 | 38766 | 38768 | 38769 |
| 38771 | 38772 | 38775 | 38779 | 38780 | 38782 | 38783 | 38787 | 38788 | 38789 | 38790 | 38792 |
| 38794 | 38798 | 38802 | 38807 | 38810 | 38811 | 38812 | 38814 | 38818 | 38819 | 38823 | 38827 |
| 38828 | 38829 | 38830 | 38834 | 38838 | 38844 | 38845 | 38847 | 38849 | 38850 | 38851 | 38852 |
| 38853 | 38854 | 38855 | 38856 | 38857 | 38859 | 38861 | 38862 | 38863 | 38866 | 38867 | 38869 |
| 38870 | 38871 | 38874 | 38875 | 38876 | 38877 | 38878 | 38879 | 38880 | 38883 | 38885 | 38889 |
| 38898 | 38900 | 38901 | 38902 | 38903 | 38904 | 38906 | 38907 | 38908 | 38909 | 38910 | 38911 |
| 38913 | 38916 | 38919 | 38921 | 38923 | 38925 | 38926 | 38929 | 38943 | 38944 | 38955 | 38956 |
| 38958 | 38959 | 38960 | 38974 | 38975 | 38976 | 38979 | 38980 | 38982 | 38987 | 38988 | 38989 |
| 38992 | 38993 | 38997 | 39000 | 39003 | 39004 | 39009 | 39021 | 39022 | 39023 | 39024 | 39029 |

TABLE 13A-continued

Seed Oil Yield/Content

| | | | | | | | | | | | |
|---|---|---|---|---|---|---|---|---|---|---|---|
| 39030 | 39031 | 39037 | 39038 | 39044 | 39045 | 39047 | 39052 | 39053 | 39054 | 39057 | 39059 |
| 39062 | 39063 | 39064 | 39066 | 39067 | 39070 | 39075 | 39078 | 39079 | 39084 | 39085 | 39088 |
| 39093 | 39095 | 39096 | 39100 | 39102 | 39103 | 39104 | 39109 | 39110 | 39112 | 39113 | 39114 |
| 39115 | 39128 | 39129 | 39133 | 39135 | 39137 | 39141 | 39143 | 39146 | 39148 | 39149 | 39153 |
| 39154 | 39158 | 39167 | 39168 | 39169 | 39172 | 39177 | 39179 | 39185 | 39187 | 39197 | 39198 |
| 39199 | 39200 | 39205 | 39206 | 39208 | 39210 | 39212 | 39213 | 39217 | 39218 | 39219 | 39220 |
| 39221 | 39222 | 39223 | 39225 | 39228 | 39232 | 39233 | 39234 | 39235 | 39237 | 39238 | 39240 |
| 39242 | 39244 | 39245 | 39248 | 39249 | 39250 | 39251 | 39252 | 39254 | 39256 | 39257 | 39258 |
| 39262 | 39263 | 39264 | 39265 | 39269 | 39270 | 39272 | 39274 | 39280 | 39283 | 39288 | 39290 |
| 39294 | 39295 | 39296 | 39298 | 39299 | 39300 | 39301 | 39302 | 39303 | 39304 | 39308 | 39309 |
| 39310 | 39311 | 39312 | 39313 | 39316 | 39317 | 39320 | 39321 | 39326 | 39329 | 39333 | 39334 |
| 39335 | 39336 | 39337 | 39338 | 39339 | 39341 | 39342 | 39343 | 39344 | 39345 | 39346 | 39348 |
| 39353 | 39354 | 39355 | 39358 | 39359 | 39363 | 39366 | 39369 | 39370 | 39375 | 39389 | 39390 |
| 39391 | 39395 | 39396 | 39397 | 39398 | 39404 | 39405 | 39411 | 39412 | 39414 | 39419 | 39421 |
| 39424 | 39426 | 39429 | 39431 | 39432 | 39434 | 39435 | 39438 | 39443 | 39446 | 39447 | 39452 |
| 39453 | 39456 | 39461 | 39463 | 39464 | 39468 | 39470 | 39471 | 39472 | 39477 | 39478 | 39480 |
| 39481 | 39482 | 39483 | 39486 | 39495 | 39497 | 39498 | 39501 | 39503 | 39505 | 39509 | 39510 |
| 39511 | 39514 | 39516 | 39518 | 39523 | 39524 | 39528 | 39537 | 39539 | 39540 | 39543 | 39549 |
| 39550 | 39556 | 39558 | 39569 | 39570 | 39571 | 39572 | 39577 | 39578 | 39579 | 39581 | 39583 |
| 39584 | 39588 | 39589 | 39590 | 39591 | 39592 | 39593 | 39594 | 39596 | 39599 | 39604 | 39605 |
| 39606 | 39607 | 39610 | 39611 | 39613 | 39615 | 39617 | 39618 | 39621 | 39622 | 39623 | 39624 |
| 39625 | 39627 | 39629 | 39630 | 39631 | 39636 | 39638 | 39639 | 39640 | 39641 | 39645 | 39646 |
| 39648 | 39650 | 39656 | 39660 | 39665 | 39669 | 39670 | 39671 | 39672 | 39674 | 39675 | 39676 |
| 39677 | 39678 | 39679 | 39683 | 39684 | 39685 | 39686 | 39687 | 39688 | 39691 | 39692 | 39695 |
| 39696 | 39701 | 39704 | 39708 | 39710 | 39711 | 39712 | 39713 | 39714 | 39715 | 39716 | 39717 |
| 39718 | 39719 | 39720 | 39721 | 39722 | 39723 | 39724 | 39726 | 39728 | 39729 | 39732 | 39733 |
| 39734 | 39735 | 39736 | 39739 | 39743 | 39744 | 39745 | 39748 | 39749 | 39754 | 39756 | 39760 |
| 39761 | 39766 | 39779 | 39780 | 39781 | 39782 | 39785 | 39786 | 39792 | 39796 | 39797 | 39798 |
| 39804 | 39805 | 39809 | 39812 | 39814 | 39815 | 39816 | 39818 | 39819 | 39822 | 39825 | 39826 |
| 39830 | 39832 | 39836 | 39837 | 39840 | 39844 | 39847 | 39850 | 39851 | 39853 | 39854 | 39859 |
| 39860 | 39862 | 39863 | 39864 | 39865 | 39868 | 39876 | 39879 | 39883 | 39885 | 39886 |
| 39890 | 39891 | 39892 | 39896 | 39897 | 39899 | 39905 | 39914 | 39915 | 39918 | 39920 | 39923 |
| 39925 | 39929 | 39933 | 39941 | 39943 | 39944 | 39945 | 39950 | 39951 | 39952 | 39954 | 39956 |
| 39959 | 39960 | 39961 | 39962 | 39963 | 39965 | 39967 | 39969 | 39971 | 39972 | 39976 | 39977 |
| 39978 | 39981 | 39982 | 39983 | 39985 | 39988 | 39989 | 39990 | 39991 | 39993 | 39995 | 39998 |
| 39999 | 40001 | 40002 | 40003 | 40004 | 40005 | 40009 | 40011 | 40015 | 40018 | 40022 | 40024 |
| 40028 | 40029 | 40031 | 40032 | 40033 | 40034 | 40035 | 40036 | 40038 | 40039 | 40040 | 40041 |
| 40043 | 40044 | 40046 | 40049 | 40050 | 40054 | 40057 | 40060 | 40063 | 40070 | 40072 | 40073 |
| 40075 | 40076 | 40078 | 40079 | 40089 | 40091 | 40094 | 40103 | 40105 | 40107 | 40108 | 40110 |
| 40115 | 40116 | 40117 | 40120 | 40121 | 40124 | 40128 | 40129 | 40132 | 40133 | 40136 | 40141 |
| 40144 | 40145 | 40150 | 40151 | 40152 | 40153 | 40157 | 40161 | 40163 | 40165 | 40167 | 40168 |
| 40170 | 40175 | 40176 | 40178 | 40181 | 40183 | 40184 | 40186 | 40193 | 40195 | 40199 | 40200 |
| 40201 | 40206 | 40208 | 40211 | 40212 | 40219 | 40220 | 40223 | 40224 | 40226 | 40232 | 40236 |
| 40237 | 40239 | 40242 | 40245 | 40247 | 40248 | 40250 | 40251 | 40258 | 40263 | 40267 | 40268 |
| 40270 | 40273 | 40277 | 40279 | 40281 | 40282 | 40283 | 40284 | 40285 | 40287 | 40288 | 40290 |
| 40291 | 40293 | 40295 | 40297 | 40299 | 40300 | 40301 | 40302 | 40303 | 40319 | 40326 | 40327 |
| 40328 | 40333 | 40334 | 40337 | 40349 | 40350 | 40351 | 40356 | 40357 | 40362 | 40364 | 40365 |
| 40366 | 40368 | 40374 | 40375 | 40377 | 40378 | 40379 | 40380 | 40381 | 40387 | 40389 | 40390 |
| 40391 | 40392 | 40393 | 40394 | 40395 | 40396 | 40407 | 40408 | 40413 | 40418 | 40421 | 40422 |
| 40423 | 40430 | 40434 | 40435 | 40436 | 40438 | 40439 | 40443 | 40444 | 40446 | 40447 | 40448 |
| 40450 | 40453 | 40460 | 40461 | 40463 | 40464 | 40465 | 40466 | 40470 | 40472 | 40474 | 40476 |
| 40479 | 40480 | 40481 | 40482 | 40486 | 40491 | 40492 | 40495 | 40496 | 40499 | 40502 | 40506 |
| 40508 | 40510 | 40511 | 40514 | 40515 | 40517 | 40522 | 40524 | 40526 | 40528 | 40531 | 40533 |
| 40537 | 40538 | 40541 | 40547 | 40550 | 40551 | 40552 | 40553 | 40554 | 40556 | 40557 | 40558 |
| 40560 | 40563 | 40565 | 40569 | 40570 | 40575 | 40577 | 40579 | 40580 | 40582 | 40584 | 40587 |
| 40588 | 40589 | 40592 | 40593 | 40594 | 40595 | 40596 | 40598 | 40599 | 40600 | 40601 |
| 40602 | 40605 | 40607 | 40608 | 40609 | 40611 | 40613 | 40614 | 40615 | 40616 | 40619 | 40620 |
| 40622 | 40625 | 40626 | 40627 | 40628 | 40630 | 40631 | 40632 | 40633 | 40636 | 40637 | 40641 |
| 40642 | 40643 | 40646 | 40652 | 40655 | 40657 | 40659 | 40660 | 40662 | 40664 | 40667 | 40668 |
| 40670 | 40671 | 40672 | 40674 | 40678 | 40679 | 40682 | 40683 | 40684 | 40685 | 40687 | 40690 |
| 40696 | 40698 | 40699 | 40701 | 40702 | 40703 | 40704 | 40708 | 40710 | 40711 | 40714 | 40715 |
| 40718 | 40719 | 40724 | 40726 | 40727 | 40730 | 40731 | 40734 | 40737 | 40738 | 40740 | 40745 |
| 40746 | 40749 | 40750 | 40752 | 40754 | 40755 | 40756 | 40759 | 40760 | 40761 | 40772 | 40773 |
| 40775 | 40776 | 40780 | 40790 | 40791 | 40793 | 40796 | 40797 | 40798 | 40799 | 40800 | 40801 |
| 40802 | 40803 | 40810 | 40812 | 40813 | 40815 | 40816 | 40827 | 40828 | 40831 | 40832 | 40833 |
| 40834 | 40839 | 40842 | 40843 | 40844 | 40845 | 40848 | 40851 | 40852 | 40856 | 40858 | 40863 |
| 40865 | 40867 | 40868 | 40869 | 40870 | 40871 | 40875 | 40877 | 40879 | 40883 | 40885 | 40888 |
| 40891 | 40893 | 40907 | 40912 | 40913 | 40915 | 40918 | 40921 | 40924 | 40926 | 40927 |
| 40929 | 40931 | 40936 | 40938 | 40939 | 40940 | 40942 | 40943 | 40944 | 40945 | 40947 | 40948 |
| 40950 | 40951 | 40952 | 40955 | 40957 | 40959 | 40960 | 40963 | 40964 | 40965 | 40966 | 40968 |
| 40969 | 40971 | 40975 | 40977 | 40978 | 40979 | 40980 | 40983 | 40985 | 40986 | 40987 | 40988 |
| 40994 | 40995 | 41006 | 41008 | 41011 | 41012 | 41015 | 41017 | 41025 | 41027 | 41028 | 41030 |
| 41032 | 41034 | 41035 | 41038 | 41039 | 41040 | 41041 | 41042 | 41045 | 41046 | 41047 | 41048 |
| 41049 | 41051 | 41053 | 41054 | 41062 | 41075 | 41076 | 41078 | 41079 | 41081 | 41085 | 41086 |
| 41087 | 41090 | 41092 | 41094 | 41095 | 41096 | 41097 | 41098 | 41099 | 41100 | 41101 | 41109 |
| 41110 | 41113 | 41114 | 41116 | 41117 | 41118 | 41119 | 41120 | 41121 | 41122 | 41123 | 41124 |
| 41126 | 41127 | 41129 | 41134 | 41136 | 41137 | 41138 | 41141 | 41144 | 41146 | 41147 | 41148 |

TABLE 13A-continued

Seed Oil Yield/Content

| | | | | | | | | | | | |
|---|---|---|---|---|---|---|---|---|---|---|---|
| 41150 | 41153 | 41154 | 41157 | 41162 | 41163 | 41173 | 41174 | 41175 | 41176 | 41185 | 41189 |
| 41194 | 41196 | 41197 | 41198 | 41200 | 41202 | 41203 | 41205 | 41206 | 41209 | 41210 | 41212 |
| 41213 | 41215 | 41216 | 41217 | 41218 | 41223 | 41224 | 41225 | 41229 | 41232 | 41238 | 41239 |
| 41240 | 41241 | 41242 | 41243 | 41251 | 41252 | 41254 | 41255 | 41257 | 41258 | 41259 | 41260 |
| 41264 | 41265 | 41266 | 41267 | 41274 | 41281 | 41289 | 41292 | 41293 | 41294 | 41296 | 41297 |
| 41300 | 41301 | 41302 | 41303 | 41306 | 41309 | 41310 | 41312 | 41313 | 41319 | 41320 | 41322 |
| 41323 | 41332 | 41333 | 41334 | 41335 | 41337 | 41339 | 41340 | 41343 | 41345 | 41347 | 41348 |
| 41351 | 41352 | 41357 | 41358 | 41361 | 41362 | 41363 | 41365 | 41366 | 41367 | 41368 | 41381 |
| 41382 | 41383 | 41387 | 41388 | 41392 | 41398 | 41402 | 41403 | 41406 | 41407 | 41409 | 41411 |
| 41412 | 41416 | 41417 | 41418 | 41423 | 41425 | 41426 | 41428 | 41429 | 41432 | 41436 | 41449 |
| 41451 | 41457 | 41458 | 41466 | 41467 | 41470 | 41471 | 41473 | 41475 | 41477 | 41479 | 41482 |
| 41483 | 41485 | 41488 | 41494 | 41496 | 41500 | 41506 | 41507 | 41509 | 41519 | 41522 | 41524 |
| 41525 | 41527 | 41528 | 41533 | 41534 | 41535 | 41536 | 41537 | 41541 | 41547 | 41548 | 41550 |
| 41551 | 41552 | 41553 | 41554 | 41555 | 41556 | 41557 | 41563 | 41568 | 41569 | 41571 |
| 41572 | 41573 | 41574 | 41575 | 41576 | 41579 | 41580 | 41585 | 41586 | 41588 | 41591 | 41596 |
| 41600 | 41601 | 41605 | 41608 | 41610 | 41613 | 41614 | 41616 | 41621 | 41622 | 41635 | 41636 |
| 41638 | 41642 | 41643 | 41645 | 41647 | 41648 | 41653 | 41655 | 41658 | 41661 | 41668 | 41669 |
| 41671 | 41672 | 41673 | 41674 | 41675 | 41676 | 41678 | 41680 | 41681 | 41682 | 41683 | 41684 |
| 41686 | 41689 | 41690 | 41693 | 41695 | 41697 | 41699 | 41700 | 41702 | 41705 | 41707 | 41708 |
| 41712 | 41713 | 41716 | 41717 | 41718 | 41721 | 41723 | 41726 | 41728 | 41730 | 41732 | 41736 |
| 41737 | 41738 | 41741 | 41742 | 41743 | 41746 | 41747 | 41748 | 41749 | 41750 | 41753 | 41754 |
| 41756 | 41757 | 41758 | 41760 | 41761 | 41762 | 41763 | 41764 | 41765 | 41766 | 41767 | 41768 |
| 41769 | 41774 | 41776 | 41779 | 41786 | 41787 | 41788 | 41791 | 41792 | 41795 | 41800 | 41801 |
| 41803 | 41804 | 41806 | 41807 | 41808 | 41811 | 41812 | 41813 | 41814 | 41816 | 41817 | 41818 |
| 41820 | 41822 | 41825 | 41826 | 41827 | 41828 | 41830 | 41831 | 41832 | 41835 | 41836 | 41838 |
| 41839 | 41841 | 41842 | 41843 | 41844 | 41845 | 41846 | 41857 | 41858 | 41860 | 41862 | 41863 |
| 41866 | 41867 | 41870 | 41872 | 41873 | 41874 | 41875 | 41876 | 41877 | 41878 | 41879 | 41880 |
| 41882 | 41886 | 41888 | 41891 | 41892 | 41896 | 41897 | 41898 | 41900 | 41906 | 41907 | 41908 |
| 41910 | 41913 | 41914 | 41915 | 41920 | 41922 | 41924 | 41928 | 41929 | 41932 | 41935 | 41946 |
| 41952 | 41953 | 41954 | 41957 | 41958 | 41961 | 41962 | 41963 | 41964 | 41965 | 41967 | 41968 |
| 41969 | 41972 | 41975 | 41980 | 41981 | 41982 | 41985 | 41986 | 41991 | 41995 | 41997 | 41998 |
| 42000 | 42001 | 42005 | 42009 | 42012 | 42014 | 42015 | 42016 | 42017 | 42025 | 42030 | 42031 |
| 42032 | 42036 | 42038 | 42043 | 42044 | 42046 | 42052 | 42054 | 42055 | 42056 | 42057 | 42058 |
| 42059 | 42060 | 42061 | 42064 | 42071 | 42077 | 42081 | 42082 | 42084 | 42088 | 42089 | 42090 |
| 42092 | 42097 | 42098 | 42104 | 42105 | 42106 | 42111 | 42112 | 42116 | 42117 | 42118 | 42119 |
| 42122 | 42129 | 42130 | 42131 | 42134 | 42136 | 42138 | 42140 | 42142 | 42151 | 42154 | 42155 |
| 42157 | 42160 | 42161 | 42162 | 42169 | 42171 | 42172 | 42173 | 42174 | 42176 | 42177 | 42178 |
| 42181 | 42187 | 42195 | 42199 | 42202 | 42203 | 42204 | 42206 | 42209 | 42215 | 42216 | 42222 |
| 42224 | 42231 | 42232 | 42235 | 42236 | 42237 | 42238 | 42243 | 42246 | 42256 | 42259 | 42260 |
| 42262 | 42263 | 42267 | 42268 | 42270 | 42275 | 42279 | 42280 | 42281 | 42282 | 42285 | 42287 |
| 42291 | 42295 | 42298 | 42299 | 42301 | 42303 | 42304 | 42305 | 42306 | 42308 | 42312 | 42317 |
| 42320 | 42321 | 42323 | 42327 | 42339 | 42342 | 42343 | 42345 | 42347 | 42348 | 42349 | 42355 |
| 42356 | 42359 | 42360 | 42368 | 42369 | 42370 | 42375 | 42379 | 42384 | 42386 | 42396 | 42397 |
| 42398 | 42405 | 42406 | 42413 | 42417 | 42418 | 42419 | 42420 | 42422 | 42427 | 42428 | 42430 |
| 42431 | 42435 | 42436 | 42438 | 42439 | 42446 | 42447 | 42448 | 42453 | 42454 | 42455 | 42458 |
| 42462 | 42465 | 42468 | 42469 | 42470 | 42472 | 42475 | 42477 | 42479 | 42489 | 42491 | 42509 |
| 42511 | 42512 | 42514 | 42515 | 42516 | 42521 | 42522 | 42524 | 42525 | 42526 | 42533 | 42545 |
| 42547 | 42548 | 42549 | 42550 | 42556 | 42566 | 42571 | 42583 | 42584 | 42591 | 42595 | 42597 |
| 42599 | 42602 | 42603 | 42607 | 42609 | 42611 | 42612 | 42613 | 42616 | 42617 | 42620 | 42624 |
| 42628 | 42632 | 42639 | 42640 | 42645 | 42646 | 42648 | 42650 | 42651 | 42655 | 42664 | 42665 |
| 42667 | 42668 | 42673 | 42674 | 42677 | 42682 | 42687 | 42692 | 42694 | 42695 | 42696 | 42697 |
| 42706 | 42707 | 42709 | 42710 | 42713 | 42725 | 42729 | 42736 | 42738 | 42742 | 42746 | 42754 |
| 42756 | 42757 | 42760 | 42761 | 42762 | 42763 | 42764 | 42765 | 42767 | 42770 | 42771 | 42772 |
| 42775 | 42777 | 42778 | 42780 | 42786 | 42789 | 42791 | 42794 | 42802 | 42804 | 42805 | 42807 |
| 42809 | 42811 | 42814 | 42817 | 42818 | 42824 | 42826 | 42842 | 42843 | 42845 | 42847 | 42850 |
| 42856 | 42858 | 42860 | 42861 | 42863 | 42865 | 42868 | 42870 | 42871 | 42878 | 42882 | 42884 |
| 42885 | 42886 | 42887 | 42888 | 42889 | 42890 | 42892 | 42899 | 42901 | 42903 | 42908 | 42909 |
| 42915 | 42917 | 42918 | 42920 | 42921 | 42925 | 42926 | 42927 | 42929 | 42930 | 42932 | 42933 |
| 42937 | 42940 | 42942 | 42944 | 42945 | 42946 | 42947 | 42948 | 42949 | 42950 | 42951 | 42958 |
| 42960 | 42963 | 42964 | 42967 | 42969 | 42979 | 42981 | 42987 | 42988 | 42993 | 42994 |
| 42996 | 42999 | 43003 | 43004 | 43012 | 43013 | 43017 | 43019 | 43020 | 43021 | 43025 | 43028 |
| 43029 | 43031 | 43033 | 43035 | 43038 | 43039 | 43042 | 43050 | 43051 | 43052 | 43053 | 43054 |
| 43055 | 43056 | 43057 | 43059 | 43063 | 43064 | 43065 | 43068 | 43074 | 43075 | 43076 | 43077 |
| 43078 | 43080 | 43081 | 43096 | 43099 | 43101 | 43103 | 43107 | 43109 | 43111 | 43120 | 43125 |
| 43128 | 43131 | 43132 | 43133 | 43134 | 43135 | 43136 | 43137 | 43148 | 43151 | 43152 | 43156 |
| 43157 | 43159 | 43164 | 43170 | 43173 | 43178 | 43180 | 43182 | 43183 | 43185 | 43188 | 43189 |
| 43190 | 43192 | 43198 | 43204 | 43209 | 43210 | 43211 | 43212 | 43215 | 43217 | 43219 | 43220 |
| 43221 | 43226 | 43227 | 43232 | 43236 | 43237 | 43239 | 43240 | 43241 | 43242 | 43244 | 43249 |
| 43253 | 43254 | 43259 | 43260 | 43261 | 43262 | 43265 | 43267 | 43268 | 43269 | 43270 | 43271 |
| 43272 | 43276 | 43277 | 43280 | 43281 | 43282 | 43284 | 43286 | 43299 | 43301 | 43302 | 43303 |
| 43304 | 43307 | 43310 | 43315 | 43320 | 43326 | 43331 | 43332 | 43336 | 43339 | 43342 | 43343 |
| 43345 | 43348 | 43350 | 43351 | 43353 | 43354 | 43358 | 43359 | 43368 | 43370 | 43371 | 43373 |
| 43375 | 43376 | 43377 | 43385 | 43386 | 43388 | 43389 | 43390 | 43391 | 43395 | 43398 | 43399 |
| 43400 | 43401 | 43402 | 43403 | 43404 | 43406 | 43422 | 43425 | 43426 | 43427 | 43428 | 43429 |
| 43430 | 43434 | 43438 | 43439 | 43441 | 43444 | 43450 | 43455 | 43456 | 43458 | 43459 | 43464 |
| 43468 | 43474 | 43478 | 43482 | 43483 | 43484 | 43486 | 43488 | 43489 | 43491 | 43493 | 43494 |
| 43495 | 43496 | 43497 | 43498 | 43499 | 43500 | 43501 | 43503 | 43504 | 43505 | 43507 | 43509 |

TABLE 13A-continued

Seed Oil Yield/Content

| | | | | | | | | | | | |
|---|---|---|---|---|---|---|---|---|---|---|---|
| 43512 | 43515 | 43518 | 43522 | 43525 | 43531 | 43533 | 43534 | 43535 | 43537 | 43539 | 43540 |
| 43541 | 43543 | 43544 | 43546 | 43547 | 43550 | 43553 | 43554 | 43563 | 43566 | 43568 | 43571 |
| 43576 | 43580 | 43587 | 43588 | 43592 | 43594 | 43595 | 43597 | 43599 | 43600 | 43602 | 43605 |
| 43606 | 43608 | 43609 | 43612 | 43613 | 43616 | 43617 | 43622 | 43633 | 43643 | 43644 | 43645 |
| 43653 | 43657 | 43660 | 43666 | 43668 | 43677 | 43684 | 43685 | 43686 | 43688 | 43694 | 43698 |
| 43701 | 43717 | 43719 | 43721 | 43722 | 43724 | 43726 | 43727 | 43728 | 43729 | 43730 | 43731 |
| 43732 | 43737 | 43738 | 43740 | 43741 | 43742 | 43743 | 43747 | 43755 | 43757 | 43758 | 43761 |
| 43763 | 43767 | 43769 | 43770 | 43773 | 43776 | 43777 | 43779 | 43780 | 43784 | 43786 | 43787 |
| 43788 | 43790 | 43793 | 43795 | 43796 | 43797 | 43805 | 43806 | 43808 | 43810 | 43813 | 43818 |
| 43820 | 43823 | 43827 | 43838 | 43839 | 43840 | 43841 | 43842 | 43843 | 43846 | 43847 | 43849 |
| 43856 | 43867 | 43868 | 43877 | 43878 | 43879 | 43882 | 43894 | 43903 | 43905 | 43907 | 43908 |
| 43909 | 43915 | 43916 | 43927 | 43928 | 43931 | 43932 | 43936 | 43940 | 43949 | 43950 | 43959 |
| 43962 | 43965 | 43967 | 43973 | 43977 | 43984 | 43985 | 43987 | 43988 | 43994 | 43995 | 43999 |
| 44000 | 44004 | 44006 | 44009 | 44013 | 44027 | 44029 | 44036 | 44037 | 44044 | 44045 | 44052 |
| 44056 | 44057 | 44061 | 44062 | 44064 | 44065 | 44073 | 44085 | 44087 | 44089 | 44091 | 44092 |
| 44096 | 44097 | 44099 | 44104 | 44105 | 44106 | 44107 | 44109 | 44110 | 44111 | 44112 | 44115 |
| 44116 | 44117 | 44124 | 44128 | 44131 | 44138 | 44139 | 44141 | 44144 | 44147 | 44148 | 44150 |
| 44151 | 44152 | 44153 | 44154 | 44155 | 44157 | 44160 | 44163 | 44164 | 44167 | 44168 | |
| 44169 | 44173 | 44176 | 44177 | 44178 | 44181 | 44182 | 44183 | 44187 | 44188 | 44190 | 44191 |
| 44192 | 44193 | 44195 | 44198 | 44199 | 44200 | 44202 | 44206 | 44210 | 44211 | 44212 | 44213 |
| 44216 | 44218 | 44219 | 44220 | 44221 | 44222 | 44223 | 44224 | 44226 | 44227 | 44230 | 44232 |
| 44235 | 44240 | 44241 | 44242 | 44243 | 44250 | 44251 | 44252 | 44254 | 44255 | 44257 | 44260 |
| 44263 | 44264 | 44265 | 44266 | 44267 | 44270 | 44271 | 44273 | 44275 | 44279 | 44280 | 44281 |
| 44285 | 44286 | 44287 | 44288 | 44289 | 44290 | 44292 | 44297 | 44299 | 44301 | 44302 | 44303 |
| 44304 | 44305 | 44306 | 44311 | 44314 | 44318 | 44323 | 44324 | 44326 | 44330 | 44333 | 44334 |
| 44335 | 44337 | 44342 | 44343 | 44348 | 44349 | 44350 | 44351 | 44352 | 44355 | 44357 | 44358 |
| 44360 | 44361 | 44364 | 44369 | 44375 | 44376 | 44377 | 44378 | 44379 | 44388 | 44390 | 44393 |
| 44394 | 44395 | 44396 | 44400 | 44402 | 44403 | 44405 | 44406 | 44407 | 44409 | 44412 | 44413 |
| 44417 | 44418 | 44423 | 44424 | 44426 | 44430 | 44431 | 44432 | 44433 | 44435 | 44436 | 44437 |
| 44439 | 44440 | 44444 | 44445 | 44448 | 44449 | 44452 | 44453 | 44455 | 44456 | 44458 | 44459 |
| 44460 | 44461 | 44462 | 44464 | 44465 | 44466 | 44467 | 44471 | 44472 | 44474 | 44476 | 44478 |
| 44484 | 44487 | 44488 | 44489 | 44490 | 44492 | 44493 | 44496 | 44498 | 44504 | 44508 | 44509 |
| 44513 | 44514 | 44515 | 44516 | 44518 | 44522 | 44523 | 44525 | 44526 | 44527 | 44535 | 44536 |
| 44537 | 44539 | 44541 | 44543 | 44544 | 44545 | 44546 | 44547 | 44552 | 44553 | 44555 | 44558 |
| 44561 | 44562 | 44563 | 44565 | 44573 | 44574 | 44576 | 44579 | 44580 | 44581 | 44582 | 44586 |
| 44590 | 44597 | 44599 | 44604 | 44606 | 44607 | 44608 | 44611 | 44615 | 44618 | 44623 | 44626 |
| 44629 | 44631 | 44633 | 44635 | 44638 | 44639 | 44646 | 44648 | 44650 | 44655 | 44657 | 44660 |
| 44667 | 44672 | 44674 | 44675 | 44676 | 44677 | 44678 | 44679 | 44680 | 44685 | 44686 | 44690 |
| 44691 | 44693 | 44695 | 44697 | 44704 | 44706 | 44708 | 44712 | 44713 | 44718 | 44719 | 44721 |
| 44722 | 44724 | 44729 | 44731 | 44732 | 44733 | 44741 | 44744 | 44746 | 44749 | 44750 | 44751 |
| 44755 | 44757 | 44758 | 44759 | 44760 | 44761 | 44762 | 44764 | 44771 | 44773 | 44778 | 44780 |
| 44788 | 44789 | 44790 | 44793 | 44798 | 44801 | 44806 | 44807 | 44811 | 44812 | 44816 | 44817 |
| 44818 | 44820 | 44821 | 44829 | 44830 | 44831 | 44834 | 44835 | 44836 | 44839 | 44841 | 44843 |
| 44846 | 44847 | 44848 | 44849 | 44851 | 44853 | 44854 | 44855 | 44857 | 44858 | 44860 | 44867 |
| 44870 | 44872 | 44873 | 44878 | 44880 | 44881 | 44883 | 44887 | 44891 | 44892 | 44893 | 44896 |
| 44897 | 44898 | 44901 | 44902 | 44903 | 44906 | 44907 | 44919 | 44922 | 44923 | 44930 | 44931 |
| 44932 | 44936 | 44939 | 44941 | 44943 | 44944 | 44947 | 44950 | 44954 | 44958 | 44960 | |
| 44967 | 44968 | 44970 | 44971 | 44972 | 44978 | 44980 | 44981 | 44982 | 44983 | 44984 | 44985 |
| 44988 | 44989 | 44991 | 44994 | 44999 | 45000 | 45001 | 45002 | 45007 | 45010 | 45011 | 45015 |
| 45016 | 45018 | 45019 | 45020 | 45021 | 45022 | 45025 | 45026 | 45027 | 45035 | 45036 | 45037 |
| 45041 | 45048 | 45050 | 45051 | 45053 | 45055 | 45058 | 45060 | 45061 | 45062 | 45063 | 45064 |
| 45066 | 45067 | 45068 | 45071 | 45074 | 45076 | 45082 | 45083 | 45085 | 45086 | 45087 | 45089 |
| 45090 | 45097 | 45098 | 45103 | 45104 | 45107 | 45108 | 45112 | 45113 | 45115 | 45117 | 45119 |
| 45121 | 45123 | 45128 | 45130 | 45132 | 45133 | 45134 | 45136 | 45146 | 45147 | 45149 | 45151 |
| 45153 | 45155 | 45157 | 45158 | 45166 | 45168 | 45170 | 45172 | 45176 | 45179 | 45190 | 45194 |
| 45199 | 45200 | 45208 | 45214 | 45219 | 45222 | 45233 | 45238 | 45239 | 45240 | 45244 | 45247 |
| 45249 | 45255 | 45256 | 45257 | 45258 | 45259 | 45261 | 45263 | 45269 | 45272 | 45273 | 45275 |
| 45277 | 45283 | 45284 | 45294 | 45295 | 45307 | 45311 | 45315 | 45318 | 45324 | 45326 | 45329 |
| 45333 | 45338 | 45342 | 45344 | 45348 | 45349 | 45351 | 45353 | 45357 | 45359 | 45361 | 45363 |
| 45364 | 45365 | 45368 | 45369 | 45370 | 45373 | 45374 | 45376 | 45378 | 45379 | 45381 | |
| 45382 | 45384 | 45387 | 45388 | 45389 | 45391 | 45392 | 45393 | 45394 | 45396 | 45397 | 45398 |
| 45399 | 45400 | 45401 | 45403 | 45404 | 45405 | 45407 | 45409 | 45410 | 45413 | 45416 | 45417 |
| 45418 | 45419 | 45420 | 45421 | 45422 | 45423 | 45424 | 45425 | 45426 | 45427 | 45428 | 45429 |
| 45432 | 45435 | 45436 | 45441 | 45444 | 45445 | 45446 | 45447 | 45450 | 45453 | 45455 | 45456 |
| 45461 | 45463 | 45465 | 45466 | 45468 | 45470 | 45471 | 45478 | 45481 | 45482 | 45487 | 45488 |
| 45490 | 45496 | 45500 | 45503 | 45504 | 45506 | 45507 | 45509 | 45511 | 45512 | 45515 | 45520 |
| 45522 | 45528 | 45531 | 45532 | 45534 | 45542 | 45547 | 45551 | 45559 | 45560 | 45570 | 45578 |
| 45580 | 45582 | 45583 | 45587 | 45595 | 45598 | 45616 | 45617 | 45624 | 45626 | 45628 | 45647 |
| 45650 | 45655 | 45659 | 45660 | 45662 | 45674 | 45675 | 45678 | 45679 | 45680 | 45681 | 45685 |
| 45686 | 45688 | 45693 | 45698 | 45699 | 45700 | 45701 | 45702 | 45704 | 45707 | 45708 | 45719 |
| 45720 | 45721 | 45722 | 45723 | 45725 | 45733 | 45734 | 45735 | 45740 | 45748 | 45753 | 45758 |
| 45759 | 45762 | 45765 | 45775 | 45781 | 45788 | 45789 | 45794 | 45802 | 45803 | 45811 | |
| 45812 | 45813 | 45814 | 45819 | 45821 | 45825 | 45833 | 45834 | 45850 | 45852 | 45857 | 45867 |
| 45873 | 45887 | 45892 | 45893 | 45897 | 45899 | 45900 | 45901 | 45902 | 45906 | 45907 | 45908 |
| 45909 | 45912 | 45918 | 45919 | 45925 | 45927 | 45932 | 45935 | 45940 | 45947 | 45948 | 45950 |
| 45956 | 45960 | 45962 | 45964 | 45966 | 45973 | 45977 | 45978 | 45982 | 45996 | 46000 | 46008 |
| 46012 | 46013 | 46014 | 46018 | 46019 | 46022 | 46032 | 46034 | 46053 | 46055 | 46057 | 46063 |

TABLE 13A-continued

Seed Oil Yield/Content

| | | | | | | | | | | | |
|---|---|---|---|---|---|---|---|---|---|---|---|
| 46065 | 46066 | 46073 | 46076 | 46078 | 46085 | 46089 | 46093 | 46104 | 46105 | 46106 | 46112 |
| 46115 | 46117 | 46118 | 46123 | 46125 | 46126 | 46127 | 46128 | 46129 | 46133 | 46134 | 46142 |
| 46145 | 46146 | 46151 | 46159 | 46179 | 46182 | 46186 | 46190 | 46196 | 46197 | 46209 | 46216 |
| 46220 | 46223 | 46225 | 46229 | 46231 | 46232 | 46236 | 46239 | 46252 | 46258 | 46259 | 46269 |
| 46270 | 46272 | 46280 | 46281 | 46285 | 46289 | 46295 | 46296 | 46297 | 46304 | 46317 | 46318 |
| 46319 | 46320 | 46322 | 46323 | 46329 | 46335 | 46340 | 46342 | 46353 | 46357 | 46362 | 46372 |
| 46387 | 46396 | 46404 | 46424 | 46425 | 46434 | 46435 | 46438 | 46440 | 46441 | 46443 | 46446 |
| 46452 | 46457 | 46460 | 46467 | 46469 | 46479 | 46483 | 46486 | 46488 | 46489 | 46504 | 46506 |
| 46509 | 46510 | 46511 | 46517 | 46518 | 46521 | 46524 | 46525 | 46526 | 46527 | 46530 | 46533 |
| 46537 | 46538 | 46539 | 46540 | 46541 | 46542 | 46546 | 46548 | 46549 | 46551 | 46552 | 46557 |
| 46559 | 46560 | 46566 | 46577 | 46579 | 46582 | 46583 | 46591 | 46592 | 46603 | 46604 | 46605 |
| 46607 | 46609 | 46615 | 46618 | 46621 | 46627 | 46632 | 46633 | 46634 | 46636 | 46639 | 46646 |
| 46649 | 46652 | 46654 | 46659 | 46661 | 46662 | 46663 | 46665 | 46667 | 46668 | 46671 | 46678 |
| 46680 | 46681 | 46687 | 46695 | 46700 | 46701 | 46702 | 46703 | 46706 | 46709 | 46710 | 46711 |
| 46713 | 46717 | 46718 | 46721 | 46722 | 46723 | 46726 | 46729 | 46739 | 46740 | 46744 | 46745 |
| 46746 | 46748 | 46750 | 46751 | 46754 | 46755 | 46757 | 46758 | 46760 | 46762 | 46767 | 46768 |
| 46771 | 46773 | 46774 | 46775 | 46778 | 46782 | 46783 | 46784 | 46786 | 46790 | 46793 | 46794 |
| 46796 | 46797 | 46799 | 46809 | 46810 | 46812 | 46813 | 46814 | 46820 | 46826 | 46827 | 46830 |
| 46831 | 46832 | 46833 | 46834 | 46835 | 46841 | 46843 | 46845 | 46848 | 46849 | 46851 | 46856 |
| 46857 | 46859 | 46861 | 46863 | 46864 | 46866 | 46868 | 46869 | 46870 | 46871 | 46872 | 46878 |
| 46879 | 46880 | 46883 | 46884 | 46885 | 46889 | 46890 | 46891 | 46895 | 46899 | 46900 | 46901 |
| 46904 | 46913 | 46914 | 46920 | 46922 | 46924 | 46927 | 46928 | 46929 | 46931 | 46934 | 46936 |
| 46938 | 46939 | 46940 | 46944 | 46945 | 46946 | 46947 | 46948 | 46950 | 46952 | 46954 | 46955 |
| 46956 | 46957 | 46958 | 46959 | 46960 | 46961 | 46963 | 46964 | 46969 | 46972 | 46973 | 46974 |
| 46976 | 46977 | 46978 | 46986 | 46987 | 46988 | 46989 | 46990 | 46991 | 46992 | 46997 | 46998 |
| 46999 | 47000 | 47005 | 47006 | 47008 | 47009 | 47011 | 47012 | 47013 | 47014 | 47015 | 47016 |
| 47020 | 47022 | 47024 | 47034 | 47035 | 47036 | 47037 | 47039 | 47041 | 47043 | 47045 | 47049 |
| 47050 | 47054 | 47056 | 47057 | 47058 | 47061 | 47063 | 47065 | 47069 | 47072 | 47075 | 47076 |
| 47077 | 47079 | 47080 | 47083 | 47086 | 47087 | 47088 | 47091 | 47095 | 47096 | 47099 | 47100 |
| 47108 | 47110 | 47113 | 47115 | 47120 | 47121 | 47129 | 47133 | 47134 | 47138 | 47142 | 47143 |
| 47144 | 47146 | 47149 | 47151 | 47153 | 47154 | 47155 | 47161 | 47163 | 47164 | 47165 | 47166 |
| 47167 | 47169 | 47171 | 47172 | 47177 | 47179 | 47182 | 47184 | 47185 | 47189 | 47192 | 47196 |
| 47197 | 47198 | 47200 | 47201 | 47203 | 47207 | 47211 | 47212 | 47213 | 47214 | 47216 | 47217 |
| 47218 | 47222 | 47223 | 47224 | 47225 | 47229 | 47233 | 47234 | 47238 | 47239 | 47244 | 47246 |
| 47249 | 47258 | 47259 | 47260 | 47261 | 47263 | 47264 | 47265 | 47266 | 47268 | 47269 | 47270 |
| 47271 | 47273 | 47274 | 47275 | 47282 | 47285 | 47288 | 47289 | 47291 | 47292 | 47295 |
| 47296 | 47297 | 47299 | 47300 | 47303 | 47306 | 47308 | 47313 | 47314 | 47317 | 47318 | 47319 |
| 47322 | 47324 | 47325 | 47326 | 47327 | 47331 | 47333 | 47337 | 47338 | 47339 | 47340 | 47342 |
| 47343 | 47344 | 47345 | 47346 | 47350 | 47353 | 47354 | 47357 | 47358 | 47359 | 47360 | 47366 |
| 47371 | | | | | | | | | | | |

TABLE 14

Seed Protein Yield/Content

Table 14A SEQ ID NOs of Polypeptides useful for improving Seed Protein Yield/Content

| | | | | | | | | | | | |
|---|---|---|---|---|---|---|---|---|---|---|---|
| 8 | 20 | 52 | 55 | 63 | 66 | 67 | 79 | 80 | 85 | 87 | 88 |
| 91 | 98 | 100 | 102 | 126 | 129 | 140 | 141 | 142 | 143 | 157 | 168 |
| 176 | 189 | 191 | 193 | 221 | 227 | 239 | 242 | 245 | 264 | 273 | 282 |
| 298 | 304 | 308 | 309 | 312 | 315 | 320 | 330 | 334 | 337 | 342 | 347 |
| 348 | 351 | 357 | 361 | 365 | 367 | 373 | 383 | 397 | 406 | 414 | 419 |
| 430 | 445 | 452 | 463 | 475 | 476 | 480 | 488 | 500 | 503 | 509 | 516 |
| 519 | 542 | 545 | 555 | 556 | 558 | 559 | 566 | 578 | 584 | 592 | 611 |
| 621 | 623 | 631 | 633 | 645 | 647 | 657 | 675 | 677 | 686 | 690 | 695 |
| 700 | 714 | 716 | 729 | 732 | 734 | 745 | 753 | 758 | 777 | 819 | 826 |
| 838 | 853 | 861 | 898 | 905 | 935 | 936 | 943 | 948 | 955 | 956 | 957 |
| 978 | 981 | 985 | 998 | 999 | 1000 | 1001 | 1012 | 1017 | 1028 | 1029 | 1041 |
| 1045 | 1048 | 1050 | 1054 | 1060 | 1084 | 1090 | 1101 | 1137 | 1145 | 1146 | 1157 |
| 1161 | 1169 | 1170 | 1171 | 1172 | 1195 | 1205 | 1208 | 1216 | 1217 | 1253 | 1265 |
| 1267 | 1275 | 1276 | 1277 | 1278 | 1291 | 1299 | 1300 | 1311 | 1333 | 1358 | 1393 |
| 1411 | 1417 | 1418 | 1419 | 1421 | 1423 | 1427 | 1441 | 1443 | 1444 | 1447 | 1450 |
| 1458 | 1459 | 1465 | 1469 | 1482 | 1495 | 1497 | 1504 | 1506 | 1508 | 1513 | 1538 |
| 1543 | 1549 | 1565 | 1571 | 1573 | 1574 | 1599 | 1601 | 1616 | 1623 | 1636 | 1639 |
| 1643 | 1645 | 1665 | 1679 | 1680 | 1681 | 1685 | 1689 | 1691 | 1698 | 1699 | 1701 |
| 1704 | 1706 | 1707 | 1721 | 1725 | 1730 | 1732 | 1739 | 1741 | 1742 | 1751 | 1753 |
| 1754 | 1756 | 1759 | 1769 | 1772 | 1783 | 1785 | 1805 | 1815 | 1816 | 1826 | 1827 |
| 1841 | 1846 | 1867 | 1872 | 1876 | 1880 | 1892 | 1893 | 1895 | 1898 | 1899 | 1910 |
| 1916 | 1926 | 1929 | 1931 | 1936 | 1946 | 1947 | 1953 | 1960 | 1962 | 1987 | 1994 |
| 2006 | 2008 | 2014 | 2019 | 2028 | 2051 | 2057 | 2059 | 2067 | 2071 | 2079 | 2082 |
| 2083 | 2086 | 2089 | 2095 | 2117 | 2126 | 2131 | 2140 | 2146 | 2152 | 2165 | 2182 |
| 2184 | 2203 | 2207 | 2226 | 2230 | 2233 | 2243 | 2244 | 2249 | 2262 | 2265 | 2269 |
| 2279 | 2286 | 2294 | 2301 | 2306 | 2308 | 2314 | 2316 | 2320 | 2322 | 2333 | 2340 |
| 2345 | 2352 | 2358 | 2369 | 2373 | 2374 | 2384 | 2387 | 2392 | 2402 | 2406 | 2414 |

TABLE 14-continued

Seed Protein Yield/Content

| | | | | | | | | | | | |
|---|---|---|---|---|---|---|---|---|---|---|---|
| 2422 | 2441 | 2455 | 2457 | 2461 | 2464 | 2476 | 2480 | 2481 | 2482 | 2483 | 2503 |
| 2504 | 2517 | 2518 | 2531 | 2536 | 2538 | 2553 | 2554 | 2566 | 2569 | 2570 | 2575 |
| 2580 | 2589 | 2597 | 2602 | 2605 | 2608 | 2619 | 2622 | 2632 | 2636 | 2638 | 2653 |
| 2683 | 2702 | 2747 | 2750 | 2757 | 2762 | 2769 | 2770 | 2785 | 2791 | 2798 | 2806 |
| 2811 | 2853 | 2857 | 2858 | 2859 | 2862 | 2865 | 2866 | 2876 | 2878 | 2898 | 2902 |
| 2953 | 2958 | 2965 | 2978 | 3015 | 3017 | 3026 | 3035 | 3036 | 3037 | 3038 | 3039 |
| 3040 | 3045 | 3050 | 3052 | 3070 | 3074 | 3088 | 3096 | 3100 | 3105 | 3110 | 3113 |
| 3120 | 3121 | 3122 | 3124 | 3125 | 3126 | 3129 | 3150 | 3154 | 3156 | 3157 | 3166 |
| 3173 | 3175 | 3182 | 3185 | 3186 | 3188 | 3199 | 3216 | 3217 | 3219 | 3226 | 3231 |
| 3235 | 3238 | 3240 | 3244 | 3250 | 3257 | 3266 | 3273 | 3277 | 3284 | 3288 | 3290 |
| 3298 | 3307 | 3309 | 3311 | 3315 | 3324 | 3327 | 3330 | 3339 | 3344 | 3350 | 3353 |
| 3355 | 3360 | 3365 | 3379 | 3381 | 3386 | 3389 | 3392 | 3393 | 3394 | 3404 | 3410 |
| 3421 | 3422 | 3426 | 3427 | 3428 | 3430 | 3431 | 3436 | 3440 | 3445 | 3451 | 3453 |
| 3455 | 3461 | 3466 | 3471 | 3488 | 3489 | 3495 | 3514 | 3520 | 3527 | 3528 | |
| 3529 | 3542 | 3543 | 3558 | 3560 | 3563 | 3583 | 3597 | 3599 | 3611 | 3616 | 3618 |
| 3619 | 3625 | 3627 | 3630 | 3634 | 3635 | 3640 | 3654 | 3655 | 3658 | 3661 | 3694 |
| 3697 | 3699 | 3700 | 3702 | 3703 | 3714 | 3715 | 3722 | 3733 | 3735 | 3766 | 3770 |
| 3776 | 3783 | 3785 | 3788 | 3793 | 3798 | 3803 | 3808 | 3819 | 3836 | 3843 | 3850 |
| 3865 | 3867 | 3868 | 3872 | 3877 | 3878 | 3879 | 3885 | 3886 | 3907 | 3911 | 3912 |
| 3913 | 3915 | 3920 | 3924 | 3934 | 3938 | 3943 | 3954 | 3956 | 3957 | 3966 | 3970 |
| 3979 | 3982 | 3983 | 3990 | 3993 | 3998 | 4001 | 4002 | 4013 | 4015 | 4016 | 4018 |
| 4023 | 4030 | 4032 | 4041 | 4043 | 4044 | 4052 | 4057 | 4074 | 4075 | 4078 | 4080 |
| 4081 | 4083 | 4097 | 4098 | 4100 | 4106 | 4118 | 4121 | 4123 | 4127 | 4130 | 4140 |
| 4154 | 4161 | 4162 | 4168 | 4169 | 4176 | 4192 | 4200 | 4201 | 4209 | 4213 | 4217 |
| 4225 | 4233 | 4240 | 4250 | 4257 | 4270 | 4275 | 4297 | 4319 | 4322 | 4337 | 4350 |
| 4361 | 4368 | 4369 | 4370 | 4391 | 4397 | 4399 | 4413 | 4416 | 4421 | 4422 | 4432 |
| 4444 | 4447 | 4450 | 4459 | 4494 | 4508 | 4520 | 4521 | 4542 | 4544 | 4548 | 4600 |
| 4619 | 4663 | 4664 | 4670 | 4671 | 4675 | 4677 | 4687 | 4708 | 4726 | 4740 | 4751 |
| 4754 | 4761 | 4772 | 4792 | 4804 | 4807 | 4828 | 4833 | 4837 | 4845 | 4853 | 4854 |
| 4858 | 4860 | 4874 | 4881 | 4885 | 4895 | 4896 | 4897 | 4901 | 4904 | 4909 | 4910 |
| 4915 | 4955 | 4975 | 4976 | 4985 | 4989 | 5007 | 5008 | 5012 | 5015 | 5033 | 5035 |
| 5040 | 5045 | 5050 | 5062 | 5065 | 5067 | 5069 | 5070 | 5071 | 5072 | 5073 | 5074 |
| 5088 | 5093 | 5098 | 5103 | 5105 | 5116 | 5117 | 5118 | 5126 | 5134 | 5140 | 5153 |
| 5154 | 5155 | 5157 | 5165 | 5176 | 5177 | 5185 | 5198 | 5202 | 5204 | 5208 | 5213 |
| 5217 | 5225 | 5228 | 5230 | 5238 | 5239 | 5240 | 5241 | 5244 | 5245 | 5247 | 5248 |
| 5249 | 5250 | 5251 | 5252 | 5275 | 5277 | 5286 | 5296 | 5297 | 5300 | 5302 | 5306 |
| 5313 | 5314 | 5316 | 5317 | 5318 | 5321 | 5327 | 5332 | 5333 | 5335 | 5340 | 5343 |
| 5344 | 5346 | 5348 | 5349 | 5350 | 5351 | 5352 | 5353 | 5354 | 5355 | 5358 | 5361 |
| 5371 | 5373 | 5374 | 5376 | 5377 | 5382 | 5390 | 5397 | 5398 | 5408 | 5411 | 5419 |
| 5423 | 5426 | 5428 | 5436 | 5442 | 5446 | 5450 | 5451 | 5452 | 5458 | 5472 | 5473 |
| 5481 | 5486 | 5487 | 5510 | 5515 | 5518 | 5527 | 5535 | 5541 | 5542 | 5545 | 5546 |
| 5550 | 5551 | 5578 | 5583 | 5586 | 5587 | 5590 | 5595 | 5611 | 5621 | 5625 | 5626 |
| 5627 | 5638 | 5652 | 5657 | 5658 | 5659 | 5660 | 5665 | 5688 | 5695 | 5698 | 5699 |
| 5700 | 5709 | 5714 | 5716 | 5717 | 5725 | 5738 | 5749 | 5753 | 5756 | 5775 | 5777 |
| 5784 | 5785 | 5787 | 5789 | 5795 | 5799 | 5808 | 5809 | 5814 | 5823 | 5827 | 5829 |
| 5830 | 5834 | 5836 | 5850 | 5855 | 5857 | 5864 | 5865 | 5866 | 5871 | 5872 | 5873 |
| 5879 | 5903 | 5911 | 5912 | 5919 | 5947 | 5951 | 5965 | 5968 | 5978 | 5980 | 5991 |
| 5998 | 6000 | 6001 | 6007 | 6008 | 6011 | 6013 | 6016 | 6029 | 6036 | 6038 | 6041 |
| 6044 | 6045 | 6046 | 6068 | 6072 | 6073 | 6084 | 6085 | 6088 | 6089 | 6090 | 6095 |
| 6096 | 6098 | 6103 | 6115 | 6116 | 6122 | 6124 | 6126 | 6129 | 6130 | 6137 | 6138 |
| 6140 | 6142 | 6144 | 6148 | 6149 | 6160 | 6163 | 6168 | 6169 | 6196 | 6197 | 6198 |
| 6220 | 6221 | 6222 | 6223 | 6235 | 6253 | 6254 | 6256 | 6257 | 6258 | 6259 | 6260 |
| 6262 | 6263 | 6279 | 6280 | 6281 | 6283 | 6285 | 6286 | 6287 | 6299 | 6300 | 6310 |
| 6314 | 6319 | 6320 | 6329 | 6333 | 6334 | 6335 | 6336 | 6337 | 6341 | 6342 | 6343 |
| 6358 | 6359 | 6363 | 6368 | 6374 | 6376 | 6381 | 6384 | 6385 | 6386 | 6398 | 6399 |
| 6402 | 6403 | 6404 | 6405 | 6406 | 6412 | 6416 | 6417 | 6421 | 6427 | 6428 | 6430 |
| 6436 | 6442 | 6443 | 6446 | 6451 | 6452 | 6455 | 6456 | 6459 | 6463 | 6464 | 6476 |
| 6486 | 6490 | 6491 | 6506 | 6509 | 6510 | 6512 | 6514 | 6515 | 6517 | 6520 | 6521 |
| 6524 | 6526 | 6531 | 6532 | 6533 | 6534 | 6535 | 6536 | 6537 | 6538 | 6539 | 6543 |
| 6546 | 6548 | 6549 | 6560 | 6561 | 6580 | 6593 | 6595 | 6606 | 6609 | 6610 | 6611 |
| 6615 | 6619 | 6622 | 6623 | 6629 | 6634 | 6643 | 6645 | 6663 | 6664 | 6666 | 6670 |
| 6672 | 6673 | 6674 | 6675 | 6680 | 6681 | 6685 | 6701 | 6702 | 6703 | 6706 | 6716 |
| 6728 | 6734 | 6739 | 6741 | 6747 | 6771 | 6773 | 6776 | 6777 | 6778 | 6780 | 6795 |
| 6797 | 6798 | 6799 | 6802 | 6806 | 6807 | 6810 | 6826 | 6828 | 6836 | 6842 | 6849 |
| 6850 | 6851 | 6854 | 6855 | 6862 | 6869 | 6870 | 6879 | 6880 | 6885 | 6886 | 6890 |
| 6913 | 6927 | 6939 | 6945 | 6959 | 6960 | 6962 | 6970 | 6977 | 6981 | 6982 | 6985 |
| 6991 | 6992 | 7000 | 7002 | 7003 | 7004 | 7006 | 7009 | 7011 | 7024 | 7026 | 7053 |
| 7075 | 7078 | 7092 | 7105 | 7111 | 7115 | 7122 | 7123 | 7124 | 7146 | 7152 | 7154 |
| 7169 | 7172 | 7177 | 7179 | 7190 | 7203 | 7206 | 7210 | 7219 | 7253 | 7266 | 7279 |
| 7280 | 7300 | 7302 | 7357 | 7376 | 7422 | 7423 | 7429 | 7430 | 7434 | 7436 | 7446 |
| 7467 | 7485 | 7499 | 7510 | 7513 | 7520 | 7522 | 7532 | 7552 | 7563 | 7566 | 7587 |
| 7592 | 7597 | 7604 | 7612 | 7613 | 7617 | 7619 | 7634 | 7639 | 7643 | 7653 | 7654 |
| 7655 | 7659 | 7662 | 7667 | 7668 | 7673 | 7713 | 7740 | 7793 | 7798 | 7799 | 7813 |
| 7829 | 7831 | 7834 | 7836 | 7847 | 7855 | 7858 | 7862 | 7866 | 7867 | 7874 | 7894 |
| 7899 | 7908 | 7929 | 7932 | 7951 | 7959 | 7981 | 7986 | 7988 | 7992 | 8000 | 8016 |
| 8025 | 8039 | 8070 | 8074 | 8082 | 8091 | 8096 | 8106 | 8120 | 8138 | 8151 | 8152 |
| 8156 | 8177 | 8195 | 8205 | 8209 | 8219 | 8224 | 8225 | 8230 | 8240 | 8258 | 8259 |

TABLE 14-continued

Seed Protein Yield/Content

| | | | | | | | | | | | |
|---|---|---|---|---|---|---|---|---|---|---|---|
| 8289 | 8292 | 8308 | 8310 | 8311 | 8318 | 8334 | 8343 | 8346 | 8366 | 8375 | 8376 |
| 8381 | 8400 | 8418 | 8422 | 8434 | 8435 | 8445 | 8448 | 8453 | 8455 | 8462 | 8478 |
| 8491 | 8501 | 8503 | 8505 | 8506 | 8510 | 8511 | 8527 | 8535 | 8536 | 8537 | 8564 |
| 8575 | 8577 | 8578 | 8580 | 8585 | 8587 | 8592 | 8600 | 8615 | 8624 | 8640 | 8658 |
| 8660 | 8663 | 8665 | 8677 | 8695 | 8698 | 8699 | 8704 | 8705 | 8707 | 8716 | 8746 |
| 8747 | 8756 | 8791 | 8792 | 8805 | 8813 | 8815 | 8816 | 8837 | 8879 | 8897 | 8902 |
| 8907 | 8915 | 8922 | 8932 | 8946 | 8963 | 8972 | 8988 | 8997 | 9004 | 9006 | 9018 |
| 9030 | 9047 | 9064 | 9066 | 9083 | 9092 | 9093 | 9094 | 9103 | 9112 | 9124 | 9135 |
| 9140 | 9160 | 9161 | 9165 | 9166 | 9174 | 9189 | 9190 | 9191 | 9196 | 9203 | 9204 |
| 9205 | 9218 | 9230 | 9234 | 9248 | 9258 | 9268 | 9270 | 9282 | 9283 | 9286 | 9289 |
| 9290 | 9316 | 9323 | 9324 | 9328 | 9336 | 9343 | 9347 | 9350 | 9353 | 9357 | 9361 |
| 9374 | 9384 | 9416 | 9417 | 9427 | 9436 | 9438 | 9440 | 9445 | 9451 | 9459 | 9468 |
| 9489 | 9490 | 9493 | 9506 | 9507 | 9508 | 9512 | 9513 | 9522 | 9524 | 9525 | 9528 |
| 9529 | 9539 | 9546 | 9550 | 9551 | 9553 | 9580 | 9593 | 9616 | 9630 | 9645 | 9646 |
| 9654 | 9656 | 9684 | 9696 | 9700 | 9710 | 9717 | 9734 | 9744 | 9753 | 9761 | 9766 |
| 9773 | 9785 | 9794 | 9802 | 9803 | 9804 | 9805 | 9806 | 9822 | 9827 | 9832 | 9858 |
| 9881 | 9886 | 9925 | 9928 | 9942 | 9961 | 9966 | 9975 | 9981 | 9982 | 9983 | 10001 |
| 10024 | 10026 | 10027 | 10058 | 10088 | 10109 | 10110 | 10136 | 10150 | 10157 | 10159 | 10167 |
| 10169 | 10171 | 10172 | 10183 | 10187 | 10190 | 10238 | 10239 | 10240 | 10244 | 10252 | 10268 |
| 10293 | 10297 | 10306 | 10319 | 10333 | 10334 | 10341 | 10352 | 10366 | 10368 | 10372 | 10381 |
| 10382 | 10385 | 10398 | 10402 | 10404 | 10407 | 10413 | 10418 | 10426 | 10429 | 10440 | 10443 |
| 10446 | 10448 | 10467 | 10480 | 10511 | 10514 | 10521 | 10525 | 10545 | 10547 | 10563 | 10602 |
| 10604 | 10608 | 10610 | 10617 | 10623 | 10625 | 10632 | 10646 | 10666 | 10667 | 10669 | 10670 |
| 10676 | 10677 | 10687 | 10743 | 10745 | 10793 | 10797 | 10800 | 10802 | 10817 | 10825 | 10827 |
| 10845 | 10847 | 10854 | 10864 | 10866 | 10867 | 10871 | 10882 | 10894 | 10899 | 10905 | 10916 |
| 10922 | 10923 | 10924 | 10929 | 10930 | 10931 | 10938 | 10942 | 10953 | 10961 | 10966 | 10975 |
| 10979 | 10985 | 10992 | 11005 | 11008 | 11011 | 11013 | 11014 | 11025 | 11026 | 11027 | 11032 |
| 11038 | 11041 | 11047 | 11048 | 11093 | 11118 | 11119 | 11136 | 11143 | 11145 | 11146 | 11150 |
| 11154 | 11163 | 11167 | 11178 | 11185 | 11200 | 11213 | 11215 | 11222 | 11229 | 11277 | 11282 |
| 11313 | 11339 | 11340 | 11346 | 11347 | 11363 | 11364 | 11371 | 11378 | 11391 | 11393 | 11414 |
| 11438 | 11447 | 11449 | 11483 | 11498 | 11499 | 11502 | 11512 | 11536 | 11539 | 11548 |
| 11566 | 11577 | 11586 | 11587 | 11590 | 11593 | 11594 | 11597 | 11600 | 11602 | 11612 | 11623 |
| 11625 | 11629 | 11659 | 11663 | 11664 | 11669 | 11681 | 11682 | 11683 | 11691 | 11704 | 11710 |
| 11712 | 11714 | 11715 | 11725 | 11731 | 11732 | 11739 | 11748 | 11763 | 11772 | 11775 | 11783 |
| 11790 | 11795 | 11796 | 11818 | 11834 | 11839 | 11851 | 11854 | 11857 | 11885 | 11887 | 11890 |
| 11897 | 11920 | 11951 | 11973 | 11978 | 11982 | 11984 | 11986 | 11988 | 12006 | 12014 | 12023 |
| 12028 | 12029 | 12042 | 12057 | 12061 | 12062 | 12065 | 12073 | 12075 | 12081 | 12086 | 12149 |
| 12158 | 12177 | 12195 | 12196 | 12198 | 12201 | 12203 | 12234 | 12236 | 12272 | 12275 | 12282 |
| 12284 | 12291 | 12314 | 12316 | 12326 | 12332 | 12333 | 12347 | 12348 | 12349 | 12353 | 12358 |
| 12368 | 12373 | 12374 | 12376 | 12383 | 12386 | 12390 | 12393 | 12401 | 12408 | 12410 | 12422 |
| 12425 | 12427 | 12430 | 12436 | 12445 | 12446 | 12450 | 12451 | 12453 | 12454 | 12468 | 12471 |
| 12477 | 12483 | 12486 | 12488 | 12496 | 12500 | 12503 | 12509 | 12525 | 12530 | 12537 | 12539 |
| 12546 | 12556 | 12562 | 12563 | 12566 | 12572 | 12598 | 12600 | 12601 | 12602 | 12612 | 12613 |
| 12621 | 12623 | 12624 | 12635 | 12638 | 12643 | 12644 | 12650 | 12652 | 12653 | 12659 | 12666 |
| 12668 | 12672 | 12675 | 12678 | 12688 | 12689 | 12693 | 12700 | 12708 | 12713 | 12715 | 12717 |
| 12730 | 12742 | 12744 | 12750 | 12751 | 12757 | 12762 | 12778 | 12792 | 12793 | 12800 | 12802 |
| 12806 | 12808 | 12810 | 12827 | 12828 | 12829 | 12834 | 12838 | 12840 | 12846 | 12857 | 12869 |
| 12870 | 12883 | 12894 | 12902 | 12912 | 12916 | 12936 | 12938 | 12941 | 12947 | 12975 | 12976 |
| 12986 | 12990 | 12995 | 13004 | 13018 | 13020 | 13022 | 13028 | 13033 | 13040 | 13057 | 13059 |
| 13068 | 13070 | 13072 | 13075 | 13080 | 13090 | 13091 | 13092 | 13098 | 13102 | 13106 | 13108 |
| 13109 | 13124 | 13127 | 13128 | 13136 | 13139 | 13146 | 13152 | 13164 | 13167 | 13179 | 13180 |
| 13188 | 13190 | 13193 | 13195 | 13197 | 13199 | 13200 | 13203 | 13204 | 13212 | 13221 | 13225 |
| 13230 | 13233 | 13235 | 13239 | 13240 | 13242 | 13244 | 13247 | 13258 | 13259 | 13262 | 13276 |
| 13277 | 13286 | 13294 | 13295 | 13303 | 13304 | 13306 | 13307 | 13310 | 13319 | 13324 | 13325 |
| 13327 | 13328 | 13335 | 13338 | 13339 | 13340 | 13350 | 13351 | 13354 | 13357 | 13360 | 13365 |
| 13366 | 13371 | 13375 | 13387 | 13392 | 13393 | 13395 | 13397 | 13400 | 13406 | 13418 | 13421 |
| 13423 | 13429 | 13430 | 13432 | 13434 | 13435 | 13436 | 13441 | 13447 | 13465 | 13469 | 13470 |
| 13481 | 13488 | 13491 | 13497 | 13526 | 13540 | 13543 | 13546 | 13554 | 13558 | 13566 | 13573 |
| 13575 | 13578 | 13584 | 13601 | 13614 | 13621 | 13627 | 13652 | 13653 | 13659 | 13662 | 13666 |
| 13671 | 13688 | 13694 | 13703 | 13709 | 13711 | 13712 | 13722 | 13724 | 13738 | 13739 | 13744 |
| 13749 | 13750 | 13770 | 13781 | 13788 | 13795 | 13810 | 13811 | 13821 | 13872 | 13880 | 13888 |
| 13897 | 13899 | 13906 | 13913 | 13916 | 13946 | 13956 | 13962 | 13971 | 13972 | 13974 | 13980 |
| 13991 | 13994 | 13999 | 14009 | 14028 | 14029 | 14031 | 14037 | 14045 | 14046 | 14047 | 14054 |
| 14055 | 14063 | 14065 | 14066 | 14067 | 14091 | 14092 | 14127 | 14131 | 14145 | 14163 |
| 14183 | 14194 | 14200 | 14214 | 14223 | 14228 | 14241 | 14242 | 14246 | 14265 | 14270 | 14283 |
| 14293 | 14295 | 14301 | 14313 | 14323 | 14339 | 14341 | 14343 | 14350 | 14354 | 14358 | 14385 |
| 14386 | 14413 | 14415 | 14426 | 14431 | 14438 | 14449 | 14456 | 14458 | 14467 | 14472 | 14474 |
| 14481 | 14482 | 14492 | 14494 | 14501 | 14508 | 14513 | 14519 | 14522 | 14529 | 14533 | 14534 |
| 14536 | 14540 | 14542 | 14543 | 14547 | 14579 | 14581 | 14615 | 14629 | 14638 | 14644 | 14664 |
| 14669 | 14676 | 14696 | 14710 | 14720 | 14721 | 14747 | 14748 | 14769 | 14785 | 14786 | 14795 |
| 14797 | 14798 | 14799 | 14801 | 14810 | 14811 | 14816 | 14846 | 14847 | 14856 | 14857 | 14866 |
| 14867 | 14877 | 14884 | 14894 | 14905 | 14912 | 14913 | 14914 | 14918 | 14946 | 14949 | 14958 |
| 14962 | 14967 | 14970 | 14972 | 14973 | 14980 | 14983 | 14984 | 14986 | 15003 | 15037 | 15042 |
| 15045 | 15047 | 15052 | 15058 | 15060 | 15062 | 15069 | 15079 | 15081 | 15087 | 15092 | 15101 |
| 15103 | 15109 | 15115 | 15142 | 15149 | 15156 | 15177 | 15199 | 15200 | 15225 | 15247 | 15292 |
| 15294 | 15295 | 15301 | 15302 | 15310 | 15339 | 15345 | 15364 | 15365 | 15367 | 15386 | 15387 |
| 15389 | 15405 | 15409 | 15418 | 15428 | 15431 | 15433 | 15439 | 15440 | 15445 | 15446 | 15447 |

TABLE 14-continued

Seed Protein Yield/Content

| | | | | | | | | | | | |
|---|---|---|---|---|---|---|---|---|---|---|---|
| 15449 | 15450 | 15451 | 15452 | 15453 | 15462 | 15465 | 15473 | 15480 | 15484 | 15491 | 15499 |
| 15501 | 15502 | 15507 | 15508 | 15509 | 15510 | 15514 | 15517 | 15524 | 15539 | 15543 | 15557 |
| 15562 | 15569 | 15591 | 15592 | 15599 | 15600 | 15601 | 15605 | 15631 | 15642 | 15644 | 15647 |
| 15648 | 15649 | 15650 | 15651 | 15652 | 15654 | 15655 | 15656 | 15657 | 15659 | 15660 | 15661 |
| 15667 | 15668 | 15676 | 15706 | 15712 | 15731 | 15732 | 15734 | 15754 | 15755 | 15757 | 15773 |
| 15777 | 15786 | 15796 | 15800 | 15801 | 15807 | 15808 | 15809 | 15813 | 15814 | 15815 | 15817 |
| 15818 | 15819 | 15820 | 15821 | 15831 | 15834 | 15843 | 15850 | 15855 | 15870 | 15873 | 15874 |
| 15879 | 15880 | 15881 | 15882 | 15886 | 15889 | 15895 | 15910 | 15915 | 15930 | 15935 | 15942 |
| 15967 | 15968 | 15976 | 15977 | 15980 | 16006 | 16017 | 16019 | 16023 | 16024 | 16025 | 16026 |
| 16027 | 16028 | 16029 | 16030 | 16031 | 16033 | 16034 | 16035 | 16036 | 16037 | 16039 | 16041 |
| 16042 | 16045 | 16046 | 16047 | 16051 | 16052 | 16057 | 16058 | 16067 | 16096 | 16101 | 16116 |
| 16117 | 16118 | 16138 | 16140 | 16141 | 16156 | 16168 | 16178 | 16182 | 16183 | 16188 | 16189 |
| 16191 | 16195 | 16196 | 16197 | 16199 | 16200 | 16201 | 16202 | 16212 | 16216 | 16222 | 16228 |
| 16230 | 16237 | 16245 | 16248 | 16249 | 16252 | 16253 | 16254 | 16260 | 16261 | 16268 | 16286 |
| 16298 | 16303 | 16308 | 16329 | 16330 | 16333 | 16334 | 16340 | 16360 | 16370 | 16398 | 16405 |
| 16415 | 16422 | 16424 | 16426 | 16429 | 16433 | 16435 | 16443 | 16450 | 16452 | 16453 | 16455 |
| 16463 | 16479 | 16483 | 16496 | 16516 | 16527 | 16530 | 16534 | 16535 | 16546 | 16547 | 16549 |
| 16555 | 16578 | 16579 | 16606 | 16608 | 16615 | 16619 | 16622 | 16635 | 16636 | 16671 | 16684 |
| 16685 | 16686 | 16687 | 16707 | 16708 | 16719 | 16726 | 16736 | 16756 | 16775 | 16778 | 16784 |
| 16787 | 16794 | 16801 | 16815 | 16821 | 16827 | 16828 | 16832 | 16834 | 16842 | 16853 | 16860 |
| 16862 | 16866 | 16881 | 16886 | 16887 | 16920 | 16934 | 16943 | 16948 | 16953 | 16959 | 16962 |
| 16990 | 17035 | 17042 | 17054 | 17064 | 17066 | 17070 | 17081 | 17082 | 17100 | 17101 | 17112 |
| 17121 | 17123 | 17130 | 17151 | 17183 | 17203 | 17215 | 17216 | 17217 | 17218 | 17219 | 17220 |
| 17226 | 17232 | 17233 | 17236 | 17243 | 17246 | 17247 | 17248 | 17250 | 17276 | 17290 | 17291 |
| 17294 | 17297 | 17302 | 17304 | 17315 | 17316 | 17317 | 17318 | 17328 | 17335 | 17358 | 17386 |
| 17390 | 17410 | 17420 | 17421 | 17424 | 17425 | 17426 | 17431 | 17461 | 17463 | 17480 | 17491 |
| 17492 | 17514 | 17515 | 17516 | 17521 | 17526 | 17527 | 17540 | 17544 | 17545 | 17558 | 17562 |
| 17569 | 17576 | 17586 | 17589 | 17593 | 17596 | 17597 | 17598 | 17603 | 17622 | 17624 | 17627 |
| 17632 | 17633 | 17640 | 17652 | 17661 | 17665 | 17675 | 17682 | 17684 | 17685 | 17686 | 17698 |
| 17699 | 17708 | 17710 | 17724 | 17726 | 17763 | 17773 | 17782 | 17784 | 17797 | 17802 | 17809 |
| 17815 | 17816 | 17820 | 17826 | 17828 | 17833 | 17836 | 17856 | 17862 | 17863 | 17874 |
| 17875 | 17879 | 17880 | 17889 | 17894 | 17912 | 17915 | 17918 | 17919 | 17923 | 17925 | 17930 |
| 17937 | 17940 | 17945 | 17948 | 17949 | 17951 | 17953 | 17969 | 17971 | 17976 | 17981 | 17982 |
| 18001 | 18002 | 18010 | 18020 | 18030 | 18031 | 18035 | 18049 | 18058 | 18067 | 18070 | 18071 |
| 18073 | 18074 | 18075 | 18076 | 18077 | 18078 | 18079 | 18080 | 18089 | 18096 | 18121 | 18127 |
| 18134 | 18138 | 18142 | 18150 | 18154 | 18158 | 18162 | 18172 | 18174 | 18180 | 18183 | 18185 |
| 18186 | 18187 | 18191 | 18195 | 18200 | 18203 | 18219 | 18247 | 18250 | 18259 | 18260 | 18261 |
| 18270 | 18271 | 18272 | 18290 | 18296 | 18298 | 18306 | 18319 | 18327 | 18328 | 18329 | 18341 |
| 18348 | 18366 | 18375 | 18384 | 18391 | 18407 | 18417 | 18420 | 18424 | 18434 | 18443 | 18448 |
| 18454 | 18465 | 18466 | 18492 | 18494 | 18500 | 18502 | 18519 | 18540 | 18552 | 18562 | 18575 |
| 18582 | 18590 | 18606 | 18609 | 18610 | 18619 | 18626 | 18628 | 18629 | 18633 | 18641 | 18643 |
| 18665 | 18667 | 18674 | 18698 | 18700 | 18701 | 18703 | 18717 | 18719 | 18752 | 18758 | 18759 |
| 18771 | 18772 | 18773 | 18788 | 18794 | 18795 | 18796 | 18854 | 18881 | 18886 | 18892 |
| 18899 | 18913 | 18923 | 18935 | 18936 | 18946 | 18963 | 18985 | 18992 | 18993 | 18999 | 19024 |
| 19025 | 19045 | 19047 | 19052 | 19108 | 19109 | 19111 | 19132 | 19135 | 19137 | 19140 | 19141 |
| 19150 | 19151 | 19152 | 19153 | 19162 | 19170 | 19186 | 19191 | 19192 | 19195 | 19196 | 19207 |
| 19209 | 19210 | 19217 | 19237 | 19241 | 19254 | 19264 | 19266 | 19267 | 19270 | 19284 | 19287 |
| 19296 | 19297 | 19298 | 19299 | 19304 | 19306 | 19308 | 19318 | 19320 | 19321 | 19322 | 19323 |
| 19324 | 19335 | 19345 | 19347 | 19349 | 19353 | 19366 | 19374 | 19375 | 19381 | 19382 | 19387 |
| 19389 | 19390 | 19402 | 19403 | 19413 | 19430 | 19432 | 19434 | 19443 | 19452 | 19453 | 19459 |
| 19462 | 19467 | 19475 | 19490 | 19496 | 19515 | 19520 | 19532 | 19535 | 19537 | 19553 | 19568 |
| 19591 | 19596 | 19605 | 19607 | 19612 | 19613 | 19616 | 19618 | 19619 | 19622 | 19625 | 19626 |
| 19629 | 19648 | 19656 | 19660 | 19679 | 19696 | 19703 | 19707 | 19710 | 19725 | 19734 | 19736 |
| 19758 | 19761 | 19762 | 19763 | 19772 | 19779 | 19780 | 19786 | 19789 | 19790 | 19791 | 19795 |
| 19831 | 19852 | 19878 | 19887 | 19915 | 19920 | 19922 | 19923 | 19939 | 19989 | 20013 | 20033 |
| 20036 | 20039 | 20047 | 20068 | 20069 | 20085 | 20086 | 20087 | 20106 | 20114 | 20115 | 20117 |
| 20125 | 20139 | 20171 | 20182 | 20192 | 20211 | 20216 | 20217 | 20221 | 20232 | 20263 | 20264 |
| 20273 | 20274 | 20291 | 20294 | 20320 | 20331 | 20333 | 20341 | 20342 | 20343 | 20344 | 20357 |
| 20365 | 20366 | 20376 | 20397 | 20426 | 20441 | 20458 | 20475 | 20488 | 20516 | 20517 | 20521 |
| 20531 | 20561 | 20563 | 20565 | 20569 | 20589 | 20601 | 20607 | 20627 | 20642 | 20643 | 20645 |
| 20653 | 20654 | 20672 | 20676 | 20679 | 20681 | 20683 | 20689 | 20695 | 20696 | 20698 | 20699 |
| 20700 | 20724 | 20732 | 20740 | 20741 | 20751 | 20772 | 20777 | 20783 | 20785 | 20787 | 20797 |
| 20812 | 20819 | 20828 | 20842 | 20872 | 20888 | 20890 | 20893 | 20896 | 20901 | 20906 | 20910 |
| 20911 | 20918 | 20921 | 20935 | 20938 | 20942 | 20947 | 20953 | 20957 | 20988 | 21000 | 21005 |
| 21027 | 21028 | 21029 | 21051 | 21052 | 21061 | 21068 | 21076 | 21082 | 21090 | 21093 | 21098 |
| 21121 | 21144 | 21148 | 21157 | 21173 | 21181 | 21182 | 21184 | 21192 | 21195 | 21201 | 21207 |
| 21212 | 21215 | 21218 | 21220 | 21222 | 21223 | 21230 | 21235 | 21241 | 21261 | 21268 | 21274 |
| 21278 | 21286 | 21288 | 21292 | 21294 | 21310 | 21325 | 21326 | 21329 | 21331 | 21332 | 21338 |
| 21347 | 21351 | 21362 | 21372 | 21394 | 21395 | 21398 | 21399 | 21406 | 21420 | 21422 | 21434 |
| 21444 | 21450 | 21461 | 21474 | 21475 | 21492 | 21528 | 21547 | 21549 | 21561 | 21579 | 21587 |
| 21600 | 21608 | 21613 | 21614 | 21615 | 21619 | 21625 | 21626 | 21627 | 21631 | 21632 | 21640 |
| 21641 | 21648 | 21660 | 21737 | 21744 | 21775 | 21785 | 21787 | 21798 | 21804 | 21807 | 21817 |
| 21821 | 21823 | 21825 | 21826 | 21834 | 21843 | 21846 | 21847 | 21852 | 21855 | 21873 | 21879 |
| 21880 | 21881 | 21886 | 21891 | 21892 | 21894 | 21898 | 21909 | 21914 | 21925 | 21929 | 21930 |
| 21943 | 21951 | 21961 | 21968 | 21975 | 21982 | 21991 | 21994 | 22000 | 22003 | 22012 | 22014 |
| 22020 | 22026 | 22028 | 22029 | 22034 | 22037 | 22046 | 22047 | 22048 | 22051 | 22055 | 22064 |
| 22066 | 22072 | 22077 | 22078 | 22086 | 22088 | 22089 | 22091 | 22111 | 22113 | 22116 | 22119 |

TABLE 14-continued

Seed Protein Yield/Content

| | | | | | | | | | | | |
|---|---|---|---|---|---|---|---|---|---|---|---|
| 22123 | 22125 | 22127 | 22131 | 22137 | 22146 | 22152 | 22176 | 22181 | 22196 | 22200 | 22202 |
| 22206 | 22207 | 22208 | 22210 | 22220 | 22221 | 22229 | 22233 | 22236 | 22240 | 22267 | 22275 |
| 22277 | 22282 | 22287 | 22290 | 22296 | 22297 | 22313 | 22322 | 22323 | 22328 | 22332 | 22338 |
| 22340 | 22345 | 22368 | 22371 | 22374 | 22376 | 22381 | 22397 | 22398 | 22404 | 22406 | 22407 |
| 22408 | 22417 | 22431 | 22433 | 22436 | 22442 | 22447 | 22470 | 22472 | 22493 | 22504 | 22510 |
| 22512 | 22522 | 22527 | 22532 | 22533 | 22539 | 22545 | 22546 | 22555 | 22560 | 22563 | 22571 |
| 22574 | 22590 | 22594 | 22599 | 22602 | 22603 | 22606 | 22619 | 22630 | 22631 | 22642 | 22644 |
| 22645 | 22646 | 22657 | 22658 | 22678 | 22681 | 22682 | 22688 | 22689 | 22710 | 22720 | 22724 |
| 22729 | 22738 | 22753 | 22754 | 22755 | 22759 | 22765 | 22769 | 22775 | 22782 | 22791 | 22792 |
| 22793 | 22797 | 22803 | 22805 | 22816 | 22848 | 22868 | 22871 | 22876 | 22877 | 22880 | 22881 |
| 22883 | 22894 | 22897 | 22904 | 22920 | 22936 | 22938 | 22941 | 22966 | 22972 | 22973 | 22988 |
| 22989 | 23012 | 23018 | 23020 | 23021 | 23036 | 23043 | 23049 | 23050 | 23057 | 23058 | 23059 |
| 23063 | 23064 | 23066 | 23068 | 23072 | 23078 | 23087 | 23091 | 23097 | 23099 | 23106 | 23118 |
| 23119 | 23120 | 23129 | 23130 | 23131 | 23132 | 23148 | 23165 | 23173 | 23180 | 23185 | 23197 |
| 23201 | 23213 | 23215 | 23224 | 23228 | 23258 | 23259 | 23278 | 23280 | 23290 | 23304 | 23305 |
| 23324 | 23348 | 23367 | 23371 | 23382 | 23385 | 23406 | 23410 | 23416 | 23430 | 23431 | 23438 |
| 23439 | 23440 | 23451 | 23460 | 23463 | 23481 | 23496 | 23499 | 23504 | 23508 | 23513 | 23521 |
| 23522 | 23529 | 23533 | 23535 | 23536 | 23544 | 23551 | 23552 | 23556 | 23562 | 23567 | 23568 |
| 23570 | 23576 | 23583 | 23589 | 23593 | 23595 | 23621 | 23624 | 23628 | 23633 | 23641 | 23642 |
| 23654 | 23656 | 23659 | 23661 | 23670 | 23671 | 23679 | 23683 | 23684 | | | |

Table 14B SEQ ID NOs of Polynucleotides useful for improving Seed Protein Yield/Content

| | | | | | | | | | | | |
|---|---|---|---|---|---|---|---|---|---|---|---|
| 23695 | 23707 | 23739 | 23742 | 23750 | 23753 | 23754 | 23766 | 23767 | 23772 | 23774 | 23775 |
| 23778 | 23785 | 23787 | 23789 | 23813 | 23816 | 23827 | 23828 | 23829 | 23830 | 23844 | 23855 |
| 23863 | 23876 | 23878 | 23880 | 23908 | 23914 | 23926 | 23929 | 23932 | 23951 | 23960 | 23969 |
| 23985 | 23991 | 23995 | 23996 | 23999 | 24002 | 24007 | 24017 | 24021 | 24024 | 24029 | 24034 |
| 24035 | 24038 | 24044 | 24048 | 24052 | 24054 | 24060 | 24070 | 24084 | 24093 | 24101 | 24106 |
| 24117 | 24132 | 24139 | 24150 | 24162 | 24163 | 24167 | 24175 | 24187 | 24190 | 24196 | 24203 |
| 24206 | 24229 | 24232 | 24242 | 24243 | 24245 | 24246 | 24253 | 24265 | 24271 | 24279 | 24298 |
| 24308 | 24310 | 24318 | 24320 | 24332 | 24334 | 24344 | 24362 | 24364 | 24373 | 24377 | 24382 |
| 24387 | 24401 | 24403 | 24416 | 24419 | 24421 | 24432 | 24440 | 24445 | 24464 | 24506 | 24513 |
| 24525 | 24540 | 24548 | 24585 | 24592 | 24622 | 24623 | 24630 | 24635 | 24642 | 24643 | 24644 |
| 24665 | 24668 | 24672 | 24685 | 24686 | 24687 | 24688 | 24699 | 24704 | 24715 | 24716 | 24728 |
| 24732 | 24735 | 24737 | 24741 | 24747 | 24771 | 24777 | 24788 | 24824 | 24832 | 24833 | 24844 |
| 24848 | 24856 | 24857 | 24858 | 24859 | 24882 | 24892 | 24895 | 24903 | 24904 | 24940 | 24952 |
| 24954 | 24962 | 24963 | 24964 | 24965 | 24978 | 24986 | 24987 | 24998 | 25020 | 25045 | 25080 |
| 25098 | 25104 | 25105 | 25106 | 25108 | 25110 | 25114 | 25128 | 25130 | 25131 | 25134 | 25137 |
| 25145 | 25146 | 25152 | 25156 | 25169 | 25182 | 25184 | 25191 | 25193 | 25195 | 25200 | 25225 |
| 25230 | 25236 | 25252 | 25258 | 25260 | 25261 | 25286 | 25288 | 25303 | 25310 | 25323 | 25326 |
| 25330 | 25332 | 25352 | 25366 | 25367 | 25368 | 25372 | 25376 | 25378 | 25385 | 25386 | 25388 |
| 25391 | 25393 | 25394 | 25408 | 25412 | 25417 | 25419 | 25426 | 25428 | 25429 | 25438 | 25440 |
| 25441 | 25443 | 25446 | 25456 | 25459 | 25470 | 25472 | 25492 | 25502 | 25503 | 25513 | 25514 |
| 25528 | 25533 | 25554 | 25559 | 25563 | 25567 | 25579 | 25580 | 25582 | 25585 | 25586 | 25597 |
| 25603 | 25613 | 25616 | 25618 | 25623 | 25633 | 25634 | 25640 | 25647 | 25649 | 25674 | 25681 |
| 25693 | 25695 | 25701 | 25706 | 25715 | 25738 | 25744 | 25746 | 25754 | 25758 | 25766 | 25769 |
| 25770 | 25773 | 25776 | 25782 | 25804 | 25813 | 25818 | 25827 | 25833 | 25839 | 25852 | 25869 |
| 25871 | 25890 | 25894 | 25913 | 25917 | 25920 | 25930 | 25931 | 25936 | 25949 | 25952 | 25956 |
| 25966 | 25973 | 25981 | 25988 | 25993 | 25995 | 26001 | 26003 | 26007 | 26009 | 26020 | 26027 |
| 26032 | 26039 | 26045 | 26056 | 26060 | 26061 | 26071 | 26074 | 26079 | 26089 | 26093 | 26101 |
| 26109 | 26128 | 26142 | 26144 | 26148 | 26151 | 26163 | 26167 | 26168 | 26169 | 26170 | 26190 |
| 26191 | 26204 | 26205 | 26218 | 26223 | 26225 | 26240 | 26241 | 26253 | 26256 | 26257 | 26262 |
| 26267 | 26276 | 26284 | 26289 | 26292 | 26295 | 26306 | 26309 | 26319 | 26323 | 26325 | 26340 |
| 26370 | 26389 | 26434 | 26437 | 26444 | 26449 | 26456 | 26457 | 26472 | 26478 | 26485 | 26493 |
| 26498 | 26540 | 26544 | 26545 | 26546 | 26549 | 26552 | 26553 | 26563 | 26565 | 26585 | 26589 |
| 26640 | 26645 | 26652 | 26665 | 26702 | 26704 | 26713 | 26722 | 26723 | 26724 | 26725 | 26726 |
| 26727 | 26732 | 26737 | 26739 | 26757 | 26761 | 26775 | 26783 | 26787 | 26792 | 26797 | 26800 |
| 26807 | 26808 | 26809 | 26811 | 26812 | 26813 | 26816 | 26837 | 26841 | 26843 | 26844 | 26853 |
| 26860 | 26862 | 26869 | 26872 | 26873 | 26875 | 26886 | 26903 | 26904 | 26906 | 26913 | 26918 |
| 26922 | 26925 | 26927 | 26931 | 26937 | 26944 | 26953 | 26960 | 26964 | 26971 | 26975 | 26977 |
| 26985 | 26994 | 26996 | 26998 | 27002 | 27011 | 27014 | 27017 | 27026 | 27031 | 27037 | 27040 |
| 27042 | 27047 | 27052 | 27066 | 27068 | 27073 | 27076 | 27079 | 27080 | 27081 | 27091 | 27097 |
| 27108 | 27109 | 27113 | 27114 | 27115 | 27117 | 27118 | 27123 | 27127 | 27132 | 27138 | 27140 |
| 27142 | 27148 | 27153 | 27158 | 27175 | 27176 | 27182 | 27188 | 27201 | 27207 | 27214 | 27215 |
| 27216 | 27229 | 27230 | 27245 | 27247 | 27250 | 27270 | 27284 | 27286 | 27298 | 27303 | 27305 |
| 27306 | 27312 | 27314 | 27317 | 27321 | 27322 | 27327 | 27341 | 27342 | 27345 | 27348 | 27381 |
| 27384 | 27386 | 27387 | 27389 | 27390 | 27401 | 27402 | 27409 | 27420 | 27422 | 27453 | 27457 |
| 27463 | 27470 | 27472 | 27475 | 27480 | 27485 | 27490 | 27495 | 27506 | 27523 | 27530 | 27537 |
| 27552 | 27554 | 27555 | 27559 | 27564 | 27565 | 27566 | 27572 | 27573 | 27594 | 27598 | 27599 |
| 27600 | 27602 | 27607 | 27611 | 27621 | 27625 | 27630 | 27641 | 27643 | 27644 | 27653 | 27657 |
| 27666 | 27669 | 27670 | 27677 | 27680 | 27685 | 27688 | 27689 | 27700 | 27702 | 27703 | 27705 |
| 27710 | 27717 | 27719 | 27728 | 27730 | 27731 | 27739 | 27744 | 27761 | 27762 | 27765 | 27767 |
| 27768 | 27770 | 27784 | 27785 | 27787 | 27793 | 27805 | 27808 | 27810 | 27814 | 27817 | 27827 |
| 27841 | 27848 | 27849 | 27855 | 27856 | 27863 | 27879 | 27887 | 27888 | 27896 | 27900 | 27904 |
| 27912 | 27920 | 27927 | 27937 | 27944 | 27957 | 27962 | 27984 | 28006 | 28009 | 28024 | 28037 |
| 28048 | 28055 | 28056 | 28057 | 28078 | 28084 | 28086 | 28100 | 28103 | 28108 | 28109 | 28119 |
| 28131 | 28134 | 28137 | 28146 | 28181 | 28195 | 28207 | 28208 | 28229 | 28231 | 28235 | 28287 |
| 28306 | 28350 | 28351 | 28357 | 28358 | 28362 | 28364 | 28374 | 28395 | 28413 | 28427 | 28438 |

TABLE 14-continued

Seed Protein Yield/Content

| | | | | | | | | | | | |
|---|---|---|---|---|---|---|---|---|---|---|---|
| 28441 | 28448 | 28459 | 28479 | 28491 | 28494 | 28515 | 28520 | 28524 | 28532 | 28540 | 28541 |
| 28545 | 28547 | 28561 | 28568 | 28572 | 28582 | 28583 | 28584 | 28588 | 28591 | 28596 | 28597 |
| 28602 | 28642 | 28662 | 28663 | 28672 | 28676 | 28694 | 28695 | 28699 | 28702 | 28720 | 28722 |
| 28727 | 28732 | 28737 | 28749 | 28752 | 28754 | 28756 | 28757 | 28758 | 28759 | 28760 | 28761 |
| 28775 | 28780 | 28785 | 28790 | 28792 | 28803 | 28804 | 28805 | 28813 | 28821 | 28827 | 28840 |
| 28841 | 28842 | 28844 | 28852 | 28863 | 28864 | 28872 | 28885 | 28889 | 28891 | 28895 | 28900 |
| 28904 | 28912 | 28915 | 28917 | 28925 | 28926 | 28927 | 28928 | 28931 | 28932 | 28934 | 28935 |
| 28936 | 28937 | 28938 | 28939 | 28962 | 28964 | 28973 | 28983 | 28984 | 28987 | 28989 | 28993 |
| 29000 | 29001 | 29003 | 29004 | 29005 | 29008 | 29014 | 29019 | 29020 | 29022 | 29027 | 29030 |
| 29031 | 29033 | 29035 | 29036 | 29037 | 29038 | 29039 | 29040 | 29041 | 29042 | 29045 | 29048 |
| 29058 | 29060 | 29061 | 29063 | 29064 | 29069 | 29077 | 29084 | 29085 | 29095 | 29098 | 29106 |
| 29110 | 29113 | 29115 | 29123 | 29129 | 29133 | 29137 | 29138 | 29139 | 29145 | 29159 | 29160 |
| 29168 | 29173 | 29174 | 29197 | 29202 | 29205 | 29214 | 29222 | 29228 | 29229 | 29232 | 29233 |
| 29237 | 29238 | 29265 | 29270 | 29273 | 29274 | 29277 | 29282 | 29298 | 29308 | 29312 | 29313 |
| 29314 | 29325 | 29339 | 29344 | 29345 | 29346 | 29347 | 29352 | 29375 | 29382 | 29385 | 29386 |
| 29387 | 29396 | 29401 | 29403 | 29404 | 29412 | 29425 | 29436 | 29440 | 29443 | 29462 | 29464 |
| 29471 | 29472 | 29474 | 29476 | 29482 | 29486 | 29495 | 29496 | 29501 | 29510 | 29514 | 29516 |
| 29517 | 29521 | 29523 | 29537 | 29542 | 29544 | 29551 | 29552 | 29553 | 29558 | 29559 | 29560 |
| 29566 | 29590 | 29598 | 29599 | 29606 | 29634 | 29638 | 29652 | 29655 | 29665 | 29667 | 29678 |
| 29685 | 29687 | 29688 | 29694 | 29695 | 29698 | 29700 | 29703 | 29716 | 29723 | 29725 | 29728 |
| 29731 | 29732 | 29733 | 29755 | 29759 | 29760 | 29771 | 29772 | 29775 | 29776 | 29777 | 29782 |
| 29783 | 29785 | 29790 | 29802 | 29803 | 29809 | 29811 | 29813 | 29816 | 29817 | 29824 | 29825 |
| 29827 | 29829 | 29831 | 29835 | 29836 | 29847 | 29850 | 29855 | 29856 | 29883 | 29884 | 29885 |
| 29907 | 29908 | 29909 | 29910 | 29922 | 29940 | 29941 | 29943 | 29944 | 29945 | 29946 | 29947 |
| 29949 | 29950 | 29966 | 29967 | 29968 | 29970 | 29972 | 29973 | 29974 | 29986 | 29987 | 29997 |
| 30001 | 30006 | 30007 | 30016 | 30020 | 30021 | 30022 | 30023 | 30024 | 30028 | 30029 | 30030 |
| 30045 | 30046 | 30050 | 30055 | 30061 | 30063 | 30068 | 30071 | 30072 | 30073 | 30085 | 30086 |
| 30089 | 30090 | 30091 | 30092 | 30093 | 30099 | 30103 | 30104 | 30108 | 30114 | 30115 | 30117 |
| 30123 | 30129 | 30130 | 30133 | 30138 | 30139 | 30142 | 30143 | 30146 | 30150 | 30151 | 30163 |
| 30173 | 30177 | 30178 | 30193 | 30196 | 30197 | 30199 | 30201 | 30202 | 30204 | 30207 | 30208 |
| 30211 | 30213 | 30218 | 30219 | 30220 | 30221 | 30222 | 30223 | 30224 | 30225 | 30226 | 30230 |
| 30233 | 30235 | 30236 | 30247 | 30248 | 30267 | 30280 | 30282 | 30293 | 30296 | 30297 | 30298 |
| 30302 | 30306 | 30309 | 30310 | 30316 | 30321 | 30330 | 30332 | 30350 | 30351 | 30353 | 30357 |
| 30359 | 30360 | 30361 | 30362 | 30367 | 30368 | 30372 | 30388 | 30389 | 30390 | 30393 | 30403 |
| 30415 | 30421 | 30426 | 30428 | 30434 | 30458 | 30460 | 30463 | 30464 | 30465 | 30467 | 30482 |
| 30484 | 30485 | 30486 | 30489 | 30493 | 30494 | 30497 | 30513 | 30515 | 30523 | 30529 | 30536 |
| 30537 | 30538 | 30541 | 30542 | 30549 | 30556 | 30557 | 30566 | 30567 | 30572 | 30573 | 30577 |
| 30600 | 30614 | 30626 | 30632 | 30646 | 30647 | 30649 | 30657 | 30664 | 30668 | 30669 | 30672 |
| 30678 | 30679 | 30687 | 30689 | 30690 | 30691 | 30693 | 30696 | 30698 | 30711 | 30713 | 30740 |
| 30762 | 30765 | 30779 | 30792 | 30798 | 30802 | 30809 | 30810 | 30811 | 30833 | 30839 | 30841 |
| 30856 | 30859 | 30864 | 30866 | 30877 | 30890 | 30893 | 30897 | 30906 | 30940 | 30953 | 30966 |
| 30967 | 30987 | 30989 | 31044 | 31063 | 31109 | 31110 | 31116 | 31117 | 31121 | 31123 | 31133 |
| 31154 | 31172 | 31186 | 31197 | 31200 | 31207 | 31209 | 31219 | 31239 | 31250 | 31253 | 31274 |
| 31279 | 31284 | 31291 | 31299 | 31300 | 31304 | 31306 | 31321 | 31326 | 31330 | 31340 | 31341 |
| 31342 | 31346 | 31349 | 31354 | 31355 | 31360 | 31400 | 31427 | 31480 | 31485 | 31486 | 31500 |
| 31516 | 31518 | 31521 | 31523 | 31534 | 31542 | 31545 | 31549 | 31553 | 31554 | 31561 | 31581 |
| 31586 | 31595 | 31616 | 31619 | 31638 | 31646 | 31668 | 31673 | 31675 | 31679 | 31687 | 31703 |
| 31712 | 31726 | 31757 | 31761 | 31769 | 31778 | 31783 | 31793 | 31807 | 31825 | 31838 | 31839 |
| 31843 | 31864 | 31882 | 31892 | 31896 | 31906 | 31911 | 31912 | 31917 | 31927 | 31945 | 31946 |
| 31976 | 31979 | 31995 | 31997 | 31998 | 32005 | 32021 | 32030 | 32033 | 32053 | 32062 | 32063 |
| 32068 | 32087 | 32105 | 32109 | 32121 | 32122 | 32132 | 32135 | 32140 | 32142 | 32149 | 32165 |
| 32178 | 32188 | 32190 | 32192 | 32193 | 32197 | 32198 | 32214 | 32222 | 32223 | 32224 | 32251 |
| 32262 | 32264 | 32265 | 32267 | 32272 | 32274 | 32279 | 32287 | 32302 | 32311 | 32327 | 32345 |
| 32347 | 32350 | 32352 | 32364 | 32382 | 32385 | 32386 | 32391 | 32392 | 32394 | 32403 | 32433 |
| 32434 | 32443 | 32478 | 32479 | 32492 | 32500 | 32502 | 32503 | 32524 | 32566 | 32584 | 32589 |
| 32594 | 32602 | 32609 | 32619 | 32633 | 32650 | 32659 | 32675 | 32684 | 32691 | 32693 | 32705 |
| 32717 | 32734 | 32751 | 32753 | 32770 | 32779 | 32780 | 32781 | 32790 | 32799 | 32811 | 32822 |
| 32827 | 32847 | 32848 | 32852 | 32853 | 32861 | 32876 | 32877 | 32878 | 32883 | 32890 | 32891 |
| 32892 | 32905 | 32917 | 32921 | 32935 | 32945 | 32955 | 32957 | 32969 | 32970 | 32973 | 32976 |
| 32977 | 33003 | 33010 | 33011 | 33015 | 33023 | 33030 | 33034 | 33037 | 33040 | 33044 | 33048 |
| 33061 | 33071 | 33103 | 33104 | 33114 | 33123 | 33125 | 33127 | 33132 | 33138 | 33146 | 33155 |
| 33176 | 33177 | 33180 | 33193 | 33194 | 33195 | 33199 | 33200 | 33209 | 33211 | 33212 | 33215 |
| 33216 | 33226 | 33233 | 33237 | 33238 | 33240 | 33267 | 33280 | 33303 | 33317 | 33332 | 33333 |
| 33341 | 33343 | 33371 | 33383 | 33387 | 33397 | 33404 | 33421 | 33440 | 33448 | 33453 |
| 33460 | 33472 | 33481 | 33489 | 33490 | 33491 | 33492 | 33493 | 33509 | 33514 | 33519 | 33545 |
| 33568 | 33573 | 33612 | 33615 | 33629 | 33648 | 33653 | 33662 | 33668 | 33669 | 33670 | 33688 |
| 33711 | 33713 | 33714 | 33745 | 33775 | 33796 | 33797 | 33823 | 33837 | 33844 | 33846 | 33854 |
| 33856 | 33858 | 33859 | 33870 | 33874 | 33877 | 33925 | 33926 | 33931 | 33939 | 33955 |
| 33980 | 33984 | 33993 | 34006 | 34020 | 34021 | 34028 | 34039 | 34053 | 34055 | 34059 | 34068 |
| 34069 | 34072 | 34085 | 34089 | 34091 | 34094 | 34100 | 34105 | 34113 | 34116 | 34127 | 34130 |
| 34133 | 34135 | 34154 | 34167 | 34198 | 34201 | 34208 | 34212 | 34232 | 34234 | 34250 | 34289 |
| 34291 | 34295 | 34297 | 34304 | 34310 | 34312 | 34319 | 34333 | 34353 | 34354 | 34356 | 34357 |
| 34363 | 34364 | 34374 | 34430 | 34432 | 34480 | 34484 | 34487 | 34489 | 34504 | 34512 | 34514 |
| 34532 | 34534 | 34541 | 34551 | 34553 | 34554 | 34558 | 34569 | 34581 | 34586 | 34592 | 34603 |
| 34609 | 34610 | 34611 | 34616 | 34617 | 34618 | 34625 | 34629 | 34640 | 34648 | 34653 | 34662 |
| 34666 | 34672 | 34679 | 34692 | 34695 | 34698 | 34700 | 34701 | 34712 | 34713 | 34714 | 34719 |
| 34725 | 34728 | 34734 | 34735 | 34780 | 34805 | 34806 | 34823 | 34830 | 34832 | 34833 | 34837 |

TABLE 14-continued

Seed Protein Yield/Content

| | | | | | | | | | | | |
|---|---|---|---|---|---|---|---|---|---|---|---|
| 34841 | 34850 | 34854 | 34865 | 34872 | 34887 | 34900 | 34902 | 34909 | 34916 | 34964 | 34969 |
| 35000 | 35026 | 35027 | 35033 | 35034 | 35050 | 35051 | 35058 | 35065 | 35078 | 35080 | 35101 |
| 35125 | 35134 | 35136 | 35170 | 35185 | 35186 | 35189 | 35193 | 35199 | 35223 | 35226 | 35235 |
| 35253 | 35264 | 35273 | 35274 | 35277 | 35280 | 35281 | 35284 | 35287 | 35289 | 35299 | 35310 |
| 35312 | 35316 | 35346 | 35350 | 35351 | 35356 | 35368 | 35369 | 35370 | 35378 | 35391 | 35397 |
| 35399 | 35401 | 35402 | 35412 | 35418 | 35419 | 35426 | 35435 | 35450 | 35459 | 35462 | 35470 |
| 35477 | 35482 | 35483 | 35505 | 35521 | 35526 | 35538 | 35541 | 35544 | 35572 | 35574 | 35577 |
| 35584 | 35607 | 35638 | 35660 | 35665 | 35669 | 35671 | 35673 | 35675 | 35693 | 35701 | 35710 |
| 35715 | 35716 | 35729 | 35744 | 35748 | 35749 | 35752 | 35760 | 35762 | 35768 | 35773 | 35836 |
| 35845 | 35864 | 35882 | 35883 | 35885 | 35888 | 35890 | 35921 | 35923 | 35959 | 35962 | 35969 |
| 35971 | 35978 | 36001 | 36003 | 36013 | 36019 | 36020 | 36034 | 36035 | 36036 | 36040 | 36045 |
| 36055 | 36060 | 36061 | 36063 | 36070 | 36073 | 36077 | 36080 | 36088 | 36095 | 36097 | 36109 |
| 36112 | 36114 | 36117 | 36123 | 36132 | 36133 | 36137 | 36138 | 36140 | 36141 | 36155 | 36158 |
| 36164 | 36170 | 36173 | 36175 | 36183 | 36187 | 36190 | 36196 | 36212 | 36217 | 36224 | 36226 |
| 36233 | 36243 | 36249 | 36250 | 36253 | 36259 | 36285 | 36287 | 36288 | 36289 | 36299 | 36300 |
| 36308 | 36310 | 36311 | 36322 | 36325 | 36330 | 36331 | 36337 | 36339 | 36340 | 36346 | 36353 |
| 36355 | 36359 | 36362 | 36365 | 36375 | 36376 | 36380 | 36387 | 36395 | 36400 | 36402 | 36404 |
| 36417 | 36429 | 36431 | 36437 | 36438 | 36444 | 36449 | 36465 | 36479 | 36480 | 36487 | 36489 |
| 36493 | 36495 | 36497 | 36514 | 36515 | 36516 | 36521 | 36525 | 36527 | 36533 | 36544 | 36556 |
| 36557 | 36570 | 36581 | 36589 | 36599 | 36603 | 36623 | 36625 | 36628 | 36634 | 36662 | 36663 |
| 36673 | 36677 | 36682 | 36691 | 36705 | 36707 | 36709 | 36715 | 36720 | 36727 | 36744 | 36746 |
| 36755 | 36757 | 36759 | 36762 | 36767 | 36777 | 36778 | 36779 | 36785 | 36789 | 36793 | 36795 |
| 36796 | 36811 | 36814 | 36815 | 36823 | 36826 | 36833 | 36839 | 36851 | 36854 | 36866 | 36867 |
| 36875 | 36877 | 36880 | 36882 | 36884 | 36886 | 36887 | 36890 | 36891 | 36899 | 36908 | 36912 |
| 36917 | 36920 | 36922 | 36926 | 36927 | 36929 | 36931 | 36934 | 36945 | 36946 | 36949 | 36963 |
| 36964 | 36973 | 36981 | 36982 | 36990 | 36991 | 36993 | 36994 | 36997 | 37006 | 37011 | 37012 |
| 37014 | 37015 | 37022 | 37025 | 37026 | 37027 | 37037 | 37038 | 37041 | 37044 | 37047 | 37052 |
| 37053 | 37058 | 37062 | 37074 | 37079 | 37080 | 37082 | 37084 | 37087 | 37093 | 37105 | 37108 |
| 37110 | 37116 | 37117 | 37119 | 37121 | 37122 | 37123 | 37128 | 37134 | 37152 | 37156 | 37157 |
| 37168 | 37175 | 37178 | 37184 | 37213 | 37227 | 37230 | 37233 | 37241 | 37245 | 37253 | 37260 |
| 37262 | 37265 | 37271 | 37288 | 37301 | 37308 | 37314 | 37339 | 37340 | 37346 | 37349 | 37353 |
| 37358 | 37375 | 37381 | 37390 | 37396 | 37398 | 37399 | 37409 | 37411 | 37425 | 37426 | 37431 |
| 37436 | 37437 | 37457 | 37468 | 37475 | 37482 | 37497 | 37498 | 37508 | 37559 | 37567 | 37575 |
| 37584 | 37586 | 37593 | 37600 | 37603 | 37633 | 37643 | 37649 | 37658 | 37659 | 37661 | 37667 |
| 37678 | 37681 | 37686 | 37696 | 37715 | 37716 | 37718 | 37724 | 37733 | 37734 | 37741 |
| 37742 | 37750 | 37752 | 37753 | 37754 | 37778 | 37779 | 37781 | 37814 | 37818 | 37832 | 37850 |
| 37870 | 37881 | 37887 | 37901 | 37910 | 37915 | 37928 | 37929 | 37933 | 37952 | 37957 | 37970 |
| 37980 | 37982 | 37988 | 38000 | 38010 | 38026 | 38028 | 38030 | 38037 | 38041 | 38045 | 38072 |
| 38073 | 38100 | 38102 | 38113 | 38118 | 38125 | 38136 | 38143 | 38145 | 38154 | 38159 | 38161 |
| 38168 | 38169 | 38179 | 38181 | 38188 | 38195 | 38200 | 38206 | 38209 | 38216 | 38220 | 38221 |
| 38223 | 38227 | 38229 | 38230 | 38234 | 38266 | 38268 | 38302 | 38316 | 38325 | 38331 | 38351 |
| 38356 | 38363 | 38383 | 38397 | 38407 | 38408 | 38434 | 38435 | 38456 | 38472 | 38473 | 38482 |
| 38484 | 38485 | 38486 | 38488 | 38497 | 38498 | 38503 | 38533 | 38534 | 38543 | 38544 | 38553 |
| 38554 | 38564 | 38571 | 38581 | 38592 | 38599 | 38600 | 38601 | 38605 | 38633 | 38636 | 38645 |
| 38649 | 38654 | 38657 | 38659 | 38660 | 38667 | 38670 | 38671 | 38673 | 38690 | 38724 | 38729 |
| 38732 | 38734 | 38739 | 38745 | 38747 | 38749 | 38756 | 38766 | 38768 | 38774 | 38779 | 38788 |
| 38790 | 38796 | 38802 | 38829 | 38836 | 38843 | 38864 | 38886 | 38887 | 38912 | 38934 | 38979 |
| 38981 | 38982 | 38988 | 38989 | 38997 | 39026 | 39032 | 39051 | 39052 | 39054 | 39073 | 39074 |
| 39076 | 39092 | 39096 | 39105 | 39115 | 39118 | 39120 | 39126 | 39127 | 39132 | 39133 | 39134 |
| 39136 | 39137 | 39138 | 39139 | 39140 | 39149 | 39152 | 39160 | 39167 | 39171 | 39178 | 39186 |
| 39188 | 39189 | 39194 | 39195 | 39196 | 39197 | 39201 | 39204 | 39211 | 39226 | 39230 | 39244 |
| 39249 | 39256 | 39278 | 39279 | 39286 | 39287 | 39288 | 39292 | 39318 | 39329 | 39331 | 39334 |
| 39335 | 39336 | 39337 | 39338 | 39339 | 39341 | 39342 | 39343 | 39344 | 39346 | 39347 | 39348 |
| 39354 | 39355 | 39363 | 39393 | 39399 | 39418 | 39419 | 39421 | 39441 | 39442 | 39444 | 39460 |
| 39464 | 39473 | 39483 | 39487 | 39488 | 39494 | 39495 | 39496 | 39500 | 39501 | 39502 | 39504 |
| 39505 | 39506 | 39507 | 39508 | 39518 | 39521 | 39530 | 39537 | 39542 | 39557 | 39560 | 39561 |
| 39566 | 39567 | 39568 | 39569 | 39573 | 39576 | 39582 | 39597 | 39602 | 39617 | 39622 | 39629 |
| 39654 | 39655 | 39663 | 39664 | 39667 | 39693 | 39704 | 39706 | 39710 | 39711 | 39712 | 39713 |
| 39714 | 39715 | 39716 | 39717 | 39718 | 39720 | 39721 | 39722 | 39723 | 39724 | 39726 | 39728 |
| 39729 | 39732 | 39733 | 39734 | 39738 | 39739 | 39744 | 39754 | 39783 | 39788 | 39803 |
| 39804 | 39805 | 39825 | 39827 | 39828 | 39843 | 39855 | 39865 | 39869 | 39870 | 39875 | 39876 |
| 39878 | 39882 | 39883 | 39884 | 39886 | 39887 | 39888 | 39889 | 39899 | 39903 | 39909 | 39915 |
| 39917 | 39924 | 39932 | 39935 | 39936 | 39939 | 39940 | 39941 | 39947 | 39948 | 39955 | 39973 |
| 39985 | 39990 | 39995 | 40016 | 40017 | 40020 | 40021 | 40027 | 40047 | 40057 | 40085 | 40092 |
| 40102 | 40109 | 40111 | 40113 | 40116 | 40120 | 40122 | 40130 | 40137 | 40139 | 40140 | 40142 |
| 40150 | 40166 | 40170 | 40183 | 40203 | 40214 | 40217 | 40221 | 40222 | 40233 | 40234 | 40236 |
| 40242 | 40265 | 40266 | 40293 | 40295 | 40302 | 40306 | 40309 | 40322 | 40323 | 40358 | 40371 |
| 40372 | 40373 | 40374 | 40394 | 40395 | 40406 | 40413 | 40423 | 40443 | 40462 | 40465 | 40471 |
| 40474 | 40481 | 40488 | 40502 | 40508 | 40514 | 40515 | 40519 | 40521 | 40529 | 40540 | 40547 |
| 40549 | 40553 | 40568 | 40573 | 40574 | 40607 | 40621 | 40630 | 40635 | 40640 | 40646 | 40649 |
| 40677 | 40722 | 40729 | 40741 | 40751 | 40753 | 40757 | 40768 | 40769 | 40787 | 40788 | 40799 |
| 40808 | 40810 | 40817 | 40838 | 40870 | 40890 | 40902 | 40903 | 40904 | 40905 | 40906 | 40907 |
| 40913 | 40919 | 40920 | 40923 | 40930 | 40933 | 40934 | 40935 | 40937 | 40963 | 40977 | 40978 |
| 40981 | 40984 | 40989 | 40991 | 41002 | 41003 | 41004 | 41005 | 41015 | 41022 | 41045 | 41073 |
| 41077 | 41097 | 41107 | 41108 | 41111 | 41112 | 41113 | 41118 | 41148 | 41150 | 41167 | 41178 |
| 41179 | 41201 | 41202 | 41203 | 41208 | 41213 | 41214 | 41227 | 41231 | 41232 | 41245 | 41249 |
| 41256 | 41263 | 41273 | 41276 | 41280 | 41283 | 41284 | 41285 | 41290 | 41309 | 41311 | 41314 |

TABLE 14-continued

Seed Protein Yield/Content

| | | | | | | | | | | |
|---|---|---|---|---|---|---|---|---|---|---|
| 41319 | 41320 | 41327 | 41339 | 41348 | 41352 | 41362 | 41369 | 41371 | 41372 | 41373 | 41385 |
| 41386 | 41395 | 41397 | 41411 | 41413 | 41450 | 41460 | 41469 | 41471 | 41484 | 41489 | 41496 |
| 41502 | 41503 | 41507 | 41513 | 41515 | 41520 | 41523 | 41531 | 41543 | 41549 | 41550 | 41561 |
| 41562 | 41566 | 41567 | 41576 | 41581 | 41599 | 41602 | 41605 | 41606 | 41610 | 41612 | 41617 |
| 41624 | 41627 | 41632 | 41635 | 41636 | 41638 | 41640 | 41656 | 41658 | 41663 | 41668 | 41669 |
| 41688 | 41689 | 41697 | 41707 | 41717 | 41718 | 41722 | 41736 | 41745 | 41754 | 41757 | 41758 |
| 41760 | 41761 | 41762 | 41763 | 41764 | 41765 | 41766 | 41767 | 41776 | 41783 | 41808 | 41814 |
| 41821 | 41825 | 41829 | 41837 | 41841 | 41845 | 41849 | 41859 | 41861 | 41867 | 41870 | 41872 |
| 41873 | 41874 | 41878 | 41882 | 41887 | 41890 | 41906 | 41934 | 41937 | 41946 | 41947 | 41948 |
| 41957 | 41958 | 41959 | 41977 | 41983 | 41985 | 41993 | 42006 | 42014 | 42015 | 42016 | 42028 |
| 42035 | 42053 | 42062 | 42071 | 42078 | 42094 | 42104 | 42107 | 42111 | 42121 | 42130 | 42135 |
| 42141 | 42152 | 42153 | 42179 | 42181 | 42187 | 42189 | 42206 | 42227 | 42239 | 42249 | 42262 |
| 42269 | 42277 | 42293 | 42296 | 42297 | 42306 | 42313 | 42315 | 42316 | 42320 | 42328 | 42330 |
| 42352 | 42354 | 42361 | 42385 | 42387 | 42388 | 42390 | 42404 | 42406 | 42439 | 42445 | 42446 |
| 42458 | 42459 | 42460 | 42475 | 42481 | 42482 | 42483 | 42487 | 42541 | 42568 | 42573 | 42579 |
| 42586 | 42600 | 42610 | 42622 | 42623 | 42633 | 42650 | 42672 | 42679 | 42680 | 42686 | 42711 |
| 42712 | 42732 | 42734 | 42739 | 42795 | 42796 | 42798 | 42819 | 42822 | 42824 | 42827 | 42828 |
| 42837 | 42838 | 42839 | 42840 | 42849 | 42857 | 42873 | 42878 | 42879 | 42882 | 42883 | 42894 |
| 42896 | 42897 | 42904 | 42924 | 42928 | 42941 | 42951 | 42953 | 42954 | 42957 | 42971 | 42974 |
| 42983 | 42984 | 42985 | 42986 | 42991 | 42993 | 42995 | 43005 | 43007 | 43008 | 43009 | 43010 |
| 43011 | 43022 | 43032 | 43034 | 43036 | 43040 | 43053 | 43061 | 43062 | 43068 | 43069 | 43074 |
| 43076 | 43077 | 43089 | 43090 | 43100 | 43117 | 43119 | 43121 | 43130 | 43139 | 43140 | 43146 |
| 43149 | 43154 | 43162 | 43177 | 43183 | 43202 | 43207 | 43219 | 43222 | 43224 | 43240 | 43255 |
| 43278 | 43283 | 43292 | 43294 | 43299 | 43300 | 43303 | 43305 | 43306 | 43309 | 43312 | 43313 |
| 43316 | 43335 | 43343 | 43347 | 43366 | 43383 | 43390 | 43394 | 43397 | 43412 | 43421 | 43423 |
| 43445 | 43448 | 43449 | 43450 | 43459 | 43466 | 43467 | 43473 | 43476 | 43477 | 43478 | 43482 |
| 43518 | 43539 | 43565 | 43574 | 43602 | 43607 | 43609 | 43610 | 43626 | 43676 | 43700 | 43720 |
| 43723 | 43726 | 43734 | 43755 | 43756 | 43772 | 43773 | 43774 | 43793 | 43801 | 43802 | 43804 |
| 43812 | 43826 | 43858 | 43869 | 43879 | 43898 | 43903 | 43904 | 43908 | 43919 | 43950 | 43951 |
| 43960 | 43961 | 43978 | 43981 | 44007 | 44018 | 44020 | 44028 | 44029 | 44030 | 44031 | 44044 |
| 44052 | 44053 | 44063 | 44084 | 44113 | 44128 | 44145 | 44162 | 44175 | 44203 | 44204 | 44208 |
| 44218 | 44248 | 44250 | 44252 | 44256 | 44276 | 44288 | 44294 | 44314 | 44329 | 44330 | 44332 |
| 44340 | 44341 | 44359 | 44363 | 44366 | 44368 | 44370 | 44376 | 44382 | 44383 | 44385 | 44386 |
| 44387 | 44411 | 44419 | 44427 | 44428 | 44438 | 44459 | 44464 | 44470 | 44472 | 44474 | 44484 |
| 44499 | 44506 | 44515 | 44529 | 44559 | 44575 | 44577 | 44580 | 44583 | 44588 | 44593 | 44597 |
| 44598 | 44605 | 44608 | 44622 | 44625 | 44629 | 44634 | 44640 | 44644 | 44675 | 44687 | 44692 |
| 44714 | 44715 | 44716 | 44738 | 44739 | 44748 | 44755 | 44763 | 44769 | 44777 | 44780 | 44785 |
| 44808 | 44831 | 44835 | 44844 | 44860 | 44868 | 44869 | 44871 | 44879 | 44882 | 44888 | 44894 |
| 44899 | 44902 | 44905 | 44907 | 44909 | 44910 | 44917 | 44922 | 44928 | 44948 | 44955 | 44961 |
| 44965 | 44973 | 44975 | 44979 | 44981 | 44997 | 45012 | 45013 | 45016 | 45018 | 45019 | 45025 |
| 45034 | 45038 | 45049 | 45059 | 45081 | 45082 | 45085 | 45086 | 45093 | 45107 | 45109 | 45121 |
| 45131 | 45137 | 45148 | 45161 | 45162 | 45179 | 45215 | 45234 | 45236 | 45248 | 45266 | 45274 |
| 45287 | 45295 | 45300 | 45301 | 45302 | 45306 | 45312 | 45313 | 45314 | 45318 | 45319 | 45327 |
| 45328 | 45335 | 45347 | 45424 | 45431 | 45462 | 45472 | 45474 | 45485 | 45491 | 45494 | 45504 |
| 45508 | 45510 | 45512 | 45513 | 45521 | 45530 | 45533 | 45534 | 45539 | 45542 | 45560 | 45566 |
| 45567 | 45568 | 45573 | 45578 | 45579 | 45581 | 45585 | 45596 | 45601 | 45612 | 45616 | 45617 |
| 45630 | 45638 | 45648 | 45655 | 45662 | 45669 | 45678 | 45681 | 45687 | 45690 | 45699 | 45701 |
| 45707 | 45713 | 45715 | 45716 | 45721 | 45724 | 45733 | 45734 | 45735 | 45738 | 45742 | 45751 |
| 45753 | 45759 | 45764 | 45765 | 45773 | 45775 | 45776 | 45778 | 45798 | 45800 | 45803 | 45806 |
| 45810 | 45812 | 45814 | 45818 | 45824 | 45833 | 45839 | 45863 | 45868 | 45883 | 45887 | 45889 |
| 45893 | 45894 | 45895 | 45897 | 45907 | 45908 | 45916 | 45920 | 45923 | 45927 | 45954 | 45962 |
| 45964 | 45969 | 45974 | 45977 | 45983 | 45984 | 46000 | 46009 | 46010 | 46015 | 46019 | 46025 |
| 46027 | 46032 | 46055 | 46058 | 46061 | 46063 | 46068 | 46084 | 46085 | 46091 | 46093 | 46094 |
| 46095 | 46104 | 46118 | 46120 | 46123 | 46129 | 46134 | 46157 | 46159 | 46180 | 46191 | 46197 |
| 46199 | 46209 | 46214 | 46219 | 46220 | 46226 | 46232 | 46233 | 46242 | 46247 | 46250 | 46258 |
| 46261 | 46277 | 46281 | 46286 | 46289 | 46290 | 46293 | 46306 | 46317 | 46318 | 46329 | 46331 |
| 46332 | 46333 | 46344 | 46345 | 46365 | 46368 | 46369 | 46375 | 46376 | 46397 | 46407 | 46411 |
| 46416 | 46425 | 46440 | 46441 | 46442 | 46446 | 46452 | 46456 | 46462 | 46469 | 46478 | 46479 |
| 46480 | 46484 | 46490 | 46492 | 46503 | 46535 | 46555 | 46558 | 46563 | 46564 | 46567 | 46568 |
| 46570 | 46581 | 46584 | 46591 | 46607 | 46623 | 46625 | 46628 | 46653 | 46659 | 46660 | 46675 |
| 46676 | 46699 | 46705 | 46707 | 46708 | 46723 | 46730 | 46736 | 46737 | 46744 | 46745 | 46746 |
| 46750 | 46751 | 46753 | 46755 | 46759 | 46765 | 46774 | 46778 | 46784 | 46786 | 46793 | 46805 |
| 46806 | 46807 | 46816 | 46817 | 46818 | 46819 | 46835 | 46852 | 46860 | 46867 | 46872 | 46884 |
| 46888 | 46900 | 46902 | 46911 | 46915 | 46945 | 46946 | 46965 | 46967 | 46977 | 46991 | 46992 |
| 47011 | 47035 | 47054 | 47058 | 47069 | 47072 | 47093 | 47097 | 47103 | 47117 | 47118 | 47125 |
| 47126 | 47127 | 47138 | 47147 | 47150 | 47168 | 47183 | 47186 | 47191 | 47195 | 47200 | 47208 |
| 47209 | 47216 | 47220 | 47222 | 47223 | 47231 | 47238 | 47239 | 47243 | 47249 | 47254 | 47255 |
| 47257 | 47263 | 47270 | 47276 | 47280 | 47282 | 47308 | 47311 | 47315 | 47320 | 47328 | 47329 |
| 47341 | 47343 | 47346 | 47348 | 47357 | 47358 | 47366 | 47370 | 47371 | | | |

TABLE 15

Yield: Carbohydrate

Table 15A SEQ ID NOs of Polypeptides useful for improving Yield: Carbohydrate

| | | | | | | | | | | | |
|---|---|---|---|---|---|---|---|---|---|---|---|
| 4 | 7 | 12 | 17 | 21 | 27 | 31 | 32 | 33 | 34 | 36 | 37 |
| 39 | 44 | 49 | 50 | 53 | 56 | 62 | 68 | 73 | 74 | 77 | 81 |
| 82 | 88 | 95 | 99 | 101 | 104 | 108 | 110 | 111 | 112 | 114 | 119 |
| 120 | 121 | 124 | 125 | 127 | 128 | 131 | 132 | 133 | 136 | 138 | 139 |
| 145 | 160 | 163 | 169 | 175 | 180 | 183 | 184 | 187 | 188 | 191 | 194 |
| 195 | 197 | 199 | 207 | 208 | 209 | 210 | 211 | 212 | 213 | 214 | 215 |
| 216 | 220 | 222 | 224 | 225 | 226 | 236 | 237 | 244 | 248 | 249 | 253 |
| 257 | 258 | 262 | 266 | 276 | 279 | 281 | 289 | 290 | 291 | 293 | 303 |
| 306 | 311 | 313 | 314 | 318 | 328 | 329 | 335 | 338 | 340 | 341 | 342 |
| 345 | 350 | 362 | 363 | 364 | 366 | 378 | 379 | 384 | 385 | 388 | 390 |
| 391 | 392 | 394 | 395 | 396 | 397 | 398 | 399 | 400 | 401 | 403 | 405 |
| 407 | 410 | 411 | 413 | 427 | 432 | 433 | 444 | 449 | 456 | 457 | 459 |
| 460 | 461 | 462 | 464 | 465 | 466 | 469 | 474 | 477 | 478 | 479 | 484 |
| 485 | 487 | 489 | 490 | 494 | 495 | 497 | 498 | 499 | 501 | 502 | 504 |
| 505 | 512 | 515 | 516 | 524 | 528 | 529 | 530 | 537 | 538 | 548 | 549 |
| 552 | 555 | 557 | 560 | 561 | 562 | 571 | 575 | 576 | 579 | 581 | 582 |
| 583 | 585 | 593 | 597 | 600 | 603 | 607 | 608 | 609 | 612 | 613 | 618 |
| 620 | 622 | 625 | 626 | 630 | 632 | 634 | 636 | 637 | 638 | 639 | 640 |
| 641 | 642 | 643 | 644 | 648 | 651 | 663 | 664 | 670 | 671 | 676 | 679 |
| 680 | 683 | 684 | 685 | 687 | 695 | 696 | 698 | 699 | 701 | 702 | 707 |
| 709 | 710 | 718 | 720 | 722 | 723 | 724 | 729 | 730 | 742 | 746 | 747 |
| 749 | 752 | 753 | 755 | 756 | 757 | 758 | 759 | 760 | 761 | 763 | 765 |
| 767 | 768 | 769 | 781 | 792 | 793 | 794 | 795 | 796 | 798 | 799 | 809 |
| 810 | 811 | 812 | 813 | 818 | 820 | 821 | 823 | 825 | 834 | 835 | 837 |
| 839 | 841 | 842 | 843 | 844 | 848 | 849 | 851 | 856 | 861 | 862 | 863 |
| 864 | 865 | 867 | 868 | 869 | 870 | 871 | 872 | 874 | 875 | 879 | 885 |
| 886 | 887 | 888 | 889 | 890 | 891 | 894 | 899 | 900 | 902 | 906 | 908 |
| 921 | 923 | 926 | 931 | 934 | 937 | 938 | 941 | 942 | 943 | 945 | 946 |
| 951 | 952 | 964 | 968 | 970 | 974 | 975 | 976 | 979 | 986 | 989 | 992 |
| 993 | 994 | 1005 | 1014 | 1018 | 1021 | 1032 | 1036 | 1042 | 1043 | 1046 | 1052 |
| 1053 | 1055 | 1064 | 1073 | 1085 | 1086 | 1089 | 1091 | 1092 | 1093 | 1099 | 1112 |
| 1113 | 1116 | 1130 | 1134 | 1136 | 1142 | 1149 | 1153 | 1155 | 1166 | 1167 | 1174 |
| 1188 | 1194 | 1198 | 1199 | 1203 | 1204 | 1219 | 1224 | 1225 | 1229 | 1231 | 1234 |
| 1236 | 1241 | 1243 | 1246 | 1263 | 1264 | 1270 | 1274 | 1281 | 1282 | 1284 | 1303 |
| 1313 | 1316 | 1321 | 1326 | 1329 | 1332 | 1339 | 1341 | 1342 | 1361 | 1372 | 1375 |
| 1414 | 1415 | 1426 | 1428 | 1429 | 1430 | 1431 | 1432 | 1435 | 1458 | 1463 | 1473 |
| 1474 | 1484 | 1489 | 1491 | 1492 | 1494 | 1497 | 1506 | 1507 | 1510 | 1515 | 1518 |
| 1521 | 1526 | 1541 | 1543 | 1554 | 1555 | 1565 | 1568 | 1572 | 1575 | 1576 | 1578 |
| 1580 | 1582 | 1584 | 1588 | 1589 | 1590 | 1591 | 1597 | 1598 | 1603 | 1605 | 1608 |
| 1618 | 1624 | 1625 | 1632 | 1641 | 1642 | 1651 | 1661 | 1669 | 1679 | 1680 | 1681 |
| 1683 | 1684 | 1688 | 1689 | 1696 | 1698 | 1699 | 1702 | 1704 | 1705 | 1706 | 1712 |
| 1719 | 1720 | 1728 | 1737 | 1745 | 1746 | 1749 | 1768 | 1781 | 1785 | 1797 | 1802 |
| 1806 | 1812 | 1814 | 1818 | 1824 | 1834 | 1838 | 1839 | 1841 | 1844 | 1847 | 1854 |
| 1856 | 1860 | 1867 | 1882 | 1883 | 1884 | 1887 | 1896 | 1897 | 1903 | 1904 | 1905 |
| 1908 | 1912 | 1917 | 1918 | 1920 | 1930 | 1933 | 1936 | 1939 | 1952 | 1958 | 1971 |
| 1973 | 2006 | 2006 | 2007 | 2008 | 2013 | 2015 | 2019 | 2027 | 2028 | 2038 | 2055 |
| 2062 | 2068 | 2104 | 2111 | 2115 | 2119 | 2122 | 2123 | 2130 | 2140 | 2147 | 2148 |
| 2154 | 2157 | 2159 | 2164 | 2166 | 2167 | 2168 | 2186 | 2194 | 2202 | 2208 | 2209 |
| 2213 | 2223 | 2229 | 2245 | 2246 | 2251 | 2252 | 2255 | 2260 | 2267 | 2268 | 2283 |
| 2284 | 2285 | 2292 | 2299 | 2311 | 2314 | 2315 | 2319 | 2320 | 2321 | 2322 |
| 2325 | 2327 | 2328 | 2330 | 2359 | 2364 | 2376 | 2427 | 2428 | 2434 | 2438 | 2440 |
| 2443 | 2444 | 2446 | 2453 | 2454 | 2461 | 2470 | 2475 | 2488 | 2489 | 2490 | 2497 |
| 2504 | 2507 | 2510 | 2524 | 2533 | 2546 | 2547 | 2550 | 2551 | 2560 | 2562 | 2564 |
| 2574 | 2578 | 2588 | 2589 | 2598 | 2603 | 2606 | 2615 | 2621 | 2624 | 2625 |
| 2626 | 2627 | 2632 | 2633 | 2635 | 2639 | 2640 | 2644 | 2658 | 2665 | 2666 | 2676 |
| 2679 | 2680 | 2685 | 2687 | 2688 | 2689 | 2691 | 2692 | 2694 | 2695 | 2696 | 2698 |
| 2700 | 2703 | 2706 | 2708 | 2711 | 2715 | 2719 | 2722 | 2725 | 2726 | 2727 | 2728 |
| 2734 | 2735 | 2737 | 2738 | 2745 | 2750 | 2751 | 2752 | 2755 | 2756 | 2759 | 2760 |
| 2761 | 2766 | 2767 | 2771 | 2774 | 2775 | 2777 | 2778 | 2780 | 2781 | 2783 | 2785 |
| 2790 | 2792 | 2795 | 2797 | 2801 | 2803 | 2807 | 2822 | 2823 | 2825 | 2828 | 2833 |
| 2840 | 2842 | 2847 | 2848 | 2852 | 2854 | 2863 | 2864 | 2873 | 2874 | 2879 | 2885 |
| 2889 | 2890 | 2894 | 2901 | 2904 | 2905 | 2909 | 2910 | 2912 | 2913 | 2914 | 2915 |
| 2916 | 2919 | 2920 | 2922 | 2923 | 2924 | 2925 | 2926 | 2928 | 2936 | 2938 | 2943 |
| 2944 | 2945 | 2946 | 2954 | 2959 | 2960 | 2961 | 2963 | 2964 | 2968 | 2970 | 2971 |
| 2972 | 2976 | 2977 | 2979 | 2980 | 2984 | 2985 | 2986 | 2995 | 3002 | 3003 | 3004 |
| 3007 | 3008 | 3009 | 3010 | 3012 | 3020 | 3023 | 3030 | 3031 | 3041 | 3045 | 3052 |
| 3054 | 3055 | 3065 | 3066 | 3067 | 3068 | 3069 | 3080 | 3087 | 3089 | 3100 | 3101 |
| 3103 | 3104 | 3107 | 3109 | 3113 | 3115 | 3124 | 3130 | 3132 | 3136 | 3145 | 3152 |
| 3154 | 3156 | 3176 | 3178 | 3181 | 3186 | 3187 | 3188 | 3189 | 3191 | 3194 | 3197 |
| 3200 | 3201 | 3206 | 3212 | 3213 | 3219 | 3232 | 3233 | 3236 | 3246 | 3248 | 3249 |
| 3251 | 3252 | 3254 | 3265 | 3270 | 3275 | 3285 | 3286 | 3290 | 3299 | 3301 | 3304 |
| 3305 | 3308 | 3309 | 3315 | 3318 | 3319 | 3324 | 3328 | 3334 | 3335 | 3343 | 3345 |
| 3348 | 3351 | 3352 | 3357 | 3358 | 3362 | 3363 | 3381 | 3385 | 3389 | 3392 | 3395 |
| 3396 | 3397 | 3398 | 3399 | 3409 | 3411 | 3414 | 3415 | 3418 | 3419 | 3421 | 3425 |
| 3434 | 3436 | 3438 | 3440 | 3442 | 3454 | 3458 | 3473 | 3478 | 3480 | 3481 | 3487 |

TABLE 15-continued

Yield: Carbohydrate

| | | | | | | | | | | | |
|---|---|---|---|---|---|---|---|---|---|---|---|
| 3490 | 3491 | 3500 | 3515 | 3526 | 3529 | 3531 | 3544 | 3555 | 3560 | 3569 | 3571 |
| 3573 | 3580 | 3588 | 3590 | 3591 | 3600 | 3605 | 3610 | 3621 | 3624 | 3629 | 3636 |
| 3637 | 3639 | 3640 | 3641 | 3643 | 3646 | 3654 | 3657 | 3658 | 3662 | 3665 | 3667 |
| 3671 | 3677 | 3680 | 3682 | 3686 | 3688 | 3695 | 3698 | 3703 | 3709 | 3711 | 3713 |
| 3714 | 3719 | 3724 | 3725 | 3733 | 3738 | 3739 | 3745 | 3746 | 3747 | 3748 | 3750 |
| 3758 | 3762 | 3764 | 3772 | 3774 | 3778 | 3780 | 3784 | 3792 | 3793 | 3794 | 3800 |
| 3805 | 3810 | 3811 | 3815 | 3819 | 3824 | 3834 | 3835 | 3837 | 3846 | 3847 | 3853 |
| 3864 | 3865 | 3866 | 3869 | 3871 | 3876 | 3887 | 3894 | 3895 | 3904 | 3918 | 3920 |
| 3924 | 3929 | 3937 | 3950 | 3951 | 3953 | 3966 | 3967 | 3969 | 3970 | 3973 | 3976 |
| 3978 | 3982 | 3984 | 3986 | 3987 | 4004 | 4006 | 4011 | 4019 | 4022 | 4033 | 4035 |
| 4037 | 4041 | 4044 | 4045 | 4047 | 4048 | 4056 | 4061 | 4077 | 4108 | 4111 | 4113 |
| 4114 | 4115 | 4117 | 4118 | 4123 | 4126 | 4128 | 4129 | 4134 | 4136 | 4137 | 4141 |
| 4142 | 4143 | 4152 | 4153 | 4164 | 4166 | 4168 | 4173 | 4176 | 4178 | 4179 | 4180 |
| 4183 | 4184 | 4186 | 4193 | 4204 | 4206 | 4211 | 4215 | 4218 | 4222 | 4227 | 4228 |
| 4229 | 4233 | 4238 | 4241 | 4242 | 4243 | 4244 | 4246 | 4249 | 4251 | 4252 | 4254 |
| 4255 | 4256 | 4259 | 4261 | 4262 | 4263 | 4266 | 4269 | 4271 | 4276 | 4277 | 4278 |
| 4279 | 4280 | 4282 | 4284 | 4285 | 4286 | 4287 | 4289 | 4291 | 4292 | 4293 | 4294 |
| 4295 | 4296 | 4299 | 4304 | 4305 | 4306 | 4307 | 4308 | 4309 | 4311 | 4314 | 4316 |
| 4318 | 4320 | 4321 | 4325 | 4326 | 4327 | 4329 | 4330 | 4332 | 4336 | 4338 | 4340 |
| 4344 | 4349 | 4355 | 4356 | 4357 | 4358 | 4360 | 4362 | 4363 | 4364 | 4366 | 4367 |
| 4368 | 4373 | 4375 | 4377 | 4379 | 4380 | 4381 | 4382 | 4383 | 4387 | 4390 | 4392 |
| 4401 | 4403 | 4404 | 4405 | 4406 | 4410 | 4411 | 4412 | 4414 | 4424 | 4425 | 4427 |
| 4428 | 4429 | 4437 | 4438 | 4441 | 4446 | 4448 | 4451 | 4452 | 4453 | 4455 | 4457 |
| 4460 | 4461 | 4464 | 4465 | 4466 | 4467 | 4471 | 4473 | 4474 | 4475 | 4479 | 4481 |
| 4483 | 4484 | 4485 | 4486 | 4490 | 4499 | 4502 | 4503 | 4504 | 4505 | 4506 | 4512 |
| 4514 | 4515 | 4517 | 4521 | 4526 | 4530 | 4531 | 4532 | 4534 | 4535 | 4536 | 4541 |
| 4543 | 4546 | 4549 | 4552 | 4553 | 4555 | 4557 | 4558 | 4561 | 4565 | 4568 | 4570 |
| 4572 | 4577 | 4578 | 4581 | 4582 | 4586 | 4594 | 4596 | 4601 | 4603 | 4604 | 4605 |
| 4606 | 4608 | 4609 | 4610 | 4611 | 4612 | 4613 | 4614 | 4618 | 4621 | 4622 | 4624 |
| 4625 | 4626 | 4632 | 4634 | 4635 | 4637 | 4638 | 4639 | 4640 | 4643 | 4644 | 4646 |
| 4647 | 4648 | 4651 | 4652 | 4653 | 4654 | 4656 | 4672 | 4673 | 4674 | 4678 | |
| 4679 | 4681 | 4688 | 4691 | 4693 | 4696 | 4697 | 4699 | 4700 | 4702 | 4704 | 4705 |
| 4706 | 4707 | 4711 | 4712 | 4714 | 4716 | 4719 | 4725 | 4727 | 4731 | 4732 | 4733 |
| 4734 | 4736 | 4739 | 4742 | 4745 | 4746 | 4747 | 4749 | 4750 | 4757 | 4758 | 4762 |
| 4763 | 4766 | 4767 | 4768 | 4771 | 4773 | 4775 | 4776 | 4780 | 4781 | 4785 | 4787 |
| 4788 | 4789 | 4790 | 4793 | 4796 | 4797 | 4799 | 4800 | 4802 | 4803 | 4806 | 4807 |
| 4810 | 4811 | 4812 | 4813 | 4814 | 4818 | 4822 | 4823 | 4830 | 4831 | 4832 | 4834 |
| 4835 | 4836 | 4840 | 4841 | 4842 | 4846 | 4847 | 4848 | 4855 | 4857 | 4860 | 4863 |
| 4865 | 4866 | 4868 | 4869 | 4871 | 4872 | 4875 | 4883 | 4886 | 4887 | 4888 | 4889 |
| 4892 | 4894 | 4899 | 4902 | 4903 | 4907 | 4911 | 4912 | 4913 | 4914 | 4917 | 4923 |
| 4924 | 4928 | 4931 | 4933 | 4935 | 4939 | 4943 | 4944 | 4945 | 4946 | 4947 | 4950 |
| 4951 | 4952 | 4954 | 4958 | 4960 | 4962 | 4964 | 4965 | 4972 | 4977 | 4981 | 4988 |
| 4992 | 4995 | 5003 | 5005 | 5023 | 5027 | 5038 | 5068 | 5081 | 5083 | 5088 | 5090 |
| 5104 | 5116 | 5117 | 5118 | 5120 | 5125 | 5152 | 5153 | 5158 | 5159 | 5172 | 5173 |
| 5180 | 5209 | 5226 | 5233 | 5234 | 5237 | 5257 | 5268 | 5271 | 5281 | 5282 | 5283 |
| 5284 | 5292 | 5293 | 5298 | 5316 | 5318 | 5326 | 5330 | 5334 | 5336 | 5338 | 5339 |
| 5346 | 5363 | 5378 | 5379 | 5394 | 5433 | 5434 | 5437 | 5439 | 5440 | 5441 | 5442 |
| 5453 | 5465 | 5470 | 5471 | 5474 | 5481 | 5490 | 5495 | 5507 | 5516 | 5520 | 5521 |
| 5522 | 5523 | 5524 | 5525 | 5533 | 5534 | 5539 | 5540 | 5543 | 5549 | 5552 | 5566 |
| 5584 | 5588 | 5589 | 5600 | 5602 | 5604 | 5609 | 5610 | 5631 | 5640 | 5646 | 5650 |
| 5656 | 5662 | 5665 | 5669 | 5680 | 5682 | 5692 | 5693 | 5701 | 5706 | 5711 | 5715 |
| 5716 | 5734 | 5735 | 5743 | 5745 | 5752 | 5773 | 5774 | 5780 | 5783 | 5788 | 5791 |
| 5794 | 5796 | 5803 | 5805 | 5806 | 5812 | 5817 | 5838 | 5844 | 5862 | 5863 | 5867 |
| 5868 | 5876 | 5886 | 5901 | 5902 | 5904 | 5910 | 5914 | 5920 | 5922 | 5923 | 5932 |
| 5933 | 5934 | 5946 | 5958 | 5975 | 5978 | 5990 | 5992 | 5993 | 6000 | 6001 | 6002 |
| 6010 | 6011 | 6012 | 6015 | 6023 | 6024 | 6026 | 6027 | 6032 | 6033 | 6034 | 6052 |
| 6062 | 6081 | 6084 | 6089 | 6090 | 6093 | 6104 | 6107 | 6108 | 6112 | 6115 | 6116 |
| 6133 | 6134 | 6143 | 6152 | 6153 | 6154 | 6156 | 6158 | 6159 | 6166 | 6175 | 6177 |
| 6187 | 6189 | 6191 | 6192 | 6197 | 6200 | 6210 | 6214 | 6220 | 6224 | 6231 | 6234 |
| 6239 | 6240 | 6241 | 6244 | 6251 | 6252 | 6263 | 6268 | 6269 | 6271 | 6272 | 6274 |
| 6280 | 6305 | 6353 | 6354 | 6355 | 6356 | 6360 | 6361 | 6369 | 6394 | 6397 | 6413 |
| 6433 | 6435 | 6437 | 6438 | 6441 | 6446 | 6450 | 6458 | 6466 | 6470 | 6471 | 6472 |
| 6473 | 6475 | 6477 | 6479 | 6484 | 6485 | 6489 | 6497 | 6502 | 6503 | 6504 | 6511 |
| 6515 | 6520 | 6524 | 6525 | 6526 | 6542 | 6547 | 6550 | 6551 | 6558 | 6561 | 6562 |
| 6563 | 6567 | 6578 | 6579 | 6581 | 6582 | 6583 | 6594 | 6597 | 6598 | 6606 | 6620 |
| 6625 | 6636 | 6640 | 6641 | 6673 | 6674 | 6693 | 6695 | 6701 | 6714 | 6715 | 6718 |
| 6720 | 6730 | 6732 | 6733 | 6739 | 6743 | 6749 | 6759 | 6768 | 6770 | 6771 | 6780 |
| 6788 | 6806 | 6809 | 6815 | 6819 | 6821 | 6822 | 6823 | 6826 | 6829 | 6830 | 6845 |
| 6870 | 6876 | 6877 | 6902 | 6907 | 6910 | 6912 | 6927 | 6939 | 6970 | 6971 | 6972 |
| 6985 | 6986 | 6990 | 7001 | 7018 | 7026 | 7033 | 7034 | 7035 | 7037 | 7039 | 7040 |
| 7041 | 7043 | 7045 | 7047 | 7048 | 7049 | 7050 | 7051 | 7052 | 7053 | 7055 | 7060 |
| 7061 | 7062 | 7063 | 7064 | 7065 | 7067 | 7070 | 7072 | 7074 | 7076 | 7077 | 7081 |
| 7082 | 7083 | 7085 | 7086 | 7088 | 7093 | 7095 | 7099 | 7102 | 7104 | 7109 | 7110 |
| 7111 | 7112 | 7114 | 7116 | 7117 | 7118 | 7120 | 7121 | 7122 | 7127 | 7129 | 7131 |
| 7133 | 7134 | 7135 | 7137 | 7138 | 7140 | 7142 | 7145 | 7147 | 7156 | 7158 | 7159 |
| 7160 | 7162 | 7166 | 7167 | 7168 | 7170 | 7182 | 7183 | 7185 | 7186 | 7187 | 7193 |
| 7196 | 7197 | 7200 | 7205 | 7207 | 7211 | 7212 | 7213 | 7217 | 7220 | 7221 | 7224 |

TABLE 15-continued

Yield: Carbohydrate

| | | | | | | | | | | | |
|---|---|---|---|---|---|---|---|---|---|---|---|
| 7225 | 7226 | 7227 | 7231 | 7233 | 7234 | 7238 | 7240 | 7242 | 7243 | 7244 | 7245 |
| 7249 | 7258 | 7261 | 7262 | 7263 | 7264 | 7270 | 7272 | 7274 | 7276 | 7280 | 7285 |
| 7288 | 7289 | 7290 | 7292 | 7293 | 7294 | 7299 | 7301 | 7304 | 7309 | 7310 | 7312 |
| 7314 | 7315 | 7319 | 7323 | 7325 | 7327 | 7329 | 7334 | 7335 | 7338 | 7339 | 7343 |
| 7351 | 7353 | 7358 | 7360 | 7361 | 7362 | 7363 | 7365 | 7366 | 7367 | 7368 | 7369 |
| 7370 | 7371 | 7375 | 7379 | 7382 | 7383 | 7384 | 7389 | 7390 | 7392 | 7393 | 7395 |
| 7396 | 7397 | 7398 | 7401 | 7402 | 7404 | 7405 | 7406 | 7409 | 7410 | 7411 | 7412 |
| 7414 | 7417 | 7431 | 7432 | 7433 | 7437 | 7438 | 7440 | 7447 | 7450 | 7454 | 7455 |
| 7457 | 7458 | 7460 | 7462 | 7463 | 7465 | 7466 | 7470 | 7471 | 7472 | 7475 | 7478 |
| 7484 | 7485 | 7486 | 7491 | 7492 | 7493 | 7494 | 7495 | 7498 | 7502 | 7505 | 7506 |
| 7507 | 7509 | 7516 | 7517 | 7521 | 7523 | 7526 | 7527 | 7528 | 7531 | 7533 | 7535 |
| 7536 | 7540 | 7541 | 7545 | 7547 | 7548 | 7549 | 7550 | 7553 | 7556 | 7558 | 7559 |
| 7561 | 7562 | 7565 | 7566 | 7569 | 7570 | 7571 | 7572 | 7573 | 7577 | 7581 | 7582 |
| 7589 | 7590 | 7591 | 7593 | 7594 | 7595 | 7599 | 7600 | 7601 | 7605 | 7606 | 7607 |
| 7614 | 7616 | 7619 | 7622 | 7624 | 7625 | 7627 | 7628 | 7629 | 7631 | 7632 | 7635 |
| 7641 | 7644 | 7645 | 7646 | 7647 | 7650 | 7652 | 7657 | 7660 | 7661 | 7665 | 7669 |
| 7670 | 7671 | 7672 | 7675 | 7681 | 7682 | 7686 | 7689 | 7691 | 7693 | 7697 | 7701 |
| 7702 | 7703 | 7704 | 7705 | 7708 | 7709 | 7710 | 7712 | 7718 | 7720 | 7722 | |
| 7723 | 7729 | 7730 | 7732 | 7738 | 7745 | 7752 | 7753 | 7754 | 7755 | 7758 | 7759 |
| 7760 | 7762 | 7764 | 7765 | 7766 | 7768 | 7769 | 7773 | 7775 | 7778 | 7781 | 7783 |
| 7784 | 7787 | 7788 | 7791 | 7794 | 7796 | 7806 | 7809 | 7810 | 7813 | 7817 | 7818 |
| 7822 | 7824 | 7825 | 7833 | 7835 | 7836 | 7837 | 7838 | 7839 | 7843 | 7844 | 7846 |
| 7852 | 7859 | 7863 | 7864 | 7869 | 7870 | 7875 | 7877 | 7879 | 7881 | 7882 | 7883 |
| 7884 | 7885 | 7897 | 7901 | 7904 | 7905 | 7906 | 7909 | 7918 | 7920 | 7923 | 7925 |
| 7927 | 7928 | 7930 | 7933 | 7934 | 7935 | 7936 | 7937 | 7938 | 7940 | 7942 | 7943 |
| 7945 | 7946 | 7947 | 7948 | 7952 | 7956 | 7957 | 7962 | 7963 | 7969 | 7970 | 7972 |
| 7973 | 7974 | 7975 | 7976 | 7977 | 7984 | 7985 | 7991 | 7994 | 7995 | 8001 | 8002 |
| 8003 | 8004 | 8005 | 8008 | 8009 | 8011 | 8012 | 8013 | 8014 | 8015 | 8016 | 8017 |
| 8018 | 8021 | 8022 | 8024 | 8026 | 8027 | 8030 | 8031 | 8032 | 8034 | 8036 | 8037 |
| 8039 | 8041 | 8045 | 8049 | 8052 | 8054 | 8055 | 8056 | 8063 | 8068 | 8071 | 8072 |
| 8078 | 8084 | 8085 | 8088 | 8092 | 8098 | 8108 | 8109 | 8111 | 8112 | 8113 | 8114 |
| 8115 | 8117 | 8119 | 8120 | 8122 | 8123 | 8124 | 8126 | 8127 | 8128 | 8129 | 8139 |
| 8144 | 8145 | 8147 | 8150 | 8157 | 8158 | 8159 | 8160 | 8162 | 8166 | 8167 | 8170 |
| 8175 | 8180 | 8181 | 8182 | 8183 | 8184 | 8186 | 8187 | 8188 | 8189 | 8195 | 8206 |
| 8207 | 8208 | 8209 | 8212 | 8218 | 8219 | 8222 | 8228 | 8232 | 8235 | 8238 | 8241 |
| 8243 | 8244 | 8245 | 8247 | 8250 | 8251 | 8253 | 8254 | 8262 | 8263 | 8265 | 8268 |
| 8270 | 8271 | 8272 | 8273 | 8274 | 8276 | 8277 | 8283 | 8286 | 8287 | 8290 | 8294 |
| 8295 | 8296 | 8299 | 8305 | 8306 | 8307 | 8309 | 8312 | 8314 | 8321 | 8324 | 8326 |
| 8328 | 8335 | 8337 | 8340 | 8341 | 8342 | 8344 | 8345 | 8346 | 8347 | 8354 | 8355 |
| 8356 | 8357 | 8359 | 8361 | 8365 | 8368 | 8370 | 8371 | 8372 | 8377 | 8379 | 8383 |
| 8384 | 8385 | 8387 | 8391 | 8392 | 8394 | 8396 | 8398 | 8401 | 8404 | 8406 | 8407 |
| 8408 | 8409 | 8411 | 8412 | 8413 | 8414 | 8416 | 8417 | 8425 | 8426 | 8430 | 8432 |
| 8438 | 8442 | 8443 | 8444 | 8446 | 8449 | 8452 | 8458 | 8464 | 8466 | 8467 | 8468 |
| 8469 | 8471 | 8472 | 8483 | 8484 | 8485 | 8486 | 8492 | 8493 | 8494 | 8498 | 8499 |
| 8500 | 8508 | 8512 | 8513 | 8514 | 8515 | 8516 | 8517 | 8521 | 8522 | 8523 | 8524 |
| 8526 | 8528 | 8531 | 8534 | 8539 | 8546 | 8551 | 8552 | 8556 | 8557 | 8564 | 8566 |
| 8567 | 8569 | 8571 | 8572 | 8573 | 8574 | 8578 | 8579 | 8586 | 8587 | 8588 | 8593 |
| 8595 | 8612 | 8614 | 8616 | 8618 | 8619 | 8621 | 8625 | 8627 | 8633 | 8634 | 8645 |
| 8646 | 8651 | 8652 | 8653 | 8654 | 8655 | 8664 | 8667 | 8672 | 8679 | 8683 | 8686 |
| 8688 | 8691 | 8692 | 8693 | 8701 | 8702 | 8706 | 8707 | 8708 | 8712 | 8715 | 8718 |
| 8720 | 8723 | 8728 | 8729 | 8730 | 8731 | 8732 | 8733 | 8734 | 8738 | 8741 | 8742 |
| 8747 | 8748 | 8752 | 8755 | 8762 | 8763 | 8765 | 8766 | 8767 | 8768 | 8769 | 8770 |
| 8774 | 8777 | 8780 | 8781 | 8782 | 8783 | 8793 | 8795 | 8796 | 8802 | 8803 | 8814 |
| 8816 | 8817 | 8819 | 8821 | 8827 | 8828 | 8830 | 8831 | 8832 | 8833 | 8834 | 8847 |
| 8848 | 8850 | 8853 | 8855 | 8860 | 8861 | 8862 | 8864 | 8866 | 8870 | 8871 | 8875 |
| 8876 | 8882 | 8885 | 8890 | 8893 | 8894 | 8895 | 8896 | 8899 | 8900 | 8901 | 8909 |
| 8910 | 8916 | 8917 | 8919 | 8921 | 8923 | 8924 | 8925 | 8927 | 8928 | 8929 | 8931 |
| 8933 | 8934 | 8938 | 8939 | 8940 | 8943 | 8947 | 8958 | 8960 | 8964 | 8965 | 8966 |
| 8973 | 8974 | 8980 | 8981 | 8983 | 8984 | 8985 | 8987 | 8998 | 8999 | 9000 | 9001 |
| 9002 | 9006 | 9012 | 9013 | 9014 | 9015 | 9016 | 9017 | 9018 | 9019 | 9021 | 9022 |
| 9027 | 9028 | 9029 | 9031 | 9035 | 9041 | 9045 | 9046 | 9047 | 9048 | 9051 | 9056 |
| 9058 | 9059 | 9062 | 9063 | 9068 | 9069 | 9072 | 9073 | 9076 | 9078 | 9080 | 9089 |
| 9096 | 9097 | 9104 | 9105 | 9106 | 9109 | 9110 | 9111 | 9114 | 9116 | 9118 | 9132 |
| 9133 | 9136 | 9139 | 9145 | 9147 | 9148 | 9149 | 9151 | 9153 | 9154 | 9156 | |
| 9163 | 9164 | 9165 | 9167 | 9170 | 9171 | 9173 | 9176 | 9177 | 9179 | 9186 | 9192 |
| 9200 | 9201 | 9208 | 9216 | 9218 | 9220 | 9225 | 9229 | 9233 | 9234 | 9235 | 9236 |
| 9238 | 9242 | 9243 | 9244 | 9245 | 9249 | 9254 | 9255 | 9262 | 9264 | 9265 | 9266 |
| 9267 | 9269 | 9270 | 9271 | 9273 | 9274 | 9291 | 9292 | 9293 | 9294 | 9295 | 9296 |
| 9300 | 9304 | 9308 | 9312 | 9323 | 9324 | 9325 | 9326 | 9330 | 9332 | 9333 | 9335 |
| 9348 | 9349 | 9358 | 9361 | 9363 | 9364 | 9368 | 9369 | 9372 | 9373 | 9376 | 9377 |
| 9381 | 9383 | 9387 | 9396 | 9401 | 9405 | 9406 | 9408 | 9410 | 9413 | 9414 | 9418 |
| 9423 | 9424 | 9425 | 9429 | 9434 | 9437 | 9439 | 9440 | 9454 | 9456 | 9463 | 9465 |
| 9466 | 9469 | 9473 | 9475 | 9476 | 9477 | 9483 | 9485 | 9487 | 9489 | 9490 | 9491 |
| 9492 | 9494 | 9495 | 9501 | 9511 | 9514 | 9515 | 9516 | 9517 | 9519 | 9531 | 9542 |
| 9544 | 9547 | 9549 | 9551 | 9554 | 9556 | 9560 | 9563 | 9565 | 9566 | 9569 | 9570 |
| 9574 | 9576 | 9578 | 9579 | 9582 | 9589 | 9592 | 9594 | 9595 | 9598 | 9602 | 9603 |
| 9608 | 9613 | 9614 | 9615 | 9619 | 9620 | 9624 | 9625 | 9627 | 9631 | 9632 | 9633 |

TABLE 15-continued

Yield: Carbohydrate

| | | | | | | | | | | |
|---|---|---|---|---|---|---|---|---|---|---|
| 9636 | 9645 | 9649 | 9650 | 9652 | 9653 | 9669 | 9671 | 9675 | 9681 | 9685 | 9704 |
| 9709 | 9712 | 9713 | 9715 | 9720 | 9725 | 9736 | 9737 | 9738 | 9743 | 9748 | 9759 |
| 9764 | 9766 | 9772 | 9774 | 9776 | 9787 | 9788 | 9789 | 9790 | 9829 | 9831 | 9840 |
| 9851 | 9858 | 9861 | 9863 | 9864 | 9865 | 9866 | 9868 | 9869 | 9876 | 9884 | 9888 |
| 9891 | 9892 | 9893 | 9894 | 9895 | 9896 | 9897 | 9898 | 9909 | 9910 | 9916 | 9920 |
| 9922 | 9926 | 9927 | 9929 | 9935 | 9936 | 9945 | 9946 | 9950 | 9958 | 9960 | 9965 |
| 9968 | 9969 | 9970 | 9976 | 9984 | 9985 | 9987 | 9988 | 9989 | 9990 | 9991 | 9993 |
| 9994 | 9995 | 10002 | 10003 | 10004 | 10005 | 10007 | 10009 | 10010 | 10016 | 10017 | 10019 |
| 10020 | 10021 | 10022 | 10023 | 10024 | 10034 | 10035 | 10037 | 10038 | 10039 | 10042 | 10045 |
| 10047 | 10050 | 10052 | 10053 | 10059 | 10060 | 10061 | 10064 | 10079 | 10084 | 10100 | 10104 |
| 10132 | 10133 | 10136 | 10141 | 10142 | 10144 | 10154 | 10158 | 10164 | 10165 | 10175 | 10179 |
| 10181 | 10182 | 10194 | 10195 | 10197 | 10198 | 10199 | 10200 | 10203 | 10204 | 10205 | 10209 |
| 10214 | 10216 | 10224 | 10225 | 10227 | 10230 | 10231 | 10232 | 10233 | 10234 | 10235 | 10237 |
| 10241 | 10245 | 10246 | 10248 | 10250 | 10253 | 10257 | 10259 | 10260 | 10261 | 10263 | 10264 |
| 10267 | 10268 | 10272 | 10273 | 10279 | 10281 | 10282 | 10283 | 10285 | 10293 | 10296 | 10307 |
| 10309 | 10310 | 10312 | 10325 | 10327 | 10331 | 10337 | 10342 | 10343 | 10344 | 10346 | 10350 |
| 10354 | 10355 | 10361 | 10367 | 10369 | 10374 | 10375 | 10382 | 10384 | 10386 | 10388 | 10395 |
| 10397 | 10399 | 10401 | 10405 | 10406 | 10407 | 10409 | 10410 | 10411 | 10413 | 10415 | 10420 |
| 10422 | 10424 | 10425 | 10427 | 10430 | 10434 | 10435 | 10451 | 10453 | 10460 | 10463 | 10465 |
| 10466 | 10468 | 10469 | 10473 | 10474 | 10477 | 10481 | 10486 | 10488 | 10494 | 10497 | 10499 |
| 10500 | 10501 | 10503 | 10505 | 10509 | 10510 | 10511 | 10516 | 10517 | 10519 | 10520 | 10522 |
| 10523 | 10524 | 10525 | 10526 | 10527 | 10528 | 10531 | 10536 | 10538 | 10540 | 10541 | 10542 |
| 10546 | 10548 | 10551 | 10552 | 10553 | 10556 | 10557 | 10560 | 10561 | 10565 | 10569 | 10571 |
| 10572 | 10573 | 10574 | 10575 | 10577 | 10578 | 10580 | 10581 | 10584 | 10587 | 10588 | 10589 |
| 10590 | 10592 | 10594 | 10596 | 10597 | 10601 | 10602 | 10603 | 10605 | 10611 | 10612 | 10614 |
| 10615 | 10616 | 10627 | 10628 | 10629 | 10630 | 10632 | 10636 | 10641 | 10642 | 10651 | 10652 |
| 10653 | 10654 | 10655 | 10656 | 10657 | 10658 | 10659 | 10660 | 10661 | 10662 | 10663 | 10664 |
| 10665 | 10667 | 10668 | 10674 | 10679 | 10681 | 10682 | 10683 | 10684 | 10689 | 10694 | 10695 |
| 10697 | 10698 | 10700 | 10703 | 10709 | 10710 | 10711 | 10712 | 10713 | 10714 | 10716 | 10718 |
| 10719 | 10720 | 10721 | 10722 | 10723 | 10725 | 10726 | 10727 | 10728 | 10729 | 10731 | 10732 |
| 10733 | 10736 | 10737 | 10738 | 10739 | 10740 | 10742 | 10744 | 10747 | 10748 | 10749 | 10751 |
| 10752 | 10753 | 10758 | 10759 | 10760 | 10761 | 10762 | 10764 | 10765 | 10766 | 10770 | 10771 |
| 10772 | 10774 | 10775 | 10777 | 10784 | 10787 | 10797 | 10798 | 10807 | 10810 | 10811 | 10812 |
| 10815 | 10819 | 10821 | 10823 | 10824 | 10826 | 10828 | 10829 | 10830 | 10831 | 10836 | 10837 |
| 10841 | 10842 | 10844 | 10849 | 10851 | 10852 | 10855 | 10857 | 10859 | 10861 | 10869 | 10882 |
| 10886 | 10888 | 10889 | 10890 | 10895 | 10897 | 10898 | 10900 | 10901 | 10902 | 10906 | 10908 |
| 10913 | 10915 | 10916 | 10920 | 10921 | 10925 | 10927 | 10928 | 10930 | 10931 | 10932 | 10933 |
| 10944 | 10949 | 10950 | 10951 | 10956 | 10957 | 10962 | 10967 | 10968 | 10969 | 10970 | 10971 |
| 10972 | 10974 | 10977 | 10981 | 10982 | 10984 | 10992 | 10993 | 10994 | 10995 | 10997 | 10998 |
| 11000 | 11002 | 11003 | 11004 | 11009 | 11010 | 11012 | 11013 | 11017 | 11021 | 11034 | 11035 |
| 11036 | 11037 | 11041 | 11053 | 11054 | 11057 | 11061 | 11064 | 11065 | 11072 | 11075 | 11079 |
| 11084 | 11085 | 11091 | 11097 | 11099 | 11121 | 11122 | 11124 | 11130 | 11134 | 11135 | 11147 |
| 11157 | 11162 | 11169 | 11172 | 11174 | 11184 | 11186 | 11188 | 11190 | 11192 | 11194 |
| 11195 | 11201 | 11217 | 11218 | 11219 | 11223 | 11225 | 11234 | 11240 | 11242 | 11247 | 11248 |
| 11249 | 11259 | 11264 | 11265 | 11273 | 11281 | 11288 | 11298 | 11301 | 11304 | 11309 | 11312 |
| 11317 | 11318 | 11331 | 11332 | 11336 | 11337 | 11338 | 11344 | 11349 | 11350 | 11357 | 11360 |
| 11362 | 11369 | 11372 | 11373 | 11374 | 11375 | 11376 | 11377 | 11378 | 11381 | 11382 | 11384 |
| 11385 | 11387 | 11388 | 11394 | 11396 | 11397 | 11399 | 11400 | 11401 | 11402 | 11404 | 11406 |
| 11407 | 11409 | 11420 | 11422 | 11424 | 11427 | 11428 | 11429 | 11436 | 11437 | 11438 | 11439 |
| 11440 | 11441 | 11442 | 11443 | 11446 | 11450 | 11452 | 11453 | 11455 | 11456 | 11458 | 11462 |
| 11467 | 11471 | 11474 | 11475 | 11477 | 11478 | 11482 | 11484 | 11486 | 11489 | 11491 | 11492 |
| 11493 | 11494 | 11496 | 11497 | 11501 | 11502 | 11503 | 11504 | 11507 | 11514 | 11516 | 11519 |
| 11520 | 11521 | 11522 | 11523 | 11524 | 11525 | 11526 | 11528 | 11531 | 11532 | 11537 | 11546 |
| 11547 | 11548 | 11550 | 11551 | 11557 | 11558 | 11559 | 11560 | 11564 | 11572 | 11578 | 11579 |
| 11583 | 11585 | 11589 | 11591 | 11594 | 11595 | 11597 | 11598 | 11599 | 11601 | 11603 | 11606 |
| 11608 | 11609 | 11610 | 11613 | 11617 | 11620 | 11626 | 11628 | 11629 | 11631 | 11633 | 11635 |
| 11637 | 11639 | 11640 | 11641 | 11642 | 11643 | 11649 | 11650 | 11651 | 11655 | 11657 | 11661 |
| 11665 | 11666 | 11668 | 11670 | 11671 | 11672 | 11673 | 11674 | 11675 | 11676 | 11677 | 11679 |
| 11680 | 11686 | 11687 | 11692 | 11693 | 11694 | 11695 | 11696 | 11698 | 11701 | 11702 | 11703 |
| 11705 | 11707 | 11711 | 11717 | 11721 | 11723 | 11724 | 11725 | 11726 | 11727 | 11728 | 11731 |
| 11735 | 11737 | 11740 | 11741 | 11744 | 11745 | 11750 | 11751 | 11755 | 11757 | 11761 | 11767 |
| 11768 | 11773 | 11779 | 11780 | 11782 | 11783 | 11788 | 11793 | 11794 | 11799 | 11803 | 11809 |
| 11817 | 11819 | 11820 | 11821 | 11822 | 11823 | 11826 | 11828 | 11832 | 11833 | 11836 | 11837 |
| 11838 | 11839 | 11842 | 11847 | 11855 | 11856 | 11862 | 11863 | 11864 | 11874 | 11875 | 11880 |
| 11881 | 11882 | 11886 | 11888 | 11889 | 11893 | 11895 | 11896 | 11898 | 11900 | 11901 | 11902 |
| 11906 | 11907 | 11909 | 11912 | 11913 | 11915 | 11918 | 11919 | 11923 | 11927 | 11928 | 11931 |
| 11942 | 11943 | 11944 | 11945 | 11948 | 11952 | 11955 | 11957 | 11958 | 11961 | 11962 | 11964 |
| 11965 | 11966 | 11969 | 11971 | 11977 | 11979 | 11981 | 11990 | 11992 | 11995 | 11997 | 11998 |
| 11999 | 12000 | 12001 | 12010 | 12011 | 12012 | 12015 | 12017 | 12018 | 12019 | 12022 | 12027 |
| 12030 | 12031 | 12032 | 12037 | 12038 | 12039 | 12040 | 12041 | 12043 | 12044 | 12047 | 12048 |
| 12049 | 12052 | 12053 | 12054 | 12055 | 12056 | 12057 | 12058 | 12059 | 12060 | 12063 | 12067 |
| 12068 | 12069 | 12070 | 12082 | 12085 | 12091 | 12092 | 12096 | 12097 | 12098 | 12101 | 12106 |
| 12111 | 12112 | 12119 | 12120 | 12121 | 12122 | 12124 | 12125 | 12126 | 12127 | 12128 | 12137 |
| 12139 | 12142 | 12148 | 12149 | 12151 | 12152 | 12155 | 12162 | 12165 | 12168 | 12169 | 12172 |
| 12173 | 12176 | 12178 | 12180 | 12181 | 12191 | 12192 | 12193 | 12195 | 12199 | 12213 | 12214 |
| 12215 | 12218 | 12219 | 12223 | 12225 | 12227 | 12229 | 12237 | 12238 | 12240 | 12242 | 12245 |
| 12251 | 12252 | 12253 | 12254 | 12255 | 12258 | 12267 | 12268 | 12269 | 12270 | 12271 | 12275 |

TABLE 15-continued

Yield: Carbohydrate

| | | | | | | | | | | | |
|---|---|---|---|---|---|---|---|---|---|---|---|
| 12276 | 12277 | 12280 | 12281 | 12285 | 12287 | 12288 | 12293 | 12294 | 12295 | 12297 | 12298 |
| 12299 | 12300 | 12301 | 12302 | 12303 | 12304 | 12305 | 12308 | 12309 | 12310 | 12318 | 12319 |
| 12320 | 12321 | 12322 | 12323 | 12327 | 12328 | 12341 | 12343 | 12350 | 12351 | 12352 | 12356 |
| 12368 | 12370 | 12373 | 12375 | 12376 | 12382 | 12384 | 12388 | 12395 | 12398 | 12402 | 12403 |
| 12404 | 12413 | 12416 | 12417 | 12418 | 12427 | 12428 | 12433 | 12435 | 12436 | 12437 | 12438 |
| 12439 | 12440 | 12446 | 12448 | 12449 | 12450 | 12454 | 12457 | 12458 | 12461 | 12463 | 12467 |
| 12469 | 12471 | 12472 | 12478 | 12480 | 12483 | 12484 | 12486 | 12491 | 12499 | 12500 | 12501 |
| 12517 | 12522 | 12524 | 12526 | 12528 | 12529 | 12532 | 12533 | 12535 | 12536 | 12538 | 12541 |
| 12542 | 12548 | 12554 | 12558 | 12559 | 12565 | 12567 | 12569 | 12570 | 12574 | 12575 | 12577 |
| 12581 | 12590 | 12592 | 12593 | 12597 | 12599 | 12602 | 12607 | 12609 | 12614 | 12618 | 12620 |
| 12626 | 12627 | 12629 | 12630 | 12640 | 12645 | 12657 | 12658 | 12661 | 12666 | 12672 | 12673 |
| 12677 | 12678 | 12682 | 12686 | 12688 | 12695 | 12697 | 12698 | 12700 | 12703 | 12704 | 12706 |
| 12711 | 12712 | 12716 | 12720 | 12722 | 12723 | 12725 | 12730 | 12738 | 12742 | 12743 | 12744 |
| 12751 | 12753 | 12754 | 12755 | 12761 | 12763 | 12765 | 12766 | 12769 | 12773 | 12774 | 12780 |
| 12783 | 12786 | 12788 | 12789 | 12793 | 12797 | 12803 | 12804 | 12806 | 12807 | 12810 | 12812 |
| 12817 | 12821 | 12824 | 12825 | 12830 | 12833 | 12840 | 12845 | 12846 | 12850 | 12854 | 12855 |
| 12860 | 12868 | 12869 | 12872 | 12879 | 12889 | 12890 | 12904 | 12908 | 12910 | 12914 | 12915 |
| 12918 | 12922 | 12923 | 12925 | 12928 | 12931 | 12932 | 12935 | 12939 | 12942 | 12945 | 12946 |
| 12947 | 12949 | 12951 | 12956 | 12957 | 12959 | 12960 | 12963 | 12966 | 12968 | 12971 | 12976 |
| 12977 | 12978 | 12980 | 12984 | 12986 | 12987 | 12992 | 12997 | 12999 | 13000 | 13002 | 13006 |
| 13007 | 13008 | 13018 | 13020 | 13022 | 13023 | 13027 | 13028 | 13030 | 13031 | 13033 | 13035 |
| 13036 | 13042 | 13044 | 13045 | 13047 | 13048 | 13050 | 13051 | 13056 | 13059 | 13065 | 13067 |
| 13069 | 13078 | 13086 | 13089 | 13091 | 13094 | 13103 | 13105 | 13107 | 13109 | 13122 | 13123 |
| 13128 | 13129 | 13139 | 13140 | 13141 | 13144 | 13154 | 13155 | 13163 | 13168 | 13173 | 13178 |
| 13185 | 13187 | 13201 | 13206 | 13210 | 13221 | 13222 | 13226 | 13234 | 13237 | 13249 | 13251 |
| 13252 | 13253 | 13255 | 13259 | 13262 | 13263 | 13279 | 13281 | 13284 | 13302 | 13303 | 13307 |
| 13308 | 13311 | 13321 | 13325 | 13329 | 13330 | 13336 | 13340 | 13347 | 13350 | 13351 | 13352 |
| 13353 | 13354 | 13355 | 13359 | 13361 | 13366 | 13370 | 13391 | 13395 | 13405 | 13422 | 13423 |
| 13424 | 13426 | 13430 | 13431 | 13433 | 13437 | 13438 | 13440 | 13443 | 13444 | 13447 | 13456 |
| 13458 | 13460 | 13461 | 13462 | 13463 | 13464 | 13465 | 13466 | 13467 | 13471 | 13472 | 13473 |
| 13474 | 13475 | 13478 | 13480 | 13484 | 13485 | 13493 | 13497 | 13502 | 13508 | 13509 | 13515 |
| 13516 | 13522 | 13523 | 13525 | 13530 | 13531 | 13535 | 13536 | 13550 | 13551 | 13560 | 13561 |
| 13569 | 13570 | 13571 | 13575 | 13577 | 13579 | 13585 | 13592 | 13593 | 13594 | 13599 | 13603 |
| 13604 | 13606 | 13607 | 13610 | 13615 | 13617 | 13622 | 13626 | 13627 | 13629 | 13634 | 13636 |
| 13639 | 13640 | 13642 | 13646 | 13648 | 13654 | 13655 | 13663 | 13664 | 13665 | 13667 | 13672 |
| 13673 | 13674 | 13675 | 13676 | 13677 | 13678 | 13685 | 13686 | 13689 | 13692 | 13695 | 13696 |
| 13702 | 13705 | 13706 | 13716 | 13718 | 13721 | 13725 | 13726 | 13733 | 13734 | 13736 | 13738 |
| 13740 | 13743 | 13745 | 13746 | 13747 | 13748 | 13751 | 13752 | 13755 | 13761 | 13769 | 13772 |
| 13773 | 13777 | 13779 | 13783 | 13784 | 13785 | 13790 | 13793 | 13794 | 13796 | 13799 | 13800 |
| 13807 | 13812 | 13815 | 13818 | 13819 | 13824 | 13826 | 13827 | 13828 | 13831 | 13832 | 13841 |
| 13848 | 13849 | 13856 | 13860 | 13861 | 13862 | 13864 | 13865 | 13868 | 13869 | 13870 | 13871 |
| 13872 | 13873 | 13874 | 13875 | 13876 | 13877 | 13878 | 13880 | 13885 | 13886 | 13887 | 13890 |
| 13892 | 13893 | 13894 | 13895 | 13900 | 13903 | 13904 | 13905 | 13909 | 13912 | 13915 | 13917 |
| 13919 | 13921 | 13922 | 13925 | 13928 | 13929 | 13931 | 13935 | 13942 | 13944 | 13951 | 13952 |
| 13953 | 13957 | 13960 | 13963 | 13964 | 13968 | 13970 | 13973 | 13975 | 13984 | 13985 | 13986 |
| 13993 | 14000 | 14005 | 14008 | 14010 | 14011 | 14014 | 14017 | 14019 | 14022 | 14032 | 14033 |
| 14034 | 14035 | 14036 | 14038 | 14039 | 14041 | 14044 | 14051 | 14058 | 14067 | 14068 | 14073 |
| 14078 | 14079 | 14081 | 14083 | 14084 | 14085 | 14086 | 14089 | 14093 | 14095 | 14101 | 14102 |
| 14103 | 14104 | 14107 | 14110 | 14113 | 14114 | 14115 | 14116 | 14119 | 14120 | 14121 | 14122 |
| 14128 | 14129 | 14130 | 14132 | 14136 | 14137 | 14139 | 14140 | 14142 | 14143 | 14144 | 14150 |
| 14151 | 14157 | 14158 | 14159 | 14160 | 14164 | 14165 | 14167 | 14173 | 14174 | 14180 | 14182 |
| 14185 | 14189 | 14192 | 14193 | 14196 | 14197 | 14199 | 14201 | 14204 | 14205 | 14209 | 14210 |
| 14211 | 14214 | 14215 | 14219 | 14220 | 14221 | 14222 | 14225 | 14226 | 14230 | 14231 | 14232 |
| 14236 | 14245 | 14251 | 14254 | 14256 | 14257 | 14258 | 14260 | 14262 | 14264 | 14266 | 14268 |
| 14269 | 14273 | 14276 | 14280 | 14281 | 14284 | 14285 | 14286 | 14287 | 14289 | 14291 | 14297 |
| 14298 | 14299 | 14300 | 14302 | 14303 | 14304 | 14306 | 14308 | 14310 | 14312 | 14314 | 14316 |
| 14321 | 14322 | 14324 | 14325 | 14326 | 14327 | 14328 | 14329 | 14338 | 14343 | 14344 | 14345 |
| 14349 | 14352 | 14355 | 14356 | 14357 | 14359 | 14361 | 14364 | 14365 | 14366 | 14369 | 14370 |
| 14375 | 14376 | 14382 | 14386 | 14389 | 14394 | 14398 | 14399 | 14401 | 14405 | 14406 | 14408 |
| 14410 | 14412 | 14413 | 14416 | 14417 | 14422 | 14423 | 14424 | 14427 | 14428 | 14429 | 14432 |
| 14437 | 14439 | 14440 | 14444 | 14445 | 14447 | 14450 | 14454 | 14455 | 14463 | 14468 | 14469 |
| 14476 | 14478 | 14480 | 14485 | 14486 | 14488 | 14489 | 14490 | 14491 | 14492 | 14496 | 14497 |
| 14500 | 14502 | 14503 | 14509 | 14510 | 14512 | 14525 | 14526 | 14527 | 14530 | 14533 | 14534 |
| 14535 | 14538 | 14545 | 14549 | 14551 | 14555 | 14559 | 14560 | 14562 | 14563 | 14564 | 14565 |
| 14569 | 14571 | 14573 | 14576 | 14577 | 14584 | 14585 | 14586 | 14587 | 14588 | 14589 | 14591 |
| 14592 | 14597 | 14604 | 14608 | 14611 | 14612 | 14613 | 14614 | 14617 | 14618 | 14619 | 14620 |
| 14624 | 14626 | 14630 | 14631 | 14633 | 14634 | 14636 | 14637 | 14638 | 14639 | 14640 | 14641 |
| 14642 | 14643 | 14646 | 14651 | 14654 | 14658 | 14660 | 14662 | 14665 | 14667 | 14680 |
| 14681 | 14682 | 14683 | 14684 | 14688 | 14691 | 14692 | 14694 | 14695 | 14697 | 14698 | 14702 |
| 14703 | 14705 | 14706 | 14709 | 14712 | 14715 | 14716 | 14717 | 14719 | 14720 | 14724 | 14728 |
| 14731 | 14733 | 14734 | 14735 | 14736 | 14737 | 14738 | 14739 | 14741 | 14743 | 14744 | 14748 |
| 14755 | 14757 | 14765 | 14766 | 14770 | 14773 | 14777 | 14778 | 14779 | 14780 | 14781 | 14782 |
| 14783 | 14784 | 14790 | 14791 | 14793 | 14802 | 14803 | 14806 | 14808 | 14809 | 14814 | 14817 |
| 14819 | 14820 | 14821 | 14823 | 14825 | 14826 | 14827 | 14828 | 14829 | 14831 | 14833 | 14834 |
| 14835 | 14836 | 14837 | 14838 | 14839 | 14842 | 14843 | 14845 | 14852 | 14855 | 14858 | 14859 |
| 14860 | 14861 | 14865 | 14870 | 14872 | 14873 | 14874 | 14875 | 14876 | 14877 | 14878 | 14880 |
| 14882 | 14886 | 14888 | 14889 | 14893 | 14895 | 14896 | 14898 | 14900 | 14904 | 14908 | 14915 |

TABLE 15-continued

Yield: Carbohydrate

| | | | | | | | | | | | |
|---|---|---|---|---|---|---|---|---|---|---|---|
| 14920 | 14927 | 14930 | 14931 | 14932 | 14933 | 14934 | 14935 | 14936 | 14937 | 14938 | 14939 |
| 14940 | 14941 | 14942 | 14943 | 14944 | 14952 | 14955 | 14957 | 14958 | 14959 | 14971 | 14976 |
| 14979 | 14982 | 14985 | 14988 | 14994 | 14997 | 15001 | 15002 | 15005 | 15006 | 15008 | 15009 |
| 15010 | 15011 | 15012 | 15015 | 15016 | 15017 | 15019 | 15022 | 15023 | 15024 | 15027 | 15028 |
| 15030 | 15033 | 15036 | 15044 | 15048 | 15049 | 15050 | 15051 | 15052 | 15055 | 15056 | 15057 |
| 15058 | 15059 | 15063 | 15065 | 15066 | 15067 | 15070 | 15073 | 15075 | 15077 | 15082 | 15083 |
| 15088 | 15091 | 15095 | 15096 | 15098 | 15099 | 15100 | 15101 | 15102 | 15104 | 15105 | 15107 |
| 15111 | 15114 | 15117 | 15120 | 15127 | 15131 | 15135 | 15137 | 15139 | 15140 | 15142 | 15143 |
| 15147 | 15148 | 15158 | 15161 | 15163 | 15165 | 15166 | 15167 | 15168 | 15169 | 15174 | 15176 |
| 15178 | 15179 | 15180 | 15181 | 15184 | 15186 | 15188 | 15189 | 15192 | 15196 | 15197 | 15198 |
| 15200 | 15201 | 15204 | 15208 | 15211 | 15213 | 15214 | 15215 | 15218 | 15219 | 15220 | 15221 |
| 15222 | 15223 | 15226 | 15231 | 15234 | 15236 | 15241 | 15242 | 15256 | 15257 | 15258 | 15260 |
| 15261 | 15268 | 15269 | 15270 | 15271 | 15272 | 15273 | 15276 | 15287 | 15291 | 15295 | 15301 |
| 15302 | 15306 | 15307 | 15308 | 15314 | 15329 | 15332 | 15334 | 15335 | 15336 | 15337 | 15341 |
| 15342 | 15343 | 15350 | 15351 | 15353 | 15357 | 15358 | 15359 | 15361 | 15362 | 15363 | 15366 |
| 15368 | 15370 | 15373 | 15374 | 15375 | 15379 | 15382 | 15385 | 15390 | 15394 | 15395 | 15397 |
| 15399 | 15400 | 15402 | 15417 | 15420 | 15426 | 15427 | 15428 | 15434 | 15435 | 15442 | 15444 |
| 15446 | 15448 | 15454 | 15455 | 15456 | 15459 | 15461 | 15466 | 15469 | 15470 | 15472 | 15478 |
| 15479 | 15481 | 15482 | 15483 | 15484 | 15485 | 15486 | 15493 | 15494 | 15495 | 15497 | 15498 |
| 15511 | 15512 | 15513 | 15521 | 15523 | 15525 | 15527 | 15533 | 15535 | 15538 | 15541 | 15548 |
| 15551 | 15553 | 15555 | 15560 | 15561 | 15562 | 15563 | 15564 | 15566 | 15567 | 15570 | 15571 |
| 15572 | 15574 | 15576 | 15577 | 15579 | 15580 | 15581 | 15583 | 15586 | 15590 | 15595 | 15597 |
| 15598 | 15604 | 15607 | 15608 | 15611 | 15612 | 15613 | 15614 | 15615 | 15616 | 15618 | 15621 |
| 15622 | 15623 | 15640 | 15641 | 15646 | 15661 | 15667 | 15668 | 15672 | 15673 | 15674 | 15680 |
| 15696 | 15699 | 15701 | 15702 | 15703 | 15704 | 15709 | 15710 | 15717 | 15718 | 15720 | 15724 |
| 15725 | 15726 | 15728 | 15729 | 15730 | 15733 | 15735 | 15737 | 15740 | 15741 | 15742 | 15743 |
| 15747 | 15750 | 15753 | 15758 | 15762 | 15763 | 15765 | 15767 | 15768 | 15770 | 15785 | 15788 |
| 15794 | 15795 | 15796 | 15802 | 15803 | 15811 | 15812 | 15814 | 15816 | 15822 | 15823 | 15824 |
| 15827 | 15829 | 15836 | 15839 | 15840 | 15842 | 15848 | 15849 | 15851 | 15852 | 15853 | 15854 |
| 15855 | 15856 | 15857 | 15864 | 15865 | 15866 | 15868 | 15869 | 15883 | 15884 | 15885 | 15892 |
| 15894 | 15896 | 15898 | 15904 | 15906 | 15909 | 15912 | 15914 | 15920 | 15924 | 15926 | 15928 |
| 15933 | 15934 | 15935 | 15936 | 15937 | 15939 | 15940 | 15943 | 15944 | 15945 | 15947 | 15951 |
| 15952 | 15953 | 15955 | 15956 | 15957 | 15959 | 15962 | 15966 | 15972 | 15974 | 15975 | 15979 |
| 15982 | 15983 | 15985 | 15987 | 15988 | 15989 | 15990 | 15991 | 15993 | 15996 | 15997 | 15998 |
| 16015 | 16016 | 16021 | 16048 | 16050 | 16052 | 16057 | 16058 | 16062 | 16063 | 16064 | 16071 |
| 16087 | 16090 | 16092 | 16093 | 16094 | 16095 | 16099 | 16100 | 16105 | 16106 | 16109 | 16110 |
| 16112 | 16113 | 16114 | 16115 | 16119 | 16120 | 16122 | 16123 | 16126 | 16127 | 16131 | 16134 |
| 16137 | 16142 | 16146 | 16147 | 16149 | 16151 | 16152 | 16154 | 16167 | 16170 | 16176 | 16177 |
| 16178 | 16184 | 16185 | 16190 | 16194 | 16196 | 16198 | 16203 | 16204 | 16205 | 16209 | 16210 |
| 16218 | 16219 | 16220 | 16221 | 16227 | 16229 | 16230 | 16231 | 16232 | 16233 | 16234 | 16239 |
| 16241 | 16242 | 16244 | 16256 | 16257 | 16258 | 16265 | 16267 | 16272 | 16276 | 16277 | 16280 |
| 16282 | 16289 | 16291 | 16294 | 16295 | 16300 | 16301 | 16302 | 16303 | 16305 | 16306 | 16310 |
| 16311 | 16312 | 16313 | 16315 | 16316 | 16317 | 16319 | 16320 | 16321 | 16322 | 16327 | 16332 |
| 16336 | 16338 | 16341 | 16344 | 16345 | 16346 | 16347 | 16348 | 16349 | 16357 | 16368 | 16369 |
| 16377 | 16378 | 16379 | 16380 | 16384 | 16385 | 16386 | 16387 | 16391 | 16394 | 16400 | 16402 |
| 16403 | 16404 | 16410 | 16416 | 16418 | 16420 | 16421 | 16423 | 16425 | 16427 | 16429 | 16430 |
| 16434 | 16438 | 16440 | 16441 | 16442 | 16445 | 16451 | 16454 | 16457 | 16460 | 16462 | 16464 |
| 16465 | 16466 | 16470 | 16474 | 16478 | 16480 | 16482 | 16488 | 16505 | 16508 | 16512 | 16513 |
| 16514 | 16517 | 16518 | 16525 | 16531 | 16532 | 16533 | 16536 | 16537 | 16542 | 16544 | 16545 |
| 16556 | 16558 | 16559 | 16560 | 16561 | 16564 | 16569 | 16571 | 16580 | 16581 | 16583 | 16585 |
| 16587 | 16588 | 16589 | 16592 | 16595 | 16596 | 16597 | 16600 | 16601 | 16603 | 16604 | 16605 |
| 16606 | 16612 | 16616 | 16617 | 16628 | 16629 | 16632 | 16634 | 16642 | 16643 | 16644 |
| 16646 | 16647 | 16650 | 16651 | 16663 | 16664 | 16675 | 16676 | 16677 | 16678 | 16679 | 16681 |
| 16692 | 16693 | 16694 | 16698 | 16700 | 16703 | 16705 | 16707 | 16708 | 16718 | 16719 | 16720 |
| 16721 | 16723 | 16727 | 16730 | 16731 | 16734 | 16735 | 16746 | 16748 | 16749 | 16751 | 16756 |
| 16759 | 16761 | 16762 | 16763 | 16764 | 16766 | 16771 | 16773 | 16774 | 16779 | 16782 | 16783 |
| 16784 | 16785 | 16786 | 16789 | 16790 | 16792 | 16793 | 16794 | 16797 | 16808 | 16811 | 16812 |
| 16816 | 16823 | 16824 | 16827 | 16829 | 16830 | 16835 | 16839 | 16844 | 16846 | 16851 | 16855 |
| 16856 | 16860 | 16863 | 16865 | 16869 | 16870 | 16878 | 16882 | 16885 | 16888 | 16890 | 16892 |
| 16893 | 16897 | 16900 | 16902 | 16903 | 16905 | 16906 | 16907 | 16908 | 16911 | 16912 | 16913 |
| 16914 | 16915 | 16917 | 16924 | 16926 | 16928 | 16929 | 16931 | 16932 | 16940 | 16941 | 16945 |
| 16947 | 16949 | 16951 | 16954 | 16956 | 16966 | 16967 | 16968 | 16969 | 16970 | 16971 | 16974 |
| 16978 | 16979 | 16980 | 16981 | 16982 | 16983 | 16985 | 16996 | 17003 | 17005 | 17011 | 17012 |
| 17018 | 17021 | 17028 | 17031 | 17032 | 17036 | 17043 | 17044 | 17045 | 17050 | 17051 | 17052 |
| 17056 | 17063 | 17067 | 17068 | 17072 | 17073 | 17075 | 17077 | 17078 | 17079 | 17080 | 17085 |
| 17086 | 17111 | 17113 | 17114 | 17115 | 17116 | 17117 | 17118 | 17120 | 17127 | 17129 | 17133 |
| 17140 | 17141 | 17142 | 17144 | 17145 | 17146 | 17147 | 17148 | 17150 | 17152 | 17156 | 17157 |
| 17158 | 17162 | 17164 | 17165 | 17169 | 17171 | 17176 | 17177 | 17178 | 17179 | 17180 | 17181 |
| 17182 | 17183 | 17184 | 17185 | 17190 | 17192 | 17201 | 17212 | 17213 | 17214 | 17223 | 17224 |
| 17225 | 17249 | 17251 | 17252 | 17253 | 17254 | 17255 | 17256 | 17257 | 17258 | 17260 | 17261 |
| 17262 | 17264 | 17266 | 17267 | 17268 | 17269 | 17270 | 17272 | 17277 | 17279 | 17280 | 17281 |
| 17282 | 17285 | 17286 | 17287 | 17288 | 17289 | 17290 | 17291 | 17296 | 17297 | 17298 | 17301 |
| 17306 | 17307 | 17308 | 17314 | 17321 | 17322 | 17324 | 17325 | 17338 | 17339 | 17340 | 17341 |
| 17342 | 17344 | 17345 | 17349 | 17350 | 17351 | 17352 | 17353 | 17354 | 17355 | 17356 | 17360 |
| 17361 | 17364 | 17366 | 17367 | 17375 | 17376 | 17388 | 17389 | 17392 | 17394 | 17395 | 17396 |
| 17397 | 17398 | 17399 | 17400 | 17403 | 17405 | 17408 | 17410 | 17411 | 17412 | 17413 | 17417 |
| 17418 | 17427 | 17430 | 17433 | 17434 | 17435 | 17436 | 17437 | 17442 | 17444 | 17445 | 17446 |

TABLE 15-continued

Yield: Carbohydrate

| | | | | | | | | | | | |
|---|---|---|---|---|---|---|---|---|---|---|---|
| 17447 | 17448 | 17449 | 17450 | 17451 | 17458 | 17464 | 17465 | 17467 | 17470 | 17472 | 17473 |
| 17474 | 17475 | 17489 | 17495 | 17496 | 17498 | 17502 | 17505 | 17506 | 17508 | 17509 | 17511 |
| 17512 | 17513 | 17515 | 17516 | 17518 | 17528 | 17529 | 17530 | 17531 | 17534 | 17536 | 17537 |
| 17538 | 17539 | 17541 | 17542 | 17543 | 17553 | 17554 | 17555 | 17556 | 17568 | 17572 | 17573 |
| 17578 | 17594 | 17595 | 17601 | 17602 | 17603 | 17604 | 17605 | 17606 | 17610 | 17611 | 17613 |
| 17616 | 17618 | 17619 | 17625 | 17630 | 17631 | 17632 | 17633 | 17645 | 17646 | 17647 | 17648 |
| 17649 | 17652 | 17653 | 17658 | 17660 | 17661 | 17662 | 17663 | 17664 | 17665 | 17666 | 17674 |
| 17677 | 17678 | 17680 | 17681 | 17694 | 17695 | 17696 | 17700 | 17705 | 17711 | 17715 | 17719 |
| 17720 | 17721 | 17722 | 17724 | 17725 | 17740 | 17741 | 17742 | 17747 | 17754 | 17756 | 17761 |
| 17764 | 17768 | 17769 | 17770 | 17776 | 17777 | 17778 | 17780 | 17781 | 17783 | 17784 | 17785 |
| 17791 | 17795 | 17796 | 17803 | 17804 | 17808 | 17813 | 17818 | 17819 | 17825 | 17827 | 17831 |
| 17832 | 17834 | 17835 | 17836 | 17837 | 17838 | 17839 | 17840 | 17841 | 17846 | 17848 | 17853 |
| 17854 | 17860 | 17863 | 17864 | 17865 | 17866 | 17867 | 17868 | 17869 | 17872 | 17876 | 17877 |
| 17878 | 17881 | 17883 | 17884 | 17885 | 17886 | 17887 | 17900 | 17901 | 17903 | 17905 | 17906 |
| 17909 | 17916 | 17926 | 17929 | 17931 | 17932 | 17935 | 17942 | 17943 | 17947 | 17949 | 17950 |
| 17951 | 17955 | 17956 | 17958 | 17964 | 17966 | 17968 | 17980 | 17982 | 17983 | 17989 | 17991 |
| 17996 | 17997 | 17998 | 17999 | 18002 | 18004 | 18006 | 18007 | 18009 | 18011 | 18012 | 18013 |
| 18015 | 18016 | 18020 | 18021 | 18024 | 18028 | 18029 | 18034 | 18036 | 18041 | 18042 | 18043 |
| 18045 | 18048 | 18049 | 18050 | 18051 | 18054 | 18061 | 18062 | 18063 | 18064 | 18066 | 18068 |
| 18084 | 18086 | 18098 | 18099 | 18101 | 18102 | 18104 | 18107 | 18108 | 18111 | 18112 | 18114 |
| 18116 | 18120 | 18121 | 18122 | 18131 | 18133 | 18138 | 18139 | 18147 | 18148 | 18151 | 18152 |
| 18154 | 18155 | 18164 | 18165 | 18170 | 18171 | 18173 | 18183 | 18185 | 18188 | 18189 | 18190 |
| 18191 | 18193 | 18199 | 18201 | 18209 | 18210 | 18211 | 18212 | 18220 | 18226 | 18227 | 18236 |
| 18237 | 18241 | 18242 | 18254 | 18255 | 18259 | 18263 | 18265 | 18266 | 18267 | 18270 | 18271 |
| 18273 | 18274 | 18275 | 18276 | 18277 | 18278 | 18282 | 18288 | 18292 | 18293 | 18294 | 18295 |
| 18298 | 18303 | 18305 | 18307 | 18312 | 18313 | 18317 | 18318 | 18323 | 18324 | 18330 | 18336 |
| 18337 | 18342 | 18343 | 18344 | 18346 | 18349 | 18351 | 18352 | 18353 | 18354 | 18356 | 18357 |
| 18358 | 18359 | 18360 | 18367 | 18368 | 18370 | 18371 | 18372 | 18373 | 18374 | 18377 | 18386 |
| 18388 | 18394 | 18395 | 18396 | 18401 | 18402 | 18403 | 18405 | 18413 | 18414 | 18416 | 18417 |
| 18418 | 18425 | 18429 | 18430 | 18431 | 18432 | 18433 | 18441 | 18442 | 18443 | 18444 | 18449 |
| 18464 | 18467 | 18468 | 18471 | 18473 | 18474 | 18475 | 18476 | 18480 | 18489 | 18490 | 18497 |
| 18500 | 18501 | 18503 | 18505 | 18506 | 18512 | 18513 | 18517 | 18518 | 18522 | 18524 | 18528 |
| 18529 | 18530 | 18531 | 18534 | 18535 | 18544 | 18545 | 18553 | 18555 | 18559 | 18565 | 18576 |
| 18580 | 18583 | 18584 | 18585 | 18593 | 18594 | 18598 | 18599 | 18604 | 18614 | 18617 | 18618 |
| 18621 | 18622 | 18634 | 18635 | 18636 | 18652 | 18653 | 18655 | 18656 | 18658 | 18660 | 18668 |
| 18669 | 18675 | 18680 | 18681 | 18682 | 18683 | 18684 | 18690 | 18697 | 18704 | 18711 | 18712 |
| 18713 | 18715 | 18719 | 18723 | 18735 | 18743 | 18744 | 18749 | 18759 | 18760 | 18761 | 18765 |
| 18766 | 18767 | 18768 | 18775 | 18776 | 18777 | 18778 | 18781 | 18782 | 18783 | 18801 | 18802 |
| 18804 | 18809 | 18811 | 18822 | 18824 | 18825 | 18828 | 18829 | 18837 | 18839 | 18846 | 18856 |
| 18858 | 18863 | 18876 | 18879 | 18896 | 18897 | 18898 | 18912 | 18915 | 18918 | 18922 | 18928 |
| 18933 | 18937 | 18940 | 18950 | 18953 | 18958 | 18959 | 18964 | 18966 | 18971 | 18972 | 18973 |
| 18977 | 18978 | 18980 | 18981 | 18986 | 18995 | 18996 | 19000 | 19009 | 19010 | 19011 | 19017 |
| 19020 | 19023 | 19026 | 19030 | 19038 | 19040 | 19043 | 19049 | 19062 | 19066 | 19067 |
| 19070 | 19074 | 19075 | 19076 | 19077 | 19080 | 19084 | 19085 | 19089 | 19094 | 19097 | 19100 |
| 19101 | 19102 | 19107 | 19115 | 19122 | 19125 | 19127 | 19129 | 19137 | 19145 | 19155 | 19156 |
| 19163 | 19164 | 19171 | 19173 | 19174 | 19176 | 19178 | 19180 | 19182 | 19183 | 19187 | 19193 |
| 19197 | 19198 | 19200 | 19201 | 19202 | 19203 | 19205 | 19214 | 19216 | 19221 | 19222 | 19223 |
| 19231 | 19234 | 19238 | 19239 | 19240 | 19242 | 19243 | 19246 | 19250 | 19253 | 19255 | 19258 |
| 19259 | 19261 | 19262 | 19269 | 19271 | 19273 | 19282 | 19283 | 19289 | 19292 | 19293 | 19295 |
| 19307 | 19309 | 19311 | 19312 | 19316 | 19330 | 19331 | 19333 | 19334 | 19339 | 19341 | 19342 |
| 19346 | 19347 | 19348 | 19351 | 19352 | 19355 | 19361 | 19365 | 19368 | 19369 | 19370 | 19372 |
| 19373 | 19376 | 19377 | 19378 | 19379 | 19383 | 19390 | 19394 | 19396 | 19397 | 19398 | 19401 |
| 19408 | 19414 | 19415 | 19416 | 19417 | 19418 | 19419 | 19422 | 19425 | 19429 | 19441 | 19442 |
| 19444 | 19445 | 19446 | 19447 | 19448 | 19449 | 19450 | 19451 | 19456 | 19472 | 19477 | 19478 |
| 19479 | 19484 | 19488 | 19491 | 19493 | 19494 | 19495 | 19497 | 19498 | 19499 | 19501 | 19502 |
| 19504 | 19517 | 19523 | 19524 | 19528 | 19530 | 19534 | 19538 | 19539 | 19540 | 19546 | 19551 |
| 19552 | 19554 | 19555 | 19556 | 19566 | 19567 | 19570 | 19574 | 19581 | 19584 | 19585 | 19587 |
| 19589 | 19590 | 19593 | 19594 | 19597 | 19614 | 19620 | 19621 | 19622 | 19623 | 19630 | 19632 |
| 19635 | 19638 | 19639 | 19661 | 19663 | 19664 | 19667 | 19668 | 19671 | 19672 | 19682 | 19688 |
| 19689 | 19690 | 19691 | 19695 | 19702 | 19703 | 19705 | 19706 | 19712 | 19715 | 19716 | 19717 |
| 19718 | 19719 | 19721 | 19723 | 19735 | 19739 | 19740 | 19741 | 19742 | 19743 | 19745 | 19751 |
| 19752 | 19753 | 19760 | 19763 | 19769 | 19770 | 19771 | 19776 | 19777 | 19781 | 19787 | 19793 |
| 19797 | 19799 | 19801 | 19802 | 19804 | 19806 | 19807 | 19808 | 19809 | 19810 | 19812 | 19814 |
| 19817 | 19820 | 19822 | 19825 | 19828 | 19835 | 19838 | 19840 | 19844 | 19845 | 19848 |
| 19849 | 19850 | 19854 | 19858 | 19859 | 19862 | 19866 | 19867 | 19871 | 19872 | 19873 | 19874 |
| 19881 | 19882 | 19884 | 19888 | 19889 | 19893 | 19894 | 19897 | 19901 | 19904 | 19906 | 19907 |
| 19908 | 19913 | 19925 | 19927 | 19935 | 19940 | 19948 | 19949 | 19951 | 19957 | 19958 | 19959 |
| 19960 | 19965 | 19966 | 19970 | 19973 | 19978 | 19979 | 19990 | 19992 | 19995 | 19996 |
| 19999 | 20010 | 20011 | 20014 | 20016 | 20018 | 20020 | 20026 | 20030 | 20032 | 20034 | 20043 |
| 20044 | 20045 | 20049 | 20051 | 20054 | 20056 | 20060 | 20062 | 20063 | 20070 | 20071 | 20074 |
| 20076 | 20077 | 20080 | 20083 | 20086 | 20093 | 20097 | 20099 | 20100 | 20105 | 20106 | 20107 |
| 20109 | 20116 | 20128 | 20132 | 20133 | 20136 | 20138 | 20146 | 20153 | 20154 | 20159 | 20160 |
| 20161 | 20162 | 20163 | 20165 | 20170 | 20177 | 20182 | 20190 | 20193 | 20195 | 20202 | 20218 |
| 20222 | 20228 | 20235 | 20244 | 20245 | 20249 | 20250 | 20251 | 20258 | 20267 | 20271 | 20275 |
| 20279 | 20280 | 20282 | 20284 | 20286 | 20298 | 20302 | 20303 | 20304 | 20306 | 20307 | 20310 |
| 20313 | 20329 | 20330 | 20336 | 20340 | 20347 | 20348 | 20350 | 20369 | 20378 | 20381 | 20386 |
| 20391 | 20393 | 20396 | 20402 | 20404 | 20405 | 20415 | 20416 | 20417 | 20420 | 20423 | 20424 |

TABLE 15-continued

Yield: Carbohydrate

| | | | | | | | | | | | |
|---|---|---|---|---|---|---|---|---|---|---|---|
| 20425 | 20430 | 20431 | 20433 | 20452 | 20454 | 20456 | 20457 | 20463 | 20464 | 20465 | 20466 |
| 20467 | 20468 | 20470 | 20471 | 20473 | 20476 | 20481 | 20482 | 20489 | 20490 | 20491 | 20493 |
| 20496 | 20497 | 20498 | 20502 | 20503 | 20505 | 20506 | 20508 | 20509 | 20513 | 20518 | 20519 |
| 20522 | 20523 | 20525 | 20528 | 20531 | 20532 | 20533 | 20537 | 20540 | 20541 | 20542 | 20544 |
| 20545 | 20553 | 20555 | 20559 | 20563 | 20564 | 20567 | 20568 | 20570 | 20574 | 20577 | 20579 |
| 20583 | 20584 | 20585 | 20588 | 20592 | 20593 | 20594 | 20602 | 20603 | 20604 | 20606 | 20608 |
| 20612 | 20615 | 20616 | 20622 | 20624 | 20626 | 20631 | 20636 | 20637 | 20640 | 20647 | 20649 |
| 20656 | 20657 | 20661 | 20662 | 20663 | 20664 | 20665 | 20666 | 20670 | 20673 | 20674 | 20682 |
| 20688 | 20692 | 20693 | 20701 | 20705 | 20706 | 20707 | 20708 | 20710 | 20712 | 20713 | 20714 |
| 20716 | 20722 | 20725 | 20726 | 20729 | 20742 | 20744 | 20745 | 20746 | 20747 | 20748 | 20749 |
| 20750 | 20751 | 20752 | 20753 | 20754 | 20760 | 20761 | 20762 | 20769 | 20773 | 20780 | 20784 |
| 20789 | 20792 | 20793 | 20797 | 20800 | 20801 | 20804 | 20807 | 20809 | 20816 | 20817 | 20821 |
| 20823 | 20824 | 20825 | 20826 | 20827 | 20828 | 20836 | 20837 | 20838 | 20839 | 20844 | 20845 |
| 20846 | 20848 | 20849 | 20850 | 20854 | 20856 | 20859 | 20865 | 20866 | 20867 | 20874 | 20875 |
| 20876 | 20878 | 20883 | 20884 | 20886 | 20887 | 20889 | 20895 | 20897 | 20898 | 20899 | 20903 |
| 20916 | 20920 | 20924 | 20931 | 20932 | 20939 | 20943 | 20946 | 20951 | 20959 | 20960 | 20968 |
| 20971 | 20973 | 20977 | 20980 | 20986 | 20987 | 20988 | 20989 | 20990 | 20991 | 20998 | 20999 |
| 21003 | 21006 | 21021 | 21025 | 21031 | 21034 | 21035 | 21037 | 21038 | 21042 | 21044 | 21046 |
| 21047 | 21048 | 21049 | 21054 | 21057 | 21062 | 21064 | 21066 | 21068 | 21070 | 21071 | 21072 |
| 21074 | 21075 | 21077 | 21084 | 21086 | 21087 | 21091 | 21092 | 21094 | 21097 | 21101 | 21103 |
| 21104 | 21107 | 21111 | 21114 | 21124 | 21127 | 21130 | 21132 | 21133 | 21135 | 21142 | 21143 |
| 21146 | 21147 | 21149 | 21156 | 21162 | 21164 | 21166 | 21167 | 21168 | 21172 | 21175 | 21180 |
| 21183 | 21184 | 21185 | 21186 | 21187 | 21189 | 21190 | 21191 | 21193 | 21194 | 21200 | 21204 |
| 21205 | 21206 | 21209 | 21210 | 21211 | 21214 | 21219 | 21220 | 21245 | 21246 | 21248 | 21249 |
| 21252 | 21253 | 21262 | 21263 | 21267 | 21271 | 21277 | 21283 | 21291 | 21295 | 21298 | 21302 |
| 21303 | 21304 | 21311 | 21312 | 21313 | 21314 | 21317 | 21318 | 21324 | 21331 | 21333 | 21334 |
| 21335 | 21339 | 21348 | 21354 | 21355 | 21363 | 21364 | 21365 | 21373 | 21375 | 21377 | 21379 |
| 21381 | 21385 | 21389 | 21391 | 21402 | 21410 | 21411 | 21412 | 21416 | 21428 | 21430 | 21432 |
| 21436 | 21445 | 21449 | 21458 | 21459 | 21462 | 21466 | 21467 | 21471 | 21479 | 21483 | 21487 |
| 21501 | 21507 | 21512 | 21518 | 21520 | 21521 | 21525 | 21530 | 21533 | 21534 | 21535 | 21536 |
| 21539 | 21540 | 21546 | 21551 | 21552 | 21557 | 21560 | 21562 | 21563 | 21564 | 21576 | 21579 |
| 21582 | 21585 | 21597 | 21617 | 21618 | 21620 | 21624 | 21630 | 21637 | 21638 | 21639 | 21642 |
| 21644 | 21657 | 21658 | 21659 | 21661 | 21662 | 21666 | 21671 | 21675 | 21676 | 21681 | 21682 |
| 21686 | 21687 | 21695 | 21697 | 21700 | 21701 | 21702 | 21705 | 21706 | 21707 | 21711 | 21712 |
| 21713 | 21714 | 21715 | 21716 | 21717 | 21718 | 21720 | 21721 | 21723 | 21726 | 21730 | 21731 |
| 21732 | 21733 | 21734 | 21735 | 21736 | 21737 | 21738 | 21740 | 21741 | 21742 | 21745 | 21754 |
| 21758 | 21759 | 21760 | 21761 | 21762 | 21766 | 21768 | 21769 | 21776 | 21779 | 21781 | 21783 |
| 21789 | 21793 | 21800 | 21801 | 21806 | 21813 | 21816 | 21819 | 21820 | 21824 | 21825 | 21831 |
| 21833 | 21841 | 21844 | 21845 | 21847 | 21856 | 21857 | 21860 | 21861 | 21862 | 21864 | 21870 |
| 21873 | 21883 | 21893 | 21896 | 21906 | 21908 | 21920 | 21930 | 21939 | 21946 | 21947 | 21952 |
| 21962 | 21966 | 21972 | 21975 | 21992 | 21996 | 21998 | 21999 | 22001 | 22002 | 22011 | 22012 |
| 22013 | 22015 | 22017 | 22020 | 22032 | 22033 | 22035 | 22036 | 22044 | 22046 | 22047 | 22048 |
| 22049 | 22053 | 22061 | 22062 | 22066 | 22071 | 22072 | 22074 | 22075 | 22078 | 22079 | 22088 |
| 22091 | 22096 | 22097 | 22102 | 22106 | 22107 | 22108 | 22115 | 22116 | 22121 | 22122 | 22124 |
| 22125 | 22126 | 22127 | 22130 | 22134 | 22135 | 22163 | 22165 | 22180 | 22194 | 22200 | 22201 |
| 22206 | 22209 | 22210 | 22212 | 22213 | 22219 | 22230 | 22231 | 22232 | 22234 | 22235 | 22238 |
| 22239 | 22248 | 22254 | 22259 | 22260 | 22261 | 22269 | 22277 | 22286 | 22295 | 22309 | 22313 |
| 22325 | 22326 | 22327 | 22329 | 22331 | 22332 | 22335 | 22337 | 22346 | 22348 | 22361 | 22372 |
| 22377 | 22378 | 22384 | 22401 | 22402 | 22414 | 22417 | 22418 | 22419 | 22430 | 22438 | 22440 |
| 22441 | 22448 | 22451 | 22463 | 22491 | 22495 | 22500 | 22502 | 22503 | 22506 | 22508 | 22510 |
| 22514 | 22520 | 22533 | 22536 | 22549 | 22572 | 22578 | 22585 | 22586 | 22593 | 22594 | 22595 |
| 22598 | 22614 | 22623 | 22630 | 22631 | 22632 | 22633 | 22635 | 22640 | 22648 | 22655 | |
| 22663 | 22669 | 22677 | 22679 | 22700 | 22709 | 22723 | 22736 | 22747 | 22749 | 22759 | 22764 |
| 22766 | 22770 | 22780 | 22786 | 22787 | 22801 | 22819 | 22822 | 22823 | 22830 | 22831 | 22833 |
| 22836 | 22837 | 22845 | 22846 | 22855 | 22856 | 22858 | 22859 | 22861 | 22862 | 22864 | 22865 |
| 22872 | 22873 | 22890 | 22892 | 22893 | 22899 | 22909 | 22911 | 22914 | 22915 | 22916 | 22917 |
| 22919 | 22922 | 22924 | 22931 | 22933 | 22945 | 22946 | 22954 | 22963 | 22965 | 22967 | 22974 |
| 22975 | 22978 | 22984 | 22985 | 22991 | 22998 | 22999 | 23000 | 23006 | 23008 | 23009 | 23015 |
| 23026 | 23027 | 23031 | 23032 | 23034 | 23039 | 23055 | 23058 | 23067 | 23069 | 23070 | 23071 |
| 23073 | 23075 | 23077 | 23080 | 23081 | 23082 | 23084 | 23086 | 23092 | 23096 | 23097 | 23102 |
| 23104 | 23105 | 23106 | 23107 | 23109 | 23110 | 23112 | 23122 | 23123 | 23125 | 23126 | 23133 |
| 23138 | 23139 | 23140 | 23143 | 23144 | 23147 | 23148 | 23150 | 23151 | 23152 | 23154 | 23162 |
| 23164 | 23165 | 23169 | 23170 | 23186 | 23187 | 23189 | 23190 | 23191 | 23192 | 23193 | 23194 |
| 23195 | 23203 | 23209 | 23210 | 23212 | 23217 | 23225 | 23226 | 23227 | 23229 | 23231 | 23232 |
| 23233 | 23234 | 23235 | 23236 | 23237 | 23238 | 23239 | 23240 | 23241 | 23242 | 23244 | 23247 |
| 23249 | 23252 | 23253 | 23259 | 23260 | 23261 | 23262 | 23263 | 23264 | 23265 | 23266 | 23267 |
| 23268 | 23270 | 23272 | 23275 | 23276 | 23277 | 23282 | 23286 | 23287 | 23288 | 23289 | 23291 |
| 23292 | 23296 | 23299 | 23300 | 23301 | 23302 | 23303 | 23304 | 23307 | 23309 | 23310 | 23311 |
| 23313 | 23314 | 23321 | 23322 | 23323 | 23324 | 23325 | 23326 | 23327 | 23333 | 23336 | 23345 |
| 23347 | 23349 | 23351 | 23352 | 23353 | 23354 | 23355 | 23361 | 23362 | 23367 | 23368 | 23369 |
| 23370 | 23371 | 23373 | 23374 | 23375 | 23376 | 23377 | 23379 | 23385 | 23388 | 23389 | 23390 |
| 23396 | 23399 | 23400 | 23408 | 23409 | 23410 | 23413 | 23419 | 23423 | 23432 | 23433 | 23434 |
| 23442 | 23443 | 23444 | 23445 | 23446 | 23447 | 23450 | 23456 | 23457 | 23462 | 23464 | 23468 |
| 23469 | 23471 | 23479 | 23482 | 23484 | 23485 | 23490 | 23493 | 23501 | 23505 | 23507 | 23511 |
| 23513 | 23516 | 23517 | 23518 | 23525 | 23527 | 23531 | 23536 | 23537 | 23538 | 23541 | 23542 |
| 23545 | 23546 | 23547 | 23551 | 23552 | 23554 | 23555 | 23558 | 23559 | 23561 | 23563 | 23566 |
| 23571 | 23572 | 23577 | 23578 | 23581 | 23582 | 23583 | 23584 | 23585 | 23586 | 23587 | 23588 |

TABLE 15-continued

Yield: Carbohydrate

| | | | | | | | | | | | |
|---|---|---|---|---|---|---|---|---|---|---|---|
| 23594 | 23596 | 23598 | 23599 | 23601 | 23602 | 23605 | 23608 | 23610 | 23616 | 23619 | 23620 |
| 23630 | 23631 | 23635 | 23638 | 23639 | 23640 | 23646 | 23650 | 23655 | 23656 | 23658 | 23665 |
| 23666 | 23667 | 23672 | 23673 | 23677 | 23679 | 23687 | | | | | |

Table 15B SEQ ID NOs of Polynucleotides useful for improving Yield: Carbohydrate

| | | | | | | | | | | | |
|---|---|---|---|---|---|---|---|---|---|---|---|
| 23691 | 23694 | 23699 | 23704 | 23708 | 23714 | 23718 | 23719 | 23720 | 23721 | 23723 | 23724 |
| 23726 | 23731 | 23736 | 23737 | 23740 | 23743 | 23749 | 23755 | 23760 | 23761 | 23764 | 23768 |
| 23769 | 23775 | 23782 | 23786 | 23788 | 23791 | 23795 | 23797 | 23798 | 23799 | 23801 | 23806 |
| 23807 | 23808 | 23811 | 23812 | 23814 | 23815 | 23818 | 23819 | 23820 | 23823 | 23825 | 23826 |
| 23832 | 23847 | 23850 | 23856 | 23862 | 23867 | 23870 | 23871 | 23874 | 23875 | 23878 | 23881 |
| 23882 | 23884 | 23886 | 23894 | 23895 | 23896 | 23897 | 23898 | 23899 | 23900 | 23901 | 23902 |
| 23903 | 23907 | 23909 | 23911 | 23912 | 23913 | 23923 | 23924 | 23931 | 23935 | 23936 | 23940 |
| 23944 | 23945 | 23949 | 23953 | 23963 | 23966 | 23968 | 23976 | 23977 | 23978 | 23980 | 23990 |
| 23993 | 23998 | 24000 | 24001 | 24005 | 24015 | 24016 | 24022 | 24025 | 24027 | 24028 | 24029 |
| 24032 | 24037 | 24049 | 24050 | 24051 | 24053 | 24065 | 24066 | 24071 | 24072 | 24075 | 24077 |
| 24078 | 24079 | 24081 | 24082 | 24083 | 24084 | 24085 | 24086 | 24087 | 24088 | 24090 | 24092 |
| 24094 | 24097 | 24098 | 24100 | 24114 | 24119 | 24120 | 24131 | 24136 | 24143 | 24144 | 24146 |
| 24147 | 24148 | 24149 | 24151 | 24152 | 24153 | 24156 | 24161 | 24164 | 24165 | 24166 | 24171 |
| 24172 | 24174 | 24176 | 24177 | 24181 | 24182 | 24184 | 24185 | 24186 | 24188 | 24189 | 24191 |
| 24192 | 24199 | 24202 | 24203 | 24211 | 24215 | 24216 | 24217 | 24224 | 24225 | 24235 | 24236 |
| 24239 | 24242 | 24244 | 24247 | 24248 | 24249 | 24258 | 24262 | 24263 | 24266 | 24268 | 24269 |
| 24270 | 24272 | 24280 | 24284 | 24287 | 24290 | 24294 | 24295 | 24296 | 24299 | 24300 | 24305 |
| 24307 | 24309 | 24312 | 24313 | 24317 | 24319 | 24321 | 24323 | 24324 | 24325 | 24326 | 24327 |
| 24328 | 24329 | 24330 | 24331 | 24335 | 24338 | 24350 | 24351 | 24357 | 24358 | 24363 | 24366 |
| 24367 | 24370 | 24371 | 24372 | 24374 | 24382 | 24383 | 24385 | 24386 | 24388 | 24389 | 24394 |
| 24396 | 24397 | 24405 | 24407 | 24409 | 24410 | 24411 | 24416 | 24417 | 24429 | 24433 | 24434 |
| 24436 | 24439 | 24440 | 24442 | 24443 | 24444 | 24445 | 24446 | 24447 | 24448 | 24450 | 24452 |
| 24454 | 24455 | 24456 | 24468 | 24479 | 24480 | 24481 | 24482 | 24483 | 24485 | 24486 | 24496 |
| 24497 | 24498 | 24499 | 24500 | 24505 | 24507 | 24508 | 24510 | 24512 | 24521 | 24522 | 24524 |
| 24526 | 24528 | 24529 | 24530 | 24531 | 24535 | 24536 | 24538 | 24543 | 24548 | 24549 | 24550 |
| 24551 | 24552 | 24554 | 24555 | 24556 | 24557 | 24558 | 24559 | 24561 | 24562 | 24566 | 24572 |
| 24573 | 24574 | 24575 | 24576 | 24577 | 24578 | 24581 | 24586 | 24587 | 24589 | 24593 | 24595 |
| 24608 | 24610 | 24613 | 24618 | 24621 | 24624 | 24625 | 24628 | 24629 | 24630 | 24632 | 24633 |
| 24638 | 24639 | 24651 | 24655 | 24657 | 24661 | 24662 | 24663 | 24666 | 24673 | 24676 | 24679 |
| 24680 | 24681 | 24692 | 24701 | 24705 | 24708 | 24719 | 24723 | 24729 | 24730 | 24733 | 24739 |
| 24740 | 24742 | 24751 | 24760 | 24772 | 24773 | 24776 | 24778 | 24779 | 24780 | 24786 | 24799 |
| 24800 | 24803 | 24817 | 24821 | 24823 | 24829 | 24836 | 24840 | 24842 | 24853 | 24854 | 24861 |
| 24875 | 24881 | 24885 | 24886 | 24890 | 24891 | 24906 | 24911 | 24912 | 24916 | 24918 | 24921 |
| 24923 | 24928 | 24930 | 24933 | 24950 | 24951 | 24957 | 24968 | 24969 | 24971 | 24990 |
| 25000 | 25003 | 25008 | 25013 | 25016 | 25019 | 25026 | 25028 | 25029 | 25048 | 25059 | 25062 |
| 25101 | 25102 | 25113 | 25115 | 25116 | 25117 | 25118 | 25119 | 25122 | 25145 | 25150 | 25160 |
| 25161 | 25171 | 25176 | 25178 | 25179 | 25181 | 25184 | 25193 | 25194 | 25197 | 25202 | 25205 |
| 25208 | 25213 | 25228 | 25230 | 25241 | 25242 | 25252 | 25255 | 25259 | 25262 | 25263 | 25265 |
| 25267 | 25269 | 25271 | 25275 | 25276 | 25277 | 25278 | 25284 | 25285 | 25290 | 25292 | 25295 |
| 25305 | 25311 | 25312 | 25319 | 25328 | 25329 | 25338 | 25348 | 25356 | 25366 | 25367 | 25368 |
| 25370 | 25371 | 25375 | 25376 | 25383 | 25385 | 25386 | 25389 | 25391 | 25392 | 25393 | 25399 |
| 25406 | 25407 | 25415 | 25424 | 25432 | 25433 | 25436 | 25455 | 25468 | 25472 | 25484 | 25489 |
| 25493 | 25499 | 25501 | 25505 | 25511 | 25521 | 25525 | 25526 | 25528 | 25531 | 25534 | 25541 |
| 25543 | 25547 | 25554 | 25569 | 25570 | 25571 | 25574 | 25583 | 25584 | 25590 | 25591 | 25592 |
| 25595 | 25599 | 25604 | 25605 | 25607 | 25617 | 25620 | 25623 | 25626 | 25639 | 25645 | 25658 |
| 25660 | 25693 | 25693 | 25694 | 25695 | 25700 | 25702 | 25706 | 25714 | 25715 | 25725 | 25742 |
| 25749 | 25755 | 25791 | 25798 | 25802 | 25806 | 25809 | 25810 | 25817 | 25827 | 25834 | 25835 |
| 25841 | 25844 | 25846 | 25851 | 25853 | 25854 | 25855 | 25873 | 25881 | 25889 | 25895 | 25896 |
| 25900 | 25910 | 25916 | 25932 | 25933 | 25938 | 25939 | 25942 | 25947 | 25954 | 25955 | 25970 |
| 25971 | 25972 | 25979 | 25986 | 25998 | 26001 | 26002 | 26003 | 26006 | 26007 | 26008 | 26009 |
| 26012 | 26014 | 26015 | 26017 | 26046 | 26051 | 26063 | 26114 | 26121 | 26125 | 26127 |
| 26130 | 26131 | 26133 | 26140 | 26141 | 26148 | 26157 | 26162 | 26175 | 26176 | 26177 | 26184 |
| 26191 | 26194 | 26197 | 26211 | 26220 | 26233 | 26234 | 26237 | 26238 | 26247 | 26249 | 26251 |
| 26261 | 26265 | 26275 | 26276 | 26285 | 26290 | 26293 | 26296 | 26302 | 26308 | 26311 | 26312 |
| 26313 | 26314 | 26319 | 26320 | 26322 | 26326 | 26327 | 26331 | 26345 | 26352 | 26353 | 26363 |
| 26366 | 26367 | 26372 | 26374 | 26375 | 26376 | 26378 | 26379 | 26381 | 26382 | 26383 | 26385 |
| 26387 | 26390 | 26393 | 26395 | 26398 | 26402 | 26406 | 26409 | 26412 | 26413 | 26414 | 26415 |
| 26421 | 26422 | 26424 | 26425 | 26432 | 26437 | 26438 | 26439 | 26442 | 26443 | 26446 | 26447 |
| 26448 | 26453 | 26454 | 26458 | 26461 | 26462 | 26464 | 26465 | 26467 | 26468 | 26470 | 26472 |
| 26477 | 26479 | 26482 | 26484 | 26488 | 26490 | 26494 | 26509 | 26510 | 26512 | 26515 | 26520 |
| 26527 | 26529 | 26534 | 26535 | 26539 | 26541 | 26550 | 26551 | 26560 | 26561 | 26566 | 26572 |
| 26576 | 26577 | 26581 | 26588 | 26591 | 26592 | 26596 | 26597 | 26599 | 26600 | 26601 | 26602 |
| 26603 | 26606 | 26607 | 26609 | 26610 | 26611 | 26612 | 26613 | 26615 | 26623 | 26625 | 26630 |
| 26631 | 26632 | 26633 | 26641 | 26646 | 26647 | 26648 | 26650 | 26651 | 26655 | 26657 | 26658 |
| 26659 | 26663 | 26664 | 26666 | 26667 | 26671 | 26672 | 26673 | 26682 | 26689 | 26690 | 26691 |
| 26694 | 26695 | 26696 | 26697 | 26699 | 26707 | 26710 | 26717 | 26718 | 26728 | 26732 | 26739 |
| 26741 | 26742 | 26752 | 26753 | 26754 | 26755 | 26756 | 26767 | 26774 | 26776 | 26787 | 26788 |
| 26790 | 26791 | 26794 | 26796 | 26800 | 26802 | 26811 | 26817 | 26819 | 26823 | 26832 | 26839 |
| 26841 | 26843 | 26863 | 26865 | 26868 | 26873 | 26874 | 26875 | 26876 | 26878 | 26881 | 26884 |
| 26887 | 26888 | 26893 | 26899 | 26900 | 26906 | 26919 | 26920 | 26923 | 26933 | 26935 | 26936 |
| 26938 | 26939 | 26941 | 26952 | 26957 | 26962 | 26972 | 26973 | 26977 | 26986 | 26988 | 26991 |
| 26992 | 26995 | 26996 | 27002 | 27005 | 27006 | 27011 | 27015 | 27021 | 27022 | 27030 | 27032 |

TABLE 15-continued

Yield: Carbohydrate

| | | | | | | | | | | | |
|---|---|---|---|---|---|---|---|---|---|---|---|
| 27035 | 27038 | 27039 | 27044 | 27045 | 27049 | 27050 | 27068 | 27072 | 27076 | 27079 | 27082 |
| 27083 | 27084 | 27085 | 27086 | 27096 | 27098 | 27101 | 27102 | 27105 | 27106 | 27108 | 27112 |
| 27121 | 27123 | 27125 | 27127 | 27129 | 27141 | 27145 | 27160 | 27165 | 27167 | 27168 | 27174 |
| 27177 | 27178 | 27187 | 27202 | 27213 | 27216 | 27218 | 27231 | 27242 | 27247 | 27256 | 27258 |
| 27260 | 27267 | 27275 | 27277 | 27278 | 27287 | 27292 | 27297 | 27308 | 27311 | 27316 | 27323 |
| 27324 | 27326 | 27327 | 27328 | 27330 | 27333 | 27341 | 27344 | 27345 | 27349 | 27352 | 27354 |
| 27358 | 27364 | 27367 | 27369 | 27373 | 27375 | 27382 | 27385 | 27390 | 27396 | 27398 | 27400 |
| 27401 | 27406 | 27411 | 27412 | 27420 | 27425 | 27426 | 27432 | 27433 | 27434 | 27435 | 27437 |
| 27445 | 27449 | 27451 | 27459 | 27461 | 27465 | 27467 | 27471 | 27479 | 27480 | 27481 | 27487 |
| 27492 | 27497 | 27498 | 27502 | 27506 | 27511 | 27521 | 27522 | 27524 | 27533 | 27534 | 27540 |
| 27551 | 27552 | 27553 | 27556 | 27558 | 27563 | 27574 | 27581 | 27582 | 27591 | 27605 | 27607 |
| 27611 | 27616 | 27624 | 27637 | 27638 | 27640 | 27653 | 27654 | 27656 | 27657 | 27660 | 27663 |
| 27665 | 27669 | 27671 | 27673 | 27674 | 27691 | 27693 | 27698 | 27706 | 27709 | 27720 | 27722 |
| 27724 | 27728 | 27731 | 27732 | 27734 | 27735 | 27743 | 27748 | 27764 | 27795 | 27798 | 27800 |
| 27801 | 27802 | 27804 | 27805 | 27810 | 27813 | 27815 | 27816 | 27821 | 27823 | 27824 | 27828 |
| 27829 | 27830 | 27839 | 27840 | 27851 | 27853 | 27855 | 27860 | 27863 | 27865 | 27866 | 27867 |
| 27870 | 27871 | 27873 | 27880 | 27891 | 27893 | 27898 | 27902 | 27905 | 27909 | 27914 | 27915 |
| 27916 | 27920 | 27925 | 27928 | 27929 | 27930 | 27931 | 27933 | 27936 | 27938 | 27939 | 27941 |
| 27942 | 27943 | 27946 | 27948 | 27949 | 27950 | 27953 | 27956 | 27958 | 27963 | 27964 | 27965 |
| 27966 | 27967 | 27969 | 27971 | 27972 | 27973 | 27974 | 27976 | 27978 | 27979 | 27980 | 27981 |
| 27982 | 27983 | 27986 | 27991 | 27992 | 27993 | 27994 | 27995 | 27996 | 27998 | 28001 | 28003 |
| 28005 | 28007 | 28008 | 28012 | 28013 | 28014 | 28016 | 28017 | 28019 | 28023 | 28025 | 28027 |
| 28031 | 28036 | 28042 | 28043 | 28044 | 28045 | 28047 | 28049 | 28050 | 28051 | 28053 | 28054 |
| 28055 | 28060 | 28062 | 28064 | 28066 | 28067 | 28068 | 28069 | 28070 | 28074 | 28077 | 28079 |
| 28088 | 28090 | 28091 | 28092 | 28093 | 28097 | 28098 | 28099 | 28101 | 28111 | 28112 | 28114 |
| 28115 | 28116 | 28124 | 28125 | 28128 | 28133 | 28135 | 28138 | 28139 | 28140 | 28142 | 28144 |
| 28147 | 28148 | 28151 | 28152 | 28153 | 28154 | 28158 | 28160 | 28161 | 28162 | 28166 | 28168 |
| 28170 | 28171 | 28172 | 28173 | 28177 | 28186 | 28189 | 28190 | 28191 | 28192 | 28193 | 28199 |
| 28201 | 28202 | 28204 | 28208 | 28213 | 28217 | 28218 | 28219 | 28221 | 28222 | 28223 | 28228 |
| 28230 | 28233 | 28236 | 28239 | 28240 | 28242 | 28244 | 28245 | 28248 | 28252 | 28255 | 28257 |
| 28259 | 28264 | 28265 | 28268 | 28269 | 28273 | 28281 | 28283 | 28288 | 28290 | 28291 | 28292 |
| 28293 | 28295 | 28296 | 28297 | 28298 | 28299 | 28300 | 28301 | 28305 | 28308 | 28309 | 28311 |
| 28312 | 28313 | 28319 | 28321 | 28322 | 28324 | 28325 | 28326 | 28327 | 28330 | 28331 | 28333 |
| 28334 | 28335 | 28338 | 28339 | 28340 | 28341 | 28343 | 28345 | 28359 | 28360 | 28361 | 28365 |
| 28366 | 28368 | 28375 | 28378 | 28380 | 28383 | 28384 | 28386 | 28387 | 28389 | 28391 | 28392 |
| 28393 | 28394 | 28398 | 28399 | 28401 | 28403 | 28406 | 28412 | 28414 | 28418 | 28419 | 28420 |
| 28421 | 28423 | 28426 | 28429 | 28432 | 28433 | 28434 | 28436 | 28437 | 28444 | 28445 | 28449 |
| 28450 | 28453 | 28454 | 28455 | 28458 | 28460 | 28462 | 28463 | 28467 | 28468 | 28472 | 28474 |
| 28475 | 28476 | 28477 | 28480 | 28483 | 28484 | 28486 | 28487 | 28489 | 28490 | 28493 | 28494 |
| 28497 | 28498 | 28499 | 28500 | 28501 | 28505 | 28509 | 28510 | 28517 | 28518 | 28519 | 28521 |
| 28522 | 28523 | 28527 | 28528 | 28529 | 28533 | 28534 | 28535 | 28542 | 28544 | 28547 | 28550 |
| 28552 | 28553 | 28555 | 28556 | 28558 | 28559 | 28562 | 28570 | 28573 | 28574 | 28575 | 28576 |
| 28579 | 28581 | 28586 | 28589 | 28590 | 28594 | 28598 | 28599 | 28600 | 28601 | 28604 | 28610 |
| 28611 | 28615 | 28618 | 28620 | 28622 | 28626 | 28630 | 28631 | 28632 | 28633 | 28634 | 28637 |
| 28638 | 28639 | 28641 | 28645 | 28647 | 28649 | 28651 | 28652 | 28659 | 28664 | 28668 | 28675 |
| 28679 | 28682 | 28690 | 28692 | 28710 | 28714 | 28725 | 28755 | 28768 | 28770 | 28775 | 28777 |
| 28791 | 28803 | 28804 | 28805 | 28807 | 28812 | 28839 | 28840 | 28845 | 28846 | 28859 | 28860 |
| 28867 | 28896 | 28913 | 28920 | 28921 | 28924 | 28944 | 28955 | 28958 | 28968 | 28969 | 28970 |
| 28971 | 28979 | 28980 | 28985 | 29003 | 29005 | 29013 | 29017 | 29021 | 29023 | 29025 | 29026 |
| 29033 | 29050 | 29065 | 29066 | 29081 | 29120 | 29121 | 29124 | 29126 | 29127 | 29128 | 29129 |
| 29140 | 29152 | 29157 | 29158 | 29161 | 29168 | 29177 | 29182 | 29194 | 29203 | 29207 | 29208 |
| 29209 | 29210 | 29211 | 29212 | 29220 | 29221 | 29226 | 29227 | 29230 | 29236 | 29239 | 29253 |
| 29271 | 29275 | 29276 | 29287 | 29289 | 29291 | 29296 | 29297 | 29318 | 29327 | 29333 | 29337 |
| 29343 | 29349 | 29352 | 29356 | 29367 | 29369 | 29379 | 29380 | 29388 | 29393 | 29398 | 29402 |
| 29403 | 29421 | 29422 | 29430 | 29432 | 29439 | 29460 | 29461 | 29467 | 29470 | 29475 | 29478 |
| 29481 | 29483 | 29490 | 29492 | 29493 | 29499 | 29504 | 29525 | 29531 | 29549 | 29550 | 29554 |
| 29555 | 29563 | 29573 | 29588 | 29589 | 29591 | 29597 | 29601 | 29607 | 29609 | 29610 | 29619 |
| 29620 | 29621 | 29633 | 29645 | 29662 | 29665 | 29677 | 29679 | 29680 | 29687 | 29688 | 29689 |
| 29697 | 29698 | 29699 | 29702 | 29710 | 29711 | 29713 | 29714 | 29719 | 29720 | 29721 | 29739 |
| 29749 | 29768 | 29771 | 29776 | 29777 | 29780 | 29791 | 29794 | 29795 | 29799 | 29802 | 29803 |
| 29820 | 29821 | 29830 | 29839 | 29840 | 29841 | 29843 | 29845 | 29846 | 29853 | 29862 | 29864 |
| 29874 | 29876 | 29878 | 29879 | 29884 | 29887 | 29897 | 29901 | 29907 | 29911 | 29918 | 29921 |
| 29926 | 29927 | 29928 | 29931 | 29938 | 29939 | 29950 | 29955 | 29956 | 29958 | 29959 | 29961 |
| 29967 | 29992 | 30040 | 30041 | 30042 | 30043 | 30047 | 30048 | 30081 | 30084 | 30100 |
| 30120 | 30122 | 30124 | 30125 | 30128 | 30133 | 30137 | 30145 | 30153 | 30157 | 30158 | 30159 |
| 30160 | 30162 | 30164 | 30166 | 30171 | 30172 | 30176 | 30184 | 30189 | 30190 | 30191 | 30198 |
| 30202 | 30207 | 30211 | 30212 | 30213 | 30229 | 30234 | 30237 | 30238 | 30245 | 30248 | 30249 |
| 30250 | 30254 | 30265 | 30266 | 30268 | 30269 | 30270 | 30281 | 30284 | 30285 | 30293 | 30307 |
| 30312 | 30323 | 30327 | 30328 | 30360 | 30361 | 30380 | 30382 | 30388 | 30401 | 30402 | 30405 |
| 30407 | 30417 | 30419 | 30420 | 30426 | 30430 | 30436 | 30446 | 30455 | 30457 | 30458 | 30467 |
| 30475 | 30493 | 30496 | 30502 | 30506 | 30508 | 30509 | 30510 | 30513 | 30516 | 30517 | 30532 |
| 30557 | 30563 | 30564 | 30589 | 30594 | 30597 | 30599 | 30614 | 30626 | 30657 | 30658 | 30659 |
| 30672 | 30673 | 30677 | 30688 | 30705 | 30713 | 30720 | 30721 | 30722 | 30724 | 30726 | 30727 |
| 30728 | 30730 | 30732 | 30734 | 30735 | 30736 | 30737 | 30738 | 30739 | 30740 | 30742 | 30747 |
| 30748 | 30749 | 30750 | 30751 | 30752 | 30754 | 30757 | 30759 | 30761 | 30763 | 30764 | 30768 |
| 30769 | 30770 | 30772 | 30773 | 30775 | 30780 | 30782 | 30786 | 30789 | 30791 | 30796 | 30797 |
| 30798 | 30799 | 30801 | 30803 | 30804 | 30805 | 30807 | 30808 | 30809 | 30814 | 30816 | 30818 |

TABLE 15-continued

Yield: Carbohydrate

| | | | | | | | | | | | |
|---|---|---|---|---|---|---|---|---|---|---|---|
| 30820 | 30821 | 30822 | 30824 | 30825 | 30827 | 30829 | 30832 | 30834 | 30843 | 30845 | 30846 |
| 30847 | 30849 | 30853 | 30854 | 30855 | 30857 | 30869 | 30870 | 30872 | 30873 | 30874 | 30880 |
| 30883 | 30884 | 30887 | 30892 | 30894 | 30898 | 30899 | 30900 | 30904 | 30907 | 30908 | 30911 |
| 30912 | 30913 | 30914 | 30918 | 30920 | 30921 | 30925 | 30927 | 30929 | 30930 | 30931 | 30932 |
| 30936 | 30945 | 30948 | 30949 | 30950 | 30951 | 30957 | 30959 | 30961 | 30963 | 30967 | 30972 |
| 30975 | 30976 | 30977 | 30979 | 30980 | 30981 | 30986 | 30988 | 30991 | 30996 | 30997 | 30999 |
| 31001 | 31002 | 31006 | 31010 | 31012 | 31014 | 31016 | 31021 | 31022 | 31025 | 31026 | 31030 |
| 31038 | 31040 | 31045 | 31047 | 31048 | 31049 | 31050 | 31052 | 31053 | 31054 | 31055 | 31056 |
| 31057 | 31058 | 31062 | 31066 | 31069 | 31070 | 31071 | 31076 | 31077 | 31079 | 31080 | 31082 |
| 31083 | 31084 | 31085 | 31088 | 31089 | 31091 | 31092 | 31093 | 31096 | 31097 | 31098 | 31099 |
| 31101 | 31104 | 31118 | 31119 | 31120 | 31124 | 31125 | 31127 | 31134 | 31137 | 31141 | 31142 |
| 31144 | 31145 | 31147 | 31149 | 31150 | 31152 | 31153 | 31157 | 31158 | 31159 | 31162 | 31165 |
| 31171 | 31172 | 31173 | 31178 | 31179 | 31180 | 31181 | 31182 | 31185 | 31189 | 31192 | 31193 |
| 31194 | 31196 | 31203 | 31204 | 31208 | 31210 | 31213 | 31214 | 31215 | 31218 | 31220 | 31222 |
| 31223 | 31227 | 31228 | 31232 | 31234 | 31235 | 31236 | 31237 | 31240 | 31243 | 31245 | 31246 |
| 31248 | 31249 | 31252 | 31253 | 31256 | 31257 | 31258 | 31259 | 31260 | 31264 | 31268 | 31269 |
| 31276 | 31277 | 31278 | 31280 | 31281 | 31282 | 31286 | 31287 | 31288 | 31292 | 31293 | 31294 |
| 31301 | 31303 | 31306 | 31309 | 31311 | 31312 | 31314 | 31315 | 31318 | 31319 | 31322 |
| 31328 | 31331 | 31332 | 31333 | 31334 | 31337 | 31339 | 31344 | 31347 | 31348 | 31352 | 31356 |
| 31357 | 31358 | 31359 | 31362 | 31368 | 31369 | 31373 | 31376 | 31378 | 31380 | 31384 | 31388 |
| 31389 | 31390 | 31391 | 31392 | 31395 | 31396 | 31397 | 31399 | 31403 | 31405 | 31407 | 31409 |
| 31410 | 31416 | 31417 | 31419 | 31425 | 31432 | 31439 | 31440 | 31442 | 31445 | 31446 |
| 31447 | 31449 | 31451 | 31452 | 31453 | 31455 | 31456 | 31460 | 31462 | 31465 | 31468 | 31470 |
| 31471 | 31474 | 31475 | 31478 | 31481 | 31483 | 31493 | 31496 | 31497 | 31500 | 31504 | 31505 |
| 31509 | 31511 | 31512 | 31520 | 31522 | 31523 | 31524 | 31525 | 31526 | 31530 | 31531 | 31533 |
| 31539 | 31546 | 31550 | 31551 | 31556 | 31557 | 31562 | 31564 | 31566 | 31568 | 31569 | 31570 |
| 31571 | 31572 | 31584 | 31588 | 31591 | 31592 | 31593 | 31596 | 31605 | 31607 | 31610 | 31612 |
| 31614 | 31615 | 31617 | 31620 | 31621 | 31622 | 31623 | 31624 | 31625 | 31627 | 31629 | 31630 |
| 31632 | 31633 | 31634 | 31635 | 31639 | 31643 | 31644 | 31649 | 31650 | 31656 | 31657 | 31659 |
| 31660 | 31661 | 31662 | 31663 | 31664 | 31671 | 31672 | 31678 | 31681 | 31682 | 31688 | 31689 |
| 31690 | 31691 | 31692 | 31695 | 31696 | 31698 | 31699 | 31700 | 31701 | 31702 | 31703 | 31704 |
| 31705 | 31708 | 31709 | 31711 | 31713 | 31714 | 31717 | 31718 | 31719 | 31721 | 31723 | 31724 |
| 31726 | 31728 | 31732 | 31736 | 31739 | 31741 | 31742 | 31743 | 31750 | 31755 | 31758 | 31759 |
| 31765 | 31771 | 31772 | 31775 | 31779 | 31785 | 31795 | 31796 | 31798 | 31799 | 31800 | 31801 |
| 31802 | 31804 | 31806 | 31807 | 31809 | 31810 | 31811 | 31813 | 31814 | 31815 | 31816 | 31826 |
| 31831 | 31832 | 31834 | 31837 | 31844 | 31845 | 31846 | 31847 | 31849 | 31853 | 31854 | 31857 |
| 31862 | 31867 | 31868 | 31869 | 31870 | 31871 | 31873 | 31874 | 31875 | 31876 | 31882 | 31893 |
| 31894 | 31895 | 31896 | 31899 | 31905 | 31906 | 31909 | 31915 | 31919 | 31922 | 31925 | 31928 |
| 31930 | 31931 | 31932 | 31934 | 31937 | 31938 | 31940 | 31941 | 31949 | 31950 | 31952 | 31955 |
| 31957 | 31958 | 31959 | 31960 | 31961 | 31963 | 31964 | 31970 | 31973 | 31974 | 31977 | 31981 |
| 31982 | 31983 | 31986 | 31992 | 31993 | 31994 | 31996 | 31999 | 32001 | 32008 | 32011 | 32013 |
| 32015 | 32022 | 32024 | 32027 | 32028 | 32029 | 32031 | 32032 | 32033 | 32034 | 32041 | 32042 |
| 32043 | 32044 | 32046 | 32048 | 32052 | 32055 | 32057 | 32058 | 32059 | 32064 | 32066 | 32070 |
| 32071 | 32072 | 32074 | 32078 | 32079 | 32081 | 32083 | 32085 | 32088 | 32091 | 32093 | 32094 |
| 32095 | 32096 | 32098 | 32099 | 32100 | 32101 | 32103 | 32104 | 32112 | 32113 | 32117 | 32119 |
| 32125 | 32129 | 32130 | 32131 | 32133 | 32136 | 32139 | 32145 | 32151 | 32153 | 32154 | 32155 |
| 32156 | 32158 | 32159 | 32170 | 32171 | 32172 | 32173 | 32179 | 32180 | 32181 | 32185 | 32186 |
| 32187 | 32195 | 32199 | 32200 | 32201 | 32202 | 32203 | 32204 | 32208 | 32209 | 32210 | 32211 |
| 32213 | 32215 | 32218 | 32221 | 32226 | 32233 | 32238 | 32239 | 32243 | 32244 | 32251 | 32253 |
| 32254 | 32256 | 32258 | 32259 | 32260 | 32261 | 32265 | 32266 | 32273 | 32274 | 32275 | 32280 |
| 32282 | 32299 | 32301 | 32303 | 32305 | 32306 | 32308 | 32312 | 32314 | 32320 | 32321 | 32332 |
| 32333 | 32338 | 32339 | 32340 | 32341 | 32342 | 32351 | 32354 | 32366 | 32370 | 32373 |
| 32375 | 32378 | 32379 | 32380 | 32388 | 32389 | 32393 | 32394 | 32395 | 32399 | 32402 | 32405 |
| 32407 | 32410 | 32415 | 32416 | 32417 | 32418 | 32419 | 32420 | 32421 | 32425 | 32428 | 32429 |
| 32434 | 32435 | 32439 | 32442 | 32449 | 32450 | 32452 | 32453 | 32454 | 32455 | 32456 | 32457 |
| 32461 | 32464 | 32467 | 32468 | 32469 | 32470 | 32480 | 32482 | 32483 | 32489 | 32490 | 32501 |
| 32503 | 32504 | 32506 | 32508 | 32514 | 32515 | 32517 | 32518 | 32519 | 32520 | 32521 | 32534 |
| 32535 | 32537 | 32540 | 32542 | 32547 | 32548 | 32549 | 32551 | 32553 | 32557 | 32558 | 32562 |
| 32563 | 32569 | 32572 | 32577 | 32580 | 32581 | 32582 | 32583 | 32586 | 32587 | 32588 | 32596 |
| 32597 | 32603 | 32604 | 32606 | 32608 | 32610 | 32611 | 32612 | 32614 | 32615 | 32616 | 32618 |
| 32620 | 32621 | 32625 | 32626 | 32627 | 32630 | 32634 | 32645 | 32647 | 32651 | 32652 | 32653 |
| 32660 | 32661 | 32667 | 32668 | 32670 | 32671 | 32672 | 32674 | 32685 | 32686 | 32687 | 32688 |
| 32689 | 32693 | 32699 | 32700 | 32701 | 32702 | 32703 | 32704 | 32705 | 32706 | 32708 | 32709 |
| 32714 | 32715 | 32716 | 32718 | 32722 | 32728 | 32732 | 32734 | 32735 | 32738 | 32743 |
| 32745 | 32746 | 32749 | 32750 | 32755 | 32756 | 32759 | 32760 | 32763 | 32765 | 32767 | 32776 |
| 32783 | 32784 | 32791 | 32792 | 32793 | 32796 | 32791 | 32798 | 32801 | 32803 | 32805 | 32819 |
| 32820 | 32823 | 32826 | 32832 | 32834 | 32835 | 32836 | 32837 | 32838 | 32840 | 32841 | 32843 |
| 32850 | 32851 | 32852 | 32854 | 32857 | 32858 | 32860 | 32863 | 32864 | 32866 | 32873 | 32879 |
| 32887 | 32888 | 32895 | 32903 | 32905 | 32907 | 32912 | 32916 | 32920 | 32921 | 32922 | 32923 |
| 32925 | 32929 | 32930 | 32931 | 32932 | 32936 | 32941 | 32942 | 32949 | 32951 | 32952 | 32953 |
| 32954 | 32956 | 32957 | 32958 | 32960 | 32961 | 32978 | 32979 | 32980 | 32981 | 32982 | 32983 |
| 32987 | 32991 | 32995 | 32999 | 33010 | 33011 | 33012 | 33013 | 33017 | 33019 | 33020 | 33022 |
| 33035 | 33036 | 33045 | 33048 | 33050 | 33051 | 33055 | 33056 | 33059 | 33060 | 33063 | 33064 |
| 33068 | 33070 | 33074 | 33083 | 33088 | 33092 | 33093 | 33095 | 33097 | 33100 | 33101 | 33105 |
| 33110 | 33111 | 33112 | 33116 | 33121 | 33124 | 33126 | 33127 | 33141 | 33143 | 33150 | 33152 |
| 33153 | 33156 | 33160 | 33162 | 33163 | 33164 | 33170 | 33172 | 33174 | 33176 | 33177 | 33178 |
| 33179 | 33181 | 33182 | 33188 | 33198 | 33201 | 33202 | 33203 | 33204 | 33206 | 33218 | 33229 |

TABLE 15-continued

Yield: Carbohydrate

| | | | | | | | | | | | |
|---|---|---|---|---|---|---|---|---|---|---|---|
| 33231 | 33234 | 33236 | 33238 | 33241 | 33243 | 33247 | 33250 | 33252 | 33253 | 33256 | 33257 |
| 33261 | 33263 | 33265 | 33266 | 33269 | 33276 | 33279 | 33281 | 33282 | 33285 | 33289 | 33290 |
| 33295 | 33300 | 33301 | 33302 | 33306 | 33307 | 33311 | 33312 | 33314 | 33318 | 33319 | 33320 |
| 33323 | 33332 | 33336 | 33337 | 33339 | 33340 | 33356 | 33358 | 33362 | 33368 | 33372 | 33391 |
| 33396 | 33399 | 33400 | 33402 | 33407 | 33412 | 33423 | 33424 | 33425 | 33430 | 33435 | 33446 |
| 33451 | 33453 | 33459 | 33461 | 33463 | 33474 | 33475 | 33476 | 33477 | 33516 | 33518 | 33527 |
| 33538 | 33545 | 33548 | 33550 | 33551 | 33552 | 33553 | 33555 | 33556 | 33563 | 33571 | 33575 |
| 33578 | 33579 | 33580 | 33581 | 33582 | 33583 | 33584 | 33585 | 33596 | 33597 | 33603 | 33607 |
| 33609 | 33613 | 33614 | 33616 | 33622 | 33623 | 33632 | 33633 | 33637 | 33645 | 33647 | 33652 |
| 33655 | 33656 | 33657 | 33663 | 33671 | 33672 | 33674 | 33675 | 33676 | 33677 | 33678 | 33680 |
| 33681 | 33682 | 33689 | 33690 | 33691 | 33692 | 33694 | 33696 | 33697 | 33703 | 33704 | 33706 |
| 33707 | 33708 | 33709 | 33710 | 33711 | 33721 | 33722 | 33724 | 33725 | 33726 | 33729 | 33732 |
| 33734 | 33737 | 33739 | 33740 | 33746 | 33747 | 33748 | 33751 | 33766 | 33771 | 33787 | 33791 |
| 33819 | 33820 | 33823 | 33828 | 33829 | 33831 | 33841 | 33845 | 33851 | 33852 | 33862 | 33866 |
| 33868 | 33869 | 33881 | 33882 | 33884 | 33885 | 33886 | 33887 | 33890 | 33891 | 33892 | 33896 |
| 33901 | 33903 | 33911 | 33912 | 33914 | 33917 | 33918 | 33919 | 33920 | 33921 | 33922 | 33924 |
| 33928 | 33932 | 33933 | 33935 | 33937 | 33940 | 33944 | 33946 | 33947 | 33948 | 33950 | 33951 |
| 33954 | 33955 | 33959 | 33960 | 33966 | 33968 | 33969 | 33970 | 33972 | 33980 | 33983 | 33994 |
| 33996 | 33997 | 33999 | 34012 | 34014 | 34018 | 34024 | 34029 | 34030 | 34031 | 34033 | 34037 |
| 34041 | 34042 | 34048 | 34054 | 34056 | 34061 | 34062 | 34069 | 34071 | 34073 | 34075 | 34082 |
| 34084 | 34086 | 34088 | 34092 | 34093 | 34094 | 34096 | 34097 | 34098 | 34100 | 34102 | 34107 |
| 34109 | 34111 | 34112 | 34114 | 34117 | 34121 | 34122 | 34138 | 34140 | 34147 | 34150 | 34152 |
| 34153 | 34155 | 34156 | 34160 | 34161 | 34164 | 34168 | 34173 | 34175 | 34181 | 34184 | 34186 |
| 34187 | 34188 | 34190 | 34192 | 34196 | 34197 | 34198 | 34203 | 34204 | 34206 | 34207 | 34209 |
| 34210 | 34211 | 34212 | 34213 | 34214 | 34215 | 34218 | 34223 | 34225 | 34227 | 34228 | 34229 |
| 34233 | 34235 | 34238 | 34239 | 34240 | 34243 | 34244 | 34247 | 34248 | 34252 | 34256 | 34258 |
| 34259 | 34260 | 34261 | 34262 | 34264 | 34265 | 34267 | 34268 | 34274 | 34275 | 34276 | |
| 34277 | 34279 | 34281 | 34283 | 34284 | 34288 | 34289 | 34290 | 34292 | 34298 | 34299 | 34301 |
| 34302 | 34303 | 34314 | 34315 | 34316 | 34317 | 34319 | 34323 | 34328 | 34329 | 34338 | 34339 |
| 34340 | 34341 | 34342 | 34343 | 34344 | 34345 | 34346 | 34347 | 34348 | 34349 | 34350 | 34351 |
| 34352 | 34354 | 34355 | 34361 | 34366 | 34368 | 34369 | 34370 | 34371 | 34376 | 34381 | 34382 |
| 34384 | 34385 | 34387 | 34390 | 34396 | 34397 | 34398 | 34399 | 34400 | 34401 | 34403 | 34405 |
| 34406 | 34407 | 34408 | 34409 | 34410 | 34412 | 34413 | 34414 | 34415 | 34416 | 34418 | 34419 |
| 34420 | 34423 | 34424 | 34425 | 34426 | 34427 | 34429 | 34431 | 34434 | 34435 | 34436 | 34438 |
| 34439 | 34440 | 34445 | 34446 | 34447 | 34448 | 34449 | 34451 | 34452 | 34453 | 34457 | 34458 |
| 34459 | 34461 | 34462 | 34464 | 34471 | 34474 | 34484 | 34485 | 34494 | 34497 | 34498 | 34499 |
| 34502 | 34506 | 34508 | 34510 | 34511 | 34513 | 34515 | 34516 | 34517 | 34518 | 34523 | 34524 |
| 34528 | 34529 | 34531 | 34536 | 34538 | 34539 | 34542 | 34544 | 34546 | 34548 | 34556 | 34569 |
| 34573 | 34575 | 34576 | 34577 | 34582 | 34584 | 34585 | 34587 | 34588 | 34589 | 34593 | 34595 |
| 34600 | 34602 | 34603 | 34607 | 34608 | 34612 | 34614 | 34615 | 34617 | 34618 | 34619 | 34620 |
| 34631 | 34636 | 34637 | 34638 | 34643 | 34644 | 34649 | 34654 | 34655 | 34656 | 34657 | 34658 |
| 34659 | 34661 | 34664 | 34668 | 34669 | 34671 | 34679 | 34680 | 34681 | 34682 | 34684 | 34685 |
| 34687 | 34689 | 34690 | 34691 | 34696 | 34697 | 34699 | 34700 | 34704 | 34708 | 34721 | 34722 |
| 34723 | 34724 | 34728 | 34740 | 34741 | 34744 | 34748 | 34751 | 34752 | 34759 | 34762 | 34766 |
| 34771 | 34772 | 34778 | 34784 | 34786 | 34808 | 34809 | 34811 | 34817 | 34821 | 34822 | 34834 |
| 34844 | 34849 | 34856 | 34859 | 34861 | 34871 | 34873 | 34875 | 34876 | 34877 | 34879 | 34881 |
| 34882 | 34888 | 34904 | 34905 | 34906 | 34910 | 34912 | 34921 | 34927 | 34929 | 34934 | 34935 |
| 34936 | 34946 | 34951 | 34952 | 34960 | 34968 | 34975 | 34985 | 34988 | 34991 | 34996 | 34999 |
| 35004 | 35005 | 35018 | 35019 | 35023 | 35024 | 35025 | 35031 | 35036 | 35037 | 35044 | 35047 |
| 35049 | 35056 | 35059 | 35060 | 35061 | 35062 | 35063 | 35064 | 35065 | 35068 | 35069 | 35071 |
| 35072 | 35074 | 35075 | 35081 | 35083 | 35084 | 35086 | 35087 | 35088 | 35089 | 35091 | 35093 |
| 35094 | 35096 | 35107 | 35109 | 35111 | 35114 | 35115 | 35116 | 35123 | 35124 | 35125 | 35126 |
| 35127 | 35128 | 35129 | 35130 | 35133 | 35137 | 35139 | 35140 | 35142 | 35143 | 35145 | 35149 |
| 35154 | 35158 | 35161 | 35162 | 35164 | 35165 | 35169 | 35171 | 35173 | 35176 | 35178 | 35179 |
| 35180 | 35181 | 35183 | 35184 | 35188 | 35189 | 35190 | 35191 | 35194 | 35201 | 35203 | 35206 |
| 35207 | 35208 | 35210 | 35211 | 35212 | 35213 | 35215 | 35218 | 35219 | 35224 | 35233 | |
| 35234 | 35235 | 35237 | 35238 | 35244 | 35245 | 35246 | 35247 | 35251 | 35259 | 35265 | 35266 |
| 35270 | 35272 | 35276 | 35278 | 35281 | 35282 | 35284 | 35285 | 35286 | 35288 | 35290 | 35293 |
| 35295 | 35296 | 35297 | 35300 | 35304 | 35307 | 35313 | 35315 | 35316 | 35318 | 35320 | 35322 |
| 35324 | 35326 | 35327 | 35328 | 35329 | 35330 | 35336 | 35337 | 35338 | 35342 | 35344 | 35348 |
| 35352 | 35353 | 35355 | 35357 | 35358 | 35359 | 35360 | 35361 | 35362 | 35363 | 35364 | 35366 |
| 35367 | 35373 | 35374 | 35379 | 35380 | 35381 | 35382 | 35383 | 35385 | 35388 | 35389 | 35390 |
| 35392 | 35394 | 35398 | 35404 | 35408 | 35410 | 35411 | 35412 | 35413 | 35414 | 35415 | 35418 |
| 35422 | 35424 | 35427 | 35428 | 35431 | 35432 | 35437 | 35438 | 35442 | 35444 | 35448 | 35454 |
| 35455 | 35460 | 35466 | 35467 | 35469 | 35470 | 35475 | 35480 | 35481 | 35486 | 35490 | 35496 |
| 35504 | 35506 | 35507 | 35508 | 35509 | 35510 | 35513 | 35515 | 35519 | 35520 | 35523 | 35524 |
| 35525 | 35526 | 35529 | 35534 | 35542 | 35543 | 35549 | 35550 | 35551 | 35561 | 35562 | 35567 |
| 35568 | 35569 | 35573 | 35575 | 35576 | 35580 | 35582 | 35583 | 35585 | 35587 | 35588 | 35589 |
| 35593 | 35594 | 35596 | 35599 | 35600 | 35602 | 35605 | 35606 | 35610 | 35614 | 35615 | 35618 |
| 35629 | 35630 | 35631 | 35632 | 35635 | 35639 | 35642 | 35644 | 35645 | 35648 | 35649 | 35651 |
| 35652 | 35653 | 35656 | 35658 | 35664 | 35666 | 35668 | 35677 | 35679 | 35682 | 35684 | 35685 |
| 35686 | 35687 | 35688 | 35697 | 35698 | 35699 | 35702 | 35704 | 35705 | 35706 | 35709 | 35714 |
| 35717 | 35718 | 35719 | 35724 | 35725 | 35726 | 35727 | 35728 | 35730 | 35731 | 35734 | 35735 |
| 35736 | 35739 | 35740 | 35741 | 35742 | 35743 | 35744 | 35745 | 35746 | 35747 | 35750 | 35754 |
| 35755 | 35756 | 35757 | 35769 | 35772 | 35778 | 35779 | 35783 | 35784 | 35785 | 35788 | 35793 |
| 35798 | 35799 | 35806 | 35807 | 35808 | 35809 | 35811 | 35812 | 35813 | 35814 | 35815 | 35824 |
| 35826 | 35829 | 35835 | 35836 | 35838 | 35839 | 35842 | 35849 | 35852 | 35855 | 35856 | 35859 |

TABLE 15-continued

Yield: Carbohydrate

| | | | | | | | | | | | |
|---|---|---|---|---|---|---|---|---|---|---|---|
| 35860 | 35863 | 35865 | 35867 | 35868 | 35878 | 35879 | 35880 | 35882 | 35886 | 35900 | 35901 |
| 35902 | 35905 | 35906 | 35910 | 35912 | 35914 | 35916 | 35924 | 35925 | 35927 | 35929 | 35932 |
| 35938 | 35939 | 35940 | 35941 | 35942 | 35945 | 35954 | 35955 | 35956 | 35957 | 35958 | 35962 |
| 35963 | 35964 | 35967 | 35968 | 35972 | 35974 | 35975 | 35980 | 35981 | 35982 | 35984 | 35985 |
| 35986 | 35987 | 35988 | 35989 | 35990 | 35991 | 35992 | 35995 | 35996 | 35997 | 36005 | 36006 |
| 36007 | 36008 | 36009 | 36010 | 36014 | 36015 | 36028 | 36030 | 36037 | 36038 | 36039 | 36043 |
| 36055 | 36057 | 36060 | 36062 | 36063 | 36069 | 36071 | 36075 | 36082 | 36085 | 36089 | 36090 |
| 36091 | 36100 | 36103 | 36104 | 36105 | 36114 | 36115 | 36120 | 36122 | 36123 | 36124 | 36125 |
| 36126 | 36127 | 36133 | 36135 | 36136 | 36137 | 36141 | 36144 | 36145 | 36148 | 36150 | 36154 |
| 36156 | 36158 | 36159 | 36165 | 36167 | 36170 | 36171 | 36173 | 36178 | 36186 | 36187 | 36188 |
| 36204 | 36209 | 36211 | 36213 | 36215 | 36216 | 36219 | 36220 | 36222 | 36223 | 36225 | 36228 |
| 36229 | 36235 | 36241 | 36245 | 36246 | 36252 | 36254 | 36256 | 36257 | 36261 | 36262 | 36264 |
| 36268 | 36277 | 36279 | 36280 | 36284 | 36286 | 36289 | 36294 | 36296 | 36301 | 36305 | 36307 |
| 36313 | 36314 | 36316 | 36317 | 36327 | 36332 | 36344 | 36345 | 36348 | 36353 | 36359 | 36360 |
| 36364 | 36365 | 36369 | 36373 | 36375 | 36382 | 36384 | 36385 | 36387 | 36390 | 36391 | 36393 |
| 36398 | 36399 | 36403 | 36407 | 36409 | 36410 | 36412 | 36417 | 36425 | 36429 | 36430 | 36431 |
| 36438 | 36440 | 36441 | 36442 | 36448 | 36450 | 36452 | 36453 | 36456 | 36460 | 36461 | 36467 |
| 36470 | 36473 | 36475 | 36476 | 36480 | 36484 | 36490 | 36491 | 36493 | 36494 | 36497 | 36499 |
| 36504 | 36508 | 36511 | 36512 | 36517 | 36520 | 36527 | 36532 | 36533 | 36537 | 36541 | 36542 |
| 36547 | 36555 | 36556 | 36559 | 36566 | 36576 | 36577 | 36591 | 36595 | 36597 | 36601 | 36602 |
| 36605 | 36609 | 36610 | 36612 | 36615 | 36618 | 36619 | 36622 | 36626 | 36629 | 36632 | 36633 |
| 36634 | 36636 | 36638 | 36643 | 36644 | 36646 | 36647 | 36650 | 36653 | 36655 | 36658 | 36663 |
| 36664 | 36665 | 36667 | 36671 | 36673 | 36674 | 36679 | 36684 | 36686 | 36687 | 36689 | 36693 |
| 36694 | 36695 | 36705 | 36707 | 36709 | 36710 | 36714 | 36715 | 36717 | 36718 | 36720 | 36722 |
| 36723 | 36729 | 36731 | 36732 | 36734 | 36735 | 36737 | 36738 | 36743 | 36746 | 36752 | 36754 |
| 36756 | 36765 | 36773 | 36776 | 36778 | 36781 | 36790 | 36792 | 36794 | 36796 | 36809 | 36810 |
| 36815 | 36816 | 36826 | 36827 | 36828 | 36831 | 36841 | 36842 | 36850 | 36855 | 36860 | 36865 |
| 36872 | 36874 | 36888 | 36893 | 36897 | 36908 | 36909 | 36913 | 36921 | 36924 | 36936 | 36938 |
| 36939 | 36940 | 36942 | 36946 | 36949 | 36950 | 36966 | 36968 | 36971 | 36989 | 36990 | 36994 |
| 36995 | 36998 | 37008 | 37012 | 37016 | 37017 | 37023 | 37027 | 37034 | 37037 | 37038 | 37039 |
| 37040 | 37041 | 37042 | 37046 | 37048 | 37053 | 37057 | 37078 | 37082 | 37092 | 37109 | 37110 |
| 37111 | 37113 | 37117 | 37118 | 37120 | 37124 | 37125 | 37127 | 37130 | 37131 | 37134 | 37143 |
| 37145 | 37147 | 37148 | 37149 | 37150 | 37151 | 37152 | 37153 | 37154 | 37158 | 37159 | 37160 |
| 37161 | 37162 | 37165 | 37167 | 37171 | 37172 | 37180 | 37184 | 37189 | 37195 | 37196 | 37202 |
| 37203 | 37209 | 37210 | 37212 | 37217 | 37218 | 37222 | 37223 | 37237 | 37238 | 37247 | 37248 |
| 37256 | 37257 | 37258 | 37262 | 37264 | 37266 | 37272 | 37279 | 37280 | 37281 | 37286 | 37290 |
| 37291 | 37293 | 37294 | 37297 | 37302 | 37304 | 37309 | 37313 | 37314 | 37316 | 37321 | 37323 |
| 37326 | 37327 | 37329 | 37333 | 37335 | 37341 | 37342 | 37350 | 37351 | 37352 | 37354 | 37359 |
| 37360 | 37361 | 37362 | 37364 | 37365 | 37372 | 37373 | 37376 | 37379 | 37382 | 37383 | |
| 37389 | 37392 | 37393 | 37403 | 37405 | 37408 | 37412 | 37413 | 37420 | 37421 | 37423 | 37425 |
| 37427 | 37430 | 37432 | 37433 | 37434 | 37435 | 37438 | 37439 | 37442 | 37448 | 37456 | 37459 |
| 37460 | 37464 | 37466 | 37470 | 37471 | 37472 | 37477 | 37480 | 37481 | 37483 | 37486 | 37487 |
| 37494 | 37499 | 37502 | 37505 | 37506 | 37511 | 37513 | 37514 | 37515 | 37518 | 37519 | 37528 |
| 37535 | 37536 | 37543 | 37547 | 37548 | 37549 | 37551 | 37552 | 37555 | 37556 | 37557 | 37558 |
| 37559 | 37560 | 37561 | 37562 | 37563 | 37564 | 37565 | 37567 | 37572 | 37573 | 37574 | 37577 |
| 37579 | 37580 | 37581 | 37582 | 37587 | 37590 | 37591 | 37592 | 37596 | 37599 | 37602 | 37604 |
| 37606 | 37608 | 37609 | 37612 | 37615 | 37616 | 37618 | 37622 | 37629 | 37631 | 37638 | 37639 |
| 37640 | 37644 | 37647 | 37650 | 37651 | 37655 | 37657 | 37660 | 37662 | 37671 | 37672 | 37673 |
| 37680 | 37687 | 37692 | 37695 | 37697 | 37698 | 37701 | 37704 | 37706 | 37709 | 37719 | 37720 |
| 37721 | 37722 | 37723 | 37725 | 37726 | 37728 | 37731 | 37738 | 37745 | 37754 | 37755 | 37760 |
| 37765 | 37766 | 37768 | 37770 | 37771 | 37772 | 37773 | 37776 | 37780 | 37782 | 37788 | 37789 |
| 37790 | 37791 | 37794 | 37797 | 37800 | 37801 | 37802 | 37806 | 37807 | 37808 | 37809 | |
| 37815 | 37816 | 37817 | 37819 | 37823 | 37824 | 37826 | 37827 | 37829 | 37830 | 37831 | 37837 |
| 37838 | 37844 | 37845 | 37846 | 37847 | 37851 | 37852 | 37854 | 37860 | 37861 | 37867 | 37869 |
| 37872 | 37876 | 37879 | 37880 | 37883 | 37884 | 37886 | 37888 | 37891 | 37892 | 37896 | 37897 |
| 37898 | 37901 | 37902 | 37906 | 37907 | 37908 | 37909 | 37912 | 37913 | 37917 | 37918 | 37919 |
| 37923 | 37932 | 37938 | 37941 | 37943 | 37944 | 37945 | 37947 | 37949 | 37951 | 37953 | 37955 |
| 37956 | 37960 | 37963 | 37967 | 37968 | 37971 | 37972 | 37973 | 37974 | 37976 | 37978 | 37984 |
| 37985 | 37986 | 37987 | 37989 | 37990 | 37991 | 37993 | 37995 | 37997 | 37999 | 38001 | 38003 |
| 38008 | 38009 | 38011 | 38012 | 38013 | 38014 | 38015 | 38016 | 38025 | 38030 | 38031 | 38032 |
| 38036 | 38039 | 38042 | 38043 | 38044 | 38046 | 38048 | 38051 | 38052 | 38053 | 38056 | 38057 |
| 38062 | 38063 | 38069 | 38073 | 38076 | 38081 | 38085 | 38086 | 38088 | 38092 | 38093 | 38095 |
| 38097 | 38099 | 38100 | 38103 | 38104 | 38109 | 38110 | 38111 | 38114 | 38115 | 38116 | 38119 |
| 38124 | 38126 | 38127 | 38131 | 38132 | 38134 | 38137 | 38141 | 38150 | 38155 | 38156 | |
| 38163 | 38165 | 38167 | 38172 | 38173 | 38175 | 38176 | 38177 | 38178 | 38179 | 38183 | 38184 |
| 38187 | 38189 | 38190 | 38196 | 38197 | 38199 | 38212 | 38213 | 38214 | 38217 | 38220 | 38221 |
| 38222 | 38225 | 38232 | 38236 | 38238 | 38242 | 38246 | 38247 | 38249 | 38250 | 38251 | 38252 |
| 38256 | 38258 | 38260 | 38263 | 38264 | 38271 | 38272 | 38273 | 38274 | 38275 | 38276 | 38278 |
| 38279 | 38284 | 38291 | 38295 | 38298 | 38299 | 38300 | 38301 | 38304 | 38305 | 38306 | 38307 |
| 38311 | 38313 | 38317 | 38318 | 38320 | 38321 | 38323 | 38324 | 38325 | 38326 | 38327 | 38328 |
| 38329 | 38330 | 38333 | 38338 | 38341 | 38345 | 38347 | 38349 | 38351 | 38352 | 38354 | 38367 |
| 38368 | 38369 | 38370 | 38371 | 38375 | 38378 | 38379 | 38381 | 38382 | 38384 | 38385 | 38389 |
| 38390 | 38392 | 38393 | 38396 | 38399 | 38402 | 38403 | 38404 | 38406 | 38407 | 38411 | 38415 |
| 38418 | 38420 | 38421 | 38422 | 38423 | 38424 | 38425 | 38426 | 38428 | 38430 | 38431 | 38435 |
| 38442 | 38444 | 38452 | 38453 | 38457 | 38460 | 38464 | 38465 | 38466 | 38467 | 38468 | 38469 |
| 38470 | 38471 | 38477 | 38478 | 38480 | 38489 | 38490 | 38493 | 38495 | 38496 | 38501 | 38504 |
| 38506 | 38507 | 38508 | 38510 | 38512 | 38513 | 38514 | 38515 | 38516 | 38518 | 38520 | 38521 |

TABLE 15-continued

Yield: Carbohydrate

| | | | | | | | | | | | |
|---|---|---|---|---|---|---|---|---|---|---|---|
| 38522 | 38523 | 38524 | 38525 | 38526 | 38529 | 38530 | 38532 | 38539 | 38542 | 38545 | 38546 |
| 38547 | 38548 | 38552 | 38557 | 38559 | 38560 | 38561 | 38562 | 38563 | 38564 | 38565 | 38567 |
| 38569 | 38573 | 38575 | 38576 | 38580 | 38582 | 38583 | 38585 | 38587 | 38591 | 38595 | 38602 |
| 38607 | 38614 | 38617 | 38618 | 38619 | 38620 | 38621 | 38622 | 38623 | 38624 | 38625 | 38626 |
| 38627 | 38628 | 38629 | 38630 | 38631 | 38639 | 38642 | 38644 | 38645 | 38646 | 38658 | 38663 |
| 38666 | 38669 | 38672 | 38675 | 38681 | 38684 | 38688 | 38689 | 38692 | 38693 | 38695 | 38696 |
| 38697 | 38698 | 38699 | 38702 | 38703 | 38704 | 38706 | 38709 | 38710 | 38711 | 38714 | 38715 |
| 38717 | 38720 | 38723 | 38731 | 38735 | 38736 | 38737 | 38738 | 38739 | 38742 | 38743 | 38744 |
| 38745 | 38746 | 38750 | 38752 | 38753 | 38754 | 38757 | 38760 | 38762 | 38764 | 38769 | 38770 |
| 38775 | 38778 | 38782 | 38783 | 38785 | 38786 | 38787 | 38788 | 38789 | 38791 | 38792 | 38794 |
| 38798 | 38801 | 38804 | 38807 | 38814 | 38818 | 38822 | 38824 | 38826 | 38827 | 38829 | 38830 |
| 38834 | 38835 | 38845 | 38848 | 38850 | 38852 | 38853 | 38854 | 38855 | 38856 | 38861 | 38863 |
| 38865 | 38866 | 38867 | 38868 | 38871 | 38873 | 38875 | 38876 | 38879 | 38883 | 38884 | 38885 |
| 38887 | 38888 | 38891 | 38895 | 38898 | 38900 | 38901 | 38902 | 38905 | 38906 | 38907 | 38908 |
| 38909 | 38910 | 38913 | 38918 | 38921 | 38923 | 38928 | 38929 | 38943 | 38944 | 38945 | 38947 |
| 38948 | 38955 | 38956 | 38957 | 38958 | 38959 | 38960 | 38963 | 38974 | 38978 | 38982 | 38988 |
| 38989 | 38993 | 38994 | 38995 | 39001 | 39016 | 39019 | 39021 | 39022 | 39023 | 39024 | 39028 |
| 39029 | 39030 | 39037 | 39038 | 39040 | 39044 | 39045 | 39046 | 39048 | 39049 | 39050 | 39053 |
| 39055 | 39057 | 39060 | 39061 | 39062 | 39066 | 39069 | 39072 | 39077 | 39081 | 39082 | 39084 |
| 39086 | 39087 | 39089 | 39104 | 39107 | 39113 | 39114 | 39115 | 39121 | 39122 | 39129 | 39131 |
| 39133 | 39135 | 39141 | 39142 | 39143 | 39146 | 39148 | 39153 | 39156 | 39157 | 39159 | 39165 |
| 39166 | 39168 | 39169 | 39170 | 39171 | 39172 | 39173 | 39180 | 39181 | 39182 | 39184 | 39185 |
| 39198 | 39199 | 39200 | 39208 | 39210 | 39212 | 39214 | 39220 | 39222 | 39225 | 39228 | 39235 |
| 39238 | 39240 | 39242 | 39247 | 39248 | 39249 | 39250 | 39251 | 39253 | 39254 | 39257 | 39258 |
| 39259 | 39261 | 39263 | 39264 | 39266 | 39267 | 39268 | 39270 | 39273 | 39277 | 39282 | 39284 |
| 39285 | 39291 | 39294 | 39295 | 39298 | 39299 | 39300 | 39301 | 39302 | 39303 | 39305 | 39308 |
| 39309 | 39310 | 39327 | 39328 | 39333 | 39348 | 39354 | 39355 | 39359 | 39360 | 39361 | 39367 |
| 39383 | 39386 | 39388 | 39389 | 39390 | 39391 | 39396 | 39397 | 39404 | 39405 | 39407 | 39411 |
| 39412 | 39413 | 39415 | 39416 | 39417 | 39420 | 39422 | 39424 | 39427 | 39428 | 39429 | 39430 |
| 39434 | 39437 | 39440 | 39445 | 39449 | 39450 | 39452 | 39454 | 39455 | 39457 | 39472 | 39475 |
| 39481 | 39482 | 39483 | 39489 | 39490 | 39498 | 39499 | 39501 | 39503 | 39509 | 39510 | 39511 |
| 39514 | 39516 | 39523 | 39526 | 39527 | 39529 | 39535 | 39536 | 39538 | 39539 | 39540 | 39541 |
| 39542 | 39543 | 39544 | 39551 | 39552 | 39553 | 39555 | 39556 | 39570 | 39571 | 39572 | 39579 |
| 39581 | 39583 | 39585 | 39591 | 39593 | 39596 | 39599 | 39601 | 39607 | 39611 | 39613 | 39615 |
| 39620 | 39621 | 39622 | 39623 | 39624 | 39626 | 39627 | 39630 | 39631 | 39632 | 39634 | 39638 |
| 39639 | 39640 | 39642 | 39643 | 39644 | 39646 | 39649 | 39653 | 39659 | 39661 | 39662 | 39666 |
| 39669 | 39670 | 39672 | 39674 | 39675 | 39676 | 39677 | 39678 | 39680 | 39683 | 39684 | 39685 |
| 39702 | 39703 | 39708 | 39735 | 39737 | 39739 | 39744 | 39745 | 39749 | 39750 | 39751 | 39758 |
| 39774 | 39777 | 39779 | 39780 | 39781 | 39782 | 39786 | 39789 | 39793 | 39796 | 39797 | |
| 39799 | 39800 | 39801 | 39802 | 39806 | 39807 | 39809 | 39810 | 39813 | 39814 | 39818 | 39821 |
| 39824 | 39829 | 39833 | 39834 | 39836 | 39838 | 39839 | 39841 | 39854 | 39857 | 39863 | 39864 |
| 39865 | 39871 | 39872 | 39877 | 39881 | 39883 | 39885 | 39890 | 39891 | 39892 | 39896 | 39897 |
| 39905 | 39906 | 39907 | 39908 | 39914 | 39916 | 39917 | 39918 | 39919 | 39920 | 39921 | 39926 |
| 39928 | 39929 | 39931 | 39943 | 39944 | 39945 | 39952 | 39954 | 39959 | 39963 | 39964 | 39967 |
| 39969 | 39976 | 39978 | 39981 | 39982 | 39987 | 39988 | 39989 | 39990 | 39992 | 39993 | 39997 |
| 39998 | 39999 | 40000 | 40002 | 40003 | 40004 | 40006 | 40007 | 40008 | 40009 | 40014 | 40019 |
| 40023 | 40025 | 40028 | 40031 | 40032 | 40033 | 40034 | 40036 | 40044 | 40055 | 40056 | |
| 40064 | 40065 | 40066 | 40067 | 40071 | 40072 | 40073 | 40074 | 40078 | 40081 | 40087 | 40089 |
| 40090 | 40091 | 40097 | 40103 | 40105 | 40107 | 40108 | 40110 | 40112 | 40114 | 40116 | 40117 |
| 40121 | 40125 | 40127 | 40128 | 40129 | 40132 | 40138 | 40141 | 40144 | 40147 | 40149 | 40151 |
| 40152 | 40153 | 40157 | 40161 | 40165 | 40167 | 40169 | 40175 | 40192 | 40195 | 40199 | 40200 |
| 40201 | 40204 | 40205 | 40212 | 40218 | 40219 | 40220 | 40223 | 40224 | 40229 | 40231 | 40232 |
| 40243 | 40245 | 40246 | 40247 | 40248 | 40251 | 40256 | 40258 | 40267 | 40268 | 40270 | 40272 |
| 40274 | 40275 | 40276 | 40279 | 40282 | 40283 | 40284 | 40287 | 40288 | 40290 | 40291 | 40292 |
| 40293 | 40299 | 40303 | 40304 | 40315 | 40316 | 40319 | 40321 | 40328 | 40329 | 40330 | 40331 |
| 40333 | 40334 | 40337 | 40338 | 40350 | 40351 | 40362 | 40363 | 40365 | 40366 | 40368 | |
| 40379 | 40380 | 40381 | 40385 | 40387 | 40390 | 40392 | 40394 | 40395 | 40405 | 40406 | 40407 |
| 40408 | 40410 | 40414 | 40417 | 40418 | 40421 | 40422 | 40433 | 40435 | 40436 | 40438 | 40443 |
| 40446 | 40448 | 40449 | 40450 | 40451 | 40453 | 40458 | 40460 | 40461 | 40466 | 40469 | 40470 |
| 40471 | 40472 | 40473 | 40476 | 40477 | 40479 | 40480 | 40481 | 40484 | 40495 | 40498 | 40499 |
| 40503 | 40510 | 40511 | 40514 | 40516 | 40517 | 40522 | 40526 | 40531 | 40533 | 40538 | 40542 |
| 40543 | 40547 | 40550 | 40552 | 40556 | 40557 | 40565 | 40569 | 40572 | 40575 | 40577 | 40579 |
| 40580 | 40584 | 40587 | 40589 | 40590 | 40592 | 40593 | 40594 | 40595 | 40598 | 40599 | 40600 |
| 40601 | 40602 | 40604 | 40611 | 40613 | 40615 | 40616 | 40618 | 40627 | 40628 | 40632 | |
| 40634 | 40636 | 40638 | 40641 | 40643 | 40653 | 40654 | 40655 | 40656 | 40657 | 40658 | 40661 |
| 40665 | 40666 | 40667 | 40668 | 40669 | 40670 | 40672 | 40683 | 40690 | 40692 | 40698 | 40699 |
| 40705 | 40708 | 40715 | 40718 | 40719 | 40723 | 40730 | 40731 | 40732 | 40737 | 40738 | 40739 |
| 40743 | 40750 | 40754 | 40755 | 40759 | 40760 | 40762 | 40764 | 40765 | 40766 | 40767 | 40772 |
| 40773 | 40798 | 40800 | 40801 | 40802 | 40803 | 40804 | 40805 | 40807 | 40814 | 40816 | 40820 |
| 40827 | 40828 | 40829 | 40831 | 40832 | 40833 | 40834 | 40835 | 40837 | 40839 | 40843 | 40844 |
| 40845 | 40849 | 40851 | 40852 | 40856 | 40858 | 40863 | 40864 | 40865 | 40866 | 40867 | 40868 |
| 40869 | 40870 | 40871 | 40872 | 40877 | 40879 | 40888 | 40899 | 40900 | 40901 | 40910 | 40911 |
| 40912 | 40936 | 40938 | 40939 | 40940 | 40941 | 40942 | 40943 | 40944 | 40945 | 40947 | 40948 |
| 40949 | 40951 | 40953 | 40954 | 40955 | 40956 | 40957 | 40959 | 40964 | 40966 | 40967 | 40968 |
| 40969 | 40972 | 40973 | 40974 | 40975 | 40976 | 40977 | 40978 | 40983 | 40984 | 40985 | 40988 |
| 40993 | 40994 | 40995 | 41001 | 41008 | 41009 | 41011 | 41012 | 41025 | 41026 | 41027 | 41028 |
| 41029 | 41031 | 41032 | 41036 | 41037 | 41038 | 41039 | 41040 | 41041 | 41042 | 41043 | 41047 |

TABLE 15-continued

Yield: Carbohydrate

| | | | | | | | | | | | |
|---|---|---|---|---|---|---|---|---|---|---|---|
| 41048 | 41051 | 41053 | 41054 | 41062 | 41063 | 41075 | 41076 | 41079 | 41081 | 41082 | 41083 |
| 41084 | 41085 | 41086 | 41087 | 41090 | 41092 | 41095 | 41097 | 41098 | 41099 | 41100 | 41104 |
| 41105 | 41114 | 41117 | 41120 | 41121 | 41122 | 41123 | 41124 | 41129 | 41131 | 41132 | 41133 |
| 41134 | 41135 | 41136 | 41137 | 41138 | 41145 | 41151 | 41152 | 41154 | 41157 | 41159 | 41160 |
| 41161 | 41162 | 41176 | 41182 | 41183 | 41185 | 41189 | 41192 | 41193 | 41195 | 41196 | 41198 |
| 41199 | 41200 | 41202 | 41203 | 41205 | 41215 | 41216 | 41217 | 41218 | 41221 | 41223 | 41224 |
| 41225 | 41226 | 41228 | 41229 | 41230 | 41240 | 41241 | 41242 | 41243 | 41255 | 41259 | 41260 |
| 41265 | 41281 | 41282 | 41288 | 41289 | 41290 | 41291 | 41292 | 41293 | 41297 | 41298 | 41300 |
| 41303 | 41305 | 41306 | 41312 | 41317 | 41318 | 41319 | 41320 | 41332 | 41333 | 41334 | 41335 |
| 41336 | 41339 | 41340 | 41345 | 41347 | 41348 | 41349 | 41350 | 41351 | 41352 | 41353 | 41361 |
| 41364 | 41365 | 41367 | 41368 | 41381 | 41382 | 41383 | 41387 | 41392 | 41398 | 41402 | 41406 |
| 41407 | 41408 | 41409 | 41411 | 41412 | 41427 | 41428 | 41429 | 41434 | 41441 | 41443 | 41448 |
| 41451 | 41455 | 41456 | 41457 | 41463 | 41464 | 41465 | 41467 | 41468 | 41470 | 41471 | 41472 |
| 41478 | 41482 | 41483 | 41490 | 41491 | 41495 | 41500 | 41505 | 41506 | 41512 | 41514 | 41518 |
| 41519 | 41521 | 41522 | 41523 | 41524 | 41525 | 41526 | 41527 | 41528 | 41533 | 41535 | 41540 |
| 41541 | 41547 | 41550 | 41551 | 41552 | 41553 | 41554 | 41555 | 41556 | 41559 | 41563 | 41564 |
| 41565 | 41568 | 41570 | 41571 | 41572 | 41573 | 41574 | 41575 | 41587 | 41590 | 41592 | 41593 |
| 41596 | 41603 | 41613 | 41616 | 41618 | 41619 | 41622 | 41629 | 41630 | 41634 | 41636 | 41637 |
| 41638 | 41642 | 41643 | 41645 | 41651 | 41653 | 41655 | 41667 | 41669 | 41670 | 41676 | 41678 |
| 41683 | 41684 | 41685 | 41686 | 41689 | 41691 | 41693 | 41694 | 41696 | 41698 | 41699 | 41700 |
| 41702 | 41703 | 41707 | 41708 | 41711 | 41715 | 41716 | 41721 | 41723 | 41728 | 41729 | 41730 |
| 41732 | 41735 | 41736 | 41737 | 41738 | 41741 | 41748 | 41749 | 41750 | 41751 | 41753 | 41755 |
| 41771 | 41773 | 41785 | 41786 | 41788 | 41789 | 41791 | 41794 | 41795 | 41798 | 41799 | 41801 |
| 41803 | 41807 | 41808 | 41809 | 41818 | 41820 | 41825 | 41826 | 41834 | 41835 | 41838 | 41839 |
| 41841 | 41842 | 41851 | 41852 | 41857 | 41858 | 41860 | 41870 | 41872 | 41875 | 41876 | 41877 |
| 41878 | 41880 | 41886 | 41888 | 41896 | 41897 | 41898 | 41899 | 41907 | 41913 | 41914 | 41923 |
| 41924 | 41928 | 41929 | 41941 | 41942 | 41946 | 41950 | 41952 | 41953 | 41954 | 41957 | 41958 |
| 41960 | 41961 | 41962 | 41963 | 41964 | 41965 | 41969 | 41975 | 41979 | 41980 | 41981 | 41982 |
| 41985 | 41990 | 41992 | 41994 | 41999 | 42000 | 42004 | 42005 | 42010 | 42011 | 42017 | 42023 |
| 42024 | 42029 | 42030 | 42031 | 42033 | 42036 | 42038 | 42039 | 42040 | 42041 | 42043 | 42044 |
| 42045 | 42046 | 42047 | 42054 | 42055 | 42057 | 42058 | 42059 | 42060 | 42061 | 42064 | 42073 |
| 42075 | 42081 | 42082 | 42083 | 42088 | 42089 | 42090 | 42092 | 42100 | 42101 | 42103 | 42104 |
| 42105 | 42112 | 42116 | 42117 | 42118 | 42119 | 42120 | 42128 | 42129 | 42130 | 42131 | 42136 |
| 42151 | 42154 | 42155 | 42158 | 42160 | 42161 | 42162 | 42163 | 42167 | 42176 | 42177 | 42184 |
| 42187 | 42188 | 42190 | 42192 | 42193 | 42199 | 42200 | 42204 | 42205 | 42209 | 42211 | 42215 |
| 42216 | 42217 | 42218 | 42221 | 42222 | 42231 | 42232 | 42240 | 42242 | 42246 | 42252 | 42263 |
| 42267 | 42270 | 42271 | 42272 | 42280 | 42281 | 42285 | 42286 | 42291 | 42301 | 42304 | 42305 |
| 42308 | 42309 | 42321 | 42322 | 42323 | 42339 | 42340 | 42342 | 42343 | 42345 | 42347 | 42355 |
| 42356 | 42362 | 42367 | 42368 | 42369 | 42370 | 42371 | 42377 | 42384 | 42391 | 42398 | 42399 |
| 42400 | 42402 | 42406 | 42410 | 42422 | 42430 | 42431 | 42436 | 42446 | 42447 | 42448 | 42452 |
| 42453 | 42454 | 42455 | 42462 | 42463 | 42464 | 42465 | 42468 | 42469 | 42470 | 42488 | 42489 |
| 42491 | 42496 | 42498 | 42509 | 42511 | 42512 | 42515 | 42516 | 42524 | 42526 | 42533 | 42543 |
| 42545 | 42550 | 42563 | 42566 | 42583 | 42584 | 42585 | 42599 | 42602 | 42605 | 42609 | 42615 |
| 42620 | 42624 | 42627 | 42637 | 42640 | 42645 | 42646 | 42651 | 42653 | 42658 | 42659 | 42660 |
| 42664 | 42665 | 42667 | 42668 | 42673 | 42682 | 42683 | 42687 | 42696 | 42697 | 42698 | 42704 |
| 42707 | 42710 | 42713 | 42717 | 42725 | 42727 | 42730 | 42736 | 42743 | 42749 | 42753 | 42754 |
| 42757 | 42761 | 42762 | 42763 | 42764 | 42767 | 42771 | 42772 | 42781 | 42784 | 42787 |
| 42788 | 42789 | 42794 | 42802 | 42809 | 42812 | 42814 | 42816 | 42824 | 42832 | 42842 | 42843 |
| 42850 | 42851 | 42858 | 42860 | 42861 | 42863 | 42865 | 42867 | 42869 | 42870 | 42874 | 42880 |
| 42884 | 42885 | 42887 | 42888 | 42889 | 42890 | 42892 | 42901 | 42903 | 42908 | 42909 | 42910 |
| 42918 | 42921 | 42925 | 42926 | 42927 | 42929 | 42930 | 42933 | 42937 | 42940 | 42942 | 42945 |
| 42946 | 42948 | 42949 | 42956 | 42958 | 42960 | 42969 | 42976 | 42979 | 42980 | 42982 |
| 42994 | 42996 | 42998 | 42999 | 43003 | 43017 | 43018 | 43020 | 43021 | 43026 | 43028 | 43029 |
| 43033 | 43034 | 43035 | 43038 | 43039 | 43042 | 43048 | 43052 | 43055 | 43056 | 43057 | 43059 |
| 43060 | 43063 | 43064 | 43065 | 43066 | 43070 | 43077 | 43081 | 43083 | 43084 | 43085 | 43088 |
| 43095 | 43101 | 43102 | 43103 | 43104 | 43105 | 43106 | 43109 | 43112 | 43116 | 43128 | 43129 |
| 43131 | 43132 | 43133 | 43134 | 43135 | 43136 | 43137 | 43138 | 43143 | 43159 | 43164 | 43165 |
| 43166 | 43171 | 43175 | 43178 | 43180 | 43181 | 43182 | 43184 | 43185 | 43186 | 43188 | 43189 |
| 43191 | 43204 | 43210 | 43211 | 43215 | 43217 | 43221 | 43225 | 43226 | 43227 | 43233 | 43238 |
| 43239 | 43241 | 43242 | 43243 | 43253 | 43254 | 43257 | 43267 | 43268 | 43271 | 43272 | 43274 |
| 43276 | 43277 | 43280 | 43281 | 43284 | 43301 | 43307 | 43308 | 43309 | 43310 | 43317 | 43319 |
| 43322 | 43325 | 43326 | 43348 | 43350 | 43351 | 43354 | 43355 | 43358 | 43359 | 43369 | 43375 |
| 43376 | 43377 | 43378 | 43382 | 43389 | 43390 | 43392 | 43393 | 43399 | 43402 | 43403 | 43404 |
| 43405 | 43406 | 43408 | 43410 | 43422 | 43426 | 43427 | 43428 | 43429 | 43430 | 43432 | 43438 |
| 43439 | 43440 | 43447 | 43450 | 43456 | 43457 | 43458 | 43463 | 43464 | 43468 | 43474 | 43480 |
| 43484 | 43486 | 43488 | 43489 | 43491 | 43493 | 43494 | 43495 | 43496 | 43497 | 43499 | 43501 |
| 43504 | 43507 | 43509 | 43512 | 43515 | 43522 | 43525 | 43527 | 43528 | 43531 | 43532 | 43535 |
| 43536 | 43537 | 43541 | 43545 | 43546 | 43549 | 43553 | 43554 | 43558 | 43559 | 43560 | 43561 |
| 43568 | 43569 | 43571 | 43575 | 43576 | 43580 | 43581 | 43584 | 43588 | 43591 | 43593 | 43594 |
| 43595 | 43600 | 43612 | 43614 | 43622 | 43627 | 43635 | 43636 | 43638 | 43644 | 43645 | 43646 |
| 43647 | 43652 | 43653 | 43657 | 43660 | 43665 | 43666 | 43667 | 43677 | 43679 | 43682 | 43683 |
| 43686 | 43697 | 43698 | 43701 | 43703 | 43705 | 43707 | 43713 | 43717 | 43719 | 43721 | 43730 |
| 43731 | 43732 | 43736 | 43738 | 43741 | 43743 | 43747 | 43749 | 43750 | 43757 | 43758 | 43761 |
| 43763 | 43764 | 43767 | 43770 | 43773 | 43780 | 43784 | 43786 | 43787 | 43792 | 43793 | 43794 |
| 43796 | 43803 | 43815 | 43819 | 43820 | 43823 | 43825 | 43833 | 43840 | 43841 | 43846 | 43847 |
| 43848 | 43849 | 43850 | 43852 | 43857 | 43864 | 43869 | 43877 | 43880 | 43882 | 43889 | 43905 |
| 43909 | 43915 | 43922 | 43931 | 43932 | 43936 | 43937 | 43938 | 43945 | 43954 | 43958 | 43962 |

TABLE 15-continued

Yield: Carbohydrate

| | | | | | | | | | | |
|---|---|---|---|---|---|---|---|---|---|---|
| 43966 | 43967 | 43969 | 43971 | 43973 | 43985 | 43989 | 43990 | 43991 | 43993 | 43994 | 43997 |
| 44000 | 44016 | 44017 | 44023 | 44027 | 44034 | 44035 | 44037 | 44056 | 44065 | 44068 | 44073 |
| 44078 | 44080 | 44083 | 44089 | 44091 | 44092 | 44102 | 44103 | 44104 | 44107 | 44110 | 44111 |
| 44112 | 44117 | 44118 | 44120 | 44139 | 44141 | 44143 | 44144 | 44150 | 44151 | 44152 | 44153 |
| 44154 | 44155 | 44157 | 44158 | 44160 | 44163 | 44168 | 44169 | 44176 | 44177 | 44178 | 44180 |
| 44183 | 44184 | 44185 | 44189 | 44190 | 44192 | 44193 | 44195 | 44196 | 44200 | 44205 | 44206 |
| 44209 | 44210 | 44212 | 44215 | 44218 | 44219 | 44220 | 44224 | 44227 | 44228 | 44229 | 44231 |
| 44232 | 44240 | 44242 | 44246 | 44250 | 44251 | 44254 | 44255 | 44257 | 44261 | 44264 | 44266 |
| 44270 | 44271 | 44272 | 44275 | 44279 | 44280 | 44281 | 44289 | 44290 | 44291 | 44293 | 44295 |
| 44299 | 44302 | 44303 | 44309 | 44311 | 44313 | 44318 | 44323 | 44324 | 44327 | 44334 | 44336 |
| 44343 | 44344 | 44348 | 44349 | 44350 | 44351 | 44352 | 44353 | 44357 | 44360 | 44361 | 44369 |
| 44375 | 44379 | 44380 | 44388 | 44392 | 44393 | 44394 | 44395 | 44397 | 44399 | 44400 | 44401 |
| 44403 | 44409 | 44412 | 44413 | 44416 | 44429 | 44431 | 44432 | 44433 | 44434 | 44435 | 44436 |
| 44437 | 44438 | 44439 | 44440 | 44441 | 44447 | 44448 | 44449 | 44456 | 44460 | 44467 | 44471 |
| 44476 | 44479 | 44480 | 44484 | 44487 | 44488 | 44491 | 44494 | 44496 | 44503 | 44504 | 44508 |
| 44510 | 44511 | 44512 | 44513 | 44514 | 44515 | 44523 | 44524 | 44525 | 44526 | 44531 | 44532 |
| 44533 | 44535 | 44536 | 44537 | 44541 | 44543 | 44546 | 44552 | 44553 | 44554 | 44561 | 44562 |
| 44563 | 44565 | 44570 | 44571 | 44573 | 44574 | 44576 | 44582 | 44584 | 44585 | 44586 | 44590 |
| 44603 | 44607 | 44611 | 44618 | 44619 | 44626 | 44630 | 44633 | 44638 | 44646 | 44647 | 44655 |
| 44658 | 44660 | 44664 | 44667 | 44673 | 44674 | 44675 | 44676 | 44677 | 44678 | 44685 | 44686 |
| 44690 | 44693 | 44708 | 44712 | 44718 | 44721 | 44722 | 44724 | 44725 | 44729 | 44731 | 44733 |
| 44734 | 44735 | 44736 | 44741 | 44744 | 44749 | 44751 | 44753 | 44755 | 44757 | 44758 | 44759 |
| 44761 | 44762 | 44764 | 44771 | 44773 | 44774 | 44778 | 44779 | 44781 | 44784 | 44788 | 44790 |
| 44791 | 44794 | 44798 | 44801 | 44811 | 44814 | 44817 | 44819 | 44820 | 44822 | 44829 | 44830 |
| 44833 | 44834 | 44836 | 44843 | 44849 | 44851 | 44853 | 44854 | 44855 | 44859 | 44862 | 44867 |
| 44870 | 44871 | 44872 | 44873 | 44874 | 44876 | 44877 | 44878 | 44880 | 44881 | 44887 | 44891 |
| 44892 | 44893 | 44896 | 44897 | 44898 | 44901 | 44906 | 44907 | 44932 | 44933 | 44935 | 44936 |
| 44939 | 44940 | 44949 | 44950 | 44954 | 44958 | 44964 | 44970 | 44978 | 44982 | 44985 | 44989 |
| 44990 | 44991 | 44998 | 44999 | 45000 | 45001 | 45004 | 45005 | 45011 | 45018 | 45020 | 45021 |
| 45022 | 45026 | 45035 | 45041 | 45042 | 45050 | 45051 | 45052 | 45060 | 45062 | 45064 | 45066 |
| 45068 | 45072 | 45076 | 45078 | 45089 | 45097 | 45098 | 45099 | 45103 | 45115 | 45117 | 45119 |
| 45123 | 45132 | 45136 | 45145 | 45146 | 45149 | 45153 | 45154 | 45158 | 45166 | 45170 | 45174 |
| 45188 | 45194 | 45199 | 45205 | 45207 | 45208 | 45212 | 45217 | 45220 | 45221 | 45222 | 45223 |
| 45226 | 45227 | 45233 | 45238 | 45239 | 45244 | 45247 | 45249 | 45250 | 45251 | 45263 | 45266 |
| 45269 | 45272 | 45284 | 45304 | 45305 | 45307 | 45311 | 45317 | 45324 | 45325 | 45326 | 45329 |
| 45331 | 45344 | 45345 | 45346 | 45348 | 45349 | 45353 | 45358 | 45362 | 45363 | 45368 | 45369 |
| 45373 | 45374 | 45382 | 45384 | 45387 | 45388 | 45389 | 45392 | 45393 | 45394 | 45398 | 45399 |
| 45400 | 45401 | 45402 | 45403 | 45404 | 45405 | 45407 | 45408 | 45410 | 45413 | 45417 | 45418 |
| 45419 | 45420 | 45421 | 45422 | 45423 | 45424 | 45425 | 45427 | 45428 | 45429 | 45432 | 45441 |
| 45445 | 45446 | 45447 | 45448 | 45449 | 45453 | 45455 | 45456 | 45463 | 45466 | 45468 | 45470 |
| 45476 | 45480 | 45487 | 45488 | 45493 | 45500 | 45503 | 45506 | 45507 | 45511 | 45512 | 45518 |
| 45520 | 45528 | 45531 | 45532 | 45534 | 45543 | 45544 | 45547 | 45548 | 45549 | 45551 | 45557 |
| 45560 | 45570 | 45580 | 45583 | 45593 | 45595 | 45607 | 45626 | 45633 | 45634 | 45639 |
| 45649 | 45653 | 45659 | 45662 | 45679 | 45683 | 45685 | 45686 | 45688 | 45689 | 45698 | 45699 |
| 45700 | 45702 | 45704 | 45707 | 45719 | 45720 | 45722 | 45723 | 45731 | 45733 | 45734 | 45735 |
| 45736 | 45740 | 45748 | 45749 | 45753 | 45758 | 45759 | 45761 | 45762 | 45765 | 45766 | 45775 |
| 45778 | 45783 | 45784 | 45789 | 45793 | 45794 | 45795 | 45803 | 45808 | 45809 | 45811 |
| 45812 | 45813 | 45814 | 45817 | 45821 | 45822 | 45850 | 45852 | 45867 | 45881 | 45887 | 45888 |
| 45893 | 45896 | 45897 | 45899 | 45900 | 45906 | 45917 | 45918 | 45919 | 45921 | 45922 | 45925 |
| 45926 | 45935 | 45941 | 45946 | 45947 | 45948 | 45956 | 45964 | 45973 | 45982 | 45996 | 46000 |
| 46012 | 46013 | 46014 | 46016 | 46018 | 46019 | 46022 | 46024 | 46033 | 46035 | 46048 | 46059 |
| 46064 | 46065 | 46071 | 46088 | 46089 | 46101 | 46104 | 46105 | 46106 | 46117 | 46125 | 46127 |
| 46128 | 46135 | 46138 | 46150 | 46178 | 46182 | 46187 | 46189 | 46190 | 46193 | 46195 | 46197 |
| 46201 | 46207 | 46220 | 46223 | 46236 | 46259 | 46265 | 46272 | 46273 | 46280 | 46281 | 46282 |
| 46285 | 46301 | 46310 | 46317 | 46318 | 46319 | 46320 | 46322 | 46323 | 46327 | 46335 | 46342 |
| 46350 | 46356 | 46364 | 46366 | 46387 | 46396 | 46410 | 46423 | 46434 | 46436 | 46446 | 46451 |
| 46453 | 46457 | 46467 | 46473 | 46474 | 46488 | 46506 | 46509 | 46510 | 46517 | 46518 | 46520 |
| 46523 | 46524 | 46532 | 46533 | 46542 | 46543 | 46545 | 46546 | 46548 | 46549 | 46551 | 46552 |
| 46559 | 46560 | 46577 | 46579 | 46580 | 46586 | 46596 | 46598 | 46601 | 46602 | 46603 | 46604 |
| 46606 | 46609 | 46611 | 46618 | 46620 | 46632 | 46633 | 46641 | 46650 | 46652 | 46654 | 46661 |
| 46662 | 46665 | 46671 | 46672 | 46678 | 46685 | 46686 | 46687 | 46693 | 46695 | 46696 | 46702 |
| 46713 | 46714 | 46718 | 46719 | 46721 | 46726 | 46742 | 46745 | 46754 | 46756 | 46757 | 46758 |
| 46760 | 46762 | 46764 | 46767 | 46768 | 46769 | 46771 | 46773 | 46779 | 46783 | 46784 | 46789 |
| 46791 | 46792 | 46793 | 46794 | 46796 | 46797 | 46799 | 46809 | 46810 | 46812 | 46813 | 46820 |
| 46825 | 46826 | 46827 | 46830 | 46831 | 46834 | 46835 | 46837 | 46838 | 46839 | 46841 | 46849 |
| 46851 | 46852 | 46856 | 46857 | 46873 | 46874 | 46876 | 46877 | 46878 | 46879 | 46880 | 46881 |
| 46882 | 46890 | 46896 | 46897 | 46899 | 46904 | 46912 | 46913 | 46914 | 46916 | 46918 | 46919 |
| 46920 | 46921 | 46922 | 46923 | 46924 | 46925 | 46926 | 46927 | 46928 | 46929 | 46931 | 46934 |
| 46936 | 46939 | 46940 | 46946 | 46947 | 46948 | 46949 | 46950 | 46951 | 46952 | 46953 | 46954 |
| 46955 | 46957 | 46959 | 46962 | 46963 | 46964 | 46969 | 46973 | 46974 | 46975 | 46976 | 46978 |
| 46979 | 46983 | 46986 | 46987 | 46988 | 46989 | 46990 | 46991 | 46994 | 46996 | 46997 | 46998 |
| 47000 | 47001 | 47008 | 47009 | 47010 | 47011 | 47012 | 47013 | 47014 | 47020 | 47023 | 47032 |
| 47034 | 47036 | 47038 | 47039 | 47040 | 47041 | 47042 | 47048 | 47049 | 47054 | 47055 | 47056 |
| 47057 | 47058 | 47060 | 47061 | 47062 | 47063 | 47064 | 47066 | 47072 | 47075 | 47076 | 47077 |
| 47083 | 47086 | 47087 | 47095 | 47096 | 47097 | 47100 | 47106 | 47110 | 47119 | 47120 | 47121 |
| 47129 | 47130 | 47131 | 47132 | 47133 | 47134 | 47137 | 47143 | 47144 | 47149 | 47151 | 47155 |
| 47156 | 47158 | 47166 | 47169 | 47171 | 47172 | 47177 | 47180 | 47188 | 47192 | 47194 | 47198 |

TABLE 15-continued

Yield: Carbohydrate

| | | | | | | | | | | |
|---|---|---|---|---|---|---|---|---|---|---|
| 47200 | 47203 | 47204 | 47205 | 47212 | 47214 | 47218 | 47223 | 47224 | 47225 | 47228 | 47229 |
| 47232 | 47233 | 47234 | 47238 | 47239 | 47241 | 47242 | 47245 | 47246 | 47248 | 47250 | 47253 |
| 47258 | 47259 | 47264 | 47265 | 47268 | 47269 | 47270 | 47271 | 47272 | 47273 | 47274 | 47275 |
| 47281 | 47283 | 47285 | 47286 | 47288 | 47289 | 47292 | 47295 | 47297 | 47303 | 47306 | 47307 |
| 47317 | 47318 | 47322 | 47325 | 47326 | 47327 | 47333 | 47337 | 47342 | 47343 | 47345 | 47352 |
| 47353 | 47354 | 47359 | 47360 | 47364 | 47366 | 47374 | | | | | |

TABLE 16

Yield: Nitrogen

Table 16A SEQ ID NOs of Polypeptides useful for improving Yield: Nitrogen

| | | | | | | | | | | |
|---|---|---|---|---|---|---|---|---|---|---|
| 9 | 18 | 21 | 68 | 71 | 76 | 93 | 94 | 110 | 129 | 139 | 209 |
| 231 | 261 | 262 | 264 | 287 | 295 | 333 | 345 | 350 | 353 | 362 | 364 |
| 443 | 447 | 455 | 508 | 603 | 612 | 616 | 618 | 625 | 626 | 681 | 699 |
| 722 | 755 | 768 | 780 | 785 | 789 | 798 | 805 | 806 | 807 | 808 | 811 |
| 815 | 827 | 828 | 829 | 830 | 831 | 832 | 840 | 852 | 859 | 869 | 873 |
| 901 | 918 | 919 | 968 | 970 | 1022 | 1032 | 1089 | 1110 | 1112 | 1224 | 1225 |
| 1295 | 1296 | 1312 | 1326 | 1354 | 1518 | 1584 | 1592 | 1747 | 1753 | 1806 | 1877 |
| 1988 | 1993 | 1995 | 2082 | 2124 | 2126 | 2129 | 2152 | 2160 | 2166 | 2199 | 2209 |
| 2246 | 2251 | 2341 | 2398 | 2407 | 2409 | 2411 | 2470 | 2550 | 2624 | 2629 | 2684 |
| 2727 | 2741 | 2820 | 2846 | 2899 | 2920 | 2954 | 2983 | 2987 | 3002 | 3005 | 3012 |
| 3017 | 3061 | 3132 | 3169 | 3171 | 3181 | 3194 | 3233 | 3259 | 3264 | 3316 | 3334 |
| 3348 | 3368 | 3379 | 3409 | 3500 | 3516 | 3611 | 3674 | 3675 | 3684 | 3685 | 3710 |
| 3771 | 3810 | 3828 | 4000 | 4046 | 4076 | 4128 | 4194 | 4229 | 4269 | 4299 | 4303 |
| 4355 | 4377 | 4407 | 4409 | 4420 | 4451 | 4481 | 4493 | 4505 | 4565 | 4569 | 4653 |
| 4678 | 4717 | 4738 | 4748 | 4762 | 4805 | 4817 | 4827 | 4828 | 4850 | 4862 | 4873 |
| 4890 | 4919 | 4940 | 4943 | 4964 | 5020 | 5152 | 5211 | 5214 | 5215 | 5279 | 5480 |
| 5510 | 5701 | 5737 | 5771 | 5778 | 5788 | 5801 | 5859 | 5868 | 5924 | 5925 | 5926 |
| 6069 | 6093 | 6105 | 6194 | 6232 | 6505 | 6717 | 6793 | 6871 | 6907 | 6912 | 6990 |
| 7055 | 7059 | 7109 | 7131 | 7163 | 7165 | 7176 | 7211 | 7240 | 7252 | 7263 | 7323 |
| 7326 | 7411 | 7437 | 7476 | 7497 | 7508 | 7521 | 7564 | 7576 | 7586 | 7587 | 7609 |
| 7621 | 7633 | 7648 | 7677 | 7698 | 7701 | 7722 | 7787 | 7788 | 7795 | 7805 | 7811 |
| 7854 | 7859 | 7863 | 7864 | 7868 | 7873 | 7898 | 7937 | 7939 | 7952 | 7994 | 8032 |
| 8057 | 8066 | 8100 | 8121 | 8160 | 8204 | 8215 | 8265 | 8274 | 8304 | 8332 | 8359 |
| 8367 | 8374 | 8415 | 8422 | 8424 | 8425 | 8445 | 8456 | 8477 | 8489 | 8504 | 8528 |
| 8544 | 8574 | 8605 | 8616 | 8635 | 8636 | 8637 | 8638 | 8659 | 8680 | 8685 | 8686 |
| 8715 | 8819 | 8880 | 8931 | 8943 | 8949 | 8952 | 8969 | 9010 | 9039 | 9059 | 9060 |
| 9074 | 9091 | 9153 | 9193 | 9200 | 9222 | 9225 | 9231 | 9268 | 9308 | 9332 | 9340 |
| 9401 | 9410 | 9412 | 9413 | 9438 | 9458 | 9462 | 9480 | 9519 | 9575 | 9583 | 9629 |
| 9643 | 9657 | 9662 | 9663 | 9670 | 9682 | 9687 | 9693 | 9698 | 9699 | 9702 | 9707 |
| 9709 | 9728 | 9729 | 9730 | 9736 | 9741 | 9752 | 9756 | 9757 | 9758 | 9760 | 9763 |
| 9783 | 9784 | 9796 | 9797 | 9801 | 9810 | 9816 | 9817 | 9823 | 9824 | 9825 | 9839 |
| 9842 | 9843 | 9844 | 9845 | 9846 | 9847 | 9848 | 9849 | 9850 | 9871 | 9872 | 9873 |
| 9882 | 9883 | 9885 | 9887 | 9906 | 9911 | 9914 | 9915 | 9917 | 9918 | 9919 | 9921 |
| 9941 | 9947 | 9948 | 9954 | 9955 | 9965 | 9998 | 9999 | 10018 | 10065 | 10104 | 10192 |
| 10222 | 10237 | 10253 | 10296 | 10337 | 10347 | 10402 | 10428 | 10444 | 10463 | 10515 | 10516 |
| 10530 | 10585 | 10607 | 10621 | 10634 | 10641 | 10742 | 10792 | 10804 | 10831 | 10856 | 10857 |
| 10909 | 10949 | 10957 | 10974 | 10986 | 10994 | 11053 | 11054 | 11072 | 11105 | 11138 | 11160 |
| 11193 | 11202 | 11227 | 11249 | 11264 | 11265 | 11281 | 11288 | 11309 | 11314 | 11413 | 11446 |
| 11458 | 11459 | 11481 | 11546 | 11582 | 11592 | 11632 | 11650 | 11661 | 11690 | 11720 | 11747 |
| 11749 | 11802 | 11803 | 11804 | 11815 | 11824 | 11840 | 11878 | 11947 | 11974 | 11985 | 11997 |
| 12026 | 12063 | 12083 | 12094 | 12135 | 12138 | 12153 | 12171 | 12196 | 12252 | 12375 | 12458 |
| 12507 | 12528 | 12529 | 12558 | 12605 | 12620 | 12676 | 12683 | 12686 | 12716 | 12761 | 12770 |
| 12797 | 12800 | 12823 | 12849 | 12996 | 13000 | 13055 | 13156 | 13163 | 13313 | 13323 | 13333 |
| 13334 | 13396 | 13446 | 13471 | 13472 | 13478 | 13479 | 13537 | 13538 | 13539 | 13556 | 13707 |
| 13716 | 13721 | 13723 | 13729 | 13793 | 13794 | 13797 | 13875 | 13926 | 13989 | 14012 | 14024 |
| 14025 | 14041 | 14066 | 14070 | 14106 | 14123 | 14192 | 14199 | 14208 | 14216 | 14232 | 14235 |
| 14248 | 14250 | 14275 | 14353 | 14383 | 14384 | 14487 | 14507 | 14518 | 14551 | 14625 | 14657 |
| 14698 | 14713 | 14715 | 14724 | 14725 | 14746 | 14754 | 14832 | 14871 | 14911 | 14966 | 15002 |
| 15020 | 15076 | 15120 | 15132 | 15181 | 15194 | 15196 | 15204 | 15206 | 15224 | 15233 | 15260 |
| 15388 | 15390 | 15399 | 15400 | 15442 | 15460 | 15471 | 15478 | 15479 | 15515 | 15529 | 15627 |
| 15694 | 15756 | 15758 | 15767 | 15768 | 15811 | 15828 | 15841 | 15848 | 15849 | 15887 | 15900 |
| 16002 | 16085 | 16139 | 16142 | 16151 | 16152 | 16190 | 16208 | 16262 | 16271 | 16355 | 16380 |
| 16417 | 16452 | 16481 | 16517 | 16565 | 16566 | 16567 | 16568 | 16595 | 16598 | 16642 | 16643 |
| 16660 | 16662 | 16683 | 16709 | 16715 | 16771 | 16791 | 16801 | 16814 | 16852 | 16896 | 16946 |
| 16996 | 17020 | 17080 | 17121 | 17134 | 17135 | 17155 | 17177 | 17231 | 17284 | 17329 | 17336 |
| 17348 | 17365 | 17373 | 17380 | 17396 | 17397 | 17466 | 17476 | 17487 | 17508 | 17572 | 17599 |
| 17658 | 17663 | 17688 | 17701 | 17708 | 17726 | 17747 | 17764 | 17765 | 17766 | 17785 | 17859 |
| 17936 | 18027 | 18054 | 18088 | 18098 | 18099 | 18107 | 18149 | 18176 | 18177 | 18192 | 18205 |
| 18338 | 18352 | 18353 | 18354 | 18367 | 18379 | 18406 | 18413 | 18414 | 18420 | 18537 | 18569 |
| 18586 | 18587 | 18612 | 18653 | 18713 | 18763 | 18804 | 18851 | 18852 | 18882 | 18914 | 18971 |
| 18978 | 19022 | 19037 | 19055 | 19072 | 19073 | 19082 | 19106 | 19182 | 19185 | 19187 | 19216 |

TABLE 16-continued

Yield: Nitrogen

| | | | | | | | | | | |
|---|---|---|---|---|---|---|---|---|---|---|
| 19256 | 19431 | 19433 | 19461 | 19464 | 19466 | 19478 | 19522 | 19572 | 19579 | 19605 | 19630 |
| 19680 | 19706 | 19709 | 19745 | 19782 | 19783 | 19784 | 19826 | 19847 | 19849 | 19916 | 19978 |
| 20008 | 20016 | 20035 | 20050 | 20133 | 20229 | 20233 | 20241 | 20270 | 20361 | 20362 | 20377 |
| 20391 | 20423 | 20469 | 20480 | 20485 | 20497 | 20548 | 20562 | 20580 | 20657 | 20695 | 20742 |
| 20747 | 20764 | 20801 | 20813 | 20814 | 20815 | 20855 | 20897 | 20919 | 20925 | 20927 | 21007 |
| 21015 | 21016 | 21038 | 21094 | 21125 | 21132 | 21147 | 21154 | 21158 | 21246 | 21281 | 21288 |
| 21327 | 21336 | 21337 | 21355 | 21391 | 21412 | 21429 | 21442 | 21467 | 21487 | 21513 | 21516 |
| 21525 | 21563 | 21564 | 21586 | 21603 | 21604 | 21658 | 21659 | 21669 | 21701 | 21706 | 21722 |
| 21743 | 21752 | 21757 | 21786 | 21803 | 21831 | 21835 | 21850 | 21952 | 22023 | 22097 | 22130 |
| 22152 | 22161 | 22197 | 22241 | 22307 | 22331 | 22377 | 22403 | 22439 | 22508 | 22516 | 22519 |
| 22553 | 22715 | 22814 | 22858 | 22887 | 22888 | 22889 | 22895 | 22909 | 22919 | 22932 | 22938 |
| 22969 | 23003 | 23017 | 23040 | 23076 | 23150 | 23159 | 23183 | 23195 | 23214 | 23218 | 23225 |
| 23238 | 23239 | 23293 | 23312 | 23315 | 23339 | 23340 | 23341 | 23342 | 23350 | 23387 | 23418 |
| 23422 | 23437 | 23479 | 23516 | 23523 | 23597 | 23610 | 23628 | 23636 | 23657 | 23660 | |

Table 16B SEQ ID NOs of Polynucleotides useful for improving Yield: Nitrogen

| | | | | | | | | | | |
|---|---|---|---|---|---|---|---|---|---|---|
| 23696 | 23705 | 23708 | 23755 | 23758 | 23763 | 23780 | 23781 | 23797 | 23816 | 23826 | 23896 |
| 23918 | 23948 | 23949 | 23951 | 23974 | 23982 | 24020 | 24032 | 24037 | 24040 | 24049 | 24051 |
| 24130 | 24134 | 24142 | 24195 | 24290 | 24299 | 24303 | 24305 | 24312 | 24313 | 24368 | 24386 |
| 24409 | 24442 | 24455 | 24467 | 24472 | 24476 | 24485 | 24492 | 24493 | 24494 | 24495 | 24498 |
| 24502 | 24514 | 24515 | 24516 | 24517 | 24518 | 24519 | 24527 | 24539 | 24546 | 24556 | 24560 |
| 24588 | 24605 | 24606 | 24655 | 24657 | 24709 | 24719 | 24776 | 24797 | 24799 | 24911 | 24912 |
| 24982 | 24983 | 24999 | 25013 | 25041 | 25205 | 25271 | 25279 | 25434 | 25440 | 25493 | 25564 |
| 25675 | 25680 | 25682 | 25769 | 25811 | 25813 | 25816 | 25839 | 25847 | 25853 | 25886 | 25896 |
| 25933 | 25938 | 26028 | 26085 | 26094 | 26096 | 26098 | 26157 | 26237 | 26311 | 26316 | 26371 |
| 26414 | 26428 | 26507 | 26533 | 26586 | 26607 | 26641 | 26670 | 26674 | 26689 | 26692 | 26699 |
| 26704 | 26748 | 26819 | 26856 | 26858 | 26868 | 26881 | 26920 | 26946 | 26951 | 27003 | 27021 |
| 27035 | 27055 | 27066 | 27096 | 27187 | 27203 | 27298 | 27361 | 27362 | 27371 | 27372 | 27397 |
| 27458 | 27497 | 27515 | 27687 | 27733 | 27763 | 27815 | 27881 | 27916 | 27956 | 27986 | 27990 |
| 28042 | 28064 | 28094 | 28096 | 28107 | 28138 | 28168 | 28180 | 28192 | 28252 | 28256 | 28340 |
| 28365 | 28404 | 28425 | 28435 | 28449 | 28492 | 28504 | 28514 | 28515 | 28537 | 28549 | 28560 |
| 28577 | 28606 | 28627 | 28630 | 28651 | 28707 | 28839 | 28898 | 28901 | 28902 | 28966 | 29167 |
| 29197 | 29388 | 29424 | 29458 | 29465 | 29475 | 29488 | 29546 | 29555 | 29611 | 29612 | 29613 |
| 29756 | 29780 | 29792 | 29881 | 29919 | 30192 | 30404 | 30480 | 30558 | 30594 | 30599 | 30677 |
| 30742 | 30746 | 30796 | 30818 | 30850 | 30852 | 30863 | 30898 | 30927 | 30939 | 30950 | 31010 |
| 31013 | 31098 | 31124 | 31163 | 31184 | 31195 | 31208 | 31251 | 31263 | 31273 | 31274 | 31296 |
| 31308 | 31320 | 31335 | 31364 | 31385 | 31388 | 31409 | 31474 | 31475 | 31482 | 31492 | 31498 |
| 31541 | 31546 | 31550 | 31551 | 31555 | 31560 | 31585 | 31624 | 31626 | 31639 | 31681 | 31719 |
| 31744 | 31753 | 31787 | 31808 | 31847 | 31891 | 31902 | 31952 | 31961 | 31991 | 32019 | 32046 |
| 32054 | 32061 | 32102 | 32109 | 32111 | 32112 | 32132 | 32143 | 32164 | 32176 | 32191 | 32215 |
| 32231 | 32261 | 32292 | 32303 | 32322 | 32323 | 32324 | 32325 | 32346 | 32367 | 32372 | 32373 |
| 32402 | 32506 | 32567 | 32618 | 32630 | 32636 | 32639 | 32656 | 32697 | 32726 | 32746 | 32747 |
| 32761 | 32778 | 32840 | 32880 | 32887 | 32909 | 32912 | 32955 | 32995 | 33019 | 33027 | |
| 33088 | 33097 | 33099 | 33100 | 33125 | 33145 | 33149 | 33167 | 33206 | 33262 | 33270 | 33316 |
| 33330 | 33344 | 33349 | 33350 | 33357 | 33369 | 33374 | 33380 | 33385 | 33386 | 33389 | 33394 |
| 33396 | 33415 | 33416 | 33417 | 33423 | 33428 | 33439 | 33443 | 33444 | 33445 | 33447 | 33450 |
| 33470 | 33471 | 33483 | 33484 | 33488 | 33497 | 33503 | 33504 | 33511 | 33512 | 33526 | |
| 33529 | 33530 | 33531 | 33532 | 33533 | 33534 | 33535 | 33536 | 33537 | 33558 | 33559 | 33560 |
| 33569 | 33570 | 33572 | 33574 | 33593 | 33598 | 33601 | 33602 | 33604 | 33605 | 33606 | 33608 |
| 33628 | 33634 | 33635 | 33641 | 33642 | 33652 | 33685 | 33686 | 33705 | 33752 | 33791 | 33879 |
| 33909 | 33924 | 33940 | 33983 | 34024 | 34034 | 34089 | 34115 | 34131 | 34150 | 34202 | 34203 |
| 34217 | 34272 | 34294 | 34308 | 34321 | 34328 | 34429 | 34479 | 34491 | 34518 | 34543 | 34544 |
| 34596 | 34636 | 34644 | 34661 | 34673 | 34681 | 34740 | 34741 | 34759 | 34792 | 34825 | 34847 |
| 34880 | 34889 | 34914 | 34936 | 34951 | 34952 | 34968 | 34975 | 34996 | 35001 | 35100 | 35133 |
| 35145 | 35146 | 35168 | 35233 | 35269 | 35279 | 35319 | 35337 | 35348 | 35377 | 35407 | 35434 |
| 35436 | 35489 | 35490 | 35491 | 35502 | 35511 | 35527 | 35565 | 35634 | 35661 | 35672 | 35684 |
| 35713 | 35750 | 35770 | 35781 | 35822 | 35825 | 35840 | 35858 | 35883 | 35939 | 36062 | 36145 |
| 36194 | 36215 | 36216 | 36245 | 36292 | 36307 | 36363 | 36370 | 36373 | 36403 | 36448 | 36457 |
| 36484 | 36487 | 36510 | 36536 | 36683 | 36687 | 36742 | 36843 | 36850 | 37000 | 37010 | 37020 |
| 37021 | 37083 | 37133 | 37158 | 37159 | 37165 | 37166 | 37224 | 37225 | 37226 | 37243 | 37394 |
| 37403 | 37408 | 37410 | 37416 | 37480 | 37481 | 37484 | 37562 | 37613 | 37676 | 37699 | 37711 |
| 37712 | 37728 | 37753 | 37757 | 37793 | 37810 | 37879 | 37886 | 37895 | 37903 | 37919 | 37922 |
| 37935 | 37937 | 37962 | 38040 | 38070 | 38071 | 38174 | 38194 | 38205 | 38238 | 38312 | 38344 |
| 38385 | 38400 | 38402 | 38411 | 38412 | 38433 | 38441 | 38463 | 38558 | 38598 | 38653 | 38689 |
| 38707 | 38763 | 38807 | 38819 | 38868 | 38881 | 38883 | 38891 | 38893 | 38911 | 38920 | 38947 |
| 39075 | 39077 | 39086 | 39087 | 39129 | 39147 | 39158 | 39165 | 39166 | 39202 | 39216 | 39314 |
| 39381 | 39443 | 39445 | 39454 | 39455 | 39498 | 39515 | 39528 | 39535 | 39536 | 39574 | 39587 |
| 39689 | 39772 | 39826 | 39829 | 39838 | 39839 | 39877 | 39895 | 39949 | 39958 | 40042 | 40067 |
| 40104 | 40139 | 40168 | 40204 | 40252 | 40253 | 40254 | 40255 | 40282 | 40285 | 40329 | 40330 |
| 40347 | 40349 | 40370 | 40396 | 40402 | 40458 | 40478 | 40488 | 40501 | 40539 | 40583 | 40633 |
| 40683 | 40707 | 40767 | 40808 | 40821 | 40822 | 40842 | 40864 | 40918 | 40971 | 41016 | 41023 |
| 41035 | 41052 | 41060 | 41067 | 41083 | 41084 | 41153 | 41174 | 41195 | 41259 | 41286 | |
| 41345 | 41350 | 41375 | 41388 | 41395 | 41413 | 41434 | 41451 | 41452 | 41453 | 41472 | 41546 |
| 41623 | 41714 | 41741 | 41775 | 41785 | 41786 | 41794 | 41836 | 41863 | 41864 | 41879 | 41892 |
| 42025 | 42039 | 42040 | 42041 | 42054 | 42066 | 42093 | 42100 | 42101 | 42107 | 42224 | 42256 |
| 42273 | 42274 | 42299 | 42340 | 42400 | 42450 | 42491 | 42538 | 42539 | 42569 | 42601 | 42658 |
| 42665 | 42709 | 42724 | 42742 | 42759 | 42760 | 42769 | 42793 | 42869 | 42872 | 42874 | 42903 |

TABLE 16-continued

Yield: Nitrogen

| | | | | | | | | | | | |
|---|---|---|---|---|---|---|---|---|---|---|---|
| 42943 | 43118 | 43120 | 43148 | 43151 | 43153 | 43165 | 43209 | 43259 | 43266 | 43292 | 43317 |
| 43367 | 43393 | 43396 | 43432 | 43469 | 43470 | 43471 | 43513 | 43534 | 43536 | 43603 | 43665 |
| 43695 | 43703 | 43722 | 43737 | 43820 | 43916 | 43920 | 43928 | 43957 | 44048 | 44049 | 44064 |
| 44078 | 44110 | 44156 | 44167 | 44172 | 44184 | 44235 | 44249 | 44267 | 44344 | 44382 | 44429 |
| 44434 | 44451 | 44488 | 44500 | 44501 | 44502 | 44542 | 44584 | 44606 | 44612 | 44614 | 44694 |
| 44702 | 44703 | 44725 | 44781 | 44812 | 44819 | 44834 | 44841 | 44845 | 44933 | 44968 | 44975 |
| 45014 | 45023 | 45024 | 45042 | 45078 | 45099 | 45116 | 45129 | 45154 | 45174 | 45200 | 45203 |
| 45212 | 45250 | 45251 | 45273 | 45290 | 45291 | 45345 | 45346 | 45356 | 45388 | 45393 | 45409 |
| 45430 | 45439 | 45444 | 45473 | 45490 | 45518 | 45522 | 45537 | 45639 | 45710 | 45784 | 45817 |
| 45839 | 45848 | 45884 | 45928 | 45994 | 46018 | 46064 | 46090 | 46126 | 46195 | 46203 | 46206 |
| 46240 | 46402 | 46501 | 46545 | 46574 | 46575 | 46576 | 46582 | 46596 | 46606 | 46619 | 46625 |
| 46656 | 46690 | 46704 | 46727 | 46763 | 46837 | 46846 | 46870 | 46882 | 46901 | 46905 | 46912 |
| 46925 | 46926 | 46980 | 46999 | 47002 | 47026 | 47027 | 47028 | 47029 | 47037 | 47074 | 47105 |
| 47109 | 47124 | 47166 | 47203 | 47210 | 47284 | 47297 | 47315 | 47323 | 47344 | 47347 | |

TABLE 17

Yield: Phosphorus

Table 17A SEQ ID NOs of Polypeptides useful for improving Yield: Phosphorus

| | | | | | | | | | | | |
|---|---|---|---|---|---|---|---|---|---|---|---|
| 24 | 304 | 438 | 695 | 861 | 982 | 1023 | 1074 | 1109 | 1177 | 1187 | 1396 |
| 1401 | 1403 | 1421 | 1424 | 1453 | 1454 | 1475 | 1482 | 1486 | 1488 | 1498 | 1514 |
| 1532 | 1538 | 1549 | 1560 | 1574 | 1576 | 1578 | 1581 | 1595 | 1596 | 1600 | 1619 |
| 1696 | 1697 | 1700 | 1721 | 1742 | 1766 | 1767 | 1795 | 1820 | 1841 | 1842 | 1864 |
| 1874 | 1879 | 1891 | 1895 | 1908 | 1924 | 1938 | 1940 | 1967 | 1968 | 1989 | 1991 |
| 2000 | 2012 | 2016 | 2039 | 2049 | 2069 | 2076 | 2085 | 2088 | 2092 | 2103 | 2108 |
| 2159 | 2161 | 2177 | 2187 | 2188 | 2212 | 2236 | 2248 | 2280 | 2299 | 2314 | 2320 |
| 2338 | 2349 | 2355 | 2371 | 2376 | 2385 | 2395 | 2414 | 2422 | 2434 | 2451 | 2454 |
| 2462 | 2494 | 2499 | 2503 | 2511 | 2515 | 2525 | 2533 | 2549 | 2557 | 2565 | 2571 |
| 2577 | 2581 | 2589 | 2611 | 2897 | 3045 | 3079 | 3091 | 3101 | 3110 | 3112 | 3147 |
| 3204 | 3205 | 3211 | 3221 | 3225 | 3229 | 3257 | 3269 | 3275 | 3282 | 3287 | 3303 |
| 3312 | 3329 | 3416 | 3428 | 3434 | 3438 | 3451 | 3452 | 3477 | 3483 | 3485 | 3514 |
| 3528 | 3552 | 3560 | 3569 | 3574 | 3596 | 3613 | 3635 | 3697 | 3718 | 3719 | 3738 |
| 3744 | 3752 | 3796 | 3848 | 3859 | 3860 | 3864 | 3880 | 3898 | 3944 | 3956 | 3957 |
| 3991 | 4007 | 4014 | 4015 | 4017 | 4023 | 4063 | 4090 | 4106 | 4120 | 4121 | 4132 |
| 4162 | 4163 | 4170 | 4193 | 4257 | 4459 | 4708 | 4782 | 4845 | 4904 | 4977 | 4979 |
| 4995 | 5032 | 5056 | 5060 | 5086 | 5133 | 5137 | 5138 | 5153 | 5156 | 5159 | 5186 |
| 5198 | 5227 | 5234 | 5235 | 5236 | 5237 | 5271 | 5309 | 5310 | 5311 | 5312 | 5321 |
| 5376 | 5388 | 5394 | 5422 | 5424 | 5475 | 5481 | 5500 | 5517 | 5554 | 5555 | 5566 |
| 5572 | 5573 | 5582 | 5645 | 5653 | 5655 | 5662 | 5685 | 5689 | 5692 | 5739 | 5763 |
| 5806 | 5808 | 5809 | 5810 | 5811 | 5838 | 5839 | 5849 | 5857 | 5877 | 5920 | 5930 |
| 5935 | 5936 | 5937 | 5950 | 5955 | 5956 | 5964 | 5997 | 6037 | 6038 | 6063 | 6064 |
| 6070 | 6074 | 6075 | 6117 | 6118 | 6119 | 6136 | 6137 | 6138 | 6155 | 6168 | 6169 |
| 6170 | 6181 | 6187 | 6203 | 6217 | 6267 | 6347 | 6401 | 6479 | 6482 | 6483 | 6518 |
| 6537 | 6603 | 6606 | 6696 | 6753 | 6770 | 6791 | 6806 | 6854 | 6872 | 6913 | 6928 |
| 6929 | 6973 | 6974 | 6975 | 6998 | 7009 | 7012 | 7027 | 7111 | 7219 | 7467 | 7542 |
| 7662 | 7763 | 7915 | 8221 | 8491 | 8778 | 8820 | 8937 | 8971 | 9070 | 9210 | 9402 |
| 9680 | 9886 | 9940 | 9973 | 9979 | 10025 | 10030 | 10068 | 10116 | 10123 | 10137 | 10177 |
| 10180 | 10458 | 10529 | 10905 | 10916 | 10930 | 10931 | 10938 | 10992 | 11027 | 11038 | 11041 |
| 11191 | 11502 | 11543 | 11577 | 11846 | 12090 | 12204 | 12230 | 12410 | 12474 | 12485 | 12509 |
| 12518 | 12539 | 12552 | 12557 | 12564 | 12567 | 12582 | 12609 | 12615 | 12616 | 12653 | 12677 |
| 12689 | 12691 | 12731 | 12752 | 12754 | 12755 | 12758 | 12816 | 12834 | 12871 | 12880 | 12887 |
| 12915 | 12936 | 12945 | 12951 | 12952 | 12966 | 12981 | 13070 | 13141 | 13162 | 13164 | 13178 |
| 13183 | 13194 | 13208 | 13224 | 13231 | 13245 | 13302 | 13306 | 13329 | 13360 | 13374 | 13447 |
| 13465 | 13497 | 13575 | 13816 | 13847 | 14075 | 14243 | 14438 | 14505 | 14676 | 14720 | 14906 |
| 15156 | 15200 | 15424 | 15792 | 16174 | 16415 | 16699 | 16765 | 16836 | 17119 | 17493 | 18047 |
| 18083 | 18089 | 18138 | 18259 | 18270 | 18271 | 18272 | 18398 | 18527 | 18948 | 19095 | 19219 |
| 19251 | 19399 | 19415 | 19480 | 19598 | 19933 | 19982 | 20023 | 20293 | 20449 | 20678 | 20734 |
| 21036 | 21137 | 21242 | 21448 | 21477 | 21548 | 21882 | 21919 | 21949 | 21964 | 21974 | 22007 |
| 22019 | 22030 | 22056 | 22065 | 22070 | 22082 | 22088 | 22108 | 22138 | 22144 | 22148 | |
| 22151 | 22154 | 22174 | 22196 | 22225 | 22228 | 22235 | 22242 | 22243 | 22255 | 22277 | 22281 |
| 22300 | 22319 | 22346 | 22360 | 22364 | 22367 | 22400 | 22401 | 22409 | 22432 | 22459 | 22460 |
| 22461 | 22471 | 22498 | 22500 | 22502 | 22520 | 22522 | 22528 | 22537 | 22575 | 22588 | 22624 |
| 22625 | 22653 | 22669 | 22678 | 22702 | 22712 | 22739 | 22741 | 22744 | 22764 | 22882 | 23056 |
| 23072 | 23411 | 23460 | 23611 | 23661 | | | | | | | |

Table 17B SEQ ID NOs of Polynucleotides useful for improving Yield: Phosphorus

| | | | | | | | | | | | |
|---|---|---|---|---|---|---|---|---|---|---|---|
| 23711 | 23991 | 24125 | 24382 | 24548 | 24669 | 24710 | 24761 | 24796 | 24864 | 24874 | 25083 |
| 25088 | 25090 | 25108 | 25111 | 25140 | 25141 | 25162 | 25169 | 25173 | 25175 | 25185 | 25201 |
| 25219 | 25225 | 25236 | 25247 | 25261 | 25263 | 25265 | 25268 | 25282 | 25283 | 25287 | 25306 |
| 25383 | 25384 | 25387 | 25408 | 25429 | 25453 | 25454 | 25482 | 25507 | 25528 | 25529 | 25551 |
| 25561 | 25566 | 25578 | 25582 | 25595 | 25611 | 25625 | 25627 | 25654 | 25655 | 25676 | 25678 |
| 25687 | 25699 | 25703 | 25726 | 25736 | 25756 | 25763 | 25772 | 25775 | 25779 | 25790 | 25795 |

TABLE 17-continued

Yield: Phosphorus

| | | | | | | | | | | | |
|---|---|---|---|---|---|---|---|---|---|---|---|
| 25846 | 25848 | 25864 | 25874 | 25875 | 25899 | 25923 | 25935 | 25967 | 25986 | 26001 | 26007 |
| 26025 | 26036 | 26042 | 26058 | 26063 | 26072 | 26082 | 26101 | 26109 | 26121 | 26138 | 26141 |
| 26149 | 26181 | 26186 | 26190 | 26198 | 26202 | 26212 | 26220 | 26236 | 26244 | 26252 | 26258 |
| 26264 | 26268 | 26276 | 26298 | 26584 | 26732 | 26766 | 26778 | 26788 | 26797 | 26799 | 26834 |
| 26891 | 26892 | 26898 | 26908 | 26912 | 26916 | 26944 | 26956 | 26962 | 26969 | 26974 | 26990 |
| 26999 | 27016 | 27103 | 27115 | 27121 | 27125 | 27138 | 27139 | 27164 | 27170 | 27172 | 27201 |
| 27215 | 27239 | 27247 | 27256 | 27261 | 27283 | 27300 | 27322 | 27384 | 27405 | 27406 | 27425 |
| 27431 | 27439 | 27483 | 27535 | 27546 | 27547 | 27551 | 27567 | 27585 | 27631 | 27643 | 27644 |
| 27678 | 27694 | 27701 | 27702 | 27704 | 27710 | 27750 | 27777 | 27793 | 27807 | 27808 | 27819 |
| 27849 | 27850 | 27857 | 27880 | 27944 | 28146 | 28395 | 28469 | 28532 | 28591 | 28664 | 28666 |
| 28682 | 28719 | 28743 | 28747 | 28773 | 28820 | 28824 | 28825 | 28840 | 28843 | 28846 | 28873 |
| 28885 | 28914 | 28921 | 28922 | 28923 | 28924 | 28958 | 28996 | 28997 | 28998 | 28999 | 29008 |
| 29063 | 29075 | 29081 | 29109 | 29111 | 29162 | 29168 | 29187 | 29204 | 29241 | 29242 | 29253 |
| 29259 | 29260 | 29269 | 29332 | 29340 | 29342 | 29349 | 29372 | 29376 | 29379 | 29426 | 29450 |
| 29493 | 29495 | 29496 | 29497 | 29498 | 29525 | 29526 | 29536 | 29544 | 29564 | 29607 | 29617 |
| 29622 | 29623 | 29624 | 29637 | 29642 | 29643 | 29651 | 29684 | 29724 | 29725 | 29750 | 29751 |
| 29757 | 29761 | 29762 | 29804 | 29805 | 29806 | 29823 | 29824 | 29825 | 29842 | 29855 | 29856 |
| 29857 | 29868 | 29874 | 29880 | 29904 | 29954 | 30034 | 30088 | 30166 | 30169 | 30170 | 30205 |
| 30224 | 30290 | 30293 | 30383 | 30440 | 30457 | 30478 | 30493 | 30541 | 30559 | 30600 | 30615 |
| 30616 | 30660 | 30661 | 30662 | 30685 | 30696 | 30699 | 30714 | 30798 | 30906 | 31154 | 31229 |
| 31349 | 31450 | 31602 | 31908 | 32178 | 32465 | 32507 | 32624 | 32658 | 32757 | 32897 | 33089 |
| 33367 | 33573 | 33627 | 33660 | 33666 | 33712 | 33717 | 33755 | 33810 | 33824 | 33864 |
| 33867 | 34145 | 34216 | 34592 | 34603 | 34617 | 34618 | 34625 | 34679 | 34714 | 34725 | 34728 |
| 34878 | 35189 | 35230 | 35264 | 35533 | 35777 | 35891 | 35917 | 36097 | 36161 | 36172 | 36196 |
| 36205 | 36226 | 36239 | 36244 | 36251 | 36254 | 36269 | 36296 | 36302 | 36303 | 36340 | 36364 |
| 36376 | 36378 | 36418 | 36439 | 36441 | 36442 | 36445 | 36503 | 36521 | 36558 | 36567 | 36574 |
| 36602 | 36623 | 36632 | 36638 | 36639 | 36653 | 36668 | 36757 | 36828 | 36849 | 36851 | 36865 |
| 36870 | 36881 | 36895 | 36911 | 36918 | 36932 | 36989 | 36993 | 37016 | 37047 | 37061 | 37134 |
| 37152 | 37184 | 37262 | 37503 | 37534 | 37762 | 37930 | 38125 | 38192 | 38363 | 38407 | 38593 |
| 38843 | 38887 | 39111 | 39479 | 39861 | 40102 | 40386 | 40452 | 40523 | 40806 | 41180 | 41734 |
| 41770 | 41776 | 41825 | 41946 | 41957 | 41958 | 41959 | 42085 | 42214 | 42635 | 42782 | 42906 |
| 42938 | 43086 | 43102 | 43167 | 43285 | 43620 | 43669 | 43710 | 43980 | 44136 | 44365 | 44421 |
| 44723 | 44824 | 44929 | 45135 | 45164 | 45235 | 45569 | 45606 | 45636 | 45651 | 45661 | 45694 |
| 45706 | 45717 | 45743 | 45752 | 45757 | 45769 | 45775 | 45795 | 45803 | 45825 | 45831 | 45835 |
| 45838 | 45841 | 45861 | 45883 | 45912 | 45915 | 45922 | 45929 | 45930 | 45942 | 45964 | 45968 |
| 45987 | 46006 | 46033 | 46047 | 46051 | 46054 | 46087 | 46088 | 46096 | 46119 | 46146 | 46147 |
| 46148 | 46158 | 46185 | 46187 | 46189 | 46207 | 46209 | 46215 | 46224 | 46262 | 46275 | 46311 |
| 46312 | 46340 | 46356 | 46365 | 46389 | 46399 | 46426 | 46428 | 46431 | 46451 | 46569 | 46743 |
| 46759 | 47098 | 47147 | 47298 | 47348 | | | | | | | |

TABLE 18

Yield: Photosynthesis

Table 18A SEQ ID NOs of Polypeptides useful for improving Yield: Photosynthesis

| | | | | | | | | | | | |
|---|---|---|---|---|---|---|---|---|---|---|---|
| 2809 | 3161 | 5960 | 6291 | 6292 | 6293 | 6294 | 6295 | 6296 | 6873 | 6874 | 6875 |
| 13792 | 15950 | 19004 | 19036 | 19834 | 20200 | 20459 | | | | | |

Table 18B SEQ ID NOs of Polynucleotides useful for improving Yield: Photosynthesis

| | | | | | | | | | | | |
|---|---|---|---|---|---|---|---|---|---|---|---|
| 26496 | 26848 | 29647 | 29978 | 29979 | 29980 | 29981 | 29982 | 29983 | 30560 | 30561 | 30562 |
| 37479 | 39637 | 42691 | 42723 | 43521 | 43887 | 44146 | | | | | |

TABLE 19

Yield: Stress Tolerance

Table 19A SEQ ID NOs of Polypeptides useful for improving Yield: Stress Tolerance

| | | | | | | | | | | | |
|---|---|---|---|---|---|---|---|---|---|---|---|
| 3 | 4 | 6 | 8 | 11 | 12 | 14 | 15 | 16 | 17 | 19 | 22 |
| 26 | 28 | 29 | 31 | 36 | 39 | 40 | 41 | 42 | 43 | 46 | 48 |
| 51 | 52 | 54 | 55 | 56 | 58 | 59 | 63 | 67 | 69 | 71 | 72 |
| 73 | 78 | 80 | 81 | 84 | 88 | 89 | 90 | 91 | 92 | 96 | 97 |
| 99 | 100 | 103 | 106 | 107 | 109 | 115 | 117 | 118 | 120 | 121 | 122 |
| 128 | 130 | 137 | 144 | 145 | 146 | 147 | 150 | 151 | 153 | 154 | 155 |
| 156 | 157 | 159 | 161 | 162 | 164 | 170 | 171 | 172 | 174 | 177 | 178 |
| 182 | 184 | 185 | 186 | 190 | 191 | 194 | 195 | 196 | 198 | 200 | 203 |
| 204 | 212 | 217 | 218 | 221 | 224 | 230 | 232 | 233 | 234 | 235 | 238 |
| 240 | 247 | 250 | 252 | 254 | 255 | 257 | 258 | 260 | 265 | 266 | 267 |
| 272 | 274 | 275 | 280 | 282 | 283 | 285 | 288 | 293 | 294 | 295 | 296 |
| 299 | 301 | 305 | 307 | 310 | 316 | 317 | 318 | 319 | 320 | 321 | 329 |
| 331 | 332 | 338 | 339 | 341 | 342 | 343 | 344 | 346 | 349 | 350 | 352 |

TABLE 19-continued

Yield: Stress Tolerance

| | | | | | | | | | | | |
|---|---|---|---|---|---|---|---|---|---|---|---|
| 354 | 356 | 357 | 358 | 359 | 360 | 363 | 366 | 368 | 369 | 372 | 374 |
| 378 | 379 | 380 | 381 | 382 | 383 | 387 | 389 | 391 | 393 | 395 | 396 |
| 399 | 400 | 401 | 402 | 403 | 404 | 405 | 408 | 409 | 412 | 416 | 418 |
| 421 | 422 | 423 | 425 | 426 | 429 | 434 | 435 | 436 | 437 | 440 | 443 |
| 446 | 449 | 450 | 451 | 453 | 454 | 456 | 458 | 459 | 462 | 466 | 467 |
| 468 | 470 | 471 | 472 | 473 | 477 | 479 | 480 | 482 | 484 | 486 | 487 |
| 491 | 498 | 500 | 501 | 502 | 505 | 506 | 508 | 510 | 511 | 515 | 516 |
| 517 | 518 | 519 | 520 | 521 | 522 | 523 | 525 | 526 | 527 | 536 | 537 |
| 539 | 540 | 541 | 543 | 544 | 547 | 548 | 549 | 550 | 551 | 555 | 556 |
| 560 | 564 | 568 | 569 | 570 | 571 | 575 | 576 | 582 | 585 | 587 | 589 |
| 590 | 593 | 596 | 599 | 601 | 606 | 609 | 614 | 616 | 623 | 624 | 631 |
| 635 | 636 | 643 | 646 | 648 | 649 | 650 | 653 | 655 | 656 | 659 | 660 |
| 664 | 665 | 666 | 667 | 668 | 671 | 672 | 673 | 675 | 678 | 680 | 681 |
| 682 | 684 | 685 | 688 | 691 | 692 | 693 | 695 | 696 | 705 | 706 | 708 |
| 709 | 712 | 715 | 717 | 719 | 720 | 725 | 726 | 727 | 732 | 735 | 736 |
| 738 | 739 | 740 | 741 | 744 | 746 | 750 | 751 | 754 | 756 | 757 | 760 |
| 761 | 764 | 766 | 770 | 771 | 772 | 773 | 774 | 776 | 778 | 779 | 782 |
| 784 | 787 | 788 | 791 | 803 | 804 | 813 | 814 | 815 | 816 | 818 | 820 |
| 822 | 823 | 824 | 835 | 836 | 837 | 844 | 848 | 849 | 852 | 853 | 854 |
| 856 | 857 | 859 | 862 | 868 | 870 | 871 | 872 | 878 | 885 | 890 | 893 |
| 895 | 896 | 897 | 902 | 903 | 904 | 906 | 909 | 910 | 912 | 913 | 914 |
| 915 | 916 | 920 | 923 | 927 | 930 | 931 | 934 | 937 | 943 | 954 | 955 |
| 956 | 957 | 959 | 964 | 969 | 973 | 975 | 976 | 977 | 979 | 980 | 983 |
| 985 | 988 | 989 | 990 | 993 | 995 | 996 | 997 | 998 | 1002 | 1006 | 1010 |
| 1014 | 1015 | 1016 | 1019 | 1021 | 1022 | 1023 | 1024 | 1025 | 1026 | 1030 | 1031 |
| 1033 | 1034 | 1035 | 1036 | 1039 | 1040 | 1041 | 1047 | 1048 | 1050 | 1054 | 1055 |
| 1057 | 1058 | 1059 | 1060 | 1061 | 1062 | 1063 | 1065 | 1067 | 1068 | 1069 | 1070 |
| 1072 | 1073 | 1075 | 1077 | 1078 | 1082 | 1083 | 1084 | 1086 | 1088 | 1094 | 1095 |
| 1100 | 1101 | 1102 | 1105 | 1106 | 1108 | 1110 | 1111 | 1113 | 1114 | 1119 | 1120 |
| 1121 | 1123 | 1126 | 1128 | 1130 | 1131 | 1132 | 1135 | 1138 | 1139 | 1140 | 1141 |
| 1143 | 1144 | 1145 | 1147 | 1148 | 1149 | 1152 | 1155 | 1156 | 1157 | 1159 | 1161 |
| 1162 | 1167 | 1168 | 1173 | 1174 | 1175 | 1176 | 1178 | 1179 | 1181 | 1182 | 1183 |
| 1184 | 1185 | 1186 | 1187 | 1188 | 1190 | 1191 | 1192 | 1193 | 1196 | 1198 | 1199 |
| 1200 | 1201 | 1202 | 1205 | 1207 | 1209 | 1211 | 1214 | 1217 | 1218 | 1221 | 1222 |
| 1226 | 1228 | 1229 | 1235 | 1237 | 1239 | 1241 | 1243 | 1245 | 1246 | 1247 | 1250 |
| 1252 | 1253 | 1254 | 1255 | 1256 | 1257 | 1258 | 1261 | 1262 | 1266 | 1268 | 1269 |
| 1271 | 1276 | 1284 | 1285 | 1289 | 1290 | 1291 | 1292 | 1297 | 1299 | 1300 | 1302 |
| 1307 | 1308 | 1309 | 1310 | 1311 | 1312 | 1313 | 1315 | 1318 | 1319 | 1323 | 1324 |
| 1325 | 1327 | 1328 | 1330 | 1331 | 1333 | 1336 | 1337 | 1344 | 1345 | 1346 | 1347 |
| 1348 | 1349 | 1358 | 1365 | 1372 | 1375 | 1377 | 1388 | 1391 | 1394 | 1396 | 1402 |
| 1403 | 1404 | 1406 | 1408 | 1409 | 1415 | 1416 | 1417 | 1419 | 1421 | 1422 | 1424 |
| 1425 | 1427 | 1428 | 1431 | 1433 | 1434 | 1437 | 1438 | 1439 | 1446 | 1447 | 1448 |
| 1449 | 1450 | 1451 | 1458 | 1459 | 1460 | 1461 | 1462 | 1464 | 1470 | 1471 | 1473 |
| 1475 | 1476 | 1477 | 1479 | 1480 | 1481 | 1482 | 1483 | 1486 | 1487 | 1488 | 1490 |
| 1493 | 1495 | 1496 | 1497 | 1499 | 1502 | 1503 | 1504 | 1505 | 1506 | 1507 | 1510 |
| 1514 | 1517 | 1520 | 1521 | 1523 | 1527 | 1529 | 1531 | 1532 | 1535 | 1543 | 1546 |
| 1548 | 1550 | 1551 | 1552 | 1556 | 1559 | 1560 | 1564 | 1565 | 1566 | 1567 | 1568 |
| 1571 | 1572 | 1574 | 1576 | 1578 | 1579 | 1581 | 1583 | 1585 | 1590 | 1591 | 1593 |
| 1595 | 1597 | 1600 | 1601 | 1602 | 1604 | 1606 | 1607 | 1608 | 1611 | 1612 | 1613 |
| 1614 | 1615 | 1617 | 1619 | 1621 | 1622 | 1625 | 1626 | 1627 | 1628 | 1630 | 1631 |
| 1632 | 1634 | 1636 | 1637 | 1641 | 1650 | 1653 | 1654 | 1657 | 1659 | 1660 | 1662 |
| 1663 | 1664 | 1667 | 1668 | 1671 | 1673 | 1674 | 1675 | 1679 | 1680 | 1681 | 1683 |
| 1685 | 1686 | 1687 | 1689 | 1691 | 1692 | 1695 | 1696 | 1697 | 1698 | 1699 | 1700 |
| 1702 | 1703 | 1704 | 1706 | 1709 | 1710 | 1712 | 1713 | 1715 | 1716 | 1717 | 1718 |
| 1721 | 1722 | 1724 | 1725 | 1726 | 1727 | 1728 | 1730 | 1731 | 1733 | 1738 | 1740 |
| 1742 | 1747 | 1748 | 1749 | 1750 | 1752 | 1754 | 1755 | 1760 | 1762 | 1764 | 1765 |
| 1766 | 1767 | 1768 | 1771 | 1773 | 1774 | 1775 | 1776 | 1778 | 1779 | 1780 | 1785 |
| 1786 | 1787 | 1788 | 1792 | 1793 | 1795 | 1796 | 1797 | 1798 | 1799 | 1800 | 1801 |
| 1803 | 1804 | 1808 | 1809 | 1810 | 1814 | 1816 | 1817 | 1819 | 1820 | 1821 | 1822 |
| 1825 | 1827 | 1828 | 1829 | 1830 | 1831 | 1832 | 1833 | 1834 | 1835 | 1836 | 1837 |
| 1841 | 1842 | 1846 | 1848 | 1849 | 1851 | 1852 | 1853 | 1855 | 1862 | 1863 | 1864 |
| 1867 | 1868 | 1870 | 1874 | 1876 | 1877 | 1878 | 1880 | 1882 | 1885 | 1886 | 1888 |
| 1890 | 1891 | 1894 | 1895 | 1896 | 1897 | 1899 | 1902 | 1903 | 1906 | 1908 | 1909 |
| 1914 | 1916 | 1922 | 1923 | 1924 | 1927 | 1928 | 1930 | 1931 | 1934 | 1935 | 1936 |
| 1938 | 1940 | 1941 | 1943 | 1944 | 1945 | 1949 | 1950 | 1951 | 1952 | 1953 | 1955 |
| 1963 | 1964 | 1966 | 1967 | 1968 | 1969 | 1970 | 1971 | 1974 | 1977 | 1978 | 1979 |
| 1985 | 1986 | 1989 | 1991 | 1994 | 1997 | 1999 | 2000 | 2001 | 2002 | 2003 | 2004 |
| 2005 | 2006 | 2007 | 2008 | 2010 | 2012 | 2014 | 2016 | 2017 | 2018 | 2019 | 2020 |
| 2021 | 2023 | 2024 | 2025 | 2028 | 2029 | 2032 | 2034 | 2036 | 2039 | 2040 | 2041 |
| 2042 | 2044 | 2046 | 2047 | 2048 | 2049 | 2050 | 2051 | 2053 | 2057 | 2058 | 2059 |
| 2065 | 2069 | 2075 | 2076 | 2077 | 2078 | 2080 | 2084 | 2085 | 2087 | 2088 | 2089 |
| 2090 | 2091 | 2092 | 2094 | 2096 | 2097 | 2098 | 2100 | 2102 | 2103 | 2104 | 2105 |
| 2106 | 2107 | 2108 | 2112 | 2118 | 2119 | 2121 | 2124 | 2125 | 2126 | 2127 | 2128 |
| 2131 | 2132 | 2133 | 2134 | 2137 | 2139 | 2140 | 2143 | 2144 | 2146 | 2147 | 2148 |
| 2150 | 2151 | 2154 | 2156 | 2157 | 2158 | 2159 | 2161 | 2162 | 2163 | 2164 | 2169 |
| 2171 | 2172 | 2173 | 2174 | 2175 | 2176 | 2177 | 2179 | 2180 | 2181 | 2182 | 2183 |
| 2184 | 2186 | 2187 | 2188 | 2192 | 2194 | 2195 | 2198 | 2199 | 2200 | 2201 | 2202 |

TABLE 19-continued

Yield: Stress Tolerance

| | | | | | | | | | | | |
|---|---|---|---|---|---|---|---|---|---|---|---|
| 2203 | 2204 | 2205 | 2206 | 2208 | 2210 | 2211 | 2212 | 2213 | 2214 | 2216 | 2218 |
| 2220 | 2222 | 2226 | 2228 | 2230 | 2231 | 2232 | 2233 | 2235 | 2236 | 2237 | 2238 |
| 2240 | 2241 | 2247 | 2248 | 2250 | 2252 | 2253 | 2254 | 2259 | 2263 | 2264 | 2265 |
| 2270 | 2271 | 2272 | 2273 | 2274 | 2276 | 2277 | 2278 | 2280 | 2282 | 2285 | 2286 |
| 2287 | 2288 | 2289 | 2290 | 2291 | 2292 | 2293 | 2294 | 2297 | 2298 | 2299 | 2300 |
| 2302 | 2303 | 2306 | 2307 | 2310 | 2312 | 2313 | 2315 | 2316 | 2317 | 2321 | 2322 |
| 2323 | 2331 | 2332 | 2333 | 2334 | 2336 | 2338 | 2339 | 2341 | 2343 | 2345 | 2346 |
| 2349 | 2351 | 2352 | 2354 | 2356 | 2357 | 2360 | 2362 | 2363 | 2365 | 2366 | 2367 |
| 2368 | 2370 | 2371 | 2373 | 2374 | 2376 | 2377 | 2378 | 2380 | 2381 | 2383 | 2385 |
| 2386 | 2388 | 2389 | 2390 | 2393 | 2394 | 2395 | 2397 | 2404 | 2405 | 2406 | 2411 |
| 2413 | 2414 | 2415 | 2419 | 2420 | 2421 | 2422 | 2423 | 2424 | 2425 | 2426 | 2429 |
| 2430 | 2431 | 2432 | 2433 | 2434 | 2436 | 2437 | 2439 | 2440 | 2441 | 2442 | 2443 |
| 2444 | 2445 | 2447 | 2448 | 2450 | 2451 | 2454 | 2455 | 2457 | 2458 | 2460 | 2462 |
| 2463 | 2464 | 2466 | 2472 | 2474 | 2477 | 2478 | 2480 | 2483 | 2485 | 2486 | 2490 |
| 2491 | 2492 | 2495 | 2497 | 2498 | 2499 | 2500 | 2503 | 2504 | 2506 | 2508 | 2510 |
| 2513 | 2514 | 2516 | 2517 | 2518 | 2519 | 2521 | 2522 | 2523 | 2525 | 2527 | 2528 |
| 2529 | 2530 | 2533 | 2534 | 2537 | 2540 | 2548 | 2549 | 2552 | 2561 | 2565 | 2566 |
| 2567 | 2568 | 2570 | 2571 | 2572 | 2574 | 2576 | 2577 | 2579 | 2581 | 2586 | 2588 |
| 2589 | 2597 | 2599 | 2600 | 2601 | 2602 | 2604 | 2608 | 2610 | 2612 | 2613 | 2614 |
| 2616 | 2617 | 2622 | 2623 | 2625 | 2626 | 2628 | 2632 | 2634 | 2638 | 2641 | 2642 |
| 2646 | 2648 | 2650 | 2651 | 2652 | 2653 | 2655 | 2656 | 2657 | 2659 | 2661 | 2662 |
| 2663 | 2667 | 2669 | 2670 | 2671 | 2674 | 2678 | 2682 | 2683 | 2686 | 2687 | 2688 |
| 2690 | 2691 | 2692 | 2697 | 2699 | 2701 | 2704 | 2705 | 2706 | 2707 | 2708 | 2710 |
| 2714 | 2718 | 2720 | 2723 | 2729 | 2731 | 2733 | 2736 | 2741 | 2742 | 2743 | 2744 |
| 2746 | 2747 | 2750 | 2752 | 2754 | 2755 | 2759 | 2763 | 2765 | 2767 | 2768 | 2773 |
| 2776 | 2779 | 2781 | 2784 | 2785 | 2786 | 2788 | 2793 | 2798 | 2800 | 2804 | 2805 |
| 2808 | 2813 | 2814 | 2815 | 2816 | 2818 | 2819 | 2821 | 2826 | 2827 | 2828 | 2829 |
| 2830 | 2831 | 2833 | 2836 | 2837 | 2839 | 2840 | 2841 | 2843 | 2844 | 2845 | 2846 |
| 2847 | 2850 | 2851 | 2853 | 2855 | 2860 | 2861 | 2864 | 2867 | 2868 | 2869 | 2871 |
| 2872 | 2875 | 2877 | 2878 | 2881 | 2882 | 2884 | 2887 | 2888 | 2893 | 2894 | 2895 |
| 2896 | 2898 | 2900 | 2904 | 2905 | 2907 | 2916 | 2917 | 2918 | 2919 | 2921 | 2927 |
| 2929 | 2936 | 2937 | 2939 | 2945 | 2946 | 2947 | 2948 | 2951 | 2955 | 2956 | 2957 |
| 2958 | 2959 | 2960 | 2964 | 2965 | 2969 | 2982 | 2984 | 2986 | 2987 | 2988 | 2994 |
| 2997 | 2998 | 2999 | 3000 | 3005 | 3006 | 3007 | 3011 | 3012 | 3014 | 3018 | 3019 |
| 3022 | 3029 | 3031 | 3035 | 3043 | 3044 | 3046 | 3047 | 3048 | 3051 | 3052 | 3055 |
| 3057 | 3059 | 3060 | 3061 | 3062 | 3063 | 3066 | 3069 | 3070 | 3071 | 3072 | 3073 |
| 3075 | 3077 | 3078 | 3081 | 3082 | 3083 | 3085 | 3086 | 3087 | 3090 | 3091 | 3093 |
| 3094 | 3095 | 3100 | 3101 | 3106 | 3108 | 3109 | 3110 | 3112 | 3113 | 3124 | 3126 |
| 3127 | 3128 | 3131 | 3136 | 3137 | 3138 | 3139 | 3141 | 3143 | 3144 | 3146 | 3147 |
| 3148 | 3154 | 3155 | 3156 | 3158 | 3159 | 3160 | 3163 | 3165 | 3168 | 3170 | 3172 |
| 3175 | 3177 | 3179 | 3180 | 3184 | 3186 | 3188 | 3190 | 3193 | 3195 | 3196 | 3198 |
| 3200 | 3201 | 3202 | 3203 | 3204 | 3205 | 3206 | 3207 | 3208 | 3211 | 3219 | 3220 |
| 3224 | 3227 | 3228 | 3231 | 3234 | 3236 | 3238 | 3240 | 3241 | 3242 | 3245 | 3249 |
| 3253 | 3254 | 3255 | 3258 | 3259 | 3261 | 3262 | 3263 | 3265 | 3266 | 3267 | 3269 |
| 3271 | 3274 | 3275 | 3278 | 3280 | 3281 | 3282 | 3283 | 3285 | 3287 | 3288 | 3289 |
| 3290 | 3291 | 3292 | 3297 | 3300 | 3302 | 3303 | 3305 | 3306 | 3309 | 3310 | 3311 |
| 3312 | 3313 | 3315 | 3318 | 3319 | 3320 | 3321 | 3322 | 3324 | 3329 | 3331 | 3332 |
| 3333 | 3334 | 3337 | 3339 | 3340 | 3342 | 3343 | 3345 | 3346 | 3347 | 3350 | 3356 |
| 3357 | 3359 | 3361 | 3362 | 3363 | 3364 | 3365 | 3366 | 3371 | 3373 | 3375 | 3376 |
| 3378 | 3380 | 3381 | 3382 | 3383 | 3384 | 3389 | 3390 | 3391 | 3392 | 3395 | 3396 |
| 3400 | 3401 | 3402 | 3405 | 3407 | 3413 | 3415 | 3416 | 3419 | 3420 | 3421 | 3426 |
| 3427 | 3429 | 3432 | 3434 | 3436 | 3437 | 3438 | 3440 | 3442 | 3443 | 3444 | 3446 |
| 3447 | 3450 | 3452 | 3453 | 3457 | 3458 | 3460 | 3461 | 3463 | 3464 | 3468 | 3469 |
| 3470 | 3471 | 3473 | 3477 | 3479 | 3481 | 3482 | 3483 | 3485 | 3486 | 3487 | 3488 |
| 3491 | 3493 | 3496 | 3498 | 3502 | 3503 | 3504 | 3505 | 3506 | 3508 | 3510 | 3512 |
| 3513 | 3514 | 3517 | 3518 | 3521 | 3522 | 3523 | 3524 | 3525 | 3526 | 3529 | 3530 |
| 3532 | 3533 | 3534 | 3535 | 3538 | 3539 | 3540 | 3542 | 3545 | 3547 | 3548 | 3549 |
| 3550 | 3552 | 3553 | 3554 | 3555 | 3557 | 3559 | 3560 | 3562 | 3563 | 3568 | 3569 |
| 3570 | 3573 | 3574 | 3575 | 3581 | 3589 | 3590 | 3591 | 3592 | 3594 | 3595 | 3596 |
| 3597 | 3598 | 3602 | 3603 | 3607 | 3608 | 3609 | 3613 | 3621 | 3628 | 3629 | 3630 |
| 3632 | 3635 | 3636 | 3640 | 3642 | 3644 | 3645 | 3650 | 3654 | 3655 | 3656 | 3658 |
| 3659 | 3660 | 3661 | 3662 | 3663 | 3666 | 3669 | 3670 | 3672 | 3673 | 3681 | 3682 |
| 3683 | 3687 | 3688 | 3689 | 3690 | 3691 | 3692 | 3693 | 3695 | 3696 | 3697 | 3700 |
| 3703 | 3704 | 3705 | 3706 | 3708 | 3714 | 3715 | 3718 | 3719 | 3720 | 3721 | 3722 |
| 3723 | 3724 | 3726 | 3727 | 3728 | 3730 | 3731 | 3733 | 3734 | 3735 | 3736 | 3737 |
| 3738 | 3739 | 3740 | 3741 | 3742 | 3744 | 3747 | 3749 | 3751 | 3752 | 3754 | 3755 |
| 3757 | 3758 | 3759 | 3760 | 3765 | 3769 | 3771 | 3773 | 3775 | 3776 | 3777 | 3780 |
| 3781 | 3784 | 3786 | 3787 | 3790 | 3793 | 3794 | 3796 | 3797 | 3799 | 3801 | 3804 |
| 3806 | 3808 | 3809 | 3813 | 3816 | 3817 | 3818 | 3819 | 3820 | 3821 | 3825 | 3826 |
| 3827 | 3833 | 3838 | 3839 | 3840 | 3842 | 3843 | 3844 | 3845 | 3846 | 3847 | 3848 |
| 3851 | 3852 | 3854 | 3855 | 3856 | 3857 | 3859 | 3860 | 3861 | 3864 | 3865 | 3869 |
| 3875 | 3877 | 3878 | 3880 | 3883 | 3885 | 3888 | 3889 | 3891 | 3892 | 3893 | 3896 |
| 3897 | 3898 | 3899 | 3900 | 3901 | 3902 | 3905 | 3906 | 3914 | 3915 | 3917 | 3919 |
| 3920 | 3923 | 3924 | 3927 | 3928 | 3930 | 3931 | 3932 | 3936 | 3937 | 3938 | 3939 |
| 3940 | 3944 | 3946 | 3947 | 3950 | 3954 | 3955 | 3956 | 3957 | 3958 | 3959 | 3960 |
| 3966 | 3968 | 3974 | 3976 | 3977 | 3978 | 3980 | 3981 | 3982 | 3983 | 3985 | 3987 |
| 3991 | 3994 | 3995 | 3996 | 3997 | 3999 | 4002 | 4006 | 4007 | 4008 | 4009 | 4012 |

TABLE 19-continued

Yield: Stress Tolerance

| | | | | | | | | | | | |
|---|---|---|---|---|---|---|---|---|---|---|---|
| 4013 | 4014 | 4016 | 4020 | 4021 | 4023 | 4024 | 4025 | 4028 | 4029 | 4030 | 4031 |
| 4034 | 4038 | 4040 | 4041 | 4044 | 4045 | 4047 | 4049 | 4052 | 4054 | 4056 | 4057 |
| 4058 | 4059 | 4060 | 4063 | 4064 | 4065 | 4067 | 4068 | 4070 | 4073 | 4075 | 4076 |
| 4078 | 4079 | 4082 | 4085 | 4088 | 4090 | 4091 | 4092 | 4093 | 4094 | 4095 | 4096 |
| 4098 | 4100 | 4101 | 4103 | 4104 | 4105 | 4106 | 4107 | 4110 | 4112 | 4113 | 4116 |
| 4117 | 4118 | 4120 | 4121 | 4122 | 4123 | 4124 | 4125 | 4127 | 4132 | 4133 | 4135 |
| 4139 | 4140 | 4142 | 4145 | 4146 | 4149 | 4150 | 4151 | 4152 | 4153 | 4154 | 4157 |
| 4158 | 4159 | 4160 | 4163 | 4168 | 4169 | 4170 | 4171 | 4172 | 4174 | 4176 | 4177 |
| 4178 | 4179 | 4182 | 4185 | 4187 | 4189 | 4193 | 4195 | 4197 | 4198 | 4200 | 4201 |
| 4202 | 4203 | 4205 | 4207 | 4208 | 4216 | 4217 | 4219 | 4223 | 4224 | 4225 | 4228 |
| 4230 | 4233 | 4234 | 4235 | 4239 | 4240 | 4242 | 4243 | 4245 | 4251 | 4252 | 4253 |
| 4254 | 4255 | 4256 | 4260 | 4261 | 4267 | 4268 | 4272 | 4277 | 4280 | 4282 | 4283 |
| 4285 | 4288 | 4290 | 4291 | 4293 | 4294 | 4295 | 4297 | 4301 | 4302 | 4310 | 4311 |
| 4312 | 4313 | 4314 | 4316 | 4317 | 4320 | 4324 | 4326 | 4327 | 4328 | 4330 | 4334 |
| 4335 | 4342 | 4345 | 4346 | 4347 | 4356 | 4359 | 4360 | 4362 | 4363 | 4366 | 4372 |
| 4373 | 4381 | 4385 | 4386 | 4388 | 4390 | 4391 | 4393 | 4394 | 4395 | 4398 | 4401 |
| 4402 | 4405 | 4411 | 4415 | 4416 | 4419 | 4423 | 4426 | 4429 | 4431 | 4433 | 4434 |
| 4436 | 4439 | 4440 | 4442 | 4443 | 4444 | 4445 | 4448 | 4449 | 4450 | 4453 | 4455 |
| 4458 | 4464 | 4466 | 4468 | 4469 | 4470 | 4472 | 4476 | 4478 | 4480 | 4482 | 4487 |
| 4488 | 4489 | 4490 | 4491 | 4493 | 4494 | 4496 | 4497 | 4501 | 4502 | 4505 | 4506 |
| 4507 | 4509 | 4513 | 4514 | 4515 | 4519 | 4521 | 4522 | 4523 | 4525 | 4529 | 4533 |
| 4537 | 4540 | 4542 | 4548 | 4551 | 4552 | 4553 | 4554 | 4555 | 4557 | 4559 | 4560 |
| 4562 | 4564 | 4566 | 4568 | 4569 | 4571 | 4574 | 4575 | 4579 | 4580 | 4582 | 4583 |
| 4585 | 4587 | 4593 | 4595 | 4596 | 4597 | 4598 | 4599 | 4603 | 4608 | 4609 | 4611 |
| 4614 | 4615 | 4617 | 4618 | 4619 | 4620 | 4621 | 4622 | 4626 | 4627 | 4631 | 4634 |
| 4635 | 4636 | 4642 | 4649 | 4650 | 4652 | 4654 | 4655 | 4657 | 4660 | 4661 | 4662 |
| 4664 | 4665 | 4666 | 4670 | 4676 | 4681 | 4683 | 4685 | 4686 | 4691 | 4693 | 4695 |
| 4698 | 4701 | 4702 | 4705 | 4708 | 4709 | 4710 | 4711 | 4713 | 4716 | 4718 | 4721 |
| 4723 | 4724 | 4727 | 4728 | 4729 | 4737 | 4740 | 4741 | 4743 | 4748 | 4751 | 4756 |
| 4759 | 4760 | 4762 | 4763 | 4764 | 4765 | 4769 | 4771 | 4774 | 4778 | 4781 | 4783 |
| 4784 | 4785 | 4786 | 4787 | 4791 | 4793 | 4801 | 4805 | 4806 | 4807 | 4808 | 4810 |
| 4811 | 4812 | 4813 | 4815 | 4816 | 4818 | 4819 | 4820 | 4824 | 4826 | 4829 | 4833 |
| 4837 | 4845 | 4846 | 4849 | 4850 | 4851 | 4852 | 4854 | 4861 | 4864 | 4865 | 4866 |
| 4869 | 4874 | 4876 | 4879 | 4880 | 4882 | 4884 | 4885 | 4886 | 4888 | 4891 | 4893 |
| 4894 | 4895 | 4897 | 4898 | 4899 | 4901 | 4907 | 4908 | 4911 | 4912 | 4914 | 4916 |
| 4917 | 4920 | 4922 | 4923 | 4925 | 4926 | 4927 | 4935 | 4936 | 4937 | 4938 | 4939 |
| 4942 | 4944 | 4946 | 4947 | 4953 | 4954 | 4956 | 4961 | 4962 | 4963 | 4965 | 4966 |
| 4968 | 4971 | 4973 | 4977 | 4978 | 4979 | 4982 | 4983 | 4984 | 4985 | 4986 | 4988 |
| 4990 | 4991 | 4992 | 4993 | 4995 | 4996 | 4997 | 5000 | 5001 | 5002 | 5003 | 5005 |
| 5007 | 5008 | 5009 | 5010 | 5011 | 5012 | 5013 | 5016 | 5017 | 5022 | 5023 | 5024 |
| 5025 | 5026 | 5028 | 5029 | 5030 | 5031 | 5032 | 5033 | 5035 | 5036 | 5037 | 5038 |
| 5039 | 5040 | 5041 | 5042 | 5044 | 5045 | 5046 | 5049 | 5050 | 5051 | 5052 | 5054 |
| 5055 | 5056 | 5057 | 5058 | 5059 | 5060 | 5061 | 5063 | 5064 | 5065 | 5066 | 5067 |
| 5068 | 5075 | 5076 | 5077 | 5079 | 5084 | 5085 | 5086 | 5087 | 5088 | 5089 | 5091 |
| 5092 | 5093 | 5096 | 5097 | 5099 | 5100 | 5104 | 5105 | 5107 | 5108 | 5112 | 5114 |
| 5115 | 5116 | 5117 | 5118 | 5119 | 5121 | 5122 | 5125 | 5127 | 5131 | 5132 | 5133 |
| 5134 | 5137 | 5138 | 5139 | 5140 | 5141 | 5142 | 5143 | 5144 | 5145 | 5147 | 5148 |
| 5149 | 5150 | 5151 | 5153 | 5154 | 5156 | 5157 | 5158 | 5159 | 5164 | 5165 | 5166 |
| 5167 | 5168 | 5169 | 5172 | 5173 | 5174 | 5175 | 5178 | 5179 | 5180 | 5181 | 5182 |
| 5183 | 5184 | 5186 | 5187 | 5188 | 5189 | 5194 | 5195 | 5196 | 5197 | 5199 | 5200 |
| 5201 | 5203 | 5204 | 5205 | 5206 | 5208 | 5210 | 5211 | 5212 | 5214 | 5215 | 5216 |
| 5217 | 5218 | 5219 | 5220 | 5221 | 5222 | 5223 | 5224 | 5226 | 5227 | 5230 | 5231 |
| 5232 | 5233 | 5234 | 5235 | 5236 | 5237 | 5238 | 5239 | 5240 | 5241 | 5242 | 5243 |
| 5247 | 5248 | 5249 | 5250 | 5251 | 5252 | 5254 | 5255 | 5256 | 5257 | 5262 | 5267 |
| 5271 | 5272 | 5273 | 5274 | 5275 | 5276 | 5278 | 5279 | 5280 | 5285 | 5287 | 5288 |
| 5289 | 5290 | 5291 | 5294 | 5295 | 5298 | 5299 | 5301 | 5304 | 5305 | 5306 | 5309 |
| 5310 | 5311 | 5312 | 5315 | 5317 | 5319 | 5320 | 5324 | 5325 | 5327 | 5328 | 5338 |
| 5339 | 5347 | 5356 | 5359 | 5362 | 5363 | 5364 | 5365 | 5367 | 5368 | 5369 | 5372 |
| 5373 | 5375 | 5380 | 5381 | 5382 | 5383 | 5384 | 5385 | 5386 | 5387 | 5388 | 5389 |
| 5391 | 5392 | 5393 | 5394 | 5395 | 5396 | 5397 | 5399 | 5401 | 5408 | 5409 | 5410 |
| 5412 | 5413 | 5414 | 5415 | 5417 | 5418 | 5421 | 5422 | 5423 | 5424 | 5425 | 5426 |
| 5428 | 5430 | 5431 | 5432 | 5437 | 5439 | 5440 | 5441 | 5442 | 5443 | 5445 | 5448 |
| 5449 | 5450 | 5451 | 5453 | 5454 | 5456 | 5462 | 5463 | 5464 | 5466 | 5467 | 5468 |
| 5469 | 5471 | 5472 | 5473 | 5475 | 5476 | 5477 | 5479 | 5480 | 5481 | 5483 | 5484 |
| 5485 | 5486 | 5487 | 5488 | 5489 | 5491 | 5492 | 5493 | 5494 | 5496 | 5498 | 5499 |
| 5500 | 5501 | 5502 | 5503 | 5504 | 5508 | 5509 | 5512 | 5513 | 5514 | 5516 | 5517 |
| 5518 | 5527 | 5528 | 5533 | 5534 | 5540 | 5541 | 5542 | 5544 | 5547 | 5550 | 5551 |
| 5552 | 5553 | 5554 | 5555 | 5556 | 5557 | 5559 | 5560 | 5561 | 5562 | 5564 | 5565 |
| 5566 | 5567 | 5568 | 5569 | 5570 | 5572 | 5573 | 5578 | 5580 | 5581 | 5588 | 5589 |
| 5591 | 5592 | 5593 | 5594 | 5595 | 5598 | 5601 | 5603 | 5604 | 5605 | 5606 | 5608 |
| 5609 | 5610 | 5612 | 5613 | 5614 | 5615 | 5616 | 5617 | 5618 | 5619 | 5622 | 5623 |
| 5624 | 5627 | 5628 | 5629 | 5630 | 5632 | 5633 | 5634 | 5635 | 5636 | 5637 | 5638 |
| 5640 | 5641 | 5643 | 5644 | 5645 | 5646 | 5647 | 5650 | 5651 | 5653 | 5654 | 5655 |
| 5658 | 5659 | 5660 | 5661 | 5662 | 5663 | 5665 | 5666 | 5667 | 5668 | 5669 | 5670 |
| 5673 | 5674 | 5675 | 5677 | 5678 | 5679 | 5681 | 5683 | 5684 | 5685 | 5686 | 5687 |
| 5688 | 5689 | 5690 | 5692 | 5693 | 5694 | 5695 | 5698 | 5699 | 5700 | 5702 | 5703 |
| 5704 | 5707 | 5708 | 5709 | 5710 | 5712 | 5713 | 5714 | 5716 | 5717 | 5718 | 5722 |

TABLE 19-continued

| Yield: Stress Tolerance | | | | | | | | | | | |
|---|---|---|---|---|---|---|---|---|---|---|---|
| 5723 | 5724 | 5726 | 5727 | 5728 | 5729 | 5730 | 5731 | 5732 | 5734 | 5736 | 5739 |
| 5740 | 5742 | 5743 | 5745 | 5747 | 5748 | 5749 | 5750 | 5751 | 5754 | 5755 | 5757 |
| 5759 | 5761 | 5762 | 5763 | 5764 | 5765 | 5766 | 5768 | 5769 | 5772 | 5777 | 5778 |
| 5779 | 5780 | 5782 | 5784 | 5785 | 5786 | 5787 | 5789 | 5790 | 5791 | 5792 | 5794 |
| 5795 | 5796 | 5797 | 5798 | 5802 | 5803 | 5804 | 5805 | 5806 | 5807 | 5810 | 5811 |
| 5812 | 5813 | 5814 | 5815 | 5816 | 5818 | 5819 | 5820 | 5821 | 5823 | 5824 | 5826 |
| 5827 | 5828 | 5829 | 5830 | 5832 | 5833 | 5834 | 5835 | 5837 | 5838 | 5839 | 5841 |
| 5842 | 5843 | 5845 | 5848 | 5849 | 5851 | 5852 | 5853 | 5854 | 5855 | 5856 | 5857 |
| 5858 | 5860 | 5862 | 5863 | 5866 | 5871 | 5872 | 5873 | 5877 | 5878 | 5879 | 5880 |
| 5882 | 5883 | 5885 | 5888 | 5889 | 5890 | 5892 | 5893 | 5894 | 5895 | 5896 | 5898 |
| 5899 | 5900 | 5901 | 5902 | 5903 | 5904 | 5905 | 5906 | 5907 | 5908 | 5909 | 5911 |
| 5912 | 5914 | 5915 | 5916 | 5917 | 5918 | 5919 | 5920 | 5921 | 5927 | 5930 | 5935 |
| 5936 | 5937 | 5939 | 5940 | 5941 | 5942 | 5944 | 5945 | 5947 | 5948 | 5950 | 5951 |
| 5952 | 5953 | 5954 | 5955 | 5956 | 5957 | 5959 | 5961 | 5962 | 5964 | 5966 | 5968 |
| 5969 | 5970 | 5971 | 5973 | 5974 | 5975 | 5976 | 5977 | 5980 | 5981 | 5983 | 5984 |
| 5985 | 5986 | 5987 | 5988 | 5989 | 5990 | 5991 | 5993 | 5995 | 5996 | 5997 | 6000 |
| 6001 | 6002 | 6003 | 6007 | 6009 | 6011 | 6012 | 6017 | 6019 | 6020 | 6024 | 6026 |
| 6027 | 6028 | 6029 | 6030 | 6031 | 6035 | 6036 | 6037 | 6038 | 6039 | 6040 | 6041 |
| 6042 | 6043 | 6045 | 6047 | 6048 | 6049 | 6050 | 6051 | 6052 | 6053 | 6055 | 6057 |
| 6059 | 6060 | 6061 | 6062 | 6063 | 6064 | 6065 | 6067 | 6070 | 6071 | 6072 | 6073 |
| 6074 | 6075 | 6078 | 6080 | 6081 | 6082 | 6083 | 6084 | 6085 | 6086 | 6087 | 6089 |
| 6090 | 6091 | 6095 | 6096 | 6097 | 6099 | 6100 | 6101 | 6102 | 6103 | 6104 | 6109 |
| 6110 | 6111 | 6115 | 6116 | 6117 | 6118 | 6119 | 6121 | 6122 | 6123 | 6124 | 6125 |
| 6126 | 6127 | 6128 | 6132 | 6135 | 6136 | 6137 | 6138 | 6139 | 6140 | 6143 | 6144 |
| 6145 | 6146 | 6148 | 6149 | 6151 | 6152 | 6155 | 6156 | 6158 | 6159 | 6160 | 6161 |
| 6162 | 6163 | 6164 | 6165 | 6167 | 6168 | 6169 | 6170 | 6171 | 6172 | 6173 | 6174 |
| 6176 | 6177 | 6178 | 6179 | 6180 | 6182 | 6183 | 6184 | 6186 | 6187 | 6188 | 6189 |
| 6193 | 6194 | 6196 | 6197 | 6199 | 6200 | 6202 | 6203 | 6204 | 6205 | 6208 | 6209 |
| 6210 | 6211 | 6213 | 6215 | 6216 | 6217 | 6218 | 6219 | 6220 | 6221 | 6222 | 6223 |
| 6225 | 6226 | 6227 | 6228 | 6229 | 6230 | 6231 | 6233 | 6235 | 6236 | 6237 | 6238 |
| 6240 | 6241 | 6245 | 6246 | 6248 | 6249 | 6250 | 6255 | 6256 | 6260 | 6261 | 6263 |
| 6264 | 6265 | 6266 | 6267 | 6268 | 6271 | 6273 | 6274 | 6275 | 6276 | 6277 | 6278 |
| 6279 | 6280 | 6281 | 6282 | 6283 | 6284 | 6287 | 6288 | 6289 | 6290 | 6297 | 6299 |
| 6300 | 6302 | 6304 | 6305 | 6306 | 6307 | 6308 | 6309 | 6310 | 6311 | 6312 | 6313 |
| 6314 | 6319 | 6320 | 6321 | 6322 | 6323 | 6329 | 6331 | 6332 | 6333 | 6335 | 6338 |
| 6339 | 6340 | 6341 | 6343 | 6344 | 6345 | 6347 | 6354 | 6360 | 6361 | 6368 | 6370 |
| 6371 | 6372 | 6373 | 6374 | 6375 | 6376 | 6377 | 6379 | 6380 | 6381 | 6383 | 6386 |
| 6389 | 6392 | 6393 | 6394 | 6396 | 6397 | 6401 | 6406 | 6407 | 6408 | 6409 | 6411 |
| 6412 | 6413 | 6414 | 6415 | 6418 | 6419 | 6420 | 6421 | 6426 | 6428 | 6429 | 6430 |
| 6431 | 6433 | 6434 | 6435 | 6438 | 6439 | 6442 | 6443 | 6444 | 6445 | 6446 | 6447 |
| 6448 | 6449 | 6454 | 6455 | 6456 | 6457 | 6458 | 6461 | 6462 | 6463 | 6464 | 6465 |
| 6467 | 6468 | 6469 | 6470 | 6471 | 6472 | 6473 | 6476 | 6479 | 6480 | 6481 | 6482 |
| 6483 | 6484 | 6485 | 6486 | 6487 | 6488 | 6491 | 6492 | 6493 | 6494 | 6495 | 6496 |
| 6500 | 6509 | 6510 | 6511 | 6514 | 6515 | 6518 | 6520 | 6521 | 6524 | 6528 | 6529 |
| 6531 | 6532 | 6535 | 6536 | 6537 | 6540 | 6541 | 6544 | 6545 | 6546 | 6547 | 6549 |
| 6552 | 6553 | 6554 | 6555 | 6556 | 6557 | 6558 | 6559 | 6561 | 6562 | 6563 | 6565 |
| 6566 | 6568 | 6569 | 6570 | 6571 | 6572 | 6576 | 6577 | 6578 | 6579 | 6580 | 6584 |
| 6585 | 6586 | 6595 | 6596 | 6597 | 6599 | 6602 | 6603 | 6605 | 6606 | 6607 | 6608 |
| 6612 | 6613 | 6614 | 6615 | 6617 | 6618 | 6624 | 6625 | 6626 | 6627 | 6628 | 6630 |
| 6632 | 6633 | 6634 | 6635 | 6636 | 6637 | 6638 | 6642 | 6644 | 6650 | 6651 | 6652 |
| 6653 | 6654 | 6666 | 6667 | 6669 | 6670 | 6673 | 6674 | 6677 | 6682 | 6685 | 6686 |
| 6688 | 6692 | 6696 | 6697 | 6698 | 6699 | 6701 | 6703 | 6706 | 6707 | 6709 |
| 6710 | 6711 | 6712 | 6713 | 6716 | 6719 | 6721 | 6722 | 6723 | 6725 | 6726 | 6728 |
| 6730 | 6731 | 6734 | 6735 | 6738 | 6739 | 6740 | 6741 | 6742 | 6746 | 6747 | 6748 |
| 6749 | 6750 | 6753 | 6754 | 6755 | 6756 | 6757 | 6758 | 6759 | 6761 | 6762 | 6763 |
| 6764 | 6765 | 6767 | 6768 | 6769 | 6770 | 6771 | 6772 | 6773 | 6774 | 6775 | 6776 |
| 6780 | 6781 | 6782 | 6783 | 6784 | 6785 | 6786 | 6787 | 6789 | 6790 | 6791 | 6792 |
| 6794 | 6795 | 6797 | 6800 | 6801 | 6803 | 6804 | 6805 | 6806 | 6807 | 6808 | 6811 |
| 6812 | 6813 | 6815 | 6816 | 6817 | 6818 | 6819 | 6820 | 6821 | 6822 | 6823 | 6824 |
| 6825 | 6826 | 6827 | 6828 | 6829 | 6831 | 6833 | 6834 | 6835 | 6836 | 6837 | 6838 |
| 6839 | 6841 | 6843 | 6845 | 6847 | 6848 | 6849 | 6851 | 6852 | 6853 | 6854 | 6856 |
| 6857 | 6858 | 6859 | 6860 | 6861 | 6862 | 6863 | 6864 | 6866 | 6867 | 6868 | 6870 |
| 6871 | 6872 | 6876 | 6877 | 6878 | 6879 | 6880 | 6883 | 6885 | 6887 | 6889 | 6890 |
| 6891 | 6892 | 6894 | 6895 | 6896 | 6897 | 6898 | 6899 | 6901 | 6902 | 6903 |
| 6904 | 6906 | 6911 | 6914 | 6915 | 6916 | 6920 | 6921 | 6922 | 6923 | 6927 | 6928 |
| 6929 | 6930 | 6931 | 6933 | 6934 | 6935 | 6936 | 6937 | 6938 | 6939 | 6940 | 6941 |
| 6944 | 6946 | 6947 | 6948 | 6949 | 6950 | 6951 | 6952 | 6953 | 6954 | 6955 | 6956 |
| 6957 | 6958 | 6961 | 6965 | 6969 | 6970 | 6973 | 6974 | 6975 | 6976 | 6977 | 6980 |
| 6984 | 6985 | 6988 | 6989 | 6991 | 6992 | 6994 | 6996 | 6997 | 6998 | 6999 | 7000 |
| 7001 | 7007 | 7008 | 7009 | 7010 | 7012 | 7013 | 7014 | 7015 | 7019 | 7020 | 7021 |
| 7022 | 7026 | 7027 | 7032 | 7035 | 7037 | 7038 | 7040 | 7044 | 7046 | 7047 | 7049 |
| 7050 | 7051 | 7053 | 7057 | 7058 | 7066 | 7067 | 7068 | 7069 | 7070 | 7072 | 7073 |
| 7076 | 7080 | 7082 | 7083 | 7084 | 7086 | 7090 | 7091 | 7097 | 7100 | 7101 | 7102 |
| 7110 | 7113 | 7114 | 7116 | 7117 | 7120 | 7126 | 7127 | 7135 | 7136 | 7140 | 7141 |
| 7143 | 7145 | 7146 | 7148 | 7149 | 7150 | 7153 | 7156 | 7157 | 7161 | 7167 | 7171 |
| 7172 | 7175 | 7180 | 7181 | 7184 | 7187 | 7189 | 7191 | 7192 | 7195 | 7198 | 7199 |
| 7201 | 7202 | 7203 | 7204 | 7207 | 7208 | 7209 | 7210 | 7213 | 7215 | 7218 | 7224 |

TABLE 19-continued

Yield: Stress Tolerance

| | | | | | | | | | | | |
|---|---|---|---|---|---|---|---|---|---|---|---|
| 7226 | 7228 | 7229 | 7230 | 7232 | 7235 | 7237 | 7239 | 7241 | 7246 | 7247 | 7248 |
| 7249 | 7250 | 7252 | 7253 | 7255 | 7256 | 7260 | 7261 | 7263 | 7264 | 7265 | 7266 |
| 7267 | 7271 | 7272 | 7273 | 7274 | 7278 | 7280 | 7281 | 7282 | 7291 | 7295 | 7298 |
| 7300 | 7306 | 7308 | 7309 | 7310 | 7311 | 7312 | 7314 | 7316 | 7318 | 7320 | 7325 |
| 7326 | 7328 | 7331 | 7332 | 7336 | 7337 | 7339 | 7340 | 7342 | 7344 | 7350 | 7352 |
| 7353 | 7354 | 7355 | 7356 | 7360 | 7365 | 7366 | 7368 | 7371 | 7372 | 7374 | 7375 |
| 7376 | 7377 | 7378 | 7379 | 7380 | 7384 | 7385 | 7389 | 7392 | 7393 | 7394 | 7400 |
| 7407 | 7408 | 7410 | 7412 | 7413 | 7415 | 7419 | 7420 | 7421 | 7423 | 7424 | 7425 |
| 7429 | 7432 | 7435 | 7440 | 7442 | 7444 | 7445 | 7450 | 7451 | 7452 | 7453 | 7456 |
| 7459 | 7460 | 7463 | 7464 | 7467 | 7468 | 7469 | 7471 | 7473 | 7475 | 7477 | 7480 |
| 7482 | 7483 | 7486 | 7487 | 7488 | 7496 | 7499 | 7500 | 7503 | 7508 | 7510 | 7515 |
| 7518 | 7519 | 7521 | 7523 | 7524 | 7525 | 7529 | 7531 | 7534 | 7538 | 7541 | 7543 |
| 7544 | 7545 | 7546 | 7547 | 7551 | 7553 | 7560 | 7564 | 7565 | 7566 | 7567 | 7569 |
| 7570 | 7571 | 7572 | 7574 | 7575 | 7577 | 7578 | 7579 | 7583 | 7585 | 7588 | 7592 |
| 7596 | 7597 | 7604 | 7605 | 7608 | 7609 | 7610 | 7611 | 7613 | 7620 | 7623 | 7624 |
| 7625 | 7629 | 7634 | 7638 | 7640 | 7642 | 7643 | 7644 | 7646 | 7649 | 7651 | 7652 |
| 7653 | 7655 | 7656 | 7657 | 7659 | 7665 | 7666 | 7669 | 7670 | 7672 | 7674 | 7675 |
| 7678 | 7680 | 7683 | 7684 | 7685 | 7693 | 7694 | 7695 | 7696 | 7697 | 7700 | 7702 |
| 7704 | 7705 | 7711 | 7712 | 7714 | 7719 | 7720 | 7721 | 7723 | 7724 | 7726 | 7728 |
| 7731 | 7735 | 7736 | 7737 | 7739 | 7742 | 7743 | 7746 | 7749 | 7750 | 7756 | 7757 |
| 7764 | 7767 | 7770 | 7771 | 7772 | 7773 | 7774 | 7776 | 7777 | 7782 | 7784 | 7785 |
| 7789 | 7790 | 7791 | 7792 | 7794 | 7795 | 7801 | 7802 | 7803 | 7805 | 7807 | 7808 |
| 7809 | 7810 | 7812 | 7813 | 7815 | 7816 | 7819 | 7820 | 7822 | 7823 | 7826 | 7836 |
| 7837 | 7839 | 7840 | 7841 | 7842 | 7846 | 7850 | 7852 | 7856 | 7858 | 7860 | 7861 |
| 7862 | 7865 | 7869 | 7871 | 7872 | 7873 | 7878 | 7880 | 7885 | 7886 | 7890 | 7891 |
| 7892 | 7894 | 7895 | 7896 | 7900 | 7902 | 7903 | 7905 | 7910 | 7911 | 7912 | 7913 |
| 7917 | 7918 | 7920 | 7921 | 7922 | 7923 | 7924 | 7926 | 7933 | 7938 | 7939 | 7941 |
| 7944 | 7951 | 7953 | 7954 | 7955 | 7958 | 7960 | 7961 | 7964 | 7965 | 7971 | 7977 |
| 7978 | 7979 | 7980 | 7983 | 7987 | 7989 | 7993 | 7996 | 7997 | 8001 | 8006 | 8007 |
| 8009 | 8010 | 8011 | 8012 | 8014 | 8015 | 8019 | 8020 | 8023 | 8024 | 8028 | 8033 |
| 8035 | 8039 | 8040 | 8041 | 8043 | 8044 | 8047 | 8050 | 8051 | 8054 | 8057 | 8060 |
| 8061 | 8062 | 8063 | 8064 | 8066 | 8070 | 8072 | 8074 | 8075 | 8076 | 8077 | 8079 |
| 8080 | 8081 | 8082 | 8083 | 8084 | 8089 | 8093 | 8094 | 8099 | 8100 | 8101 | 8102 |
| 8103 | 8104 | 8105 | 8106 | 8108 | 8111 | 8112 | 8114 | 8115 | 8116 | 8130 | 8132 |
| 8133 | 8134 | 8135 | 8136 | 8137 | 8140 | 8141 | 8142 | 8143 | 8145 | 8150 | 8153 |
| 8154 | 8157 | 8159 | 8161 | 8162 | 8168 | 8171 | 8172 | 8174 | 8175 | 8176 | 8178 |
| 8191 | 8192 | 8193 | 8194 | 8195 | 8206 | 8207 | 8209 | 8210 | 8214 | 8217 | 8218 |
| 8219 | 8220 | 8224 | 8225 | 8226 | 8229 | 8231 | 8239 | 8241 | 8243 | 8245 | 8248 |
| 8249 | 8255 | 8256 | 8257 | 8259 | 8261 | 8262 | 8263 | 8265 | 8266 | 8270 | 8275 |
| 8276 | 8277 | 8280 | 8284 | 8285 | 8288 | 8290 | 8291 | 8292 | 8296 | 8297 | 8298 |
| 8300 | 8303 | 8304 | 8309 | 8312 | 8313 | 8314 | 8315 | 8316 | 8317 | 8319 | 8320 |
| 8322 | 8323 | 8324 | 8327 | 8328 | 8329 | 8331 | 8333 | 8342 | 8345 | 8350 | 8351 |
| 8352 | 8353 | 8358 | 8361 | 8362 | 8363 | 8369 | 8373 | 8374 | 8375 | 8379 | 8380 |
| 8388 | 8389 | 8390 | 8393 | 8395 | 8399 | 8404 | 8406 | 8410 | 8412 | 8414 | 8416 |
| 8421 | 8423 | 8427 | 8428 | 8429 | 8433 | 8436 | 8437 | 8446 | 8449 | 8451 | 8454 |
| 8457 | 8459 | 8460 | 8461 | 8465 | 8471 | 8474 | 8475 | 8476 | 8479 | 8482 | 8484 |
| 8485 | 8487 | 8488 | 8489 | 8493 | 8495 | 8496 | 8499 | 8501 | 8502 | 8503 | 8506 |
| 8511 | 8513 | 8519 | 8520 | 8530 | 8531 | 8535 | 8537 | 8539 | 8540 | 8541 | 8542 |
| 8545 | 8548 | 8549 | 8551 | 8554 | 8555 | 8560 | 8562 | 8564 | 8565 | 8567 | 8576 |
| 8578 | 8579 | 8580 | 8581 | 8582 | 8586 | 8588 | 8589 | 8590 | 8592 | 8594 | 8595 |
| 8596 | 8597 | 8598 | 8599 | 8601 | 8602 | 8604 | 8606 | 8609 | 8610 | 8611 | 8612 |
| 8613 | 8617 | 8620 | 8623 | 8625 | 8626 | 8628 | 8629 | 8631 | 8632 | 8639 | 8641 |
| 8642 | 8643 | 8644 | 8646 | 8650 | 8652 | 8657 | 8661 | 8662 | 8663 | 8667 | 8668 |
| 8672 | 8676 | 8678 | 8680 | 8683 | 8684 | 8685 | 8687 | 8688 | 8689 | 8690 | 8691 |
| 8692 | 8694 | 8695 | 8698 | 8699 | 8702 | 8703 | 8707 | 8709 | 8710 | 8712 | 8714 |
| 8723 | 8729 | 8735 | 8736 | 8737 | 8739 | 8740 | 8741 | 8742 | 8743 | 8744 | 8747 |
| 8748 | 8749 | 8750 | 8751 | 8753 | 8754 | 8755 | 8757 | 8762 | 8763 | 8764 | 8767 |
| 8773 | 8778 | 8779 | 8783 | 8785 | 8787 | 8788 | 8789 | 8790 | 8793 | 8796 | 8798 |
| 8799 | 8803 | 8804 | 8806 | 8809 | 8810 | 8811 | 8812 | 8813 | 8817 | 8818 | 8825 |
| 8828 | 8829 | 8832 | 8838 | 8840 | 8841 | 8842 | 8843 | 8844 | 8845 | 8846 | 8847 |
| 8852 | 8854 | 8855 | 8857 | 8858 | 8859 | 8863 | 8867 | 8872 | 8876 | 8877 | 8880 |
| 8881 | 8884 | 8886 | 8887 | 8888 | 8889 | 8891 | 8892 | 8894 | 8897 | 8898 | 8899 |
| 8901 | 8904 | 8906 | 8907 | 8908 | 8912 | 8913 | 8914 | 8920 | 8922 | 8928 | 8933 |
| 8935 | 8939 | 8941 | 8944 | 8946 | 8948 | 8950 | 8951 | 8954 | 8956 | 8958 | 8966 |
| 8968 | 8969 | 8971 | 8975 | 8976 | 8977 | 8978 | 8979 | 8984 | 8986 | 8989 | 8990 |
| 8991 | 8992 | 8993 | 8995 | 9005 | 9006 | 9008 | 9010 | 9011 | 9017 | 9018 | 9019 |
| 9022 | 9023 | 9024 | 9025 | 9029 | 9031 | 9032 | 9034 | 9040 | 9042 | 9043 | 9049 |
| 9050 | 9053 | 9054 | 9055 | 9056 | 9057 | 9067 | 9070 | 9072 | 9077 | 9079 | 9083 |
| 9084 | 9088 | 9090 | 9092 | 9095 | 9098 | 9099 | 9100 | 9101 | 9102 | 9103 | 9105 |
| 9108 | 9113 | 9114 | 9116 | 9119 | 9120 | 9121 | 9122 | 9123 | 9128 | 9129 | 9132 |
| 9134 | 9135 | 9136 | 9138 | 9143 | 9144 | 9146 | 9148 | 9152 | 9153 | 9156 | 9157 |
| 9158 | 9159 | 9162 | 9165 | 9167 | 9168 | 9169 | 9172 | 9175 | 9178 | 9180 | 9181 |
| 9183 | 9186 | 9189 | 9190 | 9192 | 9193 | 9194 | 9195 | 9197 | 9198 | 9204 | 9206 |
| 9209 | 9212 | 9215 | 9217 | 9219 | 9224 | 9226 | 9227 | 9228 | 9232 | 9236 | 9237 |
| 9239 | 9240 | 9241 | 9243 | 9244 | 9245 | 9246 | 9252 | 9255 | 9256 | 9257 | 9260 |
| 9261 | 9263 | 9264 | 9265 | 9269 | 9270 | 9273 | 9274 | 9275 | 9276 | 9277 | 9278 |
| 9279 | 9280 | 9282 | 9284 | 9285 | 9287 | 9289 | 9290 | 9298 | 9299 | 9303 | 9304 |

TABLE 19-continued

Yield: Stress Tolerance

| | | | | | | | | | | | |
|---|---|---|---|---|---|---|---|---|---|---|---|
| 9306 | 9311 | 9315 | 9327 | 9329 | 9331 | 9334 | 9336 | 9337 | 9338 | 9339 | 9340 |
| 9341 | 9342 | 9343 | 9344 | 9346 | 9351 | 9352 | 9355 | 9356 | 9363 | 9365 | 9366 |
| 9368 | 9369 | 9370 | 9371 | 9372 | 9380 | 9382 | 9385 | 9386 | 9393 | 9397 | 9400 |
| 9403 | 9404 | 9407 | 9409 | 9411 | 9415 | 9419 | 9420 | 9422 | 9423 | 9424 | 9425 |
| 9428 | 9431 | 9432 | 9433 | 9435 | 9439 | 9440 | 9441 | 9442 | 9444 | 9447 | 9448 |
| 9450 | 9451 | 9453 | 9455 | 9460 | 9461 | 9462 | 9463 | 9467 | 9468 | 9471 | 9474 |
| 9475 | 9476 | 9478 | 9479 | 9480 | 9481 | 9482 | 9484 | 9488 | 9490 | 9496 | 9497 |
| 9498 | 9500 | 9502 | 9503 | 9504 | 9507 | 9508 | 9511 | 9512 | 9513 | 9518 | 9520 |
| 9521 | 9523 | 9524 | 9526 | 9527 | 9530 | 9532 | 9533 | 9539 | 9540 | 9542 | 9545 |
| 9546 | 9550 | 9555 | 9558 | 9562 | 9564 | 9567 | 9569 | 9574 | 9575 | 9576 | 9577 |
| 9581 | 9584 | 9585 | 9586 | 9588 | 9589 | 9590 | 9600 | 9601 | 9604 | 9606 | 9607 |
| 9609 | 9610 | 9612 | 9614 | 9621 | 9623 | 9625 | 9626 | 9628 | 9630 | 9634 | 9635 |
| 9636 | 9637 | 9638 | 9639 | 9640 | 9644 | 9645 | 9646 | 9648 | 9649 | 9650 | 9652 |
| 9661 | 9664 | 9665 | 9666 | 9667 | 9668 | 9669 | 9672 | 9673 | 9674 | 9676 | 9677 |
| 9683 | 9695 | 9697 | 9700 | 9701 | 9705 | 9706 | 9707 | 9708 | 9710 | 9712 | 9713 |
| 9715 | 9716 | 9721 | 9722 | 9723 | 9724 | 9725 | 9726 | 9727 | 9732 | 9735 | 9742 |
| 9743 | 9747 | 9750 | 9751 | 9754 | 9755 | 9758 | 9759 | 9762 | 9766 | 9769 | 9770 |
| 9772 | 9774 | 9775 | 9777 | 9778 | 9779 | 9780 | 9781 | 9782 | 9786 | 9788 | 9791 |
| 9792 | 9793 | 9795 | 9798 | 9799 | 9800 | 9807 | 9808 | 9809 | 9811 | 9812 | 9813 |
| 9814 | 9820 | 9821 | 9829 | 9831 | 9833 | 9835 | 9836 | 9837 | 9838 | 9839 | 9853 |
| 9854 | 9856 | 9857 | 9858 | 9861 | 9864 | 9865 | 9866 | 9869 | 9874 | 9875 | 9876 |
| 9879 | 9881 | 9889 | 9890 | 9892 | 9900 | 9901 | 9902 | 9903 | 9907 | 9908 | 9912 |
| 9913 | 9923 | 9924 | 9927 | 9928 | 9930 | 9937 | 9938 | 9939 | 9940 | 9946 | 9949 |
| 9950 | 9953 | 9958 | 9959 | 9960 | 9963 | 9973 | 9977 | 9978 | 9979 | 9980 | 9981 |
| 9985 | 9986 | 9989 | 9993 | 9994 | 9995 | 9996 | 9997 | 10006 | 10014 | 10018 | 10025 |
| 10026 | 10030 | 10031 | 10032 | 10033 | 10034 | 10038 | 10040 | 10041 | 10049 | 10053 | 10055 |
| 10059 | 10061 | 10063 | 10067 | 10068 | 10069 | 10070 | 10073 | 10075 | 10083 | 10086 | 10088 |
| 10089 | 10091 | 10092 | 10098 | 10099 | 10100 | 10102 | 10103 | 10104 | 10105 | 10106 | 10107 |
| 10108 | 10109 | 10112 | 10113 | 10114 | 10115 | 10118 | 10119 | 10120 | 10121 | 10123 | 10125 |
| 10130 | 10131 | 10132 | 10134 | 10135 | 10136 | 10137 | 10143 | 10145 | 10147 | 10148 | 10149 |
| 10151 | 10153 | 10155 | 10156 | 10158 | 10159 | 10160 | 10161 | 10162 | 10163 | 10168 | 10170 |
| 10173 | 10174 | 10177 | 10178 | 10180 | 10181 | 10182 | 10183 | 10184 | 10185 | 10187 | 10190 |
| 10191 | 10193 | 10196 | 10204 | 10206 | 10208 | 10211 | 10212 | 10213 | 10217 | 10223 | 10228 |
| 10229 | 10232 | 10235 | 10236 | 10242 | 10243 | 10249 | 10255 | 10258 | 10259 | 10262 | 10265 |
| 10266 | 10268 | 10269 | 10270 | 10274 | 10275 | 10276 | 10277 | 10278 | 10279 | 10284 | 10285 |
| 10286 | 10288 | 10289 | 10291 | 10292 | 10295 | 10296 | 10298 | 10299 | 10300 | 10304 | 10305 |
| 10308 | 10311 | 10312 | 10313 | 10314 | 10315 | 10316 | 10318 | 10319 | 10320 | 10324 | 10326 |
| 10328 | 10329 | 10330 | 10332 | 10335 | 10336 | 10341 | 10344 | 10345 | 10348 | 10349 | 10356 |
| 10357 | 10358 | 10359 | 10363 | 10364 | 10365 | 10366 | 10368 | 10369 | 10370 | 10373 | 10374 |
| 10375 | 10376 | 10378 | 10379 | 10381 | 10384 | 10389 | 10390 | 10392 | 10393 | 10394 | 10396 |
| 10400 | 10403 | 10404 | 10408 | 10410 | 10411 | 10413 | 10416 | 10417 | 10418 | 10421 | 10423 |
| 10424 | 10431 | 10434 | 10436 | 10438 | 10439 | 10445 | 10446 | 10447 | 10449 | 10450 | 10451 |
| 10452 | 10461 | 10470 | 10471 | 10473 | 10474 | 10475 | 10478 | 10479 | 10482 | 10483 | 10485 |
| 10487 | 10490 | 10496 | 10498 | 10505 | 10507 | 10508 | 10509 | 10512 | 10513 | 10514 | 10515 |
| 10518 | 10520 | 10521 | 10524 | 10530 | 10531 | 10532 | 10533 | 10534 | 10535 | 10539 | 10543 |
| 10544 | 10545 | 10550 | 10558 | 10559 | 10567 | 10575 | 10576 | 10579 | 10580 | 10586 | 10589 |
| 10591 | 10595 | 10596 | 10597 | 10598 | 10599 | 10600 | 10602 | 10603 | 10606 | 10607 | 10609 |
| 10615 | 10617 | 10618 | 10619 | 10622 | 10624 | 10625 | 10626 | 10629 | 10630 | 10631 | 10632 |
| 10633 | 10635 | 10638 | 10640 | 10643 | 10644 | 10646 | 10647 | 10649 | 10664 | 10671 | 10672 |
| 10675 | 10676 | 10678 | 10679 | 10680 | 10681 | 10682 | 10687 | 10688 | 10690 | 10691 | 10692 |
| 10693 | 10694 | 10696 | 10697 | 10701 | 10704 | 10705 | 10708 | 10710 | 10711 | 10715 | 10722 |
| 10729 | 10730 | 10734 | 10735 | 10736 | 10740 | 10741 | 10747 | 10748 | 10749 | 10750 | 10755 |
| 10756 | 10765 | 10768 | 10769 | 10773 | 10776 | 10778 | 10779 | 10782 | 10791 | 10794 | 10795 |
| 10797 | 10798 | 10799 | 10800 | 10801 | 10805 | 10807 | 10809 | 10810 | 10811 | 10816 | 10818 |
| 10819 | 10821 | 10822 | 10826 | 10828 | 10829 | 10830 | 10832 | 10839 | 10841 | 10850 | 10855 |
| 10858 | 10859 | 10860 | 10862 | 10866 | 10868 | 10872 | 10873 | 10875 | 10876 | 10877 | 10879 |
| 10880 | 10882 | 10883 | 10885 | 10890 | 10893 | 10894 | 10896 | 10898 | 10909 | 10910 | 10911 |
| 10913 | 10917 | 10918 | 10919 | 10920 | 10928 | 10930 | 10931 | 10932 | 10933 | 10941 | 10943 |
| 10945 | 10946 | 10947 | 10952 | 10954 | 10955 | 10960 | 10961 | 10964 | 10968 | 10969 | 10970 |
| 10971 | 10972 | 10973 | 10976 | 10978 | 10980 | 10985 | 10996 | 10998 | 11000 | 11003 | 11005 |
| 11006 | 11007 | 11013 | 11014 | 11017 | 11018 | 11019 | 11020 | 11024 | 11026 | 11028 | 11029 |
| 11030 | 11032 | 11033 | 11039 | 11041 | 11043 | 11045 | 11046 | 11047 | 11049 | 11050 | 11051 |
| 11052 | 11055 | 11058 | 11060 | 11061 | 11062 | 11064 | 11066 | 11067 | 11068 | 11069 | 11070 |
| 11071 | 11073 | 11074 | 11076 | 11077 | 11078 | 11079 | 11081 | 11085 | 11086 | 11088 | 11091 |
| 11092 | 11094 | 11095 | 11096 | 11098 | 11100 | 11101 | 11102 | 11103 | 11105 | 11106 | 11109 |
| 11110 | 11111 | 11112 | 11113 | 11115 | 11116 | 11117 | 11119 | 11120 | 11122 | 11123 | 11125 |
| 11126 | 11127 | 11128 | 11129 | 11131 | 11132 | 11133 | 11135 | 11136 | 11137 | 11139 | 11140 |
| 11141 | 11142 | 11143 | 11145 | 11146 | 11149 | 11150 | 11152 | 11155 | 11156 | 11158 |  |
| 11159 | 11160 | 11161 | 11163 | 11165 | 11166 | 11167 | 11168 | 11171 | 11174 | 11181 | 11182 |
| 11183 | 11184 | 11185 | 11187 | 11188 | 11195 | 11196 | 11197 | 11200 | 11202 | 11203 | 11204 |
| 11205 | 11206 | 11207 | 11208 | 11209 | 11210 | 11211 | 11212 | 11214 | 11216 | 11221 | 11222 |
| 11228 | 11230 | 11236 | 11237 | 11238 | 11241 | 11242 | 11244 | 11245 | 11246 | 11248 | 11249 |
| 11250 | 11251 | 11254 | 11255 | 11257 | 11258 | 11260 | 11263 | 11266 | 11268 | 11269 | 11270 |
| 11271 | 11272 | 11277 | 11282 | 11283 | 11284 | 11285 | 11286 | 11287 | 11289 | 11290 | 11293 |
| 11294 | 11296 | 11297 | 11298 | 11299 | 11300 | 11307 | 11308 | 11309 | 11310 | 11311 | 11312 |
| 11313 | 11316 | 11319 | 11320 | 11324 | 11325 | 11326 | 11327 | 11328 | 11329 | 11332 | 11334 |
| 11336 | 11338 | 11345 | 11347 | 11348 | 11349 | 11350 | 11351 | 11356 | 11358 | 11360 | 11361 |

TABLE 19-continued

Yield: Stress Tolerance

| | | | | | | | | | | | |
|---|---|---|---|---|---|---|---|---|---|---|---|
| 11362 | 11364 | 11365 | 11366 | 11367 | 11368 | 11370 | 11371 | 11377 | 11380 | 11381 | 11383 |
| 11387 | 11388 | 11389 | 11390 | 11392 | 11396 | 11398 | 11402 | 11403 | 11405 | 11407 | 11410 |
| 11412 | 11413 | 11417 | 11419 | 11420 | 11423 | 11425 | 11427 | 11431 | 11432 | 11433 | 11434 |
| 11435 | 11439 | 11440 | 11442 | 11443 | 11444 | 11445 | 11448 | 11449 | 11451 | 11453 | 11455 |
| 11457 | 11460 | 11463 | 11465 | 11466 | 11470 | 11471 | 11475 | 11476 | 11478 | 11479 | 11485 |
| 11489 | 11490 | 11493 | 11494 | 11498 | 11500 | 11502 | 11506 | 11515 | 11516 | 11518 | 11523 |
| 11526 | 11529 | 11530 | 11533 | 11534 | 11537 | 11538 | 11539 | 11540 | 11542 | 11544 | 11545 |
| 11550 | 11552 | 11554 | 11555 | 11557 | 11559 | 11561 | 11564 | 11565 | 11566 | 11567 | 11568 |
| 11570 | 11572 | 11574 | 11575 | 11576 | 11578 | 11581 | 11584 | 11588 | 11593 | 11594 | 11595 |
| 11597 | 11598 | 11604 | 11605 | 11606 | 11607 | 11609 | 11612 | 11614 | 11616 | 11623 | 11624 |
| 11627 | 11629 | 11632 | 11633 | 11637 | 11646 | 11648 | 11649 | 11651 | 11653 | 11656 | 11658 |
| 11659 | 11661 | 11663 | 11667 | 11685 | 11691 | 11697 | 11708 | 11709 | 11713 | 11714 | 11716 |
| 11718 | 11719 | 11722 | 11729 | 11731 | 11734 | 11736 | 11738 | 11740 | 11742 | 11743 | 11744 |
| 11746 | 11747 | 11749 | 11756 | 11760 | 11763 | 11766 | 11768 | 11769 | 11770 | 11773 | 11774 |
| 11776 | 11777 | 11778 | 11781 | 11783 | 11786 | 11788 | 11789 | 11791 | 11795 | 11796 | 11797 |
| 11800 | 11801 | 11805 | 11807 | 11811 | 11812 | 11813 | 11816 | 11825 | 11827 | 11829 | 11830 |
| 11831 | 11835 | 11838 | 11839 | 11840 | 11843 | 11844 | 11848 | 11850 | 11853 | 11855 | 11859 |
| 11861 | 11863 | 11867 | 11868 | 11870 | 11871 | 11874 | 11875 | 11876 | 11877 | 11879 | 11881 |
| 11884 | 11887 | 11888 | 11889 | 11891 | 11892 | 11894 | 11897 | 11899 | 11902 | 11903 | 11904 |
| 11905 | 11907 | 11908 | 11911 | 11912 | 11914 | 11915 | 11919 | 11922 | 11925 | 11926 | 11929 |
| 11932 | 11935 | 11936 | 11939 | 11940 | 11941 | 11946 | 11948 | 11950 | 11951 | 11953 | 11954 |
| 11957 | 11959 | 11961 | 11967 | 11970 | 11972 | 11975 | 11976 | 11977 | 11983 | 11985 | 11987 |
| 11988 | 11996 | 11997 | 12002 | 12004 | 12005 | 12007 | 12011 | 12013 | 12014 | 12017 | 12018 |
| 12020 | 12021 | 12023 | 12025 | 12030 | 12031 | 12033 | 12034 | 12035 | 12036 | 12044 | 12045 |
| 12050 | 12052 | 12053 | 12058 | 12059 | 12062 | 12064 | 12066 | 12071 | 12074 | 12077 | 12078 |
| 12079 | 12080 | 12083 | 12084 | 12086 | 12088 | 12089 | 12092 | 12093 | 12095 | 12096 | 12099 |
| 12103 | 12106 | 12109 | 12110 | 12112 | 12113 | 12117 | 12119 | 12123 | 12124 | 12128 | 12129 |
| 12131 | 12132 | 12135 | 12136 | 12137 | 12138 | 12140 | 12143 | 12144 | 12145 | 12146 | 12147 |
| 12149 | 12155 | 12156 | 12157 | 12159 | 12160 | 12161 | 12162 | 12167 | 12169 | 12170 | 12174 |
| 12175 | 12176 | 12177 | 12178 | 12179 | 12183 | 12186 | 12187 | 12188 | 12189 | 12190 | 12192 |
| 12193 | 12194 | 12195 | 12197 | 12200 | 12201 | 12202 | 12205 | 12211 | 12212 | 12213 | |
| 12216 | 12217 | 12218 | 12221 | 12222 | 12224 | 12226 | 12228 | 12231 | 12232 | 12233 | 12235 |
| 12239 | 12241 | 12242 | 12244 | 12245 | 12246 | 12247 | 12248 | 12250 | 12251 | 12253 | 12256 |
| 12260 | 12261 | 12262 | 12264 | 12265 | 12266 | 12269 | 12272 | 12273 | 12274 | 12275 | 12279 |
| 12282 | 12284 | 12292 | 12296 | 12298 | 12304 | 12305 | 12306 | 12307 | 12308 | 12312 | 12315 |
| 12316 | 12317 | 12324 | 12325 | 12330 | 12335 | 12339 | 12340 | 12341 | 12342 | 12344 | 12345 |
| 12346 | 12357 | 12358 | 12360 | 12362 | 12363 | 12364 | 12366 | 12368 | 12371 | 12372 | 12373 |
| 12376 | 12377 | 12378 | 12379 | 12380 | 12381 | 12385 | 12387 | 12389 | 12391 | 12395 | 12396 |
| 12397 | 12398 | 12399 | 12400 | 12407 | 12408 | 12409 | 12412 | 12418 | 12420 | 12423 | 12426 |
| 12427 | 12431 | 12433 | 12434 | 12436 | 12441 | 12444 | 12446 | 12450 | 12451 | 12452 | 12454 |
| 12456 | 12459 | 12460 | 12461 | 12462 | 12464 | 12465 | 12466 | 12470 | 12471 | 12472 | 12474 |
| 12475 | 12479 | 12482 | 12483 | 12484 | 12485 | 12486 | 12487 | 12488 | 12489 | 12492 | 12493 |
| 12494 | 12495 | 12496 | 12498 | 12500 | 12502 | 12504 | 12505 | 12507 | 12509 | 12513 | 12514 |
| 12515 | 12516 | 12517 | 12518 | 12521 | 12524 | 12525 | 12527 | 12530 | 12531 | 12539 | 12540 |
| 12547 | 12551 | 12552 | 12554 | 12556 | 12557 | 12564 | 12566 | 12567 | 12568 | 12571 | 12575 |
| 12576 | 12579 | 12580 | 12581 | 12582 | 12583 | 12585 | 12586 | 12589 | 12593 | 12594 | 12595 |
| 12596 | 12598 | 12600 | 12602 | 12604 | 12605 | 12608 | 12609 | 12611 | 12615 | 12616 | 12617 |
| 12622 | 12624 | 12625 | 12626 | 12627 | 12628 | 12629 | 12630 | 12633 | 12634 | 12636 | 12638 |
| 12639 | 12642 | 12643 | 12644 | 12645 | 12646 | 12647 | 12648 | 12649 | 12653 | 12655 | 12662 |
| 12664 | 12665 | 12666 | 12668 | 12672 | 12673 | 12677 | 12678 | 12679 | 12688 | 12689 | 12690 |
| 12691 | 12692 | 12694 | 12695 | 12696 | 12699 | 12700 | 12702 | 12703 | 12707 | 12709 | 12710 |
| 12717 | 12720 | 12721 | 12722 | 12723 | 12726 | 12727 | 12728 | 12730 | 12731 | 12733 | |
| 12734 | 12736 | 12737 | 12739 | 12741 | 12742 | 12745 | 12746 | 12747 | 12748 | 12751 | 12752 |
| 12754 | 12755 | 12758 | 12760 | 12764 | 12765 | 12767 | 12768 | 12771 | 12774 | 12777 | 12778 |
| 12779 | 12781 | 12782 | 12784 | 12788 | 12790 | 12793 | 12794 | 12801 | 12806 | 12808 | 12810 |
| 12813 | 12815 | 12816 | 12819 | 12820 | 12822 | 12825 | 12827 | 12832 | 12835 | 12836 | 12837 |
| 12838 | 12840 | 12841 | 12842 | 12844 | 12846 | 12847 | 12851 | 12853 | 12854 | 12859 | 12861 |
| 12862 | 12863 | 12864 | 12865 | 12866 | 12869 | 12874 | 12876 | 12877 | 12879 | 12880 | 12882 |
| 12886 | 12889 | 12891 | 12892 | 12893 | 12895 | 12898 | 12899 | 12900 | 12901 | 12903 | 12906 |
| 12907 | 12911 | 12912 | 12913 | 12915 | 12916 | 12918 | 12921 | 12924 | 12925 | 12926 | 12927 |
| 12929 | 12931 | 12932 | 12934 | 12936 | 12937 | 12939 | 12941 | 12943 | 12944 | 12945 | 12947 |
| 12949 | 12951 | 12952 | 12953 | 12964 | 12966 | 12967 | 12969 | 12976 | 12977 | 12979 | 12981 |
| 12983 | 12984 | 12985 | 12986 | 12987 | 12989 | 12991 | 12992 | 12993 | 12994 | 12998 | 13001 |
| 13003 | 13006 | 13007 | 13010 | 13011 | 13014 | 13018 | 13019 | 13020 | 13022 | 13023 | 13025 |
| 13026 | 13028 | 13029 | 13032 | 13033 | 13038 | 13039 | 13040 | 13041 | 13043 | 13044 | 13046 |
| 13049 | 13051 | 13052 | 13054 | 13061 | 13062 | 13064 | 13071 | 13072 | 13073 | 13074 | 13076 |
| 13078 | 13079 | 13080 | 13081 | 13082 | 13085 | 13088 | 13090 | 13091 | 13093 | 13095 | 13096 |
| 13098 | 13100 | 13101 | 13104 | 13106 | 13108 | 13109 | 13111 | 13112 | 13113 | 13114 | 13115 |
| 13119 | 13120 | 13121 | 13122 | 13125 | 13126 | 13128 | 13130 | 13131 | 13134 | 13136 | 13137 |
| 13139 | 13141 | 13144 | 13145 | 13147 | 13148 | 13149 | 13150 | 13151 | 13152 | 13155 | 13156 |
| 13158 | 13159 | 13160 | 13161 | 13162 | 13165 | 13166 | 13169 | 13170 | 13171 | 13178 | 13179 |
| 13182 | 13183 | 13184 | 13188 | 13189 | 13191 | 13192 | 13193 | 13194 | 13195 | 13197 | 13198 |
| 13201 | 13202 | 13205 | 13208 | 13209 | 13211 | 13212 | 13213 | 13214 | 13215 | 13216 | 13217 |
| 13219 | 13221 | 13223 | 13224 | 13225 | 13228 | 13231 | 13236 | 13239 | 13242 | 13246 | 13247 |
| 13249 | 13252 | 13253 | 13254 | 13256 | 13257 | 13259 | 13261 | 13262 | 13263 | 13264 | 13265 |
| 13266 | 13269 | 13270 | 13271 | 13272 | 13277 | 13278 | 13280 | 13282 | 13283 | 13284 | 13287 |
| 13292 | 13293 | 13295 | 13296 | 13297 | 13298 | 13300 | 13302 | 13303 | 13306 | 13307 | 13310 |

TABLE 19-continued

Yield: Stress Tolerance

| | | | | | | | | | | | |
|---|---|---|---|---|---|---|---|---|---|---|---|
| 13312 | 13313 | 13314 | 13315 | 13316 | 13317 | 13318 | 13319 | 13320 | 13322 | 13325 | 13326 |
| 13329 | 13330 | 13331 | 13333 | 13335 | 13337 | 13338 | 13339 | 13341 | 13343 | 13344 | 13345 |
| 13347 | 13349 | 13350 | 13351 | 13354 | 13355 | 13356 | 13358 | 13360 | 13362 | 13365 | 13366 |
| 13369 | 13371 | 13373 | 13374 | 13375 | 13376 | 13377 | 13379 | 13381 | 13384 | 13385 | 13386 |
| 13387 | 13389 | 13390 | 13394 | 13395 | 13400 | 13401 | 13403 | 13408 | 13409 | 13410 | 13418 |
| 13419 | 13420 | 13421 | 13422 | 13423 | 13424 | 13425 | 13427 | 13428 | 13429 | 13430 | 13434 |
| 13437 | 13441 | 13445 | 13447 | 13449 | 13450 | 13451 | 13453 | 13454 | 13459 | 13467 | 13470 |
| 13473 | 13477 | 13479 | 13480 | 13481 | 13483 | 13484 | 13485 | 13486 | 13488 | 13491 | 13493 |
| 13494 | 13499 | 13506 | 13509 | 13510 | 13511 | 13514 | 13517 | 13518 | 13519 | 13520 | 13521 |
| 13522 | 13524 | 13528 | 13529 | 13534 | 13535 | 13536 | 13538 | 13539 | 13541 | 13542 | 13543 |
| 13544 | 13549 | 13552 | 13553 | 13554 | 13555 | 13556 | 13557 | 13558 | 13559 | 13562 | 13564 |
| 13567 | 13568 | 13570 | 13571 | 13572 | 13574 | 13575 | 13576 | 13577 | 13578 | 13582 | 13587 |
| 13591 | 13592 | 13595 | 13596 | 13598 | 13606 | 13610 | 13612 | 13613 | 13616 | 13617 | 13620 |
| 13627 | 13631 | 13632 | 13633 | 13637 | 13640 | 13641 | 13643 | 13644 | 13647 | 13648 | 13649 |
| 13650 | 13653 | 13656 | 13657 | 13660 | 13661 | 13662 | 13668 | 13670 | 13671 | 13675 | 13679 |
| 13680 | 13682 | 13688 | 13690 | 13691 | 13693 | 13694 | 13699 | 13702 | 13703 | 13704 | 13706 |
| 13707 | 13710 | 13713 | 13714 | 13715 | 13717 | 13719 | 13720 | 13727 | 13728 | 13731 | 13732 |
| 13736 | 13737 | 13738 | 13740 | 13742 | 13749 | 13751 | 13752 | 13754 | 13755 | 13756 | 13758 |
| 13759 | 13764 | 13767 | 13768 | 13769 | 13773 | 13775 | 13776 | 13780 | 13781 | 13783 | 13784 |
| 13789 | 13797 | 13798 | 13802 | 13803 | 13804 | 13805 | 13806 | 13807 | 13809 | 13810 | 13811 |
| 13813 | 13816 | 13817 | 13818 | 13820 | 13825 | 13829 | 13830 | 13833 | 13834 | 13835 | 13836 |
| 13837 | 13839 | 13841 | 13843 | 13844 | 13845 | 13846 | 13851 | 13855 | 13859 | 13863 | 13865 |
| 13866 | 13867 | 13868 | 13869 | 13873 | 13874 | 13877 | 13880 | 13881 | 13882 | 13884 | 13887 |
| 13890 | 13896 | 13898 | 13901 | 13902 | 13903 | 13904 | 13905 | 13906 | 13908 | 13910 | 13911 |
| 13912 | 13913 | 13914 | 13917 | 13918 | 13920 | 13924 | 13927 | 13928 | 13930 | 13932 | 13936 |
| 13939 | 13941 | 13943 | 13946 | 13948 | 13951 | 13955 | 13957 | 13958 | 13959 | 13961 | 13970 |
| 13971 | 13973 | 13974 | 13979 | 13987 | 13988 | 13990 | 13995 | 13997 | 13999 | 14000 | 14001 |
| 14002 | 14004 | 14005 | 14006 | 14007 | 14016 | 14017 | 14018 | 14020 | 14021 | 14022 | 14026 |
| 14027 | 14030 | 14033 | 14034 | 14035 | 14036 | 14039 | 14040 | 14043 | 14045 | 14048 | 14049 |
| 14050 | 14051 | 14053 | 14057 | 14060 | 14061 | 14062 | 14067 | 14068 | 14069 | 14072 | 14075 |
| 14077 | 14078 | 14086 | 14090 | 14092 | 14097 | 14098 | 14108 | 14109 | 14113 | 14117 | 14124 |
| 14125 | 14126 | 14134 | 14138 | 14141 | 14143 | 14145 | 14147 | 14149 | 14150 | 14151 | 14152 |
| 14154 | 14155 | 14161 | 14162 | 14166 | 14168 | 14170 | 14175 | 14176 | 14178 | 14181 | 14183 |
| 14186 | 14187 | 14191 | 14195 | 14197 | 14198 | 14204 | 14212 | 14213 | 14216 | 14218 | 14224 |
| 14225 | 14227 | 14228 | 14232 | 14233 | 14234 | 14236 | 14238 | 14239 | 14240 | 14242 | 14244 |
| 14246 | 14247 | 14248 | 14249 | 14253 | 14255 | 14257 | 14259 | 14260 | 14263 | 14266 | 14271 |
| 14272 | 14277 | 14278 | 14283 | 14284 | 14290 | 14293 | 14294 | 14296 | 14305 | 14307 | 14308 |
| 14309 | 14313 | 14314 | 14320 | 14322 | 14324 | 14325 | 14328 | 14330 | 14333 | 14334 | 14335 |
| 14338 | 14340 | 14346 | 14348 | 14351 | 14355 | 14356 | 14359 | 14360 | 14363 | 14364 | 14365 |
| 14367 | 14368 | 14371 | 14372 | 14381 | 14383 | 14384 | 14388 | 14391 | 14392 | 14395 | 14397 |
| 14399 | 14400 | 14402 | 14403 | 14404 | 14407 | 14409 | 14411 | 14412 | 14413 | 14418 | 14421 |
| 14424 | 14431 | 14433 | 14434 | 14436 | 14441 | 14443 | 14444 | 14446 | 14448 | 14452 | 14453 |
| 14457 | 14460 | 14461 | 14464 | 14465 | 14466 | 14471 | 14472 | 14473 | 14474 | 14475 | 14476 |
| 14477 | 14479 | 14482 | 14483 | 14484 | 14487 | 14488 | 14490 | 14491 | 14493 | 14501 | 14504 |
| 14508 | 14510 | 14514 | 14515 | 14516 | 14517 | 14519 | 14521 | 14522 | 14523 | 14525 | 14526 |
| 14528 | 14529 | 14531 | 14534 | 14535 | 14540 | 14541 | 14544 | 14547 | 14548 | 14550 | 14551 |
| 14556 | 14558 | 14560 | 14563 | 14564 | 14565 | 14567 | 14570 | 14574 | 14575 | 14580 | |
| 14582 | 14586 | 14588 | 14590 | 14594 | 14597 | 14598 | 14600 | 14607 | 14610 | 14613 | 14615 |
| 14616 | 14621 | 14624 | 14626 | 14632 | 14634 | 14645 | 14647 | 14648 | 14652 | 14653 | 14656 |
| 14657 | 14659 | 14662 | 14663 | 14664 | 14666 | 14669 | 14673 | 14674 | 14675 | 14677 | 14678 |
| 14686 | 14697 | 14700 | 14701 | 14705 | 14706 | 14707 | 14708 | 14711 | 14714 | 14717 | |
| 14720 | 14722 | 14723 | 14726 | 14729 | 14730 | 14731 | 14732 | 14734 | 14740 | 14745 | 14746 |
| 14748 | 14750 | 14752 | 14757 | 14758 | 14760 | 14763 | 14764 | 14771 | 14772 | 14777 | 14788 |
| 14791 | 14792 | 14794 | 14795 | 14796 | 14799 | 14800 | 14804 | 14805 | 14806 | 14810 | 14813 |
| 14816 | 14818 | 14820 | 14822 | 14824 | 14825 | 14832 | 14835 | 14840 | 14842 | 14843 | 14844 |
| 14845 | 14847 | 14848 | 14849 | 14850 | 14851 | 14853 | 14854 | 14864 | 14867 | 14868 | |
| 14869 | 14871 | 14873 | 14875 | 14876 | 14880 | 14881 | 14882 | 14885 | 14890 | 14894 | 14901 |
| 14902 | 14903 | 14907 | 14912 | 14916 | 14917 | 14920 | 14923 | 14924 | 14925 | 14931 | 14938 |
| 14943 | 14945 | 14947 | 14950 | 14951 | 14955 | 14956 | 14960 | 14962 | 14963 | 14964 | 14965 |
| 14967 | 14973 | 14974 | 14975 | 14978 | 14979 | 14981 | 14983 | 14985 | 14986 | 14987 | 14991 |
| 14992 | 14995 | 14997 | 15003 | 15004 | 15008 | 15013 | 15014 | 15015 | 15016 | 15020 | 15021 |
| 15025 | 15027 | 15029 | 15030 | 15031 | 15032 | 15034 | 15035 | 15036 | 15037 | 15038 | 15039 |
| 15040 | 15043 | 15046 | 15047 | 15051 | 15053 | 15058 | 15059 | 15060 | 15061 | 15064 | 15068 |
| 15075 | 15079 | 15080 | 15083 | 15089 | 15090 | 15092 | 15093 | 15094 | 15096 | 15103 | 15106 |
| 15107 | 15110 | 15112 | 15113 | 15115 | 15116 | 15118 | 15119 | 15120 | 15122 | 15125 | 15126 |
| 15130 | 15132 | 15133 | 15136 | 15140 | 15141 | 15142 | 15144 | 15145 | 15146 | 15149 | 15153 |
| 15154 | 15155 | 15158 | 15159 | 15160 | 15171 | 15179 | 15180 | 15183 | 15185 | 15188 | 15189 |
| 15190 | 15191 | 15192 | 15193 | 15195 | 15198 | 15202 | 15203 | 15207 | 15209 | 15210 | 15211 |
| 15212 | 15214 | 15216 | 15224 | 15227 | 15228 | 15229 | 15236 | 15237 | 15240 | 15243 | 15244 |
| 15251 | 15252 | 15259 | 15263 | 15265 | 15268 | 15274 | 15275 | 15283 | 15285 | 15286 | 15287 |
| 15289 | 15292 | 15293 | 15295 | 15296 | 15297 | 15303 | 15310 | 15321 | 15322 | 15325 | 15326 |
| 15327 | 15328 | 15334 | 15335 | 15336 | 15338 | 15340 | 15342 | 15346 | 15348 | 15349 | 15353 |
| 15354 | 15356 | 15358 | 15360 | 15365 | 15369 | 15371 | 15374 | 15376 | 15377 | 15378 | 15379 |
| 15380 | 15388 | 15392 | 15393 | 15396 | 15398 | 15401 | 15403 | 15406 | 15407 | 15409 | 15410 |
| 15411 | 15414 | 15415 | 15416 | 15419 | 15421 | 15422 | 15423 | 15428 | 15429 | 15430 | 15431 |
| 15436 | 15437 | 15438 | 15440 | 15442 | 15443 | 15449 | 15450 | 15454 | 15455 | 15457 | 15458 |
| 15459 | 15463 | 15471 | 15474 | 15475 | 15477 | 15480 | 15482 | 15488 | 15489 | 15490 | 15492 |

TABLE 19-continued

Yield: Stress Tolerance

| | | | | | | | | | | | |
|---|---|---|---|---|---|---|---|---|---|---|---|
| 15496 | 15500 | 15506 | 15510 | 15511 | 15512 | 15516 | 15518 | 15519 | 15520 | 15522 | 15525 |
| 15526 | 15530 | 15533 | 15534 | 15535 | 15538 | 15544 | 15545 | 15551 | 15552 | 15553 | 15556 |
| 15560 | 15561 | 15562 | 15563 | 15566 | 15569 | 15573 | 15575 | 15580 | 15582 | 15583 | 15584 |
| 15585 | 15587 | 15601 | 15602 | 15606 | 15609 | 15610 | 15611 | 15617 | 15619 | 15620 | 15624 |
| 15630 | 15632 | 15634 | 15636 | 15637 | 15638 | 15639 | 15642 | 15643 | 15646 | 15647 | 15648 |
| 15649 | 15650 | 15651 | 15652 | 15654 | 15655 | 15656 | 15657 | 15658 | 15659 | 15661 | 15662 |
| 15663 | 15669 | 15676 | 15687 | 15688 | 15691 | 15692 | 15693 | 15694 | 15695 | 15702 | 15703 |
| 15705 | 15707 | 15708 | 15709 | 15713 | 15715 | 15716 | 15721 | 15723 | 15725 | 15727 | 15732 |
| 15736 | 15738 | 15741 | 15744 | 15745 | 15746 | 15747 | 15748 | 15756 | 15760 | 15761 | 15764 |
| 15766 | 15769 | 15771 | 15774 | 15775 | 15777 | 15778 | 15779 | 15782 | 15783 | 15784 | 15787 |
| 15789 | 15790 | 15791 | 15796 | 15797 | 15798 | 15799 | 15800 | 15804 | 15805 | 15806 | 15808 |
| 15809 | 15811 | 15817 | 15818 | 15822 | 15823 | 15825 | 15826 | 15827 | 15830 | 15832 | 15835 |
| 15841 | 15844 | 15845 | 15847 | 15850 | 15853 | 15854 | 15858 | 15860 | 15861 | 15862 | 15863 |
| 15867 | 15871 | 15878 | 15882 | 15883 | 15884 | 15888 | 15890 | 15891 | 15893 | 15896 | 15897 |
| 15901 | 15904 | 15905 | 15906 | 15909 | 15916 | 15917 | 15924 | 15925 | 15926 | 15929 | 15933 |
| 15934 | 15935 | 15936 | 15939 | 15942 | 15946 | 15949 | 15951 | 15956 | 15958 | 15959 | 15960 |
| 15961 | 15963 | 15981 | 15984 | 15985 | 15986 | 15992 | 15994 | 15995 | 15999 | 16005 | 16007 |
| 16009 | 16011 | 16012 | 16013 | 16014 | 16017 | 16018 | 16021 | 16023 | 16024 | 16025 | 16026 |
| 16027 | 16028 | 16029 | 16030 | 16031 | 16033 | 16034 | 16035 | 16036 | 16037 | 16039 | 16041 |
| 16042 | 16045 | 16046 | 16047 | 16048 | 16049 | 16052 | 16053 | 16059 | 16067 | 16070 | 16078 |
| 16079 | 16080 | 16083 | 16084 | 16085 | 16086 | 16092 | 16093 | 16094 | 16097 | 16099 | 16102 |
| 16103 | 16104 | 16107 | 16108 | 16110 | 16111 | 16117 | 16121 | 16124 | 16126 | 16128 | 16129 |
| 16130 | 16131 | 16132 | 16138 | 16139 | 16143 | 16144 | 16148 | 16150 | 16153 | 16157 | 16158 |
| 16159 | 16161 | 16162 | 16164 | 16165 | 16166 | 16169 | 16171 | 16172 | 16173 | 16178 | 16179 |
| 16180 | 16181 | 16182 | 16186 | 16187 | 16189 | 16190 | 16191 | 16193 | 16199 | 16200 | 16204 |
| 16205 | 16206 | 16207 | 16210 | 16211 | 16214 | 16215 | 16223 | 16224 | 16226 | 16228 | 16233 |
| 16234 | 16235 | 16236 | 16238 | 16240 | 16243 | 16246 | 16254 | 16255 | 16256 | 16257 | 16259 |
| 16263 | 16264 | 16266 | 16269 | 16272 | 16273 | 16276 | 16277 | 16280 | 16284 | 16291 | 16292 |
| 16294 | 16297 | 16300 | 16301 | 16302 | 16303 | 16305 | 16308 | 16309 | 16314 | 16315 | 16319 |
| 16322 | 16323 | 16324 | 16328 | 16339 | 16342 | 16344 | 16350 | 16351 | 16352 | 16359 | 16361 |
| 16363 | 16365 | 16366 | 16367 | 16370 | 16371 | 16373 | 16374 | 16375 | 16376 | 16381 | 16382 |
| 16383 | 16386 | 16388 | 16389 | 16391 | 16395 | 16396 | 16397 | 16406 | 16407 | 16408 | 16409 |
| 16411 | 16412 | 16413 | 16414 | 16419 | 16420 | 16421 | 16428 | 16429 | 16430 | 16432 | 16433 |
| 16436 | 16437 | 16444 | 16445 | 16446 | 16447 | 16448 | 16451 | 16454 | 16456 | 16457 | 16459 |
| 16462 | 16463 | 16467 | 16468 | 16469 | 16471 | 16472 | 16475 | 16477 | 16478 | 16480 | 16481 |
| 16483 | 16484 | 16485 | 16486 | 16487 | 16490 | 16495 | 16496 | 16497 | 16501 | 16502 | 16503 |
| 16510 | 16511 | 16512 | 16514 | 16519 | 16520 | 16522 | 16524 | 16525 | 16529 | 16536 | 16540 |
| 16549 | 16550 | 16551 | 16552 | 16553 | 16554 | 16555 | 16558 | 16560 | 16561 | 16562 | 16570 |
| 16571 | 16574 | 16575 | 16576 | 16577 | 16580 | 16590 | 16591 | 16592 | 16593 | 16595 | 16597 |
| 16598 | 16599 | 16603 | 16605 | 16607 | 16609 | 16610 | 16611 | 16616 | 16618 | 16620 | 16621 |
| 16624 | 16625 | 16626 | 16630 | 16631 | 16633 | 16637 | 16646 | 16647 | 16649 | 16653 | 16654 |
| 16655 | 16656 | 16657 | 16658 | 16659 | 16661 | 16662 | 16664 | 16666 | 16667 | 16668 | 16669 |
| 16670 | 16674 | 16675 | 16679 | 16680 | 16681 | 16682 | 16687 | 16689 | 16692 | 16693 | 16695 |
| 16696 | 16697 | 16701 | 16702 | 16703 | 16705 | 16707 | 16709 | 16710 | 16711 | 16712 | 16713 |
| 16714 | 16715 | 16716 | 16717 | 16721 | 16722 | 16726 | 16728 | 16729 | 16732 | 16735 | 16737 |
| 16738 | 16740 | 16744 | 16749 | 16753 | 16756 | 16757 | 16758 | 16759 | 16767 | 16769 | 16770 |
| 16772 | 16776 | 16777 | 16778 | 16779 | 16780 | 16781 | 16782 | 16783 | 16787 | 16788 | 16790 |
| 16793 | 16798 | 16799 | 16803 | 16804 | 16805 | 16806 | 16807 | 16809 | 16810 | 16812 | 16813 |
| 16815 | 16817 | 16823 | 16826 | 16827 | 16828 | 16830 | 16831 | 16833 | 16835 | 16836 | 16837 |
| 16838 | 16840 | 16841 | 16843 | 16844 | 16849 | 16851 | 16854 | 16857 | 16858 | 16859 | 16861 |
| 16863 | 16864 | 16865 | 16866 | 16868 | 16870 | 16872 | 16873 | 16875 | 16877 | 16879 | 16884 |
| 16889 | 16891 | 16894 | 16895 | 16898 | 16899 | 16901 | 16904 | 16909 | 16915 | 16916 | 16917 |
| 16919 | 16920 | 16923 | 16925 | 16926 | 16930 | 16933 | 16935 | 16940 | 16941 | 16943 | 16946 |
| 16948 | 16949 | 16952 | 16957 | 16958 | 16959 | 16963 | 16964 | 16968 | 16970 | 16980 | 16981 |
| 16983 | 16984 | 16985 | 16986 | 16987 | 16988 | 16993 | 16995 | 17002 | 17006 | 17009 | 17010 |
| 17011 | 17015 | 17017 | 17020 | 17024 | 17026 | 17029 | 17030 | 17031 | 17032 | 17033 | 17037 |
| 17040 | 17042 | 17044 | 17046 | 17049 | 17055 | 17057 | 17058 | 17059 | 17060 | 17061 | 17063 |
| 17065 | 17067 | 17068 | 17069 | 17071 | 17072 | 17092 | 17093 | 17094 | 17095 | 17100 | 17102 |
| 17103 | 17105 | 17111 | 17113 | 17122 | 17123 | 17125 | 17126 | 17129 | 17131 | 17136 | 17137 |
| 17138 | 17139 | 17140 | 17143 | 17149 | 17153 | 17154 | 17155 | 17157 | 17158 | 17159 | 17163 |
| 17166 | 17167 | 17168 | 17169 | 17170 | 17171 | 17172 | 17174 | 17178 | 17182 | 17183 | 17185 |
| 17186 | 17187 | 17189 | 17193 | 17194 | 17195 | 17196 | 17197 | 17198 | 17199 | 17200 | 17201 |
| 17204 | 17205 | 17207 | 17208 | 17210 | 17211 | 17217 | 17220 | 17221 | 17222 | 17226 | 17230 |
| 17231 | 17234 | 17235 | 17236 | 17237 | 17240 | 17249 | 17259 | 17265 | 17270 | 17273 | 17274 |
| 17275 | 17277 | 17278 | 17279 | 17281 | 17283 | 17284 | 17289 | 17301 | 17303 | 17307 | 17309 |
| 17310 | 17313 | 17319 | 17321 | 17322 | 17323 | 17326 | 17327 | 17328 | 17330 | 17331 | 17332 |
| 17333 | 17337 | 17345 | 17348 | 17352 | 17358 | 17359 | 17363 | 17368 | 17369 | 17370 | 17371 |
| 17372 | 17373 | 17374 | 17375 | 17377 | 17378 | 17379 | 17381 | 17382 | 17383 | 17384 | 17385 |
| 17387 | 17388 | 17389 | 17391 | 17392 | 17398 | 17399 | 17401 | 17402 | 17403 | 17404 | 17410 |
| 17412 | 17415 | 17418 | 17419 | 17421 | 17426 | 17427 | 17430 | 17436 | 17443 | 17447 | 17453 |
| 17454 | 17455 | 17456 | 17462 | 17463 | 17464 | 17466 | 17467 | 17468 | 17469 | 17471 | 17476 |
| 17477 | 17478 | 17481 | 17483 | 17484 | 17485 | 17490 | 17491 | 17494 | 17500 | 17501 | 17504 |
| 17507 | 17510 | 17515 | 17517 | 17519 | 17520 | 17522 | 17523 | 17524 | 17526 | 17527 | 17535 |
| 17536 | 17537 | 17545 | 17546 | 17547 | 17548 | 17549 | 17550 | 17551 | 17552 | 17554 | 17555 |
| 17556 | 17557 | 17559 | 17560 | 17564 | 17565 | 17566 | 17568 | 17570 | 17571 | 17572 | 17573 |
| 17574 | 17575 | 17579 | 17582 | 17583 | 17584 | 17587 | 17588 | 17589 | 17590 | 17592 | 17600 |
| 17605 | 17608 | 17614 | 17615 | 17617 | 17619 | 17622 | 17623 | 17626 | 17629 | 17641 | 17651 |

TABLE 19-continued

Yield: Stress Tolerance

| | | | | | | | | | | | |
|---|---|---|---|---|---|---|---|---|---|---|---|
| 17652 | 17654 | 17655 | 17656 | 17657 | 17658 | 17659 | 17660 | 17661 | 17667 | 17668 | 17669 |
| 17670 | 17671 | 17672 | 17673 | 17675 | 17676 | 17678 | 17679 | 17683 | 17685 | 17687 | 17688 |
| 17689 | 17690 | 17691 | 17692 | 17693 | 17697 | 17701 | 17702 | 17706 | 17707 | 17712 | 17713 |
| 17718 | 17722 | 17723 | 17724 | 17725 | 17727 | 17728 | 17731 | 17732 | 17733 | 17737 | 17738 |
| 17739 | 17741 | 17742 | 17743 | 17744 | 17745 | 17746 | 17749 | 17752 | 17753 | 17755 | 17757 |
| 17758 | 17759 | 17760 | 17762 | 17765 | 17767 | 17770 | 17772 | 17774 | 17775 | 17776 | 17786 |
| 17788 | 17789 | 17790 | 17791 | 17793 | 17805 | 17806 | 17807 | 17809 | 17810 | 17811 | 17814 |
| 17817 | 17820 | 17821 | 17822 | 17823 | 17824 | 17830 | 17837 | 17840 | 17843 | 17849 | 17851 |
| 17852 | 17856 | 17857 | 17858 | 17860 | 17863 | 17868 | 17869 | 17870 | 17873 | 17888 | 17889 |
| 17890 | 17891 | 17895 | 17896 | 17897 | 17898 | 17899 | 17901 | 17902 | 17906 | 17913 | 17914 |
| 17917 | 17918 | 17920 | 17921 | 17922 | 17924 | 17925 | 17926 | 17927 | 17928 | 17930 | 17933 |
| 17934 | 17938 | 17939 | 17941 | 17944 | 17946 | 17948 | 17949 | 17951 | 17954 | 17955 | 17958 |
| 17959 | 17963 | 17965 | 17966 | 17968 | 17970 | 17971 | 17973 | 17979 | 17981 | 17982 | 17984 |
| 17985 | 17990 | 17992 | 17993 | 17995 | 18008 | 18009 | 18010 | 18012 | 18013 | 18017 | 18022 |
| 18025 | 18026 | 18030 | 18031 | 18032 | 18034 | 18036 | 18037 | 18038 | 18041 | 18043 | 18045 |
| 18046 | 18049 | 18050 | 18051 | 18052 | 18054 | 18055 | 18058 | 18060 | 18063 | 18065 | 18066 |
| 18067 | 18069 | 18070 | 18071 | 18073 | 18074 | 18075 | 18076 | 18077 | 18078 | 18079 | 18080 |
| 18081 | 18082 | 18086 | 18089 | 18091 | 18094 | 18095 | 18101 | 18103 | 18106 | 18113 | 18115 |
| 18118 | 18121 | 18123 | 18128 | 18131 | 18132 | 18135 | 18136 | 18143 | 18145 | 18146 | 18147 |
| 18149 | 18150 | 18151 | 18153 | 18154 | 18156 | 18160 | 18163 | 18166 | 18167 | 18168 | 18169 |
| 18170 | 18172 | 18176 | 18178 | 18180 | 18181 | 18182 | 18184 | 18186 | 18187 | 18191 | 18192 |
| 18194 | 18195 | 18196 | 18197 | 18198 | 18199 | 18203 | 18204 | 18205 | 18206 | 18208 | 18211 |
| 18213 | 18217 | 18222 | 18226 | 18227 | 18228 | 18230 | 18232 | 18234 | 18237 | 18239 | 18241 |
| 18245 | 18249 | 18251 | 18260 | 18261 | 18264 | 18265 | 18266 | 18267 | 18269 | 18270 | 18271 |
| 18278 | 18281 | 18284 | 18286 | 18290 | 18297 | 18300 | 18301 | 18302 | 18306 | 18308 | 18309 |
| 18311 | 18313 | 18315 | 18316 | 18317 | 18320 | 18321 | 18323 | 18326 | 18330 | 18332 | 18333 |
| 18334 | 18335 | 18338 | 18345 | 18350 | 18355 | 18359 | 18361 | 18362 | 18364 | 18365 | 18367 |
| 18378 | 18379 | 18380 | 18381 | 18382 | 18383 | 18387 | 18389 | 18390 | 18391 | 18397 | 18399 |
| 18400 | 18401 | 18402 | 18405 | 18416 | 18417 | 18418 | 18421 | 18422 | 18423 | 18424 | 18426 |
| 18427 | 18430 | 18431 | 18432 | 18434 | 18435 | 18436 | 18437 | 18438 | 18442 | 18443 | 18444 |
| 18446 | 18447 | 18451 | 18452 | 18456 | 18457 | 18458 | 18459 | 18460 | 18461 | 18462 | 18464 |
| 18469 | 18473 | 18474 | 18475 | 18477 | 18478 | 18479 | 18486 | 18487 | 18488 | 18489 | 18491 |
| 18496 | 18497 | 18498 | 18499 | 18500 | 18504 | 18506 | 18507 | 18509 | 18510 | 18511 | 18514 |
| 18517 | 18522 | 18525 | 18526 | 18529 | 18532 | 18533 | 18537 | 18538 | 18540 | 18544 | 18545 |
| 18546 | 18551 | 18554 | 18555 | 18557 | 18558 | 18561 | 18562 | 18563 | 18568 | 18569 | 18571 |
| 18574 | 18577 | 18578 | 18580 | 18583 | 18592 | 18593 | 18594 | 18595 | 18597 | 18598 | 18600 |
| 18601 | 18602 | 18605 | 18606 | 18607 | 18608 | 18612 | 18613 | 18614 | 18617 | 18618 | 18620 |
| 18624 | 18625 | 18628 | 18629 | 18631 | 18632 | 18633 | 18635 | 18636 | 18637 | 18639 | 18640 |
| 18641 | 18642 | 18643 | 18644 | 18646 | 18647 | 18648 | 18649 | 18650 | 18651 | 18654 | 18655 |
| 18657 | 18660 | 18665 | 18667 | 18668 | 18671 | 18672 | 18673 | 18674 | 18676 | 18678 | 18688 |
| 18691 | 18693 | 18694 | 18695 | 18696 | 18697 | 18699 | 18705 | 18706 | 18707 | 18710 | 18711 |
| 18716 | 18718 | 18719 | 18720 | 18722 | 18724 | 18725 | 18728 | 18729 | 18731 | 18733 | 18736 |
| 18737 | 18739 | 18740 | 18741 | 18742 | 18745 | 18751 | 18752 | 18754 | 18755 | 18756 | 18759 |
| 18760 | 18761 | 18762 | 18764 | 18768 | 18769 | 18771 | 18774 | 18775 | 18779 | 18780 | 18781 |
| 18786 | 18788 | 18789 | 18791 | 18793 | 18795 | 18798 | 18801 | 18804 | 18805 | 18807 | 18808 |
| 18812 | 18814 | 18815 | 18816 | 18817 | 18819 | 18820 | 18821 | 18824 | 18828 | 18830 | 18831 |
| 18832 | 18836 | 18840 | 18844 | 18845 | 18846 | 18847 | 18848 | 18850 | 18855 | 18858 | 18859 |
| 18861 | 18862 | 18863 | 18864 | 18865 | 18866 | 18867 | 18869 | 18870 | 18871 | 18872 | 18873 |
| 18874 | 18877 | 18878 | 18882 | 18884 | 18885 | 18886 | 18887 | 18888 | 18889 | 18890 | 18893 |
| 18895 | 18897 | 18901 | 18902 | 18904 | 18905 | 18906 | 18907 | 18912 | 18914 | 18916 | 18917 |
| 18919 | 18921 | 18923 | 18925 | 18926 | 18930 | 18934 | 18935 | 18936 | 18937 | 18938 | 18941 |
| 18942 | 18943 | 18944 | 18949 | 18952 | 18953 | 18954 | 18955 | 18956 | 18957 | 18960 | 18961 |
| 18962 | 18963 | 18967 | 18970 | 18974 | 18975 | 18976 | 18978 | 18979 | 18982 | 18983 | 18989 |
| 18991 | 18996 | 18998 | 18999 | 19002 | 19007 | 19008 | 19012 | 19013 | 19015 | 19016 | 19018 |
| 19021 | 19022 | 19023 | 19026 | 19028 | 19029 | 19031 | 19034 | 19035 | 19039 | 19048 | 19054 |
| 19055 | 19057 | 19058 | 19059 | 19060 | 19063 | 19065 | 19069 | 19071 | 19073 | 19079 | 19081 |
| 19086 | 19087 | 19092 | 19095 | 19098 | 19103 | 19105 | 19109 | 19112 | 19114 | 19115 | 19116 |
| 19118 | 19119 | 19120 | 19121 | 19123 | 19128 | 19133 | 19134 | 19136 | 19137 | 19138 | 19139 |
| 19142 | 19143 | 19144 | 19148 | 19154 | 19156 | 19157 | 19158 | 19159 | 19160 | 19165 | 19172 |
| 19175 | 19177 | 19179 | 19191 | 19194 | 19195 | 19198 | 19199 | 19200 | 19201 | 19202 | 19203 |
| 19204 | 19205 | 19206 | 19208 | 19211 | 19213 | 19214 | 19216 | 19218 | 19220 | 19221 | 19224 |
| 19225 | 19229 | 19231 | 19232 | 19233 | 19235 | 19239 | 19240 | 19242 | 19243 | 19244 | 19247 |
| 19248 | 19249 | 19252 | 19257 | 19260 | 19261 | 19264 | 19265 | 19268 | 19271 | 19272 | 19274 |
| 19275 | 19276 | 19277 | 19278 | 19280 | 19281 | 19284 | 19288 | 19291 | 19294 | 19295 |
| 19300 | 19301 | 19302 | 19303 | 19305 | 19306 | 19309 | 19314 | 19315 | 19317 | 19328 | 19330 |
| 19333 | 19334 | 19336 | 19337 | 19338 | 19340 | 19343 | 19350 | 19351 | 19358 | 19359 | 19360 |
| 19363 | 19364 | 19365 | 19366 | 19371 | 19372 | 19380 | 19381 | 19385 | 19386 | 19389 | 19390 |
| 19391 | 19392 | 19394 | 19395 | 19396 | 19399 | 19402 | 19404 | 19405 | 19406 | 19407 | 19410 |
| 19411 | 19414 | 19415 | 19416 | 19420 | 19423 | 19426 | 19427 | 19428 | 19433 | 19434 | 19435 |
| 19436 | 19439 | 19440 | 19441 | 19455 | 19456 | 19457 | 19458 | 19461 | 19463 | 19464 | 19465 |
| 19467 | 19471 | 19472 | 19473 | 19474 | 19476 | 19480 | 19481 | 19482 | 19483 | 19485 | 19486 |
| 19487 | 19492 | 19493 | 19500 | 19502 | 19506 | 19508 | 19509 | 19510 | 19511 | 19512 | 19513 |
| 19516 | 19518 | 19519 | 19520 | 19521 | 19522 | 19523 | 19526 | 19531 | 19532 | 19541 | 19542 |
| 19543 | 19544 | 19547 | 19549 | 19550 | 19553 | 19557 | 19558 | 19559 | 19560 | 19563 | 19564 |
| 19569 | 19571 | 19572 | 19573 | 19575 | 19577 | 19578 | 19579 | 19580 | 19583 | 19585 | 19588 |
| 19593 | 19594 | 19595 | 19599 | 19600 | 19601 | 19602 | 19603 | 19604 | 19606 | 19608 | 19610 |
| 19611 | 19612 | 19614 | 19616 | 19617 | 19618 | 19620 | 19624 | 19627 | 19628 | 19631 | 19634 |

TABLE 19-continued

Yield: Stress Tolerance

| | | | | | | | | | | | |
|---|---|---|---|---|---|---|---|---|---|---|---|
| 19637 | 19639 | 19641 | 19642 | 19644 | 19645 | 19647 | 19653 | 19654 | 19656 | 19657 | 19659 |
| 19664 | 19665 | 19666 | 19669 | 19670 | 19671 | 19672 | 19676 | 19684 | 19686 | 19689 | 19690 |
| 19693 | 19696 | 19703 | 19704 | 19708 | 19711 | 19714 | 19716 | 19719 | 19720 | 19722 | 19724 |
| 19727 | 19728 | 19729 | 19730 | 19731 | 19732 | 19733 | 19735 | 19737 | 19739 | 19746 | 19748 |
| 19749 | 19754 | 19755 | 19759 | 19761 | 19763 | 19765 | 19766 | 19767 | 19772 | 19774 | 19776 |
| 19778 | 19779 | 19785 | 19788 | 19790 | 19791 | 19795 | 19799 | 19800 | 19802 | 19803 | 19805 |
| 19808 | 19819 | 19820 | 19821 | 19823 | 19824 | 19826 | 19829 | 19831 | 19833 | 19838 | 19839 |
| 19840 | 19841 | 19842 | 19846 | 19847 | 19850 | 19852 | 19853 | 19854 | 19855 | 19857 | 19859 |
| 19860 | 19861 | 19865 | 19868 | 19869 | 19870 | 19875 | 19877 | 19878 | 19880 | 19884 | 19885 |
| 19891 | 19892 | 19895 | 19896 | 19897 | 19902 | 19903 | 19909 | 19911 | 19914 | 19915 | 19916 |
| 19917 | 19918 | 19921 | 19922 | 19924 | 19928 | 19929 | 19930 | 19931 | 19932 | 19933 | 19935 |
| 19936 | 19937 | 19938 | 19942 | 19943 | 19945 | 19946 | 19948 | 19950 | 19954 | 19955 | 19956 |
| 19958 | 19961 | 19962 | 19964 | 19968 | 19969 | 19975 | 19977 | 19985 | 19986 | 19988 | 19990 |
| 19991 | 19994 | 20000 | 20003 | 20005 | 20006 | 20009 | 20011 | 20012 | 20013 | 20019 | 20021 |
| 20022 | 20023 | 20024 | 20025 | 20027 | 20028 | 20031 | 20032 | 20033 | 20035 | 20038 | 20042 |
| 20046 | 20048 | 20050 | 20056 | 20057 | 20058 | 20060 | 20065 | 20066 | 20067 | 20068 | 20074 |
| 20075 | 20078 | 20079 | 20084 | 20086 | 20088 | 20089 | 20103 | 20104 | 20106 | 20108 | 20111 |
| 20112 | 20113 | 20118 | 20119 | 20120 | 20122 | 20126 | 20127 | 20129 | 20130 | 20133 | 20134 |
| 20135 | 20137 | 20140 | 20141 | 20143 | 20144 | 20147 | 20148 | 20149 | 20150 | 20155 | 20157 |
| 20158 | 20162 | 20167 | 20172 | 20173 | 20174 | 20178 | 20185 | 20186 | 20192 | 20194 | 20195 |
| 20197 | 20198 | 20199 | 20201 | 20203 | 20204 | 20205 | 20207 | 20208 | 20212 | 20213 | 20214 |
| 20215 | 20216 | 20219 | 20220 | 20221 | 20223 | 20225 | 20226 | 20227 | 20229 | 20230 | 20236 |
| 20237 | 20238 | 20241 | 20242 | 20243 | 20246 | 20247 | 20248 | 20249 | 20252 | 20253 | 20255 |
| 20257 | 20259 | 20260 | 20261 | 20262 | 20263 | 20264 | 20266 | 20268 | 20269 | 20275 | 20276 |
| 20277 | 20278 | 20280 | 20282 | 20285 | 20287 | 20289 | 20291 | 20296 | 20297 | 20298 | 20299 |
| 20301 | 20304 | 20309 | 20312 | 20313 | 20314 | 20317 | 20319 | 20320 | 20321 | 20322 | 20323 |
| 20324 | 20325 | 20328 | 20332 | 20334 | 20335 | 20337 | 20342 | 20350 | 20351 | 20355 | 20356 |
| 20357 | 20358 | 20363 | 20365 | 20366 | 20368 | 20372 | 20373 | 20374 | 20375 | 20376 | 20377 |
| 20378 | 20380 | 20383 | 20384 | 20388 | 20389 | 20390 | 20392 | 20394 | 20395 | 20397 | 20400 |
| 20407 | 20408 | 20409 | 20410 | 20411 | 20412 | 20413 | 20414 | 20417 | 20418 | 20419 | 20421 |
| 20428 | 20432 | 20434 | 20435 | 20436 | 20437 | 20438 | 20439 | 20440 | 20441 | 20442 | 20443 |
| 20445 | 20446 | 20447 | 20448 | 20449 | 20450 | 20452 | 20453 | 20454 | 20455 | 20460 | 20461 |
| 20472 | 20474 | 20480 | 20484 | 20486 | 20492 | 20493 | 20494 | 20503 | 20504 | 20506 | 20507 |
| 20514 | 20515 | 20520 | 20530 | 20531 | 20535 | 20536 | 20539 | 20543 | 20546 | 20547 | 20548 |
| 20550 | 20551 | 20553 | 20554 | 20557 | 20558 | 20560 | 20562 | 20564 | 20565 | 20566 | 20568 |
| 20569 | 20570 | 20575 | 20577 | 20578 | 20580 | 20586 | 20591 | 20593 | 20597 | 20600 | 20601 |
| 20603 | 20607 | 20615 | 20619 | 20621 | 20623 | 20624 | 20625 | 20627 | 20628 | 20629 | 20630 |
| 20632 | 20633 | 20634 | 20635 | 20641 | 20643 | 20644 | 20646 | 20647 | 20648 | 20651 | 20652 |
| 20655 | 20658 | 20659 | 20660 | 20668 | 20669 | 20670 | 20675 | 20680 | 20685 | 20686 | 20687 |
| 20689 | 20694 | 20701 | 20702 | 20704 | 20706 | 20707 | 20709 | 20713 | 20714 | 20715 | 20717 |
| 20723 | 20728 | 20731 | 20733 | 20734 | 20739 | 20743 | 20744 | 20745 | 20749 | 20750 | 20755 |
| 20756 | 20757 | 20758 | 20759 | 20761 | 20765 | 20770 | 20772 | 20773 | 20774 | 20776 | 20777 |
| 20781 | 20782 | 20784 | 20786 | 20787 | 20788 | 20789 | 20795 | 20797 | 20798 | 20800 | 20801 |
| 20802 | 20805 | 20806 | 20807 | 20808 | 20809 | 20810 | 20811 | 20817 | 20819 | 20820 | 20827 |
| 20828 | 20829 | 20830 | 20832 | 20833 | 20834 | 20835 | 20836 | 20840 | 20847 | 20848 | 20852 |
| 20853 | 20854 | 20859 | 20860 | 20861 | 20862 | 20863 | 20865 | 20869 | 20870 | 20871 | 20873 |
| 20877 | 20878 | 20880 | 20881 | 20882 | 20885 | 20886 | 20891 | 20892 | 20893 | 20894 | 20895 |
| 20902 | 20904 | 20905 | 20907 | 20908 | 20909 | 20910 | 20913 | 20915 | 20918 | 20919 | 20921 |
| 20922 | 20923 | 20929 | 20930 | 20933 | 20935 | 20937 | 20940 | 20941 | 20942 | 20946 | 20947 |
| 20949 | 20950 | 20952 | 20955 | 20956 | 20957 | 20962 | 20964 | 20965 | 20966 | 20967 | 20969 |
| 20972 | 20974 | 20975 | 20978 | 20979 | 20982 | 20983 | 20984 | 20987 | 20988 | 20989 | 20990 |
| 20991 | 20992 | 20993 | 20995 | 20997 | 21002 | 21003 | 21004 | 21007 | 21008 | 21009 | 21011 |
| 21012 | 21013 | 21014 | 21020 | 21023 | 21032 | 21037 | 21039 | 21040 | 21041 | 21042 | 21043 |
| 21047 | 21050 | 21051 | 21052 | 21055 | 21058 | 21059 | 21060 | 21065 | 21067 | 21068 | 21069 |
| 21073 | 21075 | 21077 | 21080 | 21081 | 21085 | 21088 | 21089 | 21091 | 21092 | 21095 | 21096 |
| 21098 | 21103 | 21105 | 21108 | 21109 | 21110 | 21111 | 21112 | 21113 | 21115 | 21116 | 21117 |
| 21118 | 21119 | 21122 | 21123 | 21124 | 21128 | 21129 | 21130 | 21136 | 21137 | 21140 | 21141 |
| 21143 | 21144 | 21147 | 21149 | 21150 | 21151 | 21153 | 21161 | 21163 | 21164 | 21165 | 21167 |
| 21170 | 21173 | 21176 | 21177 | 21178 | 21179 | 21185 | 21186 | 21188 | 21195 | 21196 | 21198 |
| 21199 | 21200 | 21202 | 21203 | 21204 | 21206 | 21208 | 21209 | 21210 | 21213 | 21219 | 21220 |
| 21224 | 21226 | 21227 | 21228 | 21229 | 21231 | 21233 | 21235 | 21238 | 21240 | 21243 | 21244 |
| 21245 | 21249 | 21250 | 21251 | 21260 | 21263 | 21264 | 21265 | 21266 | 21270 | 21271 | 21272 |
| 21275 | 21276 | 21277 | 21280 | 21281 | 21282 | 21283 | 21284 | 21285 | 21287 | 21290 | 21291 |
| 21296 | 21300 | 21304 | 21306 | 21308 | 21309 | 21313 | 21314 | 21316 | 21321 | 21323 | 21324 |
| 21328 | 21330 | 21331 | 21332 | 21333 | 21335 | 21340 | 21341 | 21342 | 21343 | 21344 | 21345 |
| 21346 | 21347 | 21348 | 21351 | 21353 | 21354 | 21356 | 21357 | 21359 | 21363 | 21364 | 21365 |
| 21366 | 21367 | 21368 | 21369 | 21371 | 21372 | 21373 | 21378 | 21379 | 21381 | 21383 | 21384 |
| 21386 | 21387 | 21389 | 21390 | 21392 | 21393 | 21394 | 21395 | 21396 | 21398 | 21402 | 21404 |
| 21405 | 21406 | 21409 | 21410 | 21411 | 21414 | 21415 | 21416 | 21418 | 21419 | 21422 | 21423 |
| 21424 | 21425 | 21428 | 21430 | 21432 | 21433 | 21434 | 21435 | 21436 | 21439 | 21441 | 21442 |
| 21443 | 21445 | 21446 | 21447 | 21448 | 21455 | 21456 | 21457 | 21462 | 21463 | 21464 | 21465 |
| 21466 | 21472 | 21473 | 21475 | 21476 | 21478 | 21479 | 21480 | 21481 | 21484 | 21486 | 21488 |
| 21491 | 21492 | 21494 | 21495 | 21496 | 21497 | 21498 | 21499 | 21502 | 21504 | 21505 | 21506 |
| 21507 | 21509 | 21510 | 21511 | 21513 | 21514 | 21515 | 21522 | 21526 | 21527 | 21528 | 21538 |
| 21541 | 21543 | 21545 | 21547 | 21549 | 21552 | 21555 | 21556 | 21557 | 21558 | 21559 | 21561 |
| 21565 | 21566 | 21567 | 21574 | 21578 | 21580 | 21583 | 21585 | 21586 | 21587 | 21588 | 21589 |
| 21590 | 21591 | 21592 | 21593 | 21598 | 21600 | 21602 | 21607 | 21608 | 21611 | 21612 | 21615 |

TABLE 19-continued

Yield: Stress Tolerance

| | | | | | | | | | | | |
|---|---|---|---|---|---|---|---|---|---|---|---|
| 21616 | 21622 | 21623 | 21624 | 21629 | 21631 | 21637 | 21639 | 21640 | 21643 | 21645 | 21647 |
| 21649 | 21652 | 21653 | 21654 | 21655 | 21656 | 21660 | 21664 | 21666 | 21668 | 21670 | 21673 |
| 21677 | 21679 | 21680 | 21682 | 21683 | 21684 | 21689 | 21690 | 21691 | 21692 | 21693 | 21694 |
| 21696 | 21698 | 21699 | 21701 | 21702 | 21703 | 21704 | 21711 | 21712 | 21722 | 21724 | 21726 |
| 21728 | 21729 | 21731 | 21741 | 21745 | 21746 | 21747 | 21750 | 21751 | 21753 | 21756 | 21757 |
| 21758 | 21760 | 21763 | 21765 | 21770 | 21771 | 21772 | 21777 | 21778 | 21779 | 21780 | 21781 |
| 21788 | 21790 | 21791 | 21792 | 21794 | 21795 | 21796 | 21797 | 21801 | 21802 | 21803 | 21809 |
| 21810 | 21811 | 21812 | 21813 | 21814 | 21815 | 21816 | 21817 | 21818 | 21819 | 21821 | 21822 |
| 21823 | 21824 | 21825 | 21827 | 21832 | 21836 | 21837 | 21838 | 21839 | 21840 | 21841 | 21842 |
| 21844 | 21845 | 21847 | 21848 | 21850 | 21851 | 21853 | 21854 | 21858 | 21859 | 21865 | 21866 |
| 21867 | 21869 | 21873 | 21875 | 21876 | 21878 | 21882 | 21883 | 21885 | 21887 | 21889 | 21890 |
| 21891 | 21896 | 21897 | 21900 | 21902 | 21905 | 21910 | 21911 | 21912 | 21915 | 21916 | 21917 |
| 21918 | 21919 | 21921 | 21926 | 21929 | 21930 | 21934 | 21937 | 21938 | 21940 | 21942 | 21943 |
| 21945 | 21948 | 21949 | 21950 | 21953 | 21954 | 21956 | 21958 | 21959 | 21960 | 21961 | 21962 |
| 21964 | 21965 | 21969 | 21971 | 21973 | 21974 | 21975 | 21980 | 21981 | 21982 | 21983 | 21984 |
| 21985 | 21986 | 21987 | 21988 | 21989 | 21999 | 22000 | 22006 | 22007 | 22009 | 22010 | 22011 |
| 22012 | 22013 | 22015 | 22016 | 22019 | 22020 | 22021 | 22022 | 22024 | 22027 | 22030 | 22031 |
| 22033 | 22034 | 22038 | 22039 | 22040 | 22041 | 22043 | 22044 | 22045 | 22046 | 22047 | 22048 |
| 22049 | 22050 | 22053 | 22054 | 22056 | 22058 | 22060 | 22063 | 22066 | 22067 | 22071 | 22072 |
| 22075 | 22076 | 22078 | 22081 | 22082 | 22083 | 22088 | 22090 | 22093 | 22094 | 22096 | 22098 |
| 22101 | 22104 | 22107 | 22108 | 22109 | 22110 | 22114 | 22116 | 22120 | 22124 | 22125 | 22126 |
| 22127 | 22128 | 22133 | 22135 | 22137 | 22138 | 22139 | 22140 | 22141 | 22143 | 22144 | 22145 |
| 22146 | 22147 | 22148 | 22150 | 22151 | 22153 | 22154 | 22155 | 22156 | 22158 | 22160 | 22161 |
| 22164 | 22165 | 22166 | 22167 | 22168 | 22170 | 22171 | 22174 | 22175 | 22176 | 22177 | 22181 |
| 22183 | 22184 | 22185 | 22186 | 22187 | 22190 | 22191 | 22192 | 22193 | 22195 | 22198 | 22200 |
| 22201 | 22204 | 22205 | 22206 | 22207 | 22210 | 22214 | 22216 | 22217 | 22218 | 22220 | 22221 |
| 22224 | 22225 | 22226 | 22227 | 22228 | 22232 | 22233 | 22235 | 22237 | 22239 | 22240 | 22243 |
| 22244 | 22246 | 22249 | 22251 | 22252 | 22253 | 22255 | 22257 | 22264 | 22265 | 22266 | 22268 |
| 22269 | 22270 | 22271 | 22272 | 22277 | 22279 | 22280 | 22281 | 22282 | 22283 | 22284 | 22289 |
| 22291 | 22293 | 22294 | 22295 | 22296 | 22298 | 22299 | 22300 | 22301 | 22302 | 22303 | 22306 |
| 22308 | 22310 | 22313 | 22314 | 22315 | 22316 | 22319 | 22320 | 22325 | 22332 | 22333 | 22335 |
| 22336 | 22340 | 22341 | 22342 | 22346 | 22350 | 22351 | 22352 | 22353 | 22354 | 22357 | 22359 |
| 22360 | 22362 | 22364 | 22365 | 22366 | 22367 | 22368 | 22369 | 22370 | 22371 | 22372 | 22373 |
| 22375 | 22376 | 22378 | 22379 | 22380 | 22382 | 22384 | 22386 | 22387 | 22390 | 22391 | 22392 |
| 22393 | 22394 | 22396 | 22398 | 22399 | 22400 | 22401 | 22402 | 22405 | 22406 | 22407 | 22409 |
| 22410 | 22413 | 22415 | 22416 | 22417 | 22420 | 22424 | 22425 | 22427 | 22428 | 22430 | 22432 |
| 22433 | 22436 | 22438 | 22439 | 22443 | 22444 | 22446 | 22452 | 22454 | 22458 | 22459 | 22460 |
| 22461 | 22463 | 22468 | 22471 | 22472 | 22480 | 22482 | 22484 | 22487 | 22490 | 22492 | 22494 |
| 22495 | 22496 | 22497 | 22498 | 22499 | 22500 | 22501 | 22502 | 22503 | 22507 | 22509 | 22510 |
| 22511 | 22512 | 22515 | 22517 | 22520 | 22522 | 22525 | 22528 | 22533 | 22536 | 22537 | 22538 |
| 22540 | 22543 | 22544 | 22545 | 22547 | 22548 | 22550 | 22551 | 22554 | 22558 | 22564 | 22565 |
| 22568 | 22569 | 22570 | 22571 | 22573 | 22575 | 22577 | 22578 | 22579 | 22581 | 22582 | 22583 |
| 22584 | 22585 | 22588 | 22590 | 22591 | 22592 | 22593 | 22594 | 22595 | 22596 | 22597 | 22601 |
| 22605 | 22606 | 22607 | 22609 | 22610 | 22611 | 22612 | 22613 | 22616 | 22617 | 22620 | 22621 |
| 22622 | 22624 | 22625 | 22626 | 22628 | 22630 | 22631 | 22632 | 22634 | 22638 | 22641 | 22642 |
| 22646 | 22649 | 22652 | 22653 | 22654 | 22660 | 22667 | 22669 | 22672 | 22674 | 22675 | 22680 |
| 22683 | 22685 | 22687 | 22691 | 22693 | 22694 | 22696 | 22698 | 22701 | 22702 | 22703 | 22704 |
| 22705 | 22706 | 22707 | 22708 | 22712 | 22713 | 22722 | 22725 | 22726 | 22727 | 22728 | 22730 |
| 22732 | 22733 | 22737 | 22739 | 22740 | 22741 | 22742 | 22743 | 22744 | 22746 | 22748 | 22750 |
| 22752 | 22753 | 22754 | 22755 | 22757 | 22759 | 22760 | 22762 | 22763 | 22764 | 22765 | 22767 |
| 22768 | 22769 | 22771 | 22772 | 22775 | 22776 | 22777 | 22780 | 22781 | 22782 | 22786 | 22788 |
| 22789 | 22790 | 22791 | 22794 | 22798 | 22799 | 22801 | 22802 | 22804 | 22806 | 22807 | 22808 |
| 22809 | 22810 | 22811 | 22813 | 22815 | 22817 | 22821 | 22823 | 22825 | 22828 | 22831 | 22832 |
| 22834 | 22835 | 22838 | 22839 | 22840 | 22843 | 22844 | 22846 | 22848 | 22854 | 22859 | 22862 |
| 22863 | 22864 | 22865 | 22868 | 22870 | 22872 | 22873 | 22875 | 22878 | 22881 | 22885 | 22886 |
| 22890 | 22891 | 22894 | 22895 | 22897 | 22898 | 22900 | 22901 | 22903 | 22905 | 22906 | |
| 22907 | 22910 | 22911 | 22912 | 22913 | 22920 | 22921 | 22922 | 22924 | 22925 | 22927 | 22928 |
| 22930 | 22931 | 22933 | 22935 | 22936 | 22939 | 22946 | 22948 | 22953 | 22955 | 22956 | 22957 |
| 22958 | 22962 | 22964 | 22966 | 22968 | 22971 | 22972 | 22980 | 22982 | 22983 | 22986 | 22987 |
| 22989 | 22992 | 22995 | 22996 | 22997 | 22999 | 23000 | 23001 | 23003 | 23004 | 23005 | 23007 |
| 23008 | 23011 | 23013 | 23015 | 23025 | 23026 | 23028 | 23029 | 23030 | 23033 | 23037 | 23038 |
| 23044 | 23049 | 23051 | 23052 | 23054 | 23059 | 23060 | 23062 | 23063 | 23065 | 23067 | 23068 |
| 23071 | 23073 | 23075 | 23079 | 23080 | 23083 | 23087 | 23089 | 23090 | 23095 | 23097 | 23100 |
| 23101 | 23107 | 23108 | 23110 | 23111 | 23113 | 23115 | 23116 | 23117 | 23119 | 23120 | 23121 |
| 23124 | 23125 | 23126 | 23127 | 23135 | 23141 | 23142 | 23145 | 23146 | 23147 | 23148 | 23155 |
| 23157 | 23158 | 23162 | 23163 | 23166 | 23167 | 23176 | 23179 | 23180 | 23181 | 23182 | 23183 |
| 23185 | 23188 | 23198 | 23201 | 23202 | 23205 | 23207 | 23214 | 23217 | 23219 | 23220 | 23221 |
| 23222 | 23223 | 23226 | 23227 | 23230 | 23233 | 23236 | 23240 | 23241 | 23243 | 23245 | 23246 |
| 23247 | 23254 | 23255 | 23256 | 23259 | 23261 | 23263 | 23265 | 23270 | 23271 | 23272 | 23276 |
| 23281 | 23283 | 23286 | 23290 | 23292 | 23294 | 23295 | 23297 | 23298 | 23302 | 23304 | 23306 |
| 23312 | 23313 | 23316 | 23322 | 23324 | 23326 | 23329 | 23330 | 23331 | 23332 | 23334 | 23338 |
| 23343 | 23344 | 23349 | 23350 | 23352 | 23355 | 23358 | 23359 | 23360 | 23363 | 23364 | 23365 |
| 23366 | 23370 | 23371 | 23372 | 23376 | 23380 | 23381 | 23383 | 23384 | 23385 | 23391 | 23392 |
| 23394 | 23395 | 23397 | 23398 | 23401 | 23402 | 23403 | 23405 | 23407 | 23413 | 23414 | 23415 |
| 23423 | 23425 | 23426 | 23427 | 23429 | 23430 | 23434 | 23436 | 23440 | 23441 | 23446 | 23448 |
| 23449 | 23450 | 23452 | 23453 | 23457 | 23459 | 23463 | 23464 | 23465 | 23467 | 23468 | 23469 |
| 23470 | 23474 | 23479 | 23480 | 23484 | 23487 | 23488 | 23489 | 23491 | 23497 | 23498 | 23500 |

TABLE 19-continued

| Yield: Stress Tolerance | | | | | | | | | | | |
|---|---|---|---|---|---|---|---|---|---|---|---|
| 23502 | 23503 | 23505 | 23511 | 23512 | 23514 | 23515 | 23516 | 23520 | 23524 | 23526 | 23529 |
| 23531 | 23532 | 23534 | 23535 | 23536 | 23538 | 23539 | 23540 | 23546 | 23549 | 23550 | 23551 |
| 23552 | 23553 | 23560 | 23562 | 23565 | 23567 | 23568 | 23575 | 23582 | 23583 | 23584 | 23590 |
| 23591 | 23592 | 23595 | 23598 | 23601 | 23602 | 23604 | 23607 | 23610 | 23612 | 23613 | 23614 |
| 23615 | 23617 | 23618 | 23619 | 23622 | 23623 | 23625 | 23631 | 23634 | 23638 | 23640 | 23645 |
| 23647 | 23648 | 23649 | 23650 | 23651 | 23652 | 23653 | 23656 | 23658 | 23659 | 23662 | 23664 |
| 23666 | 23667 | 23668 | 23669 | 23671 | 23673 | 23674 | 23675 | 23676 | 23678 | 23681 | 23684 |
| 23686 | | | | | | | | | | | |

Table 19B SEQ ID NOs of Polynucleotides useful for improving Yield: Stress Tolerance

| | | | | | | | | | | | |
|---|---|---|---|---|---|---|---|---|---|---|---|
| 23690 | 23691 | 23693 | 23695 | 23698 | 23699 | 23701 | 23702 | 23703 | 23704 | 23706 | 23709 |
| 23713 | 23715 | 23716 | 23718 | 23723 | 23726 | 23727 | 23728 | 23729 | 23730 | 23733 | 23735 |
| 23738 | 23739 | 23741 | 23742 | 23743 | 23745 | 23746 | 23750 | 23754 | 23756 | 23758 | 23759 |
| 23760 | 23765 | 23767 | 23768 | 23771 | 23775 | 23776 | 23777 | 23778 | 23779 | 23783 | 23784 |
| 23786 | 23787 | 23790 | 23793 | 23794 | 23796 | 23802 | 23804 | 23805 | 23807 | 23808 | 23809 |
| 23815 | 23817 | 23824 | 23831 | 23832 | 23833 | 23834 | 23837 | 23838 | 23840 | 23841 | 23842 |
| 23843 | 23844 | 23846 | 23848 | 23849 | 23851 | 23857 | 23858 | 23859 | 23861 | 23864 | 23865 |
| 23869 | 23871 | 23872 | 23873 | 23877 | 23878 | 23881 | 23882 | 23883 | 23885 | 23887 | 23890 |
| 23891 | 23899 | 23904 | 23905 | 23908 | 23911 | 23917 | 23919 | 23920 | 23921 | 23922 | 23925 |
| 23927 | 23934 | 23937 | 23939 | 23941 | 23942 | 23944 | 23945 | 23947 | 23952 | 23953 | 23954 |
| 23959 | 23961 | 23962 | 23967 | 23969 | 23970 | 23972 | 23975 | 23980 | 23981 | 23982 | 23983 |
| 23986 | 23988 | 23992 | 23994 | 23997 | 24003 | 24004 | 24005 | 24006 | 24007 | 24008 | 24016 |
| 24018 | 24019 | 24025 | 24026 | 24028 | 24029 | 24030 | 24031 | 24033 | 24036 | 24037 | 24039 |
| 24041 | 24043 | 24044 | 24045 | 24046 | 24047 | 24050 | 24053 | 24055 | 24056 | 24059 | 24061 |
| 24065 | 24066 | 24067 | 24068 | 24069 | 24070 | 24074 | 24076 | 24078 | 24080 | 24082 | 24083 |
| 24086 | 24087 | 24088 | 24089 | 24090 | 24091 | 24092 | 24095 | 24096 | 24099 | 24103 | 24105 |
| 24108 | 24109 | 24110 | 24112 | 24113 | 24116 | 24121 | 24122 | 24123 | 24124 | 24127 | 24130 |
| 24133 | 24136 | 24137 | 24138 | 24140 | 24141 | 24143 | 24145 | 24146 | 24149 | 24153 | 24154 |
| 24155 | 24157 | 24158 | 24159 | 24160 | 24164 | 24166 | 24167 | 24169 | 24171 | 24173 | 24174 |
| 24178 | 24185 | 24187 | 24188 | 24189 | 24192 | 24193 | 24195 | 24197 | 24198 | 24202 | 24203 |
| 24204 | 24205 | 24206 | 24207 | 24208 | 24209 | 24210 | 24212 | 24213 | 24214 | 24223 | 24224 |
| 24226 | 24227 | 24228 | 24230 | 24231 | 24234 | 24235 | 24236 | 24237 | 24238 | 24242 | 24243 |
| 24247 | 24251 | 24255 | 24256 | 24257 | 24258 | 24262 | 24263 | 24269 | 24272 | 24274 | 24276 |
| 24277 | 24280 | 24283 | 24286 | 24288 | 24293 | 24296 | 24301 | 24303 | 24310 | 24311 | 24318 |
| 24322 | 24323 | 24330 | 24333 | 24335 | 24336 | 24337 | 24340 | 24342 | 24343 | 24346 | 24347 |
| 24351 | 24352 | 24353 | 24354 | 24355 | 24358 | 24359 | 24360 | 24362 | 24365 | 24367 | 24368 |
| 24369 | 24371 | 24372 | 24375 | 24378 | 24379 | 24380 | 24382 | 24383 | 24392 | 24393 | 24395 |
| 24396 | 24399 | 24402 | 24404 | 24406 | 24407 | 24412 | 24413 | 24414 | 24419 | 24422 | 24423 |
| 24425 | 24426 | 24427 | 24428 | 24431 | 24433 | 24437 | 24438 | 24441 | 24443 | 24444 | 24447 |
| 24448 | 24451 | 24453 | 24457 | 24458 | 24459 | 24460 | 24461 | 24463 | 24465 | 24466 | 24469 |
| 24471 | 24474 | 24475 | 24478 | 24490 | 24491 | 24500 | 24501 | 24502 | 24503 | 24505 | 24507 |
| 24509 | 24510 | 24511 | 24522 | 24523 | 24524 | 24531 | 24535 | 24536 | 24539 | 24540 | 24541 |
| 24543 | 24544 | 24546 | 24549 | 24555 | 24557 | 24558 | 24559 | 24565 | 24572 | 24577 | 24580 |
| 24582 | 24583 | 24584 | 24589 | 24590 | 24591 | 24593 | 24596 | 24597 | 24599 | 24600 | 24601 |
| 24602 | 24603 | 24607 | 24610 | 24614 | 24617 | 24618 | 24621 | 24624 | 24630 | 24641 | 24642 |
| 24643 | 24644 | 24646 | 24651 | 24656 | 24660 | 24662 | 24663 | 24664 | 24666 | 24667 | 24670 |
| 24672 | 24675 | 24676 | 24677 | 24680 | 24682 | 24683 | 24684 | 24685 | 24689 | 24693 | 24697 |
| 24701 | 24702 | 24703 | 24706 | 24708 | 24709 | 24710 | 24711 | 24712 | 24713 | 24717 | 24718 |
| 24720 | 24721 | 24722 | 24723 | 24726 | 24727 | 24728 | 24734 | 24735 | 24737 | 24741 | 24742 |
| 24744 | 24745 | 24746 | 24747 | 24748 | 24749 | 24750 | 24752 | 24754 | 24755 | 24756 | 24757 |
| 24759 | 24760 | 24762 | 24764 | 24765 | 24769 | 24770 | 24771 | 24773 | 24775 | 24781 | 24782 |
| 24787 | 24788 | 24789 | 24792 | 24793 | 24795 | 24797 | 24798 | 24801 | 24806 | 24807 | |
| 24808 | 24810 | 24813 | 24815 | 24817 | 24818 | 24819 | 24822 | 24825 | 24826 | 24827 | 24828 |
| 24830 | 24831 | 24832 | 24834 | 24835 | 24836 | 24839 | 24842 | 24843 | 24844 | 24846 | 24848 |
| 24849 | 24854 | 24855 | 24860 | 24861 | 24862 | 24863 | 24865 | 24866 | 24868 | 24869 | 24870 |
| 24871 | 24872 | 24873 | 24874 | 24875 | 24877 | 24878 | 24879 | 24880 | 24883 | 24885 | 24886 |
| 24887 | 24888 | 24889 | 24892 | 24894 | 24896 | 24898 | 24901 | 24904 | 24905 | 24908 | 24909 |
| 24913 | 24915 | 24916 | 24922 | 24924 | 24926 | 24928 | 24930 | 24932 | 24933 | 24934 | 24937 |
| 24939 | 24940 | 24941 | 24942 | 24943 | 24944 | 24945 | 24948 | 24949 | 24953 | 24955 | 24956 |
| 24958 | 24963 | 24971 | 24972 | 24976 | 24977 | 24978 | 24979 | 24984 | 24986 | 24987 | 24989 |
| 24994 | 24995 | 24996 | 24997 | 24998 | 24999 | 25000 | 25002 | 25005 | 25006 | 25010 | 25011 |
| 25012 | 25014 | 25015 | 25017 | 25018 | 25020 | 25023 | 25024 | 25031 | 25032 | 25033 | 25034 |
| 25035 | 25036 | 25045 | 25052 | 25059 | 25062 | 25064 | 25075 | 25078 | 25081 | 25083 | 25089 |
| 25090 | 25091 | 25093 | 25095 | 25096 | 25102 | 25103 | 25104 | 25106 | 25108 | 25109 | 25111 |
| 25112 | 25114 | 25115 | 25118 | 25120 | 25121 | 25124 | 25125 | 25126 | 25133 | 25134 | 25135 |
| 25136 | 25137 | 25138 | 25145 | 25146 | 25147 | 25148 | 25149 | 25151 | 25157 | 25158 | 25160 |
| 25162 | 25163 | 25164 | 25166 | 25167 | 25168 | 25169 | 25170 | 25173 | 25174 | 25175 | 25177 |
| 25180 | 25182 | 25183 | 25184 | 25186 | 25189 | 25190 | 25191 | 25192 | 25193 | 25194 | 25197 |
| 25201 | 25204 | 25207 | 25208 | 25210 | 25214 | 25216 | 25218 | 25219 | 25222 | 25230 | 25233 |
| 25235 | 25237 | 25238 | 25239 | 25243 | 25246 | 25247 | 25251 | 25252 | 25253 | 25254 | 25255 |
| 25258 | 25259 | 25261 | 25263 | 25265 | 25266 | 25268 | 25270 | 25272 | 25277 | 25278 | 25280 |
| 25282 | 25284 | 25287 | 25288 | 25289 | 25291 | 25293 | 25294 | 25295 | 25298 | 25299 | 25300 |
| 25301 | 25302 | 25304 | 25306 | 25308 | 25309 | 25312 | 25313 | 25314 | 25315 | 25317 | 25318 |
| 25319 | 25321 | 25323 | 25324 | 25328 | 25337 | 25340 | 25341 | 25344 | 25346 | 25347 | 25349 |
| 25350 | 25351 | 25354 | 25355 | 25358 | 25360 | 25361 | 25362 | 25366 | 25367 | 25368 | 25370 |
| 25372 | 25373 | 25374 | 25376 | 25378 | 25379 | 25382 | 25383 | 25384 | 25385 | 25386 | 25387 |
| 25389 | 25390 | 25391 | 25393 | 25396 | 25397 | 25399 | 25400 | 25402 | 25403 | 25404 | 25405 |

TABLE 19-continued

Yield: Stress Tolerance

| | | | | | | | | | | | |
|---|---|---|---|---|---|---|---|---|---|---|---|
| 25408 | 25409 | 25411 | 25412 | 25413 | 25414 | 25415 | 25417 | 25418 | 25420 | 25425 | 25427 |
| 25429 | 25434 | 25435 | 25436 | 25437 | 25439 | 25441 | 25442 | 25447 | 25449 | 25451 | 25452 |
| 25453 | 25454 | 25455 | 25458 | 25460 | 25461 | 25462 | 25463 | 25465 | 25466 | 25467 | 25472 |
| 25473 | 25474 | 25475 | 25479 | 25480 | 25482 | 25483 | 25484 | 25485 | 25486 | 25487 | 25488 |
| 25490 | 25491 | 25495 | 25496 | 25497 | 25501 | 25503 | 25504 | 25506 | 25507 | 25508 | 25509 |
| 25512 | 25514 | 25515 | 25516 | 25517 | 25518 | 25519 | 25520 | 25521 | 25522 | 25523 | 25524 |
| 25528 | 25529 | 25533 | 25535 | 25536 | 25538 | 25539 | 25540 | 25542 | 25549 | 25550 | 25551 |
| 25554 | 25555 | 25557 | 25561 | 25563 | 25564 | 25565 | 25567 | 25569 | 25572 | 25573 | 25575 |
| 25577 | 25578 | 25581 | 25582 | 25583 | 25584 | 25586 | 25589 | 25590 | 25593 | 25595 | 25596 |
| 25601 | 25603 | 25609 | 25610 | 25611 | 25614 | 25615 | 25617 | 25618 | 25621 | 25622 | 25623 |
| 25625 | 25627 | 25628 | 25630 | 25631 | 25632 | 25636 | 25637 | 25638 | 25639 | 25640 | 25642 |
| 25650 | 25651 | 25653 | 25654 | 25655 | 25656 | 25657 | 25658 | 25661 | 25664 | 25665 | 25666 |
| 25672 | 25673 | 25676 | 25678 | 25681 | 25684 | 25686 | 25687 | 25688 | 25689 | 25690 | 25691 |
| 25692 | 25693 | 25694 | 25695 | 25697 | 25699 | 25701 | 25703 | 25704 | 25705 | 25706 | 25707 |
| 25708 | 25710 | 25711 | 25712 | 25715 | 25716 | 25719 | 25721 | 25723 | 25726 | 25727 | 25728 |
| 25729 | 25731 | 25733 | 25734 | 25735 | 25736 | 25737 | 25738 | 25740 | 25744 | 25745 | 25746 |
| 25752 | 25756 | 25762 | 25763 | 25764 | 25765 | 25767 | 25771 | 25772 | 25774 | 25775 | 25776 |
| 25777 | 25778 | 25779 | 25781 | 25783 | 25784 | 25785 | 25787 | 25789 | 25790 | 25791 | 25792 |
| 25793 | 25794 | 25795 | 25799 | 25805 | 25806 | 25808 | 25811 | 25812 | 25813 | 25814 | 25815 |
| 25818 | 25819 | 25820 | 25821 | 25824 | 25826 | 25827 | 25830 | 25831 | 25833 | 25834 | 25835 |
| 25837 | 25838 | 25841 | 25843 | 25844 | 25845 | 25846 | 25848 | 25849 | 25850 | 25851 | 25856 |
| 25858 | 25859 | 25860 | 25861 | 25862 | 25863 | 25864 | 25866 | 25867 | 25868 | 25869 | 25870 |
| 25871 | 25873 | 25874 | 25875 | 25879 | 25881 | 25882 | 25885 | 25886 | 25887 | 25888 | 25889 |
| 25890 | 25891 | 25892 | 25893 | 25895 | 25897 | 25898 | 25899 | 25900 | 25901 | 25903 | 25905 |
| 25907 | 25909 | 25913 | 25915 | 25917 | 25918 | 25919 | 25920 | 25922 | 25923 | 25924 | 25925 |
| 25927 | 25928 | 25934 | 25935 | 25937 | 25939 | 25940 | 25941 | 25946 | 25950 | 25951 | 25952 |
| 25957 | 25958 | 25959 | 25960 | 25961 | 25963 | 25964 | 25965 | 25967 | 25969 | 25972 | 25973 |
| 25974 | 25975 | 25976 | 25977 | 25978 | 25979 | 25980 | 25981 | 25984 | 25985 | 25986 | 25987 |
| 25989 | 25990 | 25993 | 25994 | 25997 | 25999 | 26000 | 26002 | 26003 | 26004 | 26008 | 26009 |
| 26010 | 26018 | 26019 | 26020 | 26021 | 26023 | 26025 | 26026 | 26028 | 26030 | 26032 | 26033 |
| 26036 | 26038 | 26039 | 26041 | 26043 | 26044 | 26047 | 26049 | 26050 | 26052 | 26053 | 26054 |
| 26055 | 26057 | 26058 | 26060 | 26061 | 26063 | 26064 | 26065 | 26067 | 26068 | 26070 | 26072 |
| 26073 | 26075 | 26076 | 26077 | 26080 | 26081 | 26082 | 26084 | 26091 | 26092 | 26093 | 26098 |
| 26100 | 26101 | 26102 | 26106 | 26107 | 26108 | 26109 | 26110 | 26111 | 26112 | 26113 | 26116 |
| 26117 | 26118 | 26119 | 26120 | 26121 | 26123 | 26124 | 26126 | 26127 | 26128 | 26129 | 26130 |
| 26131 | 26132 | 26134 | 26135 | 26137 | 26138 | 26141 | 26142 | 26144 | 26145 | 26147 | 26149 |
| 26150 | 26151 | 26153 | 26159 | 26161 | 26164 | 26165 | 26167 | 26170 | 26172 | 26173 | 26177 |
| 26178 | 26179 | 26182 | 26184 | 26185 | 26186 | 26187 | 26190 | 26191 | 26193 | 26195 | 26197 |
| 26200 | 26201 | 26203 | 26204 | 26205 | 26206 | 26208 | 26209 | 26212 | 26214 | 26215 |
| 26216 | 26217 | 26220 | 26221 | 26224 | 26227 | 26235 | 26236 | 26239 | 26248 | 26252 | 26253 |
| 26254 | 26255 | 26257 | 26258 | 26259 | 26261 | 26263 | 26264 | 26266 | 26268 | 26273 | 26275 |
| 26276 | 26284 | 26286 | 26287 | 26288 | 26289 | 26291 | 26295 | 26297 | 26299 | 26300 | 26301 |
| 26303 | 26304 | 26309 | 26310 | 26312 | 26313 | 26315 | 26319 | 26321 | 26325 | 26328 | 26329 |
| 26333 | 26335 | 26337 | 26338 | 26339 | 26340 | 26342 | 26343 | 26344 | 26346 | 26348 | 26349 |
| 26350 | 26354 | 26356 | 26357 | 26358 | 26361 | 26365 | 26369 | 26370 | 26373 | 26374 | 26375 |
| 26377 | 26378 | 26379 | 26384 | 26386 | 26388 | 26391 | 26392 | 26393 | 26394 | 26395 | 26397 |
| 26401 | 26405 | 26407 | 26410 | 26416 | 26418 | 26420 | 26423 | 26428 | 26429 | 26430 | 26431 |
| 26433 | 26434 | 26437 | 26439 | 26441 | 26442 | 26446 | 26450 | 26452 | 26454 | 26455 | 26460 |
| 26463 | 26466 | 26468 | 26471 | 26472 | 26473 | 26475 | 26480 | 26485 | 26487 | 26491 | 26492 |
| 26495 | 26500 | 26501 | 26502 | 26503 | 26505 | 26506 | 26508 | 26513 | 26514 | 26515 | 26516 |
| 26517 | 26518 | 26520 | 26523 | 26524 | 26526 | 26527 | 26528 | 26530 | 26531 | 26532 | 26533 |
| 26534 | 26537 | 26538 | 26540 | 26542 | 26547 | 26548 | 26551 | 26554 | 26555 | 26556 | 26558 |
| 26559 | 26562 | 26564 | 26565 | 26568 | 26569 | 26571 | 26574 | 26575 | 26580 | 26581 | 26582 |
| 26583 | 26585 | 26587 | 26591 | 26592 | 26594 | 26603 | 26604 | 26605 | 26606 | 26608 | 26614 |
| 26616 | 26623 | 26624 | 26626 | 26632 | 26633 | 26634 | 26635 | 26638 | 26642 | 26643 | 26644 |
| 26645 | 26646 | 26647 | 26651 | 26652 | 26656 | 26669 | 26671 | 26674 | 26675 | 26681 |
| 26684 | 26685 | 26686 | 26687 | 26692 | 26693 | 26694 | 26698 | 26699 | 26701 | 26705 | 26706 |
| 26709 | 26716 | 26718 | 26722 | 26730 | 26731 | 26733 | 26734 | 26735 | 26738 | 26739 | 26742 |
| 26744 | 26746 | 26747 | 26748 | 26749 | 26750 | 26753 | 26756 | 26757 | 26758 | 26759 | 26760 |
| 26762 | 26764 | 26765 | 26768 | 26769 | 26770 | 26772 | 26774 | 26777 | 26778 | 26780 |
| 26781 | 26782 | 26787 | 26788 | 26793 | 26795 | 26796 | 26797 | 26799 | 26800 | 26811 | 26813 |
| 26814 | 26815 | 26818 | 26823 | 26824 | 26825 | 26826 | 26828 | 26830 | 26831 | 26833 | 26834 |
| 26835 | 26841 | 26842 | 26843 | 26845 | 26846 | 26847 | 26850 | 26852 | 26855 | 26857 | 26859 |
| 26862 | 26864 | 26866 | 26867 | 26871 | 26873 | 26875 | 26877 | 26880 | 26882 | 26883 | 26885 |
| 26887 | 26888 | 26889 | 26890 | 26891 | 26892 | 26893 | 26894 | 26895 | 26898 | 26906 | 26907 |
| 26911 | 26914 | 26915 | 26918 | 26921 | 26923 | 26925 | 26927 | 26928 | 26929 | 26932 | 26936 |
| 26940 | 26941 | 26942 | 26945 | 26946 | 26948 | 26949 | 26950 | 26952 | 26953 | 26954 | 26956 |
| 26958 | 26961 | 26962 | 26965 | 26967 | 26968 | 26969 | 26970 | 26972 | 26974 | 26975 | 26976 |
| 26977 | 26978 | 26979 | 26984 | 26987 | 26989 | 26990 | 26992 | 26993 | 26996 | 26997 | 26998 |
| 26999 | 27000 | 27002 | 27005 | 27006 | 27007 | 27008 | 27009 | 27011 | 27016 | 27018 | 27019 |
| 27020 | 27021 | 27024 | 27026 | 27027 | 27029 | 27030 | 27032 | 27033 | 27034 | 27037 | 27043 |
| 27044 | 27046 | 27048 | 27049 | 27050 | 27051 | 27052 | 27053 | 27058 | 27060 | 27062 | 27063 |
| 27065 | 27067 | 27068 | 27069 | 27070 | 27071 | 27076 | 27077 | 27078 | 27079 | 27082 | 27083 |
| 27087 | 27088 | 27089 | 27092 | 27094 | 27100 | 27102 | 27103 | 27106 | 27107 | 27108 | 27113 |
| 27114 | 27116 | 27119 | 27121 | 27123 | 27124 | 27125 | 27127 | 27129 | 27130 | 27131 | 27133 |
| 27134 | 27137 | 27139 | 27140 | 27144 | 27145 | 27147 | 27148 | 27150 | 27151 | 27155 | 27156 |
| 27157 | 27158 | 27160 | 27164 | 27166 | 27168 | 27169 | 27170 | 27172 | 27173 | 27174 | 27175 |

TABLE 19-continued

Yield: Stress Tolerance

| | | | | | | | | | | | |
|---|---|---|---|---|---|---|---|---|---|---|---|
| 27178 | 27180 | 27183 | 27185 | 27189 | 27190 | 27191 | 27192 | 27193 | 27195 | 27197 | 27199 |
| 27200 | 27201 | 27204 | 27205 | 27208 | 27209 | 27210 | 27211 | 27212 | 27213 | 27216 | 27217 |
| 27219 | 27220 | 27221 | 27222 | 27225 | 27226 | 27227 | 27229 | 27232 | 27234 | 27235 | 27236 |
| 27237 | 27239 | 27240 | 27241 | 27242 | 27244 | 27246 | 27247 | 27249 | 27250 | 27255 | 27256 |
| 27257 | 27260 | 27261 | 27262 | 27268 | 27276 | 27277 | 27278 | 27279 | 27281 | 27282 | 27283 |
| 27284 | 27285 | 27289 | 27290 | 27294 | 27295 | 27296 | 27300 | 27308 | 27315 | 27316 | 27317 |
| 27319 | 27322 | 27323 | 27327 | 27329 | 27331 | 27332 | 27337 | 27341 | 27342 | 27343 | 27345 |
| 27346 | 27347 | 27348 | 27349 | 27350 | 27353 | 27356 | 27357 | 27359 | 27360 | 27368 | 27369 |
| 27370 | 27374 | 27375 | 27376 | 27377 | 27378 | 27379 | 27380 | 27382 | 27383 | 27384 | 27387 |
| 27390 | 27391 | 27392 | 27393 | 27395 | 27401 | 27402 | 27405 | 27406 | 27407 | 27408 | 27409 |
| 27410 | 27411 | 27413 | 27414 | 27415 | 27417 | 27418 | 27420 | 27421 | 27422 | 27423 | 27424 |
| 27425 | 27426 | 27427 | 27428 | 27429 | 27431 | 27434 | 27436 | 27438 | 27439 | 27441 | 27442 |
| 27444 | 27445 | 27446 | 27447 | 27452 | 27456 | 27458 | 27460 | 27462 | 27463 | 27464 | 27467 |
| 27468 | 27471 | 27473 | 27474 | 27477 | 27480 | 27481 | 27483 | 27484 | 27486 | 27488 | 27491 |
| 27493 | 27495 | 27496 | 27500 | 27503 | 27504 | 27505 | 27506 | 27507 | 27508 | 27512 | 27513 |
| 27514 | 27520 | 27525 | 27526 | 27527 | 27529 | 27530 | 27531 | 27532 | 27533 | 27534 | 27535 |
| 27538 | 27539 | 27541 | 27542 | 27543 | 27544 | 27546 | 27547 | 27548 | 27551 | 27552 | 27556 |
| 27562 | 27564 | 27565 | 27567 | 27570 | 27572 | 27575 | 27576 | 27578 | 27579 | 27580 | 27583 |
| 27584 | 27585 | 27586 | 27587 | 27588 | 27589 | 27592 | 27593 | 27601 | 27602 | 27604 | 27606 |
| 27607 | 27610 | 27611 | 27614 | 27615 | 27617 | 27618 | 27619 | 27623 | 27624 | 27625 | 27626 |
| 27627 | 27631 | 27633 | 27634 | 27637 | 27641 | 27642 | 27643 | 27644 | 27645 | 27646 | 27647 |
| 27653 | 27655 | 27661 | 27663 | 27664 | 27665 | 27667 | 27668 | 27669 | 27670 | 27672 | 27674 |
| 27678 | 27681 | 27682 | 27683 | 27684 | 27686 | 27689 | 27693 | 27694 | 27695 | 27696 | 27699 |
| 27700 | 27701 | 27703 | 27707 | 27708 | 27710 | 27711 | 27712 | 27715 | 27716 | 27717 | 27718 |
| 27721 | 27725 | 27727 | 27728 | 27731 | 27732 | 27734 | 27736 | 27739 | 27741 | 27743 | 27744 |
| 27745 | 27746 | 27747 | 27750 | 27751 | 27752 | 27754 | 27755 | 27757 | 27760 | 27762 | 27763 |
| 27765 | 27766 | 27769 | 27772 | 27775 | 27777 | 27778 | 27779 | 27780 | 27781 | 27782 | 27783 |
| 27785 | 27787 | 27788 | 27790 | 27791 | 27792 | 27793 | 27794 | 27797 | 27799 | 27800 | 27803 |
| 27804 | 27805 | 27807 | 27808 | 27809 | 27810 | 27811 | 27812 | 27814 | 27819 | 27820 | 27822 |
| 27826 | 27827 | 27829 | 27832 | 27833 | 27836 | 27837 | 27838 | 27839 | 27840 | 27841 | 27844 |
| 27845 | 27846 | 27847 | 27850 | 27855 | 27856 | 27857 | 27858 | 27859 | 27861 | 27863 | 27864 |
| 27865 | 27866 | 27869 | 27872 | 27874 | 27876 | 27880 | 27882 | 27884 | 27885 | 27887 | 27888 |
| 27889 | 27890 | 27892 | 27894 | 27895 | 27903 | 27904 | 27906 | 27910 | 27911 | 27912 | 27915 |
| 27917 | 27920 | 27921 | 27922 | 27926 | 27927 | 27929 | 27930 | 27932 | 27938 | 27939 | 27940 |
| 27941 | 27942 | 27943 | 27947 | 27948 | 27954 | 27955 | 27959 | 27964 | 27967 | 27969 | 27970 |
| 27972 | 27975 | 27977 | 27978 | 27980 | 27981 | 27982 | 27984 | 27988 | 27989 | 27997 | 27998 |
| 27999 | 28000 | 28001 | 28003 | 28004 | 28007 | 28011 | 28013 | 28014 | 28015 | 28017 | 28021 |
| 28022 | 28029 | 28032 | 28033 | 28034 | 28043 | 28046 | 28047 | 28049 | 28050 | 28053 | 28059 |
| 28060 | 28068 | 28072 | 28073 | 28075 | 28077 | 28078 | 28080 | 28081 | 28082 | 28085 | 28088 |
| 28089 | 28092 | 28098 | 28102 | 28103 | 28106 | 28110 | 28113 | 28116 | 28118 | 28120 | 28121 |
| 28123 | 28126 | 28127 | 28129 | 28130 | 28131 | 28132 | 28135 | 28136 | 28137 | 28140 | 28142 |
| 28145 | 28151 | 28153 | 28155 | 28156 | 28157 | 28159 | 28163 | 28165 | 28167 | 28169 | 28174 |
| 28175 | 28176 | 28177 | 28178 | 28180 | 28181 | 28183 | 28189 | 28184 | 28189 | 28192 | 28193 |
| 28194 | 28196 | 28200 | 28201 | 28202 | 28206 | 28208 | 28209 | 28210 | 28212 | 28216 | 28220 |
| 28224 | 28227 | 28229 | 28235 | 28238 | 28239 | 28240 | 28241 | 28242 | 28244 | 28246 | 28247 |
| 28249 | 28251 | 28253 | 28255 | 28256 | 28258 | 28261 | 28262 | 28266 | 28267 | 28269 | 28270 |
| 28272 | 28274 | 28280 | 28282 | 28283 | 28284 | 28285 | 28286 | 28290 | 28295 | 28296 | 28298 |
| 28301 | 28302 | 28304 | 28305 | 28306 | 28307 | 28308 | 28309 | 28313 | 28314 | 28318 | 28321 |
| 28322 | 28323 | 28329 | 28336 | 28337 | 28339 | 28341 | 28342 | 28344 | 28347 | 28348 | 28349 |
| 28351 | 28352 | 28353 | 28357 | 28363 | 28368 | 28370 | 28372 | 28373 | 28378 | 28380 | 28382 |
| 28385 | 28388 | 28389 | 28392 | 28395 | 28396 | 28397 | 28398 | 28400 | 28403 | 28405 | 28408 |
| 28410 | 28411 | 28414 | 28415 | 28416 | 28424 | 28427 | 28428 | 28430 | 28435 | 28438 | 28443 |
| 28446 | 28447 | 28449 | 28450 | 28451 | 28452 | 28456 | 28458 | 28461 | 28465 | 28468 | 28470 |
| 28471 | 28472 | 28473 | 28474 | 28478 | 28480 | 28488 | 28492 | 28493 | 28494 | 28495 | 28497 |
| 28498 | 28499 | 28500 | 28502 | 28503 | 28505 | 28506 | 28507 | 28511 | 28513 | 28516 | 28520 |
| 28524 | 28532 | 28533 | 28536 | 28537 | 28538 | 28539 | 28548 | 28551 | 28552 | 28553 |
| 28556 | 28561 | 28563 | 28566 | 28567 | 28569 | 28571 | 28572 | 28573 | 28575 | 28578 | 28580 |
| 28581 | 28582 | 28584 | 28585 | 28586 | 28588 | 28594 | 28595 | 28598 | 28599 | 28601 | 28603 |
| 28604 | 28607 | 28609 | 28610 | 28612 | 28613 | 28614 | 28622 | 28623 | 28624 | 28625 | 28626 |
| 28629 | 28631 | 28633 | 28634 | 28640 | 28641 | 28643 | 28648 | 28649 | 28650 | 28652 | 28653 |
| 28655 | 28658 | 28660 | 28664 | 28665 | 28666 | 28669 | 28670 | 28671 | 28672 | 28673 | 28675 |
| 28677 | 28678 | 28679 | 28680 | 28682 | 28683 | 28684 | 28687 | 28688 | 28689 | 28690 | 28692 |
| 28694 | 28695 | 28696 | 28697 | 28698 | 28699 | 28700 | 28703 | 28704 | 28709 | 28710 | 28711 |
| 28712 | 28713 | 28715 | 28716 | 28717 | 28718 | 28719 | 28720 | 28722 | 28723 | 28724 | 28725 |
| 28726 | 28727 | 28728 | 28729 | 28731 | 28732 | 28733 | 28736 | 28737 | 28738 | 28739 | 28741 |
| 28742 | 28743 | 28744 | 28745 | 28746 | 28747 | 28748 | 28750 | 28751 | 28752 | 28753 | 28754 |
| 28755 | 28762 | 28763 | 28764 | 28766 | 28771 | 28772 | 28773 | 28774 | 28775 | 28776 | 28778 |
| 28779 | 28780 | 28783 | 28784 | 28786 | 28787 | 28791 | 28792 | 28794 | 28795 | 28799 | 28801 |
| 28802 | 28803 | 28804 | 28805 | 28806 | 28808 | 28809 | 28812 | 28814 | 28818 | 28819 | 28820 |
| 28821 | 28824 | 28825 | 28826 | 28827 | 28828 | 28829 | 28830 | 28831 | 28832 | 28834 | 28835 |
| 28836 | 28837 | 28838 | 28840 | 28841 | 28843 | 28844 | 28845 | 28846 | 28851 | 28852 | 28853 |
| 28854 | 28855 | 28856 | 28859 | 28860 | 28861 | 28862 | 28865 | 28867 | 28868 | 28869 |
| 28870 | 28871 | 28873 | 28874 | 28875 | 28876 | 28881 | 28882 | 28883 | 28884 | 28886 | 28887 |
| 28888 | 28890 | 28891 | 28892 | 28893 | 28895 | 28897 | 28898 | 28899 | 28901 | 28902 | 28903 |
| 28904 | 28905 | 28906 | 28907 | 28908 | 28909 | 28910 | 28911 | 28913 | 28914 | 28917 | 28918 |
| 28919 | 28920 | 28921 | 28922 | 28923 | 28924 | 28925 | 28926 | 28927 | 28928 | 28929 | 28930 |
| 28934 | 28935 | 28936 | 28937 | 28938 | 28939 | 28941 | 28942 | 28943 | 28944 | 28949 | 28954 |

TABLE 19-continued

Yield: Stress Tolerance

| | | | | | | | | | | | |
|---|---|---|---|---|---|---|---|---|---|---|---|
| 28958 | 28959 | 28960 | 28961 | 28962 | 28963 | 28965 | 28966 | 28967 | 28972 | 28974 | 28975 |
| 28976 | 28977 | 28978 | 28981 | 28982 | 28985 | 28986 | 28988 | 28991 | 28992 | 28993 | 28996 |
| 28997 | 28998 | 28999 | 29002 | 29004 | 29006 | 29007 | 29011 | 29012 | 29014 | 29015 | 29025 |
| 29026 | 29034 | 29043 | 29046 | 29049 | 29050 | 29051 | 29052 | 29054 | 29055 | 29056 | 29059 |
| 29060 | 29062 | 29067 | 29068 | 29069 | 29070 | 29071 | 29072 | 29073 | 29074 | 29075 | 29076 |
| 29078 | 29079 | 29080 | 29081 | 29082 | 29083 | 29084 | 29086 | 29088 | 29095 | 29096 | 29097 |
| 29099 | 29100 | 29101 | 29102 | 29104 | 29105 | 29108 | 29109 | 29110 | 29111 | 29112 | 29113 |
| 29115 | 29117 | 29118 | 29119 | 29124 | 29126 | 29127 | 29128 | 29129 | 29130 | 29132 | 29135 |
| 29136 | 29137 | 29138 | 29140 | 29141 | 29143 | 29149 | 29150 | 29151 | 29153 | 29154 | 29155 |
| 29156 | 29158 | 29159 | 29160 | 29162 | 29163 | 29164 | 29166 | 29167 | 29168 | 29170 | 29171 |
| 29172 | 29173 | 29174 | 29175 | 29176 | 29178 | 29179 | 29180 | 29181 | 29183 | 29185 | 29186 |
| 29187 | 29188 | 29189 | 29190 | 29191 | 29195 | 29196 | 29199 | 29200 | 29201 | 29203 | 29204 |
| 29205 | 29214 | 29215 | 29220 | 29221 | 29227 | 29228 | 29229 | 29231 | 29234 | 29237 | 29238 |
| 29239 | 29240 | 29241 | 29242 | 29243 | 29244 | 29246 | 29247 | 29248 | 29249 | 29251 | 29252 |
| 29253 | 29254 | 29255 | 29256 | 29257 | 29259 | 29260 | 29265 | 29267 | 29268 | 29275 | 29276 |
| 29278 | 29279 | 29280 | 29281 | 29282 | 29285 | 29288 | 29290 | 29291 | 29292 | 29293 | 29295 |
| 29296 | 29297 | 29299 | 29300 | 29301 | 29302 | 29303 | 29304 | 29305 | 29306 | 29309 | 29310 |
| 29311 | 29314 | 29315 | 29316 | 29317 | 29319 | 29320 | 29321 | 29322 | 29323 | 29324 | 29325 |
| 29327 | 29328 | 29330 | 29331 | 29332 | 29333 | 29334 | 29337 | 29338 | 29340 | 29341 | 29342 |
| 29345 | 29346 | 29347 | 29348 | 29349 | 29350 | 29352 | 29353 | 29354 | 29355 | 29356 | 29357 |
| 29360 | 29361 | 29362 | 29364 | 29365 | 29366 | 29368 | 29370 | 29371 | 29372 | 29373 | 29374 |
| 29375 | 29376 | 29377 | 29379 | 29380 | 29381 | 29382 | 29385 | 29386 | 29387 | 29389 | 29390 |
| 29391 | 29394 | 29395 | 29396 | 29397 | 29399 | 29400 | 29401 | 29403 | 29404 | 29405 | 29409 |
| 29410 | 29411 | 29413 | 29414 | 29415 | 29416 | 29417 | 29418 | 29419 | 29421 | 29423 | 29426 |
| 29427 | 29429 | 29430 | 29432 | 29434 | 29435 | 29436 | 29437 | 29438 | 29441 | 29442 | 29444 |
| 29446 | 29448 | 29449 | 29450 | 29451 | 29452 | 29453 | 29455 | 29456 | 29459 | 29464 | 29465 |
| 29466 | 29467 | 29469 | 29471 | 29472 | 29473 | 29474 | 29476 | 29477 | 29478 | 29479 | 29481 |
| 29482 | 29483 | 29484 | 29485 | 29489 | 29490 | 29491 | 29492 | 29493 | 29494 | 29497 | 29498 |
| 29499 | 29500 | 29501 | 29502 | 29503 | 29505 | 29506 | 29507 | 29508 | 29510 | 29511 | 29513 |
| 29514 | 29515 | 29516 | 29517 | 29519 | 29520 | 29521 | 29522 | 29524 | 29525 | 29526 | 29528 |
| 29529 | 29530 | 29532 | 29535 | 29536 | 29538 | 29539 | 29540 | 29541 | 29542 | 29543 | 29544 |
| 29545 | 29547 | 29549 | 29550 | 29553 | 29558 | 29559 | 29560 | 29564 | 29565 | 29566 | 29567 |
| 29569 | 29570 | 29572 | 29575 | 29576 | 29577 | 29579 | 29580 | 29581 | 29582 | 29583 | 29585 |
| 29586 | 29587 | 29588 | 29589 | 29590 | 29591 | 29592 | 29593 | 29594 | 29595 | 29596 | 29598 |
| 29599 | 29601 | 29602 | 29603 | 29604 | 29605 | 29606 | 29607 | 29608 | 29614 | 29617 | 29622 |
| 29623 | 29624 | 29626 | 29627 | 29628 | 29629 | 29631 | 29632 | 29634 | 29635 | 29637 | 29638 |
| 29639 | 29640 | 29641 | 29642 | 29643 | 29644 | 29646 | 29648 | 29649 | 29651 | 29653 | 29655 |
| 29656 | 29657 | 29658 | 29660 | 29661 | 29662 | 29663 | 29664 | 29667 | 29668 | 29670 | 29671 |
| 29672 | 29673 | 29674 | 29675 | 29676 | 29677 | 29678 | 29680 | 29682 | 29683 | 29684 | 29687 |
| 29688 | 29689 | 29690 | 29694 | 29696 | 29698 | 29699 | 29704 | 29706 | 29707 | 29711 | 29713 |
| 29714 | 29715 | 29716 | 29717 | 29718 | 29722 | 29723 | 29724 | 29725 | 29726 | 29727 | 29728 |
| 29729 | 29730 | 29732 | 29734 | 29735 | 29736 | 29737 | 29738 | 29739 | 29740 | 29742 | 29744 |
| 29746 | 29747 | 29748 | 29749 | 29750 | 29751 | 29752 | 29754 | 29757 | 29758 | 29759 | 29760 |
| 29761 | 29762 | 29765 | 29767 | 29768 | 29769 | 29770 | 29771 | 29772 | 29773 | 29774 | 29776 |
| 29777 | 29778 | 29782 | 29783 | 29784 | 29786 | 29787 | 29788 | 29789 | 29790 | 29791 | 29796 |
| 29797 | 29798 | 29802 | 29803 | 29804 | 29805 | 29806 | 29808 | 29809 | 29810 | 29811 | 29812 |
| 29813 | 29814 | 29815 | 29819 | 29822 | 29823 | 29824 | 29825 | 29826 | 29827 | 29830 | 29831 |
| 29832 | 29833 | 29835 | 29836 | 29838 | 29839 | 29842 | 29843 | 29845 | 29846 | 29847 | 29848 |
| 29849 | 29850 | 29851 | 29852 | 29854 | 29855 | 29856 | 29857 | 29858 | 29859 | 29860 | 29861 |
| 29863 | 29864 | 29865 | 29866 | 29867 | 29869 | 29870 | 29871 | 29873 | 29874 | 29875 | 29876 |
| 29880 | 29881 | 29883 | 29884 | 29886 | 29887 | 29889 | 29890 | 29891 | 29892 | 29895 | 29896 |
| 29897 | 29898 | 29900 | 29902 | 29903 | 29904 | 29905 | 29906 | 29907 | 29908 | 29909 | 29910 |
| 29912 | 29913 | 29914 | 29915 | 29916 | 29917 | 29918 | 29920 | 29922 | 29923 | 29924 | 29925 |
| 29927 | 29928 | 29932 | 29933 | 29935 | 29936 | 29937 | 29942 | 29943 | 29947 | 29948 | 29950 |
| 29951 | 29952 | 29953 | 29954 | 29955 | 29958 | 29960 | 29961 | 29962 | 29963 | 29964 | 29965 |
| 29966 | 29967 | 29968 | 29969 | 29970 | 29971 | 29974 | 29975 | 29976 | 29977 | 29984 | 29986 |
| 29987 | 29989 | 29991 | 29992 | 29993 | 29994 | 29995 | 29996 | 29997 | 29998 | 29999 | 30000 |
| 30001 | 30006 | 30007 | 30008 | 30009 | 30010 | 30016 | 30018 | 30019 | 30020 | 30022 | 30025 |
| 30026 | 30027 | 30028 | 30030 | 30031 | 30032 | 30034 | 30041 | 30047 | 30048 | 30055 | 30057 |
| 30058 | 30059 | 30060 | 30061 | 30062 | 30063 | 30064 | 30067 | 30068 | 30070 | 30073 | |
| 30076 | 30079 | 30080 | 30081 | 30083 | 30084 | 30088 | 30093 | 30094 | 30095 | 30096 | 30098 |
| 30099 | 30100 | 30101 | 30102 | 30105 | 30106 | 30107 | 30108 | 30113 | 30115 | 30116 | 30117 |
| 30118 | 30120 | 30121 | 30122 | 30125 | 30126 | 30129 | 30130 | 30131 | 30132 | 30133 | 30134 |
| 30135 | 30136 | 30141 | 30142 | 30143 | 30144 | 30145 | 30148 | 30149 | 30150 | 30151 | 30152 |
| 30154 | 30155 | 30156 | 30157 | 30158 | 30159 | 30160 | 30163 | 30166 | 30167 | 30168 | 30169 |
| 30170 | 30171 | 30172 | 30173 | 30174 | 30175 | 30178 | 30179 | 30180 | 30181 | 30182 | 30183 |
| 30187 | 30196 | 30197 | 30198 | 30201 | 30202 | 30205 | 30207 | 30208 | 30211 | 30215 | 30216 |
| 30218 | 30219 | 30222 | 30223 | 30224 | 30227 | 30228 | 30231 | 30232 | 30233 | 30234 | 30236 |
| 30239 | 30240 | 30241 | 30242 | 30243 | 30244 | 30245 | 30246 | 30248 | 30249 | 30250 | 30252 |
| 30253 | 30255 | 30256 | 30257 | 30258 | 30259 | 30263 | 30264 | 30265 | 30266 | 30267 | 30271 |
| 30272 | 30273 | 30282 | 30283 | 30284 | 30286 | 30289 | 30290 | 30292 | 30293 | 30294 | 30295 |
| 30299 | 30300 | 30301 | 30302 | 30304 | 30305 | 30311 | 30312 | 30313 | 30314 | 30315 | 30317 |
| 30319 | 30320 | 30321 | 30322 | 30323 | 30324 | 30325 | 30329 | 30331 | 30337 | 30338 | 30339 |
| 30340 | 30341 | 30353 | 30354 | 30356 | 30357 | 30360 | 30361 | 30364 | 30369 | 30372 | 30373 |
| 30375 | 30379 | 30383 | 30384 | 30385 | 30386 | 30388 | 30389 | 30390 | 30393 | 30394 | 30396 |
| 30397 | 30398 | 30399 | 30400 | 30403 | 30406 | 30408 | 30409 | 30410 | 30412 | 30413 | 30415 |
| 30417 | 30418 | 30421 | 30422 | 30425 | 30426 | 30427 | 30428 | 30429 | 30433 | 30434 | 30435 |

TABLE 19-continued

Yield: Stress Tolerance

| | | | | | | | | | | | |
|---|---|---|---|---|---|---|---|---|---|---|---|
| 30436 | 30437 | 30440 | 30441 | 30442 | 30443 | 30444 | 30445 | 30446 | 30448 | 30449 | 30450 |
| 30451 | 30452 | 30454 | 30455 | 30456 | 30457 | 30458 | 30459 | 30460 | 30461 | 30462 | 30463 |
| 30467 | 30468 | 30469 | 30470 | 30471 | 30472 | 30473 | 30474 | 30476 | 30477 | 30478 | 30479 |
| 30481 | 30482 | 30484 | 30487 | 30488 | 30490 | 30491 | 30492 | 30493 | 30494 | 30495 | 30498 |
| 30499 | 30500 | 30502 | 30503 | 30504 | 30505 | 30506 | 30507 | 30508 | 30509 | 30510 | 30511 |
| 30512 | 30513 | 30514 | 30515 | 30516 | 30518 | 30520 | 30521 | 30522 | 30523 | 30524 | 30525 |
| 30526 | 30528 | 30530 | 30532 | 30534 | 30535 | 30536 | 30538 | 30539 | 30540 | 30541 | 30543 |
| 30544 | 30545 | 30546 | 30547 | 30548 | 30549 | 30550 | 30551 | 30553 | 30554 | 30555 | 30557 |
| 30558 | 30559 | 30563 | 30564 | 30565 | 30566 | 30567 | 30570 | 30572 | 30574 | 30576 | 30577 |
| 30578 | 30579 | 30581 | 30582 | 30583 | 30584 | 30585 | 30586 | 30587 | 30588 | 30589 | 30590 |
| 30591 | 30593 | 30598 | 30601 | 30602 | 30603 | 30607 | 30608 | 30609 | 30610 | 30614 | 30615 |
| 30616 | 30617 | 30618 | 30620 | 30621 | 30622 | 30623 | 30624 | 30625 | 30626 | 30627 | 30628 |
| 30631 | 30633 | 30634 | 30635 | 30636 | 30637 | 30638 | 30639 | 30640 | 30641 | 30642 | 30643 |
| 30644 | 30645 | 30648 | 30652 | 30656 | 30657 | 30660 | 30661 | 30662 | 30663 | 30664 | 30667 |
| 30671 | 30672 | 30675 | 30676 | 30678 | 30679 | 30681 | 30683 | 30684 | 30685 | 30686 | 30687 |
| 30688 | 30694 | 30695 | 30696 | 30697 | 30699 | 30700 | 30701 | 30702 | 30706 | 30707 | 30708 |
| 30709 | 30713 | 30714 | 30719 | 30722 | 30724 | 30725 | 30727 | 30731 | 30733 | 30734 | 30736 |
| 30737 | 30738 | 30740 | 30744 | 30745 | 30753 | 30754 | 30755 | 30756 | 30757 | 30759 | 30760 |
| 30763 | 30767 | 30769 | 30770 | 30771 | 30773 | 30777 | 30778 | 30784 | 30787 | 30788 | 30789 |
| 30797 | 30800 | 30801 | 30803 | 30804 | 30807 | 30813 | 30814 | 30822 | 30823 | 30827 | 30828 |
| 30830 | 30832 | 30833 | 30835 | 30836 | 30837 | 30840 | 30843 | 30844 | 30848 | 30854 | 30858 |
| 30859 | 30862 | 30867 | 30868 | 30871 | 30874 | 30876 | 30878 | 30879 | 30882 | 30885 | 30886 |
| 30888 | 30889 | 30890 | 30891 | 30894 | 30895 | 30896 | 30897 | 30900 | 30902 | 30905 | 30911 |
| 30913 | 30915 | 30916 | 30917 | 30919 | 30922 | 30924 | 30926 | 30928 | 30933 | 30934 | 30935 |
| 30936 | 30937 | 30939 | 30940 | 30942 | 30943 | 30947 | 30948 | 30950 | 30951 | 30952 | 30953 |
| 30954 | 30958 | 30959 | 30960 | 30961 | 30965 | 30967 | 30968 | 30969 | 30978 | 30982 | 30985 |
| 30987 | 30993 | 30995 | 30996 | 30997 | 30998 | 30999 | 31001 | 31003 | 31005 | 31007 | 31012 |
| 31013 | 31015 | 31018 | 31019 | 31023 | 31024 | 31026 | 31027 | 31029 | 31031 | 31037 | 31039 |
| 31040 | 31041 | 31042 | 31043 | 31047 | 31052 | 31053 | 31055 | 31058 | 31059 | 31061 | 31062 |
| 31063 | 31064 | 31065 | 31066 | 31067 | 31071 | 31072 | 31076 | 31079 | 31080 | 31081 | 31087 |
| 31094 | 31095 | 31097 | 31099 | 31100 | 31102 | 31106 | 31107 | 31108 | 31110 | 31111 | 31112 |
| 31116 | 31119 | 31122 | 31127 | 31129 | 31131 | 31132 | 31137 | 31138 | 31139 | 31140 | 31143 |
| 31146 | 31147 | 31150 | 31151 | 31154 | 31155 | 31156 | 31158 | 31160 | 31162 | 31164 | 31167 |
| 31169 | 31170 | 31173 | 31174 | 31175 | 31183 | 31186 | 31187 | 31190 | 31195 | 31197 | 31202 |
| 31205 | 31206 | 31208 | 31210 | 31211 | 31212 | 31216 | 31218 | 31221 | 31225 | 31228 | 31230 |
| 31231 | 31232 | 31233 | 31234 | 31238 | 31240 | 31247 | 31251 | 31252 | 31253 | 31254 | 31256 |
| 31257 | 31258 | 31259 | 31261 | 31262 | 31264 | 31265 | 31266 | 31270 | 31272 | 31275 | 31279 |
| 31283 | 31284 | 31291 | 31292 | 31295 | 31296 | 31297 | 31298 | 31300 | 31307 | 31310 | 31311 |
| 31312 | 31316 | 31321 | 31325 | 31327 | 31329 | 31330 | 31331 | 31333 | 31336 | 31338 | 31339 |
| 31340 | 31342 | 31343 | 31344 | 31346 | 31352 | 31353 | 31356 | 31357 | 31359 | 31361 | 31362 |
| 31365 | 31367 | 31370 | 31371 | 31372 | 31380 | 31381 | 31382 | 31383 | 31384 | 31387 | 31389 |
| 31391 | 31392 | 31398 | 31399 | 31401 | 31406 | 31407 | 31408 | 31410 | 31411 | 31413 | 31415 |
| 31418 | 31422 | 31423 | 31424 | 31426 | 31429 | 31430 | 31433 | 31436 | 31437 | 31443 | 31444 |
| 31451 | 31454 | 31457 | 31458 | 31459 | 31460 | 31461 | 31463 | 31464 | 31469 | 31471 | 31472 |
| 31476 | 31477 | 31478 | 31479 | 31481 | 31482 | 31488 | 31489 | 31490 | 31492 | 31494 | 31495 |
| 31496 | 31497 | 31499 | 31500 | 31502 | 31503 | 31506 | 31507 | 31509 | 31510 | 31513 | 31523 |
| 31524 | 31526 | 31527 | 31528 | 31529 | 31533 | 31537 | 31539 | 31543 | 31545 | 31547 | 31548 |
| 31549 | 31552 | 31556 | 31558 | 31559 | 31560 | 31565 | 31567 | 31572 | 31573 | 31577 | 31578 |
| 31579 | 31581 | 31582 | 31583 | 31587 | 31589 | 31590 | 31592 | 31597 | 31598 | 31599 | 31600 |
| 31604 | 31605 | 31607 | 31608 | 31609 | 31610 | 31611 | 31613 | 31620 | 31625 | 31626 | 31628 |
| 31631 | 31638 | 31640 | 31641 | 31642 | 31645 | 31647 | 31648 | 31651 | 31652 | 31658 | 31664 |
| 31665 | 31666 | 31667 | 31670 | 31674 | 31676 | 31680 | 31683 | 31684 | 31688 | 31693 | 31694 |
| 31696 | 31697 | 31698 | 31699 | 31701 | 31702 | 31706 | 31707 | 31710 | 31711 | 31715 | 31720 |
| 31722 | 31726 | 31727 | 31728 | 31730 | 31731 | 31734 | 31737 | 31738 | 31741 | 31744 | 31747 |
| 31748 | 31749 | 31750 | 31751 | 31753 | 31757 | 31759 | 31761 | 31762 | 31763 | 31764 | 31766 |
| 31767 | 31768 | 31769 | 31770 | 31771 | 31776 | 31780 | 31781 | 31786 | 31787 | 31788 | 31789 |
| 31790 | 31791 | 31792 | 31793 | 31795 | 31798 | 31799 | 31801 | 31802 | 31803 | 31817 | 31819 |
| 31820 | 31821 | 31822 | 31823 | 31824 | 31827 | 31828 | 31829 | 31830 | 31832 | 31837 | 31840 |
| 31841 | 31844 | 31846 | 31848 | 31849 | 31855 | 31858 | 31859 | 31861 | 31862 | 31863 | 31865 |
| 31878 | 31879 | 31880 | 31881 | 31882 | 31893 | 31894 | 31897 | 31901 | 31904 | 31905 |
| 31906 | 31907 | 31911 | 31912 | 31913 | 31916 | 31918 | 31926 | 31928 | 31930 | 31932 | 31935 |
| 31936 | 31942 | 31943 | 31944 | 31946 | 31948 | 31949 | 31950 | 31952 | 31953 | 31957 | 31962 |
| 31963 | 31964 | 31967 | 31971 | 31972 | 31975 | 31977 | 31978 | 31979 | 31983 | 31984 | 31985 |
| 31987 | 31990 | 31991 | 31996 | 31999 | 32000 | 32001 | 32002 | 32003 | 32004 | 32006 | 32007 |
| 32009 | 32010 | 32011 | 32014 | 32015 | 32016 | 32018 | 32020 | 32029 | 32032 | 32037 | 32038 |
| 32039 | 32040 | 32045 | 32048 | 32049 | 32050 | 32056 | 32060 | 32061 | 32062 | 32066 | 32067 |
| 32075 | 32076 | 32077 | 32080 | 32082 | 32086 | 32091 | 32093 | 32097 | 32099 | 32101 | 32103 |
| 32108 | 32110 | 32114 | 32115 | 32116 | 32120 | 32123 | 32124 | 32133 | 32136 | 32138 | 32141 |
| 32144 | 32146 | 32147 | 32148 | 32152 | 32158 | 32161 | 32162 | 32163 | 32166 | 32169 | 32171 |
| 32172 | 32174 | 32175 | 32176 | 32180 | 32182 | 32183 | 32186 | 32188 | 32189 | 32190 | 32193 |
| 32198 | 32200 | 32206 | 32207 | 32217 | 32218 | 32222 | 32224 | 32226 | 32227 | 32228 | 32229 |
| 32232 | 32235 | 32236 | 32238 | 32241 | 32242 | 32247 | 32249 | 32251 | 32252 | 32254 | 32263 |
| 32265 | 32266 | 32267 | 32268 | 32269 | 32273 | 32275 | 32276 | 32277 | 32279 | 32281 | 32282 |
| 32283 | 32284 | 32285 | 32286 | 32288 | 32289 | 32291 | 32293 | 32296 | 32297 | 32298 | 32299 |
| 32300 | 32304 | 32307 | 32310 | 32312 | 32313 | 32315 | 32316 | 32318 | 32319 | 32326 | 32328 |
| 32329 | 32330 | 32331 | 32333 | 32337 | 32339 | 32344 | 32348 | 32349 | 32350 | 32354 | 32355 |
| 32359 | 32363 | 32365 | 32367 | 32370 | 32371 | 32372 | 32374 | 32375 | 32376 | 32377 | 32378 |

TABLE 19-continued

Yield: Stress Tolerance

| | | | | | | | | | | | |
|---|---|---|---|---|---|---|---|---|---|---|---|
| 32379 | 32381 | 32382 | 32385 | 32386 | 32389 | 32390 | 32394 | 32396 | 32397 | 32399 | 32401 |
| 32410 | 32416 | 32422 | 32423 | 32424 | 32426 | 32427 | 32428 | 32429 | 32430 | 32431 | 32434 |
| 32435 | 32436 | 32437 | 32438 | 32440 | 32441 | 32442 | 32444 | 32449 | 32450 | 32451 | 32454 |
| 32460 | 32465 | 32466 | 32470 | 32472 | 32474 | 32475 | 32476 | 32477 | 32480 | 32483 | 32485 |
| 32486 | 32490 | 32491 | 32493 | 32496 | 32497 | 32498 | 32499 | 32500 | 32504 | 32505 | 32512 |
| 32515 | 32516 | 32519 | 32525 | 32527 | 32528 | 32529 | 32530 | 32531 | 32532 | 32533 | 32534 |
| 32539 | 32541 | 32542 | 32544 | 32545 | 32546 | 32550 | 32554 | 32559 | 32563 | 32564 | 32567 |
| 32568 | 32571 | 32573 | 32574 | 32575 | 32576 | 32578 | 32579 | 32581 | 32584 | 32585 | 32586 |
| 32588 | 32591 | 32593 | 32594 | 32595 | 32599 | 32600 | 32601 | 32607 | 32609 | 32615 | 32620 |
| 32622 | 32626 | 32628 | 32631 | 32633 | 32635 | 32637 | 32638 | 32641 | 32643 | 32645 | 32653 |
| 32655 | 32656 | 32658 | 32662 | 32663 | 32664 | 32665 | 32666 | 32671 | 32673 | 32676 | 32677 |
| 32678 | 32679 | 32680 | 32682 | 32692 | 32693 | 32695 | 32697 | 32698 | 32704 | 32705 | 32706 |
| 32709 | 32710 | 32711 | 32712 | 32716 | 32718 | 32719 | 32721 | 32727 | 32729 | 32730 | 32736 |
| 32737 | 32740 | 32741 | 32742 | 32743 | 32744 | 32754 | 32757 | 32759 | 32764 | 32766 | 32770 |
| 32771 | 32775 | 32777 | 32779 | 32782 | 32785 | 32786 | 32787 | 32788 | 32789 | 32790 | 32792 |
| 32795 | 32800 | 32801 | 32803 | 32806 | 32807 | 32808 | 32809 | 32810 | 32815 | 32816 | 32819 |
| 32821 | 32822 | 32823 | 32825 | 32830 | 32831 | 32833 | 32835 | 32839 | 32840 | 32843 | 32844 |
| 32845 | 32846 | 32849 | 32852 | 32854 | 32855 | 32856 | 32859 | 32862 | 32865 | 32867 | 32868 |
| 32870 | 32873 | 32876 | 32877 | 32879 | 32880 | 32881 | 32882 | 32884 | 32885 | 32891 | 32893 |
| 32896 | 32899 | 32902 | 32904 | 32906 | 32911 | 32913 | 32914 | 32915 | 32919 | 32923 | 32924 |
| 32926 | 32927 | 32928 | 32930 | 32931 | 32932 | 32933 | 32939 | 32942 | 32943 | 32944 | 32947 |
| 32948 | 32950 | 32951 | 32952 | 32956 | 32957 | 32960 | 32961 | 32962 | 32963 | 32964 | 32965 |
| 32966 | 32967 | 32969 | 32971 | 32972 | 32974 | 32976 | 32977 | 32985 | 32986 | 32990 | 32991 |
| 32993 | 32998 | 33002 | 33014 | 33016 | 33018 | 33021 | 33023 | 33024 | 33025 | 33026 | 33027 |
| 33028 | 33029 | 33030 | 33031 | 33033 | 33038 | 33039 | 33042 | 33043 | 33050 | 33052 | 33053 |
| 33055 | 33056 | 33057 | 33058 | 33059 | 33067 | 33069 | 33072 | 33073 | 33080 | 33084 | 33087 |
| 33090 | 33091 | 33094 | 33096 | 33098 | 33102 | 33106 | 33107 | 33109 | 33110 | 33111 | 33112 |
| 33115 | 33118 | 33119 | 33120 | 33122 | 33126 | 33127 | 33128 | 33129 | 33131 | 33134 | 33135 |
| 33137 | 33138 | 33140 | 33142 | 33147 | 33148 | 33149 | 33150 | 33154 | 33155 | 33158 | 33161 |
| 33162 | 33163 | 33165 | 33166 | 33167 | 33168 | 33169 | 33171 | 33175 | 33177 | 33183 | 33184 |
| 33185 | 33187 | 33189 | 33190 | 33191 | 33194 | 33195 | 33198 | 33199 | 33200 | 33205 | 33207 |
| 33208 | 33210 | 33211 | 33213 | 33214 | 33217 | 33219 | 33220 | 33226 | 33227 | 33229 | 33232 |
| 33233 | 33237 | 33242 | 33245 | 33249 | 33251 | 33254 | 33256 | 33261 | 33262 | 33263 | 33264 |
| 33268 | 33271 | 33272 | 33273 | 33275 | 33276 | 33277 | 33287 | 33288 | 33291 | 33293 | 33294 |
| 33296 | 33297 | 33299 | 33301 | 33308 | 33310 | 33312 | 33313 | 33315 | 33317 | 33321 | 33322 |
| 33323 | 33324 | 33325 | 33326 | 33327 | 33331 | 33332 | 33333 | 33335 | 33336 | 33337 | 33339 |
| 33348 | 33351 | 33352 | 33353 | 33354 | 33355 | 33356 | 33359 | 33360 | 33361 | 33363 | 33364 |
| 33370 | 33382 | 33384 | 33387 | 33388 | 33392 | 33393 | 33394 | 33395 | 33397 | 33399 | 33400 |
| 33402 | 33403 | 33408 | 33409 | 33410 | 33411 | 33412 | 33413 | 33414 | 33419 | 33422 | 33429 |
| 33430 | 33434 | 33437 | 33438 | 33441 | 33442 | 33445 | 33446 | 33449 | 33453 | 33456 | 33457 |
| 33459 | 33461 | 33462 | 33464 | 33465 | 33466 | 33467 | 33468 | 33469 | 33473 | 33475 | 33478 |
| 33479 | 33480 | 33482 | 33485 | 33486 | 33487 | 33494 | 33495 | 33496 | 33498 | 33499 | 33500 |
| 33501 | 33507 | 33508 | 33516 | 33518 | 33520 | 33522 | 33523 | 33524 | 33525 | 33526 | 33540 |
| 33541 | 33543 | 33544 | 33545 | 33548 | 33551 | 33552 | 33553 | 33556 | 33561 | 33562 | 33563 |
| 33566 | 33568 | 33576 | 33577 | 33579 | 33587 | 33588 | 33589 | 33590 | 33594 | 33595 | 33599 |
| 33600 | 33610 | 33611 | 33614 | 33615 | 33617 | 33624 | 33625 | 33626 | 33627 | 33633 | 33636 |
| 33637 | 33640 | 33645 | 33646 | 33647 | 33650 | 33660 | 33664 | 33665 | 33666 | 33667 | 33668 |
| 33672 | 33673 | 33676 | 33680 | 33681 | 33682 | 33683 | 33684 | 33693 | 33701 | 33705 | 33712 |
| 33713 | 33717 | 33718 | 33719 | 33720 | 33721 | 33725 | 33727 | 33728 | 33736 | 33740 | 33742 |
| 33746 | 33748 | 33750 | 33754 | 33755 | 33756 | 33757 | 33760 | 33762 | 33770 | 33773 | 33775 |
| 33776 | 33778 | 33779 | 33785 | 33786 | 33787 | 33789 | 33790 | 33791 | 33792 | 33793 | 33794 |
| 33795 | 33796 | 33799 | 33800 | 33801 | 33802 | 33805 | 33806 | 33807 | 33808 | 33810 | 33812 |
| 33817 | 33818 | 33819 | 33821 | 33822 | 33823 | 33824 | 33830 | 33832 | 33834 | 33835 | 33836 |
| 33838 | 33840 | 33842 | 33843 | 33845 | 33846 | 33847 | 33848 | 33849 | 33850 | 33855 | 33857 |
| 33860 | 33861 | 33864 | 33865 | 33867 | 33868 | 33869 | 33870 | 33871 | 33872 | 33874 | 33877 |
| 33878 | 33880 | 33883 | 33891 | 33893 | 33895 | 33898 | 33899 | 33904 | 33910 | 33915 |
| 33916 | 33919 | 33922 | 33923 | 33929 | 33930 | 33936 | 33942 | 33945 | 33946 | 33949 | 33952 |
| 33953 | 33955 | 33956 | 33957 | 33961 | 33962 | 33963 | 33964 | 33965 | 33966 | 33971 | 33972 |
| 33973 | 33975 | 33976 | 33978 | 33979 | 33982 | 33983 | 33985 | 33986 | 33987 | 33991 | 33992 |
| 33995 | 33998 | 33999 | 34000 | 34001 | 34002 | 34003 | 34005 | 34006 | 34007 | 34011 | 34013 |
| 34015 | 34016 | 34017 | 34019 | 34022 | 34023 | 34028 | 34031 | 34032 | 34035 | 34036 | 34043 |
| 34044 | 34045 | 34046 | 34050 | 34051 | 34052 | 34053 | 34055 | 34056 | 34057 | 34060 | 34061 |
| 34062 | 34063 | 34065 | 34066 | 34068 | 34071 | 34076 | 34077 | 34079 | 34080 | 34081 | 34083 |
| 34087 | 34090 | 34095 | 34097 | 34098 | 34100 | 34103 | 34104 | 34105 | 34108 | 34110 |
| 34111 | 34118 | 34121 | 34123 | 34125 | 34126 | 34132 | 34133 | 34134 | 34136 | 34137 | 34138 |
| 34139 | 34148 | 34157 | 34158 | 34160 | 34161 | 34162 | 34165 | 34166 | 34169 | 34170 | 34172 |
| 34174 | 34177 | 34183 | 34185 | 34192 | 34194 | 34195 | 34196 | 34199 | 34200 | 34201 | 34202 |
| 34205 | 34207 | 34208 | 34211 | 34217 | 34218 | 34219 | 34220 | 34221 | 34222 | 34226 | 34230 |
| 34231 | 34232 | 34237 | 34245 | 34246 | 34254 | 34262 | 34263 | 34266 | 34267 | 34273 | 34276 |
| 34278 | 34282 | 34283 | 34284 | 34285 | 34286 | 34287 | 34289 | 34290 | 34293 | 34294 | 34296 |
| 34302 | 34304 | 34305 | 34306 | 34309 | 34311 | 34312 | 34313 | 34316 | 34317 | 34318 | 34319 |
| 34320 | 34322 | 34325 | 34327 | 34330 | 34331 | 34333 | 34334 | 34336 | 34351 | 34358 | 34359 |
| 34362 | 34363 | 34365 | 34366 | 34367 | 34368 | 34369 | 34374 | 34375 | 34377 | 34378 | 34379 |
| 34380 | 34381 | 34383 | 34384 | 34388 | 34391 | 34392 | 34395 | 34397 | 34398 | 34402 | 34409 |
| 34416 | 34417 | 34421 | 34422 | 34423 | 34427 | 34428 | 34434 | 34435 | 34436 | 34437 | 34442 |
| 34443 | 34452 | 34455 | 34456 | 34460 | 34463 | 34465 | 34466 | 34469 | 34478 | 34481 | 34482 |
| 34484 | 34485 | 34486 | 34487 | 34488 | 34492 | 34494 | 34496 | 34497 | 34498 | 34503 | 34505 |

TABLE 19-continued

Yield: Stress Tolerance

| | | | | | | | | | | | |
|---|---|---|---|---|---|---|---|---|---|---|---|
| 34506 | 34508 | 34509 | 34513 | 34515 | 34516 | 34517 | 34519 | 34526 | 34528 | 34537 | 34542 |
| 34545 | 34546 | 34547 | 34549 | 34553 | 34555 | 34559 | 34560 | 34562 | 34563 | 34564 | 34566 |
| 34567 | 34569 | 34570 | 34572 | 34577 | 34580 | 34581 | 34583 | 34585 | 34596 | 34597 | 34598 |
| 34600 | 34604 | 34605 | 34606 | 34607 | 34615 | 34617 | 34618 | 34619 | 34620 | 34628 | 34630 |
| 34632 | 34633 | 34634 | 34639 | 34641 | 34642 | 34647 | 34648 | 34651 | 34655 | 34656 | 34657 |
| 34658 | 34659 | 34660 | 34663 | 34665 | 34667 | 34672 | 34683 | 34685 | 34687 | 34690 | 34692 |
| 34693 | 34694 | 34700 | 34701 | 34704 | 34705 | 34706 | 34707 | 34711 | 34713 | 34715 | 34716 |
| 34717 | 34719 | 34720 | 34726 | 34728 | 34730 | 34732 | 34733 | 34734 | 34736 | 34737 | 34738 |
| 34739 | 34742 | 34745 | 34747 | 34748 | 34749 | 34751 | 34753 | 34754 | 34755 | 34756 | 34757 |
| 34758 | 34760 | 34761 | 34763 | 34764 | 34765 | 34766 | 34768 | 34772 | 34773 | 34775 | 34778 |
| 34779 | 34781 | 34782 | 34783 | 34785 | 34787 | 34788 | 34789 | 34790 | 34792 | 34793 | 34796 |
| 34797 | 34798 | 34799 | 34800 | 34802 | 34803 | 34804 | 34806 | 34807 | 34809 | 34810 | 34812 |
| 34813 | 34814 | 34815 | 34816 | 34818 | 34819 | 34820 | 34822 | 34823 | 34824 | 34826 | 34827 |
| 34828 | 34829 | 34830 | 34832 | 34833 | 34835 | 34836 | 34839 | 34842 | 34843 | 34845 | |
| 34846 | 34847 | 34848 | 34850 | 34852 | 34853 | 34854 | 34855 | 34858 | 34861 | 34868 | 34869 |
| 34870 | 34871 | 34872 | 34874 | 34875 | 34882 | 34883 | 34884 | 34887 | 34889 | 34890 | 34891 |
| 34892 | 34893 | 34894 | 34895 | 34896 | 34897 | 34898 | 34899 | 34901 | 34903 | 34908 | 34909 |
| 34915 | 34917 | 34923 | 34924 | 34925 | 34928 | 34929 | 34931 | 34932 | 34933 | 34935 | 34936 |
| 34937 | 34938 | 34941 | 34942 | 34944 | 34945 | 34947 | 34950 | 34953 | 34955 | 34956 | 34957 |
| 34958 | 34959 | 34964 | 34969 | 34970 | 34971 | 34972 | 34973 | 34974 | 34976 | 34977 | 34980 |
| 34981 | 34983 | 34984 | 34985 | 34986 | 34987 | 34994 | 34995 | 34996 | 34997 | 34998 | 34999 |
| 35000 | 35003 | 35006 | 35007 | 35011 | 35012 | 35013 | 35014 | 35015 | 35016 | 35019 | 35021 |
| 35023 | 35025 | 35032 | 35034 | 35035 | 35036 | 35037 | 35038 | 35043 | 35045 | 35047 | 35048 |
| 35049 | 35051 | 35052 | 35053 | 35054 | 35055 | 35057 | 35058 | 35064 | 35067 | 35068 | 35070 |
| 35074 | 35075 | 35076 | 35077 | 35079 | 35083 | 35085 | 35089 | 35090 | 35092 | 35094 | 35097 |
| 35099 | 35100 | 35104 | 35106 | 35107 | 35110 | 35112 | 35114 | 35118 | 35119 | 35120 | 35121 |
| 35122 | 35126 | 35127 | 35129 | 35130 | 35131 | 35132 | 35135 | 35136 | 35138 | 35140 | 35142 |
| 35144 | 35147 | 35150 | 35152 | 35153 | 35157 | 35158 | 35162 | 35163 | 35165 | 35166 | 35172 |
| 35176 | 35177 | 35180 | 35181 | 35185 | 35187 | 35189 | 35193 | 35202 | 35203 | 35205 | 35210 |
| 35213 | 35216 | 35217 | 35220 | 35221 | 35224 | 35225 | 35226 | 35227 | 35229 | 35231 | 35232 |
| 35237 | 35239 | 35241 | 35242 | 35244 | 35246 | 35248 | 35251 | 35252 | 35253 | 35254 | 35255 |
| 35257 | 35259 | 35261 | 35262 | 35263 | 35265 | 35268 | 35271 | 35275 | 35280 | 35281 | 35282 |
| 35284 | 35285 | 35291 | 35292 | 35293 | 35294 | 35296 | 35299 | 35301 | 35303 | 35310 | 35311 |
| 35314 | 35316 | 35319 | 35320 | 35324 | 35333 | 35335 | 35336 | 35338 | 35340 | 35343 | 35345 |
| 35346 | 35348 | 35350 | 35354 | 35372 | 35378 | 35384 | 35395 | 35396 | 35400 | 35401 | 35403 |
| 35405 | 35406 | 35409 | 35416 | 35418 | 35421 | 35423 | 35425 | 35427 | 35429 | 35430 | 35431 |
| 35433 | 35434 | 35436 | 35443 | 35447 | 35450 | 35453 | 35455 | 35456 | 35457 | 35460 | 35461 |
| 35463 | 35464 | 35465 | 35468 | 35470 | 35473 | 35475 | 35476 | 35478 | 35482 | 35483 | 35484 |
| 35487 | 35488 | 35492 | 35494 | 35498 | 35499 | 35500 | 35503 | 35512 | 35514 | 35516 | 35517 |
| 35518 | 35522 | 35525 | 35526 | 35527 | 35530 | 35531 | 35535 | 35537 | 35540 | 35542 | 35546 |
| 35548 | 35550 | 35554 | 35555 | 35557 | 35558 | 35561 | 35562 | 35563 | 35564 | 35566 | 35568 |
| 35571 | 35574 | 35575 | 35576 | 35578 | 35579 | 35581 | 35584 | 35586 | 35589 | 35590 | 35591 |
| 35592 | 35594 | 35595 | 35598 | 35599 | 35601 | 35602 | 35606 | 35609 | 35612 | 35613 | 35616 |
| 35619 | 35622 | 35623 | 35626 | 35627 | 35628 | 35633 | 35635 | 35637 | 35638 | 35640 | 35641 |
| 35644 | 35646 | 35648 | 35654 | 35657 | 35659 | 35662 | 35663 | 35664 | 35670 | 35672 | 35674 |
| 35675 | 35683 | 35684 | 35689 | 35691 | 35692 | 35694 | 35698 | 35700 | 35701 | 35704 | 35705 |
| 35707 | 35708 | 35710 | 35712 | 35717 | 35718 | 35720 | 35721 | 35722 | 35723 | 35731 | 35732 |
| 35737 | 35739 | 35740 | 35745 | 35746 | 35749 | 35751 | 35753 | 35758 | 35761 | 35764 | 35765 |
| 35766 | 35767 | 35770 | 35771 | 35773 | 35775 | 35776 | 35779 | 35780 | 35782 | 35783 | 35786 |
| 35790 | 35793 | 35796 | 35797 | 35799 | 35800 | 35804 | 35806 | 35810 | 35811 | 35815 | 35816 |
| 35818 | 35819 | 35822 | 35823 | 35824 | 35825 | 35827 | 35830 | 35831 | 35832 | 35833 | 35834 |
| 35836 | 35842 | 35843 | 35844 | 35846 | 35847 | 35848 | 35849 | 35852 | 35856 | 35857 | 35861 |
| 35862 | 35863 | 35864 | 35865 | 35866 | 35870 | 35873 | 35874 | 35875 | 35876 | 35877 | 35879 |
| 35880 | 35881 | 35882 | 35884 | 35887 | 35888 | 35889 | 35892 | 35894 | 35898 | 35899 | 35900 |
| 35903 | 35904 | 35905 | 35908 | 35909 | 35911 | 35913 | 35915 | 35918 | 35919 | 35920 | 35922 |
| 35926 | 35928 | 35929 | 35931 | 35932 | 35933 | 35934 | 35935 | 35937 | 35938 | 35940 | 35943 |
| 35947 | 35948 | 35949 | 35951 | 35952 | 35953 | 35956 | 35959 | 35960 | 35961 | 35962 | 35966 |
| 35969 | 35971 | 35979 | 35983 | 35985 | 35991 | 35992 | 35993 | 35994 | 35995 | 35999 | 36002 |
| 36003 | 36004 | 36011 | 36012 | 36017 | 36022 | 36026 | 36027 | 36028 | 36029 | 36031 | 36032 |
| 36033 | 36044 | 36045 | 36047 | 36049 | 36050 | 36051 | 36053 | 36055 | 36058 | 36059 | 36060 |
| 36063 | 36064 | 36065 | 36066 | 36067 | 36068 | 36072 | 36074 | 36076 | 36078 | 36082 | 36083 |
| 36084 | 36085 | 36086 | 36087 | 36094 | 36095 | 36096 | 36099 | 36105 | 36107 | 36110 | 36113 |
| 36114 | 36118 | 36120 | 36121 | 36123 | 36128 | 36131 | 36133 | 36137 | 36138 | 36139 | 36141 |
| 36143 | 36146 | 36147 | 36148 | 36149 | 36151 | 36152 | 36153 | 36157 | 36158 | 36159 | 36161 |
| 36162 | 36166 | 36169 | 36170 | 36171 | 36172 | 36173 | 36174 | 36175 | 36176 | 36179 | 36180 |
| 36181 | 36182 | 36183 | 36185 | 36187 | 36189 | 36191 | 36192 | 36193 | 36196 | 36200 | 36201 |
| 36202 | 36203 | 36204 | 36205 | 36208 | 36211 | 36212 | 36214 | 36217 | 36218 | 36226 | 36227 |
| 36234 | 36238 | 36239 | 36241 | 36243 | 36244 | 36251 | 36253 | 36254 | 36255 | 36258 | 36262 |
| 36263 | 36266 | 36267 | 36268 | 36269 | 36270 | 36272 | 36273 | 36276 | 36280 | 36281 | 36282 |
| 36283 | 36285 | 36287 | 36289 | 36291 | 36292 | 36295 | 36296 | 36298 | 36302 | 36303 | 36304 |
| 36309 | 36311 | 36312 | 36313 | 36314 | 36315 | 36316 | 36317 | 36320 | 36321 | 36323 | 36325 |
| 36326 | 36329 | 36330 | 36331 | 36332 | 36333 | 36334 | 36335 | 36336 | 36340 | 36342 | 36349 |
| 36351 | 36352 | 36353 | 36355 | 36359 | 36360 | 36364 | 36365 | 36366 | 36375 | 36376 | 36377 |
| 36378 | 36379 | 36381 | 36382 | 36383 | 36386 | 36387 | 36389 | 36390 | 36394 | 36396 | 36397 |
| 36404 | 36407 | 36408 | 36409 | 36410 | 36413 | 36414 | 36415 | 36416 | 36417 | 36418 | 36420 |
| 36421 | 36423 | 36424 | 36426 | 36428 | 36429 | 36432 | 36433 | 36434 | 36435 | 36438 | 36439 |
| 36441 | 36442 | 36445 | 36447 | 36451 | 36452 | 36454 | 36455 | 36458 | 36461 | 36464 | 36465 |

TABLE 19-continued

Yield: Stress Tolerance

| | | | | | | | | | | | |
|---|---|---|---|---|---|---|---|---|---|---|---|
| 36466 | 36468 | 36469 | 36471 | 36475 | 36477 | 36480 | 36481 | 36488 | 36493 | 36495 | 36497 |
| 36500 | 36502 | 36503 | 36506 | 36507 | 36509 | 36512 | 36514 | 36519 | 36522 | 36523 | 36524 |
| 36525 | 36527 | 36528 | 36529 | 36531 | 36533 | 36534 | 36538 | 36540 | 36541 | 36546 | 36548 |
| 36549 | 36550 | 36551 | 36552 | 36553 | 36556 | 36561 | 36563 | 36564 | 36566 | 36567 | 36569 |
| 36573 | 36576 | 36578 | 36579 | 36580 | 36582 | 36585 | 36586 | 36587 | 36588 | 36590 | 36593 |
| 36594 | 36598 | 36599 | 36600 | 36602 | 36603 | 36605 | 36608 | 36611 | 36612 | 36613 | 36614 |
| 36616 | 36618 | 36619 | 36621 | 36623 | 36624 | 36626 | 36628 | 36630 | 36631 | 36632 | 36634 |
| 36636 | 36638 | 36639 | 36640 | 36651 | 36653 | 36654 | 36656 | 36663 | 36664 | 36666 | 36668 |
| 36670 | 36671 | 36672 | 36673 | 36674 | 36676 | 36678 | 36679 | 36680 | 36681 | 36685 | 36688 |
| 36690 | 36693 | 36694 | 36697 | 36698 | 36701 | 36705 | 36706 | 36707 | 36709 | 36710 | 36712 |
| 36713 | 36715 | 36716 | 36719 | 36720 | 36725 | 36726 | 36727 | 36728 | 36730 | 36731 | 36733 |
| 36736 | 36738 | 36739 | 36741 | 36748 | 36749 | 36751 | 36758 | 36759 | 36760 | 36761 | 36763 |
| 36765 | 36766 | 36767 | 36768 | 36769 | 36772 | 36775 | 36777 | 36778 | 36780 | 36782 | 36783 |
| 36785 | 36787 | 36788 | 36791 | 36793 | 36795 | 36796 | 36798 | 36799 | 36800 | 36801 | 36802 |
| 36806 | 36807 | 36808 | 36809 | 36812 | 36813 | 36815 | 36817 | 36818 | 36821 | 36823 | 36824 |
| 36826 | 36828 | 36831 | 36832 | 36834 | 36835 | 36836 | 36837 | 36838 | 36839 | 36842 | 36843 |
| 36845 | 36846 | 36847 | 36848 | 36849 | 36852 | 36853 | 36856 | 36857 | 36858 | 36865 | 36866 |
| 36869 | 36870 | 36871 | 36875 | 36876 | 36878 | 36879 | 36880 | 36881 | 36882 | 36884 | 36885 |
| 36888 | 36889 | 36892 | 36895 | 36896 | 36898 | 36899 | 36900 | 36901 | 36902 | 36903 | 36904 |
| 36906 | 36908 | 36910 | 36911 | 36912 | 36915 | 36918 | 36923 | 36926 | 36929 | 36933 | 36934 |
| 36936 | 36939 | 36940 | 36941 | 36943 | 36944 | 36946 | 36948 | 36949 | 36950 | 36951 | 36952 |
| 36953 | 36956 | 36957 | 36958 | 36959 | 36964 | 36965 | 36967 | 36969 | 36970 | 36971 | 36974 |
| 36979 | 36980 | 36982 | 36983 | 36984 | 36985 | 36987 | 36989 | 36990 | 36993 | 36994 | 36997 |
| 36999 | 37000 | 37001 | 37002 | 37003 | 37004 | 37005 | 37006 | 37007 | 37009 | 37012 | 37013 |
| 37016 | 37017 | 37018 | 37020 | 37022 | 37024 | 37025 | 37027 | 37028 | 37030 | 37031 | 37032 |
| 37034 | 37036 | 37037 | 37038 | 37041 | 37042 | 37043 | 37045 | 37047 | 37049 | 37052 | 37053 |
| 37056 | 37058 | 37060 | 37061 | 37062 | 37063 | 37064 | 37066 | 37068 | 37071 | 37072 | 37073 |
| 37074 | 37076 | 37077 | 37081 | 37082 | 37087 | 37088 | 37090 | 37095 | 37096 | 37097 | 37105 |
| 37106 | 37107 | 37108 | 37109 | 37110 | 37111 | 37112 | 37114 | 37115 | 37116 | 37117 | 37121 |
| 37124 | 37128 | 37132 | 37134 | 37136 | 37137 | 37138 | 37140 | 37141 | 37146 | 37154 | 37157 |
| 37160 | 37164 | 37166 | 37167 | 37168 | 37170 | 37171 | 37172 | 37173 | 37175 | 37178 | 37180 |
| 37181 | 37186 | 37193 | 37196 | 37197 | 37198 | 37201 | 37204 | 37205 | 37206 | 37207 | 37208 |
| 37209 | 37211 | 37215 | 37216 | 37221 | 37222 | 37223 | 37225 | 37226 | 37228 | 37229 | 37230 |
| 37231 | 37236 | 37239 | 37240 | 37241 | 37242 | 37243 | 37244 | 37245 | 37246 | 37249 | 37251 |
| 37254 | 37255 | 37257 | 37258 | 37259 | 37261 | 37262 | 37263 | 37264 | 37265 | 37269 | 37274 |
| 37278 | 37279 | 37282 | 37283 | 37285 | 37293 | 37297 | 37299 | 37300 | 37303 | 37304 | 37307 |
| 37314 | 37318 | 37319 | 37320 | 37324 | 37327 | 37328 | 37330 | 37331 | 37334 | 37335 | 37336 |
| 37337 | 37340 | 37343 | 37344 | 37347 | 37348 | 37349 | 37355 | 37357 | 37358 | 37362 | 37366 |
| 37367 | 37369 | 37375 | 37377 | 37378 | 37380 | 37381 | 37386 | 37389 | 37390 | 37391 | 37393 |
| 37394 | 37397 | 37400 | 37401 | 37402 | 37404 | 37406 | 37407 | 37414 | 37415 | 37418 | 37419 |
| 37423 | 37424 | 37425 | 37427 | 37429 | 37436 | 37438 | 37439 | 37441 | 37442 | 37443 | 37445 |
| 37446 | 37451 | 37454 | 37455 | 37456 | 37460 | 37462 | 37463 | 37467 | 37468 | 37470 | 37471 |
| 37476 | 37484 | 37485 | 37489 | 37490 | 37491 | 37492 | 37493 | 37496 | 37497 | 37498 |
| 37500 | 37503 | 37504 | 37505 | 37507 | 37512 | 37516 | 37517 | 37520 | 37521 | 37522 | 37523 |
| 37524 | 37526 | 37528 | 37530 | 37531 | 37532 | 37533 | 37538 | 37542 | 37546 | 37550 | 37552 |
| 37553 | 37554 | 37555 | 37556 | 37560 | 37561 | 37564 | 37567 | 37568 | 37569 | 37571 | 37574 |
| 37577 | 37583 | 37585 | 37588 | 37589 | 37590 | 37591 | 37592 | 37593 | 37595 | 37597 | 37598 |
| 37599 | 37600 | 37601 | 37604 | 37605 | 37607 | 37611 | 37614 | 37615 | 37617 | 37619 | 37623 |
| 37626 | 37628 | 37630 | 37633 | 37635 | 37638 | 37642 | 37644 | 37645 | 37646 | 37648 | 37657 |
| 37658 | 37660 | 37661 | 37666 | 37674 | 37675 | 37677 | 37682 | 37684 | 37686 | 37687 | 37688 |
| 37689 | 37691 | 37692 | 37693 | 37694 | 37703 | 37704 | 37705 | 37707 | 37708 | 37709 | 37713 |
| 37714 | 37717 | 37720 | 37721 | 37722 | 37723 | 37726 | 37727 | 37730 | 37732 | 37735 | 37736 |
| 37737 | 37738 | 37740 | 37744 | 37747 | 37748 | 37749 | 37754 | 37755 | 37756 | 37759 | 37762 |
| 37764 | 37765 | 37773 | 37777 | 37779 | 37784 | 37785 | 37795 | 37796 | 37800 | 37804 | 37811 |
| 37812 | 37813 | 37821 | 37825 | 37828 | 37830 | 37832 | 37834 | 37836 | 37837 | 37838 | 37839 |
| 37841 | 37842 | 37848 | 37849 | 37853 | 37855 | 37857 | 37862 | 37863 | 37865 | 37868 | 37870 |
| 37873 | 37874 | 37878 | 37882 | 37884 | 37885 | 37891 | 37899 | 37900 | 37903 | 37905 | 37911 |
| 37912 | 37914 | 37915 | 37919 | 37920 | 37921 | 37923 | 37925 | 37926 | 37927 | 37929 | 37931 |
| 37933 | 37934 | 37935 | 37936 | 37940 | 37942 | 37944 | 37946 | 37947 | 37950 | 37953 | 37958 |
| 37959 | 37964 | 37965 | 37970 | 37971 | 37977 | 37980 | 37983 | 37992 | 37994 | 37995 |
| 37996 | 38000 | 38001 | 38007 | 38009 | 38011 | 38012 | 38015 | 38017 | 38020 | 38021 | 38022 |
| 38025 | 38027 | 38033 | 38035 | 38038 | 38042 | 38043 | 38046 | 38047 | 38050 | 38051 | 38052 |
| 38054 | 38055 | 38058 | 38059 | 38068 | 38070 | 38071 | 38075 | 38078 | 38079 | 38082 | 38084 |
| 38086 | 38087 | 38089 | 38090 | 38091 | 38094 | 38096 | 38098 | 38099 | 38100 | 38105 | 38108 |
| 38111 | 38118 | 38120 | 38121 | 38123 | 38128 | 38130 | 38131 | 38133 | 38135 | 38139 | 38140 |
| 38144 | 38147 | 38148 | 38151 | 38152 | 38153 | 38158 | 38159 | 38160 | 38161 | 38162 | 38163 |
| 38164 | 38166 | 38169 | 38170 | 38171 | 38174 | 38175 | 38177 | 38178 | 38180 | 38188 | 38191 |
| 38195 | 38197 | 38201 | 38202 | 38203 | 38204 | 38206 | 38208 | 38209 | 38210 | 38212 | 38213 |
| 38215 | 38216 | 38218 | 38221 | 38222 | 38227 | 38228 | 38231 | 38234 | 38235 | 38237 | 38238 |
| 38243 | 38245 | 38247 | 38250 | 38251 | 38252 | 38254 | 38255 | 38257 | 38261 | 38262 | 38267 |
| 38269 | 38273 | 38275 | 38277 | 38281 | 38284 | 38285 | 38287 | 38294 | 38297 | 38300 | 38302 |
| 38303 | 38308 | 38311 | 38313 | 38319 | 38321 | 38332 | 38334 | 38335 | 38339 | 38340 | 38343 |
| 38344 | 38346 | 38349 | 38350 | 38351 | 38353 | 38356 | 38360 | 38361 | 38362 | 38364 | 38365 |
| 38373 | 38384 | 38387 | 38388 | 38392 | 38393 | 38394 | 38395 | 38396 | 38398 | 38401 | 38404 |
| 38407 | 38409 | 38410 | 38413 | 38416 | 38417 | 38418 | 38419 | 38421 | 38427 | 38432 | 38433 |
| 38435 | 38437 | 38439 | 38444 | 38445 | 38447 | 38450 | 38451 | 38458 | 38459 | 38464 | 38475 |
| 38478 | 38479 | 38481 | 38482 | 38483 | 38486 | 38487 | 38491 | 38492 | 38493 | 38497 | 38500 |

TABLE 19-continued

Yield: Stress Tolerance

| | | | | | | | | | | | |
|---|---|---|---|---|---|---|---|---|---|---|---|
| 38503 | 38505 | 38507 | 38509 | 38511 | 38512 | 38519 | 38522 | 38527 | 38529 | 38530 | 38531 |
| 38532 | 38534 | 38535 | 38536 | 38537 | 38538 | 38540 | 38541 | 38550 | 38551 | 38554 | 38555 |
| 38556 | 38558 | 38560 | 38562 | 38563 | 38567 | 38568 | 38569 | 38572 | 38577 | 38581 | 38588 |
| 38589 | 38590 | 38594 | 38599 | 38603 | 38604 | 38607 | 38610 | 38611 | 38612 | 38618 | 38625 |
| 38630 | 38632 | 38634 | 38637 | 38638 | 38642 | 38643 | 38647 | 38649 | 38650 | 38651 | 38652 |
| 38654 | 38660 | 38661 | 38662 | 38665 | 38666 | 38668 | 38670 | 38672 | 38673 | 38674 | 38678 |
| 38679 | 38682 | 38684 | 38690 | 38691 | 38695 | 38700 | 38701 | 38702 | 38703 | 38707 | 38708 |
| 38712 | 38714 | 38716 | 38717 | 38718 | 38719 | 38721 | 38722 | 38723 | 38724 | 38725 | 38726 |
| 38727 | 38730 | 38733 | 38734 | 38738 | 38740 | 38745 | 38746 | 38747 | 38748 | 38751 | 38755 |
| 38762 | 38766 | 38767 | 38770 | 38776 | 38777 | 38779 | 38780 | 38781 | 38783 | 38790 | 38793 |
| 38794 | 38797 | 38799 | 38800 | 38802 | 38803 | 38805 | 38806 | 38807 | 38809 | 38812 | 38813 |
| 38817 | 38819 | 38820 | 38823 | 38827 | 38828 | 38829 | 38831 | 38832 | 38833 | 38836 | 38840 |
| 38841 | 38842 | 38845 | 38846 | 38847 | 38858 | 38866 | 38867 | 38870 | 38872 | 38875 | 38876 |
| 38877 | 38878 | 38879 | 38880 | 38882 | 38885 | 38889 | 38894 | 38896 | 38897 | 38898 |
| 38899 | 38901 | 38903 | 38911 | 38914 | 38915 | 38916 | 38923 | 38924 | 38927 | 38930 | 38931 |
| 38938 | 38939 | 38946 | 38950 | 38952 | 38955 | 38961 | 38962 | 38970 | 38972 | 38973 | 38974 |
| 38976 | 38979 | 38980 | 38982 | 38983 | 38984 | 38990 | 38997 | 39008 | 39009 | 39012 | 39013 |
| 39014 | 39015 | 39021 | 39022 | 39023 | 39025 | 39027 | 39029 | 39033 | 39035 | 39036 | 39040 |
| 39041 | 39043 | 39045 | 39047 | 39052 | 39056 | 39058 | 39061 | 39063 | 39064 | 39065 | 39066 |
| 39067 | 39075 | 39079 | 39080 | 39083 | 39085 | 39088 | 39090 | 39093 | 39094 | 39096 | 39097 |
| 39098 | 39101 | 39102 | 39103 | 39106 | 39108 | 39109 | 39110 | 39115 | 39116 | 39117 | 39118 |
| 39123 | 39124 | 39125 | 39127 | 39129 | 39130 | 39136 | 39137 | 39141 | 39142 | 39144 | 39145 |
| 39146 | 39150 | 39158 | 39161 | 39162 | 39164 | 39167 | 39169 | 39175 | 39176 | 39177 | 39179 |
| 39183 | 39187 | 39193 | 39197 | 39198 | 39199 | 39203 | 39205 | 39206 | 39207 | 39209 | 39212 |
| 39213 | 39217 | 39220 | 39221 | 39222 | 39225 | 39231 | 39232 | 39238 | 39239 | 39240 | 39243 |
| 39247 | 39248 | 39249 | 39250 | 39253 | 39256 | 39260 | 39262 | 39267 | 39269 | 39270 | 39271 |
| 39272 | 39274 | 39288 | 39289 | 39293 | 39296 | 39297 | 39298 | 39304 | 39306 | 39307 | 39311 |
| 39317 | 39319 | 39321 | 39323 | 39324 | 39325 | 39326 | 39329 | 39330 | 39333 | 39334 | 39335 |
| 39336 | 39337 | 39338 | 39339 | 39341 | 39342 | 39343 | 39344 | 39345 | 39346 | 39348 | 39349 |
| 39350 | 39356 | 39363 | 39374 | 39375 | 39378 | 39379 | 39380 | 39381 | 39382 | 39389 | 39390 |
| 39392 | 39394 | 39395 | 39396 | 39400 | 39402 | 39403 | 39408 | 39410 | 39412 | 39414 | 39419 |
| 39423 | 39425 | 39428 | 39431 | 39432 | 39433 | 39434 | 39435 | 39443 | 39447 | 39448 | 39451 |
| 39453 | 39456 | 39458 | 39461 | 39462 | 39464 | 39465 | 39466 | 39469 | 39470 | 39471 | 39474 |
| 39476 | 39477 | 39478 | 39483 | 39484 | 39485 | 39486 | 39487 | 39491 | 39492 | 39493 | 39495 |
| 39496 | 39498 | 39504 | 39505 | 39509 | 39510 | 39512 | 39513 | 39514 | 39517 | 39519 | 39522 |
| 39528 | 39531 | 39532 | 39534 | 39537 | 39540 | 39541 | 39545 | 39547 | 39548 | 39549 | 39550 |
| 39554 | 39558 | 39565 | 39569 | 39570 | 39571 | 39575 | 39577 | 39578 | 39580 | 39583 | 39584 |
| 39588 | 39591 | 39592 | 39593 | 39596 | 39603 | 39604 | 39611 | 39612 | 39613 | 39616 | 39620 |
| 39621 | 39622 | 39623 | 39626 | 39629 | 39633 | 39636 | 39643 | 39645 | 39646 | 39647 |
| 39648 | 39650 | 39668 | 39671 | 39672 | 39673 | 39679 | 39681 | 39682 | 39686 | 39692 | 39694 |
| 39696 | 39698 | 39699 | 39700 | 39701 | 39704 | 39705 | 39708 | 39710 | 39711 | 39712 | 39713 |
| 39714 | 39715 | 39716 | 39717 | 39718 | 39720 | 39721 | 39722 | 39723 | 39724 | 39726 | 39728 |
| 39729 | 39732 | 39733 | 39734 | 39735 | 39736 | 39739 | 39740 | 39746 | 39754 | 39757 | 39765 |
| 39766 | 39767 | 39770 | 39771 | 39772 | 39773 | 39779 | 39780 | 39781 | 39784 | 39786 | 39789 |
| 39790 | 39791 | 39794 | 39795 | 39797 | 39798 | 39804 | 39808 | 39811 | 39813 | 39815 | 39816 |
| 39817 | 39818 | 39819 | 39825 | 39826 | 39830 | 39831 | 39835 | 39837 | 39840 | 39844 | 39845 |
| 39846 | 39848 | 39849 | 39851 | 39852 | 39853 | 39856 | 39858 | 39859 | 39860 | 39865 | 39866 |
| 39867 | 39868 | 39869 | 39873 | 39874 | 39876 | 39877 | 39878 | 39880 | 39886 | 39887 | 39891 |
| 39892 | 39893 | 39894 | 39897 | 39898 | 39901 | 39902 | 39910 | 39911 | 39913 | 39915 | 39920 |
| 39921 | 39922 | 39923 | 39925 | 39927 | 39930 | 39933 | 39941 | 39942 | 39943 | 39944 | 39946 |
| 39950 | 39951 | 39953 | 39956 | 39959 | 39960 | 39963 | 39964 | 39967 | 39971 | 39978 | 39979 |
| 39981 | 39984 | 39987 | 39988 | 39989 | 39990 | 39992 | 39995 | 39996 | 40001 | 40002 | 40006 |
| 40009 | 40010 | 40011 | 40015 | 40026 | 40029 | 40031 | 40037 | 40038 | 40039 | 40046 | 40048 |
| 40050 | 40052 | 40053 | 40054 | 40057 | 40058 | 40060 | 40061 | 40062 | 40063 | 40068 | 40069 |
| 40070 | 40073 | 40075 | 40076 | 40078 | 40082 | 40083 | 40084 | 40093 | 40094 | 40095 | 40096 |
| 40098 | 40099 | 40100 | 40101 | 40106 | 40107 | 40108 | 40115 | 40116 | 40117 | 40119 | 40120 |
| 40123 | 40124 | 40131 | 40132 | 40133 | 40134 | 40135 | 40138 | 40141 | 40143 | 40144 | 40146 |
| 40149 | 40150 | 40154 | 40155 | 40156 | 40158 | 40159 | 40162 | 40164 | 40165 | 40167 | 40168 |
| 40170 | 40171 | 40172 | 40173 | 40174 | 40177 | 40182 | 40183 | 40184 | 40188 | 40189 | 40190 |
| 40197 | 40198 | 40199 | 40201 | 40206 | 40207 | 40209 | 40211 | 40212 | 40216 | 40223 | 40227 |
| 40236 | 40237 | 40238 | 40239 | 40240 | 40241 | 40242 | 40245 | 40247 | 40248 | 40249 | 40257 |
| 40258 | 40261 | 40262 | 40263 | 40264 | 40267 | 40277 | 40278 | 40279 | 40280 | 40282 | 40284 |
| 40285 | 40286 | 40290 | 40292 | 40294 | 40296 | 40297 | 40298 | 40303 | 40305 | 40307 | 40308 |
| 40311 | 40312 | 40313 | 40317 | 40318 | 40320 | 40324 | 40333 | 40336 | 40340 | 40341 |
| 40342 | 40343 | 40344 | 40345 | 40346 | 40348 | 40349 | 40351 | 40353 | 40354 | 40355 | 40356 |
| 40357 | 40361 | 40362 | 40366 | 40367 | 40368 | 40369 | 40372 | 40374 | 40379 | 40380 | 40382 |
| 40383 | 40384 | 40388 | 40389 | 40390 | 40392 | 40394 | 40396 | 40397 | 40398 | 40399 | 40400 |
| 40401 | 40402 | 40403 | 40404 | 40408 | 40409 | 40413 | 40415 | 40416 | 40419 | 40422 | 40424 |
| 40425 | 40427 | 40431 | 40436 | 40440 | 40443 | 40444 | 40445 | 40446 | 40454 | 40456 | 40457 |
| 40459 | 40463 | 40464 | 40465 | 40466 | 40467 | 40468 | 40469 | 40470 | 40474 | 40475 | 40477 |
| 40480 | 40485 | 40486 | 40490 | 40491 | 40492 | 40493 | 40494 | 40496 | 40497 | 40499 | 40500 |
| 40502 | 40504 | 40510 | 40513 | 40514 | 40515 | 40517 | 40518 | 40520 | 40522 | 40523 | 40524 |
| 40525 | 40527 | 40528 | 40530 | 40531 | 40536 | 40538 | 40541 | 40544 | 40545 | 40546 | 40548 |
| 40550 | 40551 | 40552 | 40553 | 40555 | 40557 | 40559 | 40560 | 40562 | 40564 | 40566 | 40571 |
| 40576 | 40578 | 40581 | 40582 | 40585 | 40586 | 40588 | 40591 | 40596 | 40602 | 40603 | 40604 |
| 40606 | 40607 | 40610 | 40612 | 40613 | 40617 | 40620 | 40622 | 40627 | 40628 | 40630 | 40633 |
| 40635 | 40636 | 40639 | 40644 | 40645 | 40646 | 40650 | 40651 | 40655 | 40657 | 40667 | 40668 |

TABLE 19-continued

Yield: Stress Tolerance

| | | | | | | | | | | | |
|---|---|---|---|---|---|---|---|---|---|---|---|
| 40670 | 40671 | 40672 | 40673 | 40674 | 40675 | 40680 | 40682 | 40689 | 40693 | 40696 | 40697 |
| 40698 | 40702 | 40704 | 40707 | 40711 | 40713 | 40716 | 40717 | 40718 | 40719 | 40720 | 40724 |
| 40727 | 40729 | 40731 | 40733 | 40736 | 40742 | 40744 | 40745 | 40746 | 40747 | 40748 | 40750 |
| 40752 | 40754 | 40755 | 40756 | 40758 | 40759 | 40779 | 40780 | 40781 | 40782 | 40787 | 40789 |
| 40790 | 40792 | 40798 | 40800 | 40809 | 40810 | 40812 | 40813 | 40816 | 40818 | 40823 | 40824 |
| 40825 | 40826 | 40827 | 40830 | 40836 | 40840 | 40841 | 40842 | 40844 | 40845 | 40846 | 40850 |
| 40853 | 40854 | 40855 | 40856 | 40857 | 40858 | 40859 | 40861 | 40865 | 40869 | 40870 | 40872 |
| 40873 | 40874 | 40876 | 40880 | 40881 | 40882 | 40883 | 40884 | 40885 | 40886 | 40887 | 40888 |
| 40891 | 40892 | 40894 | 40895 | 40897 | 40898 | 40904 | 40907 | 40908 | 40909 | 40913 | 40917 |
| 40918 | 40921 | 40922 | 40923 | 40924 | 40927 | 40936 | 40946 | 40952 | 40957 | 40960 | 40961 |
| 40962 | 40964 | 40965 | 40966 | 40968 | 40970 | 40971 | 40976 | 40988 | 40990 | 40994 | 40996 |
| 40997 | 41000 | 41006 | 41008 | 41009 | 41010 | 41013 | 41014 | 41015 | 41017 | 41018 | 41019 |
| 41020 | 41024 | 41032 | 41035 | 41039 | 41045 | 41046 | 41050 | 41055 | 41056 | 41057 | 41058 |
| 41059 | 41060 | 41061 | 41062 | 41064 | 41065 | 41066 | 41069 | 41070 | 41071 | 41072 | |
| 41074 | 41075 | 41076 | 41078 | 41079 | 41085 | 41086 | 41088 | 41089 | 41090 | 41091 | 41097 |
| 41099 | 41102 | 41105 | 41106 | 41108 | 41113 | 41114 | 41117 | 41123 | 41130 | 41134 | 41140 |
| 41141 | 41142 | 41143 | 41149 | 41150 | 41151 | 41153 | 41154 | 41155 | 41156 | 41158 | 41163 |
| 41164 | 41165 | 41168 | 41170 | 41171 | 41172 | 41177 | 41178 | 41181 | 41187 | 41188 | 41191 |
| 41194 | 41197 | 41202 | 41204 | 41206 | 41207 | 41209 | 41210 | 41211 | 41213 | 41214 | 41222 |
| 41223 | 41224 | 41232 | 41233 | 41234 | 41235 | 41236 | 41237 | 41238 | 41239 | 41241 | 41242 |
| 41243 | 41244 | 41246 | 41247 | 41251 | 41252 | 41253 | 41255 | 41257 | 41258 | 41259 | 41260 |
| 41261 | 41262 | 41266 | 41269 | 41270 | 41271 | 41274 | 41275 | 41277 | 41279 | 41287 | |
| 41292 | 41295 | 41301 | 41302 | 41304 | 41306 | 41309 | 41310 | 41313 | 41316 | 41328 | 41338 |
| 41339 | 41341 | 41342 | 41343 | 41344 | 41345 | 41346 | 41347 | 41348 | 41354 | 41355 | 41356 |
| 41357 | 41358 | 41359 | 41360 | 41362 | 41363 | 41365 | 41366 | 41370 | 41372 | 41374 | 41375 |
| 41376 | 41377 | 41378 | 41379 | 41380 | 41384 | 41388 | 41389 | 41393 | 41394 | 41399 | 41400 |
| 41405 | 41409 | 41410 | 41411 | 41412 | 41414 | 41415 | 41418 | 41419 | 41420 | 41424 | 41425 |
| 41426 | 41428 | 41429 | 41430 | 41431 | 41432 | 41433 | 41436 | 41439 | 41440 | 41442 | 41444 |
| 41445 | 41446 | 41447 | 41449 | 41452 | 41454 | 41457 | 41459 | 41461 | 41462 | 41463 | 41473 |
| 41475 | 41476 | 41477 | 41478 | 41480 | 41492 | 41493 | 41494 | 41496 | 41497 | 41498 | 41501 |
| 41504 | 41507 | 41508 | 41509 | 41510 | 41511 | 41517 | 41524 | 41527 | 41530 | 41536 | 41538 |
| 41539 | 41543 | 41544 | 41545 | 41547 | 41550 | 41555 | 41556 | 41557 | 41560 | 41575 | 41576 |
| 41577 | 41578 | 41582 | 41583 | 41584 | 41585 | 41586 | 41588 | 41589 | 41593 | 41600 | 41601 |
| 41604 | 41605 | 41607 | 41608 | 41609 | 41611 | 41612 | 41613 | 41614 | 41615 | 41617 | 41620 |
| 41621 | 41625 | 41626 | 41628 | 41631 | 41633 | 41635 | 41636 | 41638 | 41641 | 41642 | 41645 |
| 41646 | 41650 | 41652 | 41653 | 41655 | 41657 | 41658 | 41660 | 41666 | 41668 | 41669 | 41671 |
| 41672 | 41677 | 41679 | 41680 | 41682 | 41695 | 41696 | 41697 | 41699 | 41700 | 41704 | 41709 |
| 41712 | 41713 | 41717 | 41718 | 41719 | 41721 | 41723 | 41724 | 41725 | 41728 | 41730 | 41732 |
| 41733 | 41736 | 41737 | 41738 | 41739 | 41741 | 41742 | 41745 | 41750 | 41752 | 41753 | |
| 41754 | 41756 | 41757 | 41758 | 41760 | 41761 | 41762 | 41763 | 41764 | 41765 | 41766 | 41767 |
| 41768 | 41769 | 41773 | 41776 | 41778 | 41781 | 41782 | 41788 | 41790 | 41793 | 41800 | 41802 |
| 41805 | 41808 | 41810 | 41815 | 41818 | 41819 | 41822 | 41823 | 41830 | 41832 | 41833 | 41834 |
| 41836 | 41837 | 41838 | 41840 | 41841 | 41843 | 41847 | 41850 | 41853 | 41854 | 41855 | 41856 |
| 41857 | 41859 | 41863 | 41865 | 41867 | 41868 | 41869 | 41871 | 41873 | 41874 | 41878 | 41879 |
| 41881 | 41882 | 41883 | 41884 | 41885 | 41886 | 41890 | 41891 | 41892 | 41893 | 41895 | 41898 |
| 41900 | 41904 | 41909 | 41913 | 41914 | 41915 | 41917 | 41919 | 41921 | 41924 | 41926 | 41928 |
| 41932 | 41936 | 41938 | 41947 | 41948 | 41951 | 41952 | 41953 | 41954 | 41956 | 41957 | 41958 |
| 41965 | 41968 | 41971 | 41973 | 41977 | 41984 | 41987 | 41988 | 41989 | 41993 | 41995 | 41996 |
| 41998 | 42000 | 42002 | 42003 | 42004 | 42007 | 42008 | 42010 | 42013 | 42017 | 42019 | 42020 |
| 42021 | 42022 | 42025 | 42032 | 42037 | 42042 | 42046 | 42048 | 42049 | 42051 | 42052 | 42054 |
| 42065 | 42066 | 42067 | 42068 | 42069 | 42070 | 42074 | 42076 | 42077 | 42078 | 42084 | 42086 |
| 42087 | 42088 | 42089 | 42092 | 42103 | 42104 | 42105 | 42109 | 42110 | 42111 | 42113 | |
| 42114 | 42117 | 42118 | 42119 | 42121 | 42122 | 42123 | 42124 | 42125 | 42129 | 42130 | 42131 |
| 42133 | 42134 | 42138 | 42139 | 42143 | 42144 | 42145 | 42146 | 42147 | 42148 | 42149 | 42151 |
| 42156 | 42160 | 42161 | 42162 | 42164 | 42165 | 42166 | 42173 | 42174 | 42175 | 42176 | 42178 |
| 42183 | 42184 | 42185 | 42186 | 42187 | 42191 | 42193 | 42196 | 42197 | 42198 | 42201 | |
| 42204 | 42209 | 42212 | 42213 | 42216 | 42219 | 42220 | 42224 | 42225 | 42227 | 42231 | 42232 |
| 42233 | 42238 | 42241 | 42242 | 42244 | 42245 | 42248 | 42249 | 42250 | 42255 | 42256 | 42258 |
| 42261 | 42264 | 42265 | 42267 | 42270 | 42279 | 42280 | 42281 | 42282 | 42284 | 42285 | 42287 |
| 42288 | 42289 | 42292 | 42293 | 42294 | 42295 | 42299 | 42300 | 42301 | 42304 | 42305 | 42307 |
| 42311 | 42312 | 42315 | 42316 | 42318 | 42319 | 42320 | 42322 | 42323 | 42324 | 42326 | 42327 |
| 42328 | 42329 | 42330 | 42331 | 42333 | 42334 | 42335 | 42336 | 42337 | 42338 | 42341 | 42342 |
| 42344 | 42347 | 42352 | 42354 | 42355 | 42358 | 42359 | 42360 | 42361 | 42363 | 42365 | 42375 |
| 42378 | 42380 | 42381 | 42382 | 42383 | 42384 | 42386 | 42393 | 42394 | 42397 | 42398 | |
| 42403 | 42405 | 42406 | 42407 | 42409 | 42411 | 42412 | 42415 | 42416 | 42418 | 42420 | 42423 |
| 42424 | 42426 | 42427 | 42428 | 42429 | 42432 | 42438 | 42439 | 42441 | 42442 | 42443 | 42446 |
| 42447 | 42448 | 42449 | 42451 | 42455 | 42456 | 42458 | 42461 | 42462 | 42466 | 42467 | 42468 |
| 42473 | 42475 | 42476 | 42478 | 42480 | 42482 | 42485 | 42491 | 42492 | 42494 | 42495 | |
| 42499 | 42501 | 42502 | 42503 | 42504 | 42506 | 42507 | 42508 | 42511 | 42515 | 42517 | 42518 |
| 42519 | 42523 | 42527 | 42531 | 42532 | 42533 | 42534 | 42535 | 42537 | 42542 | 42545 | 42546 |
| 42548 | 42549 | 42550 | 42551 | 42552 | 42553 | 42554 | 42556 | 42557 | 42558 | 42559 | 42560 |
| 42561 | 42564 | 42565 | 42569 | 42571 | 42572 | 42573 | 42574 | 42575 | 42576 | 42577 | 42580 |
| 42582 | 42584 | 42588 | 42589 | 42591 | 42592 | 42593 | 42594 | 42599 | 42601 | 42603 | 42604 |
| 42606 | 42608 | 42610 | 42612 | 42613 | 42617 | 42621 | 42622 | 42623 | 42624 | 42625 | 42628 |
| 42629 | 42630 | 42631 | 42636 | 42639 | 42640 | 42641 | 42642 | 42643 | 42644 | 42647 | 42648 |
| 42649 | 42650 | 42654 | 42657 | 42661 | 42662 | 42663 | 42665 | 42666 | 42669 | 42670 | 42676 |
| 42678 | 42683 | 42685 | 42686 | 42689 | 42694 | 42695 | 42699 | 42700 | 42702 | 42703 | 42705 |

TABLE 19-continued

Yield: Stress Tolerance

| | | | | | | | | | | | |
|---|---|---|---|---|---|---|---|---|---|---|---|
| 42708 | 42709 | 42710 | 42713 | 42715 | 42716 | 42718 | 42721 | 42722 | 42726 | 42735 | 42741 |
| 42742 | 42744 | 42745 | 42746 | 42747 | 42750 | 42752 | 42756 | 42758 | 42760 | 42766 | 42768 |
| 42773 | 42774 | 42779 | 42782 | 42785 | 42790 | 42792 | 42796 | 42799 | 42801 | 42802 | 42803 |
| 42805 | 42806 | 42807 | 42808 | 42810 | 42815 | 42820 | 42821 | 42823 | 42824 | 42825 | 42826 |
| 42829 | 42830 | 42831 | 42835 | 42841 | 42843 | 42844 | 42845 | 42846 | 42847 | 42852 | 42859 |
| 42862 | 42864 | 42866 | 42878 | 42881 | 42882 | 42885 | 42886 | 42887 | 42888 | 42889 | 42890 |
| 42891 | 42892 | 42893 | 42895 | 42898 | 42900 | 42901 | 42903 | 42905 | 42907 | 42908 | 42911 |
| 42912 | 42916 | 42918 | 42919 | 42920 | 42922 | 42926 | 42927 | 42929 | 42930 | 42931 | 42934 |
| 42935 | 42936 | 42939 | 42944 | 42947 | 42948 | 42951 | 42952 | 42955 | 42958 | 42959 | 42961 |
| 42962 | 42963 | 42964 | 42965 | 42967 | 42968 | 42971 | 42973 | 42975 | 42978 | 42981 | 42982 |
| 42987 | 42988 | 42989 | 42990 | 42992 | 42993 | 42996 | 43001 | 43002 | 43004 | 43015 | 43017 |
| 43020 | 43021 | 43023 | 43024 | 43025 | 43027 | 43030 | 43037 | 43038 | 43045 | 43046 | 43047 |
| 43050 | 43051 | 43052 | 43053 | 43058 | 43059 | 43067 | 43068 | 43072 | 43073 | 43076 | 43077 |
| 43078 | 43079 | 43081 | 43082 | 43083 | 43086 | 43089 | 43091 | 43092 | 43093 | 43094 | 43097 |
| 43098 | 43101 | 43102 | 43103 | 43107 | 43110 | 43113 | 43114 | 43115 | 43120 | 43121 | 43122 |
| 43123 | 43126 | 43127 | 43128 | 43142 | 43143 | 43144 | 43145 | 43148 | 43150 | 43151 | 43152 |
| 43154 | 43158 | 43159 | 43160 | 43161 | 43163 | 43167 | 43168 | 43169 | 43170 | 43172 | 43173 |
| 43174 | 43179 | 43180 | 43187 | 43189 | 43193 | 43195 | 43197 | 43198 | 43199 | 43200 | |
| 43203 | 43205 | 43206 | 43207 | 43208 | 43209 | 43210 | 43213 | 43218 | 43219 | 43228 | 43229 |
| 43230 | 43231 | 43234 | 43236 | 43237 | 43240 | 43244 | 43245 | 43246 | 43247 | 43250 | 43251 |
| 43256 | 43258 | 43259 | 43260 | 43262 | 43264 | 43265 | 43266 | 43267 | 43270 | 43272 | 43275 |
| 43280 | 43281 | 43282 | 43286 | 43287 | 43288 | 43289 | 43291 | 43293 | 43295 | 43297 | |
| 43298 | 43299 | 43301 | 43303 | 43304 | 43305 | 43307 | 43311 | 43314 | 43315 | 43318 | 43321 |
| 43324 | 43326 | 43328 | 43329 | 43331 | 43332 | 43334 | 43340 | 43341 | 43343 | 43344 | 43346 |
| 43351 | 43352 | 43353 | 43356 | 43357 | 43358 | 43359 | 43363 | 43371 | 43373 | 43376 | 43377 |
| 43380 | 43383 | 43390 | 43391 | 43395 | 43398 | 43401 | 43403 | 43406 | 43407 | 43409 | 43411 |
| 43414 | 43415 | 43416 | 43417 | 43418 | 43419 | 43420 | 43422 | 43424 | 43426 | 43433 | 43435 |
| 43436 | 43441 | 43442 | 43446 | 43448 | 43450 | 43452 | 43453 | 43454 | 43459 | 43461 | 43463 |
| 43465 | 43466 | 43472 | 43475 | 43477 | 43478 | 43482 | 43486 | 43487 | 43489 | 43490 | 43492 |
| 43495 | 43506 | 43507 | 43508 | 43510 | 43511 | 43513 | 43516 | 43518 | 43520 | 43525 | 43526 |
| 43527 | 43528 | 43529 | 43533 | 43534 | 43537 | 43539 | 43540 | 43541 | 43542 | 43544 | 43546 |
| 43547 | 43548 | 43552 | 43555 | 43556 | 43557 | 43562 | 43564 | 43565 | 43567 | 43571 | 43572 |
| 43578 | 43579 | 43582 | 43583 | 43584 | 43589 | 43590 | 43596 | 43598 | 43601 | 43602 | 43603 |
| 43604 | 43605 | 43608 | 43609 | 43611 | 43615 | 43616 | 43617 | 43618 | 43619 | 43620 | 43622 |
| 43623 | 43624 | 43625 | 43629 | 43630 | 43632 | 43633 | 43635 | 43637 | 43641 | 43642 | 43643 |
| 43645 | 43648 | 43649 | 43651 | 43655 | 43656 | 43662 | 43664 | 43672 | 43673 | 43675 | 43677 |
| 43678 | 43681 | 43687 | 43690 | 43692 | 43693 | 43696 | 43698 | 43699 | 43700 | 43706 | 43708 |
| 43709 | 43710 | 43711 | 43712 | 43714 | 43715 | 43718 | 43719 | 43720 | 43722 | 43725 | 43729 |
| 43733 | 43735 | 43737 | 43743 | 43744 | 43745 | 43747 | 43752 | 43753 | 43754 | 43755 | 43761 |
| 43762 | 43765 | 43766 | 43771 | 43773 | 43775 | 43776 | 43790 | 43791 | 43793 | 43795 | 43798 |
| 43799 | 43800 | 43805 | 43806 | 43807 | 43809 | 43813 | 43814 | 43816 | 43817 | 43820 | 43821 |
| 43822 | 43824 | 43827 | 43828 | 43830 | 43831 | 43834 | 43835 | 43836 | 43837 | 43842 | 43844 |
| 43845 | 43849 | 43854 | 43859 | 43860 | 43861 | 43865 | 43872 | 43873 | 43879 | 43881 | 43882 |
| 43884 | 43885 | 43886 | 43888 | 43890 | 43891 | 43892 | 43894 | 43895 | 43899 | 43900 | 43901 |
| 43902 | 43903 | 43906 | 43907 | 43908 | 43910 | 43912 | 43913 | 43914 | 43916 | 43917 | 43923 |
| 43924 | 43925 | 43928 | 43929 | 43930 | 43933 | 43934 | 43935 | 43936 | 43939 | 43940 | 43942 |
| 43944 | 43946 | 43947 | 43948 | 43949 | 43950 | 43951 | 43953 | 43955 | 43956 | 43962 | 43963 |
| 43964 | 43965 | 43967 | 43969 | 43972 | 43974 | 43976 | 43978 | 43983 | 43984 | 43985 | 43986 |
| 43988 | 43991 | 43996 | 43999 | 44000 | 44001 | 44004 | 44006 | 44007 | 44008 | 44009 | 44010 |
| 44011 | 44012 | 44015 | 44019 | 44021 | 44022 | 44024 | 44029 | 44037 | 44038 | 44042 | 44043 |
| 44044 | 44045 | 44050 | 44052 | 44053 | 44055 | 44059 | 44060 | 44061 | 44062 | 44063 | 44064 |
| 44065 | 44067 | 44070 | 44071 | 44075 | 44076 | 44077 | 44079 | 44081 | 44082 | 44084 | 44087 |
| 44094 | 44095 | 44096 | 44097 | 44098 | 44099 | 44100 | 44101 | 44104 | 44105 | 44106 | 44108 |
| 44115 | 44119 | 44121 | 44122 | 44123 | 44124 | 44125 | 44126 | 44127 | 44128 | 44129 | 44130 |
| 44132 | 44133 | 44134 | 44135 | 44136 | 44137 | 44139 | 44140 | 44141 | 44142 | 44147 | 44148 |
| 44159 | 44161 | 44167 | 44171 | 44173 | 44179 | 44180 | 44181 | 44190 | 44191 | 44193 | 44194 |
| 44201 | 44202 | 44207 | 44217 | 44218 | 44222 | 44223 | 44226 | 44230 | 44233 | 44234 | 44235 |
| 44237 | 44238 | 44240 | 44241 | 44244 | 44245 | 44247 | 44249 | 44251 | 44252 | 44253 | 44255 |
| 44256 | 44257 | 44262 | 44264 | 44265 | 44267 | 44273 | 44278 | 44280 | 44284 | 44287 | 44288 |
| 44290 | 44294 | 44302 | 44306 | 44308 | 44310 | 44311 | 44312 | 44315 | 44316 | 44317 | |
| 44319 | 44320 | 44321 | 44322 | 44328 | 44330 | 44331 | 44333 | 44334 | 44335 | 44338 | 44339 |
| 44342 | 44345 | 44346 | 44347 | 44355 | 44356 | 44357 | 44362 | 44367 | 44372 | 44373 | 44374 |
| 44376 | 44381 | 44388 | 44389 | 44391 | 44393 | 44394 | 44396 | 44400 | 44401 | 44402 | 44404 |
| 44410 | 44415 | 44418 | 44420 | 44421 | 44426 | 44430 | 44432 | 44436 | 44437 | 44442 | |
| 44443 | 44444 | 44445 | 44446 | 44448 | 44452 | 44457 | 44459 | 44460 | 44461 | 44463 | 44464 |
| 44468 | 44469 | 44471 | 44473 | 44474 | 44475 | 44476 | 44482 | 44484 | 44485 | 44487 | 44488 |
| 44489 | 44492 | 44493 | 44494 | 44495 | 44496 | 44497 | 44498 | 44504 | 44506 | 44507 | 44514 |
| 44515 | 44516 | 44517 | 44519 | 44520 | 44521 | 44522 | 44523 | 44534 | 44535 | 44539 | |
| 44540 | 44541 | 44546 | 44547 | 44548 | 44549 | 44550 | 44552 | 44556 | 44557 | 44558 | 44560 |
| 44564 | 44565 | 44567 | 44568 | 44569 | 44572 | 44573 | 44578 | 44579 | 44580 | 44581 | 44582 |
| 44589 | 44591 | 44592 | 44594 | 44595 | 44596 | 44597 | 44600 | 44602 | 44605 | 44606 | 44608 |
| 44609 | 44610 | 44616 | 44617 | 44620 | 44622 | 44624 | 44627 | 44628 | 44629 | 44633 | 44634 |
| 44636 | 44637 | 44639 | 44642 | 44643 | 44644 | 44649 | 44651 | 44652 | 44653 | 44654 | 44656 |
| 44659 | 44661 | 44662 | 44665 | 44666 | 44669 | 44670 | 44671 | 44674 | 44675 | 44676 | 44677 |
| 44678 | 44679 | 44680 | 44682 | 44684 | 44689 | 44690 | 44691 | 44694 | 44695 | 44696 | 44698 |
| 44699 | 44700 | 44701 | 44707 | 44710 | 44719 | 44724 | 44726 | 44727 | 44728 | 44729 | 44730 |
| 44734 | 44737 | 44738 | 44739 | 44742 | 44745 | 44746 | 44747 | 44752 | 44754 | 44755 | 44756 |

TABLE 19-continued

Yield: Stress Tolerance

| | | | | | | | | | | | |
|---|---|---|---|---|---|---|---|---|---|---|---|
| 44760 | 44762 | 44764 | 44767 | 44768 | 44772 | 44775 | 44776 | 44778 | 44779 | 44782 | 44783 |
| 44785 | 44790 | 44792 | 44795 | 44796 | 44797 | 44798 | 44799 | 44800 | 44802 | 44803 | 44804 |
| 44805 | 44806 | 44809 | 44810 | 44811 | 44815 | 44816 | 44817 | 44823 | 44824 | 44827 | 44828 |
| 44830 | 44831 | 44834 | 44836 | 44837 | 44838 | 44840 | 44848 | 44850 | 44851 | 44852 | 44854 |
| 44857 | 44860 | 44863 | 44864 | 44865 | 44866 | 44872 | 44873 | 44875 | 44882 | 44883 | 44885 |
| 44886 | 44887 | 44889 | 44890 | 44891 | 44893 | 44895 | 44896 | 44897 | 44900 | 44906 | 44907 |
| 44911 | 44913 | 44914 | 44915 | 44916 | 44918 | 44920 | 44922 | 44925 | 44927 | 44930 | 44931 |
| 44932 | 44936 | 44937 | 44938 | 44947 | 44950 | 44951 | 44952 | 44953 | 44957 | 44958 | 44959 |
| 44962 | 44963 | 44964 | 44967 | 44968 | 44969 | 44970 | 44971 | 44972 | 44974 | 44977 | 44978 |
| 44983 | 44987 | 44991 | 44993 | 44995 | 44996 | 45000 | 45001 | 45003 | 45008 | 45010 | 45011 |
| 45015 | 45017 | 45018 | 45019 | 45020 | 45022 | 45027 | 45028 | 45029 | 45030 | 45031 | 45032 |
| 45033 | 45034 | 45035 | 45038 | 45040 | 45041 | 45043 | 45044 | 45046 | 45050 | 45051 | 45052 |
| 45053 | 45054 | 45055 | 45056 | 45058 | 45059 | 45060 | 45065 | 45066 | 45068 | 45070 | 45071 |
| 45073 | 45074 | 45076 | 45077 | 45079 | 45080 | 45081 | 45082 | 45083 | 45085 | 45089 | 45091 |
| 45092 | 45093 | 45096 | 45097 | 45098 | 45101 | 45102 | 45103 | 45105 | 45106 | 45109 | 45110 |
| 45111 | 45112 | 45115 | 45117 | 45119 | 45120 | 45121 | 45122 | 45123 | 45126 | 45128 | 45129 |
| 45130 | 45132 | 45133 | 45134 | 45135 | 45142 | 45143 | 45144 | 45149 | 45150 | 45151 | 45152 |
| 45153 | 45159 | 45160 | 45162 | 45163 | 45165 | 45166 | 45167 | 45168 | 45171 | 45173 | 45175 |
| 45178 | 45179 | 45181 | 45182 | 45183 | 45184 | 45185 | 45186 | 45189 | 45191 | 45192 | 45193 |
| 45194 | 45196 | 45197 | 45198 | 45200 | 45201 | 45202 | 45209 | 45213 | 45214 | 45215 | 45225 |
| 45228 | 45230 | 45232 | 45234 | 45236 | 45239 | 45242 | 45243 | 45244 | 45245 | 45246 | 45248 |
| 45252 | 45253 | 45254 | 45261 | 45265 | 45267 | 45270 | 45272 | 45273 | 45274 | 45275 | 45276 |
| 45277 | 45278 | 45279 | 45280 | 45285 | 45287 | 45289 | 45294 | 45295 | 45298 | 45299 | 45302 |
| 45303 | 45309 | 45310 | 45311 | 45316 | 45318 | 45324 | 45326 | 45327 | 45330 | 45332 | 45334 |
| 45336 | 45339 | 45340 | 45341 | 45342 | 45343 | 45347 | 45351 | 45353 | 45355 | 45357 | 45360 |
| 45364 | 45366 | 45367 | 45369 | 45370 | 45371 | 45376 | 45377 | 45378 | 45379 | 45380 | 45381 |
| 45383 | 45385 | 45386 | 45388 | 45389 | 45390 | 45391 | 45398 | 45399 | 45409 | 45411 | 45413 |
| 45415 | 45416 | 45418 | 45428 | 45432 | 45433 | 45434 | 45437 | 45438 | 45440 | 45443 | 45444 |
| 45445 | 45447 | 45450 | 45452 | 45457 | 45458 | 45459 | 45464 | 45465 | 45466 | 45467 | 45468 |
| 45475 | 45477 | 45478 | 45479 | 45481 | 45482 | 45483 | 45484 | 45488 | 45489 | 45490 | 45496 |
| 45497 | 45498 | 45499 | 45500 | 45501 | 45502 | 45503 | 45505 | 45506 | 45508 | 45509 | |
| 45510 | 45511 | 45512 | 45514 | 45519 | 45523 | 45524 | 45525 | 45526 | 45527 | 45528 | 45529 |
| 45531 | 45532 | 45534 | 45535 | 45537 | 45538 | 45540 | 45541 | 45545 | 45546 | 45552 | 45553 |
| 45554 | 45556 | 45560 | 45562 | 45563 | 45565 | 45569 | 45570 | 45572 | 45574 | 45576 | 45577 |
| 45578 | 45583 | 45584 | 45587 | 45589 | 45592 | 45597 | 45598 | 45599 | 45602 | 45603 | 45604 |
| 45605 | 45606 | 45608 | 45613 | 45616 | 45617 | 45621 | 45624 | 45625 | 45627 | 45629 | 45630 |
| 45632 | 45635 | 45636 | 45637 | 45640 | 45641 | 45643 | 45645 | 45646 | 45647 | 45648 | 45649 |
| 45651 | 45652 | 45656 | 45658 | 45660 | 45661 | 45662 | 45667 | 45668 | 45669 | 45670 | 45671 |
| 45672 | 45673 | 45674 | 45675 | 45676 | 45686 | 45687 | 45693 | 45694 | 45696 | 45697 | 45698 |
| 45699 | 45700 | 45702 | 45703 | 45706 | 45707 | 45708 | 45709 | 45711 | 45714 | 45717 | 45718 |
| 45720 | 45721 | 45725 | 45726 | 45727 | 45728 | 45730 | 45731 | 45732 | 45733 | 45734 | 45735 |
| 45736 | 45737 | 45740 | 45741 | 45743 | 45745 | 45747 | 45750 | 45753 | 45754 | 45758 | 45759 |
| 45762 | 45763 | 45765 | 45768 | 45769 | 45770 | 45775 | 45777 | 45780 | 45781 | 45783 | 45785 |
| 45788 | 45791 | 45794 | 45795 | 45796 | 45797 | 45801 | 45803 | 45807 | 45811 | 45812 | 45813 |
| 45814 | 45815 | 45820 | 45822 | 45824 | 45825 | 45826 | 45827 | 45828 | 45830 | 45831 | 45832 |
| 45833 | 45834 | 45835 | 45837 | 45838 | 45840 | 45841 | 45842 | 45843 | 45845 | 45847 | 45848 |
| 45851 | 45852 | 45853 | 45854 | 45855 | 45857 | 45858 | 45862 | 45863 | 45864 | 45865 | 45868 |
| 45870 | 45871 | 45872 | 45873 | 45874 | 45877 | 45878 | 45879 | 45880 | 45882 | 45885 | 45887 |
| 45888 | 45891 | 45892 | 45893 | 45894 | 45897 | 45901 | 45903 | 45904 | 45905 | 45907 | 45908 |
| 45911 | 45912 | 45913 | 45914 | 45915 | 45919 | 45920 | 45922 | 45924 | 45926 | 45927 | 45930 |
| 45931 | 45933 | 45936 | 45938 | 45939 | 45940 | 45942 | 45944 | 45951 | 45952 | 45953 | 45955 |
| 45956 | 45957 | 45958 | 45959 | 45964 | 45966 | 45967 | 45968 | 45969 | 45970 | 45971 | 45976 |
| 45978 | 45980 | 45981 | 45982 | 45983 | 45985 | 45986 | 45987 | 45988 | 45989 | 45990 | 45993 |
| 45995 | 45997 | 46000 | 46001 | 46002 | 46003 | 46006 | 46007 | 46012 | 46019 | 46020 | 46022 |
| 46023 | 46027 | 46028 | 46029 | 46033 | 46037 | 46038 | 46039 | 46040 | 46041 | 46044 | 46046 |
| 46047 | 46049 | 46051 | 46052 | 46053 | 46054 | 46055 | 46056 | 46057 | 46058 | 46059 | 46060 |
| 46062 | 46063 | 46065 | 46066 | 46067 | 46069 | 46071 | 46073 | 46074 | 46077 | 46078 | 46079 |
| 46080 | 46081 | 46083 | 46085 | 46086 | 46087 | 46088 | 46089 | 46092 | 46093 | 46094 | 46096 |
| 46097 | 46100 | 46102 | 46103 | 46104 | 46107 | 46111 | 46112 | 46114 | 46115 | 46117 | 46119 |
| 46120 | 46123 | 46125 | 46126 | 46130 | 46131 | 46133 | 46139 | 46141 | 46145 | 46146 | 46147 |
| 46148 | 46150 | 46155 | 46158 | 46159 | 46167 | 46169 | 46171 | 46174 | 46177 | 46179 | 46181 |
| 46182 | 46183 | 46184 | 46185 | 46186 | 46187 | 46188 | 46189 | 46190 | 46194 | 46196 | 46197 |
| 46198 | 46199 | 46202 | 46204 | 46207 | 46209 | 46212 | 46215 | 46220 | 46223 | 46224 | 46225 |
| 46227 | 46230 | 46231 | 46232 | 46234 | 46235 | 46237 | 46238 | 46244 | 46245 | 46251 | 46252 |
| 46255 | 46256 | 46257 | 46258 | 46260 | 46262 | 46264 | 46265 | 46266 | 46268 | 46269 | 46270 |
| 46271 | 46272 | 46275 | 46277 | 46278 | 46279 | 46280 | 46281 | 46282 | 46283 | 46284 | 46288 |
| 46292 | 46293 | 46294 | 46296 | 46297 | 46298 | 46299 | 46300 | 46303 | 46304 | 46307 | 46308 |
| 46309 | 46311 | 46312 | 46313 | 46315 | 46317 | 46318 | 46319 | 46321 | 46325 | 46328 | 46329 |
| 46333 | 46336 | 46339 | 46340 | 46341 | 46347 | 46354 | 46356 | 46359 | 46361 | 46362 | 46367 |
| 46370 | 46372 | 46374 | 46378 | 46380 | 46381 | 46383 | 46385 | 46387 | 46388 | 46389 | 46391 |
| 46392 | 46393 | 46394 | 46395 | 46399 | 46400 | 46409 | 46412 | 46413 | 46414 | 46415 | 46417 |
| 46419 | 46420 | 46424 | 46426 | 46427 | 46428 | 46429 | 46430 | 46431 | 46433 | 46435 | 46437 |
| 46439 | 46440 | 46441 | 46442 | 46444 | 46446 | 46447 | 46449 | 46450 | 46451 | 46452 | 46454 |
| 46455 | 46456 | 46458 | 46459 | 46462 | 46463 | 46464 | 46467 | 46468 | 46469 | 46473 | 46475 |
| 46476 | 46477 | 46478 | 46481 | 46485 | 46486 | 46488 | 46489 | 46491 | 46493 | 46494 | 46495 |
| 46496 | 46497 | 46498 | 46500 | 46502 | 46504 | 46508 | 46510 | 46512 | 46515 | 46518 | 46519 |
| 46521 | 46522 | 46525 | 46526 | 46527 | 46530 | 46531 | 46533 | 46535 | 46541 | 46546 | 46549 |

TABLE 19-continued

Yield: Stress Tolerance

| | | | | | | | | | | |
|---|---|---|---|---|---|---|---|---|---|---|
| 46550 | 46551 | 46552 | 46555 | 46557 | 46559 | 46560 | 46562 | 46565 | 46568 | 46572 | 46573 |
| 46577 | 46578 | 46581 | 46582 | 46584 | 46585 | 46587 | 46588 | 46589 | 46590 | 46592 | 46593 |
| 46594 | 46597 | 46598 | 46599 | 46600 | 46607 | 46608 | 46609 | 46611 | 46612 | 46614 | 46615 |
| 46617 | 46618 | 46620 | 46622 | 46623 | 46626 | 46633 | 46635 | 46640 | 46642 | 46643 | 46644 |
| 46645 | 46649 | 46651 | 46653 | 46655 | 46658 | 46659 | 46667 | 46669 | 46670 | 46673 | 46674 |
| 46676 | 46679 | 46682 | 46683 | 46684 | 46686 | 46687 | 46688 | 46690 | 46691 | 46692 | 46694 |
| 46695 | 46698 | 46700 | 46702 | 46712 | 46713 | 46715 | 46716 | 46717 | 46720 | 46724 | 46725 |
| 46731 | 46736 | 46738 | 46739 | 46741 | 46746 | 46747 | 46749 | 46750 | 46752 | 46754 | 46755 |
| 46758 | 46760 | 46762 | 46766 | 46767 | 46770 | 46774 | 46776 | 46777 | 46782 | 46784 | 46787 |
| 46788 | 46794 | 46795 | 46797 | 46798 | 46800 | 46802 | 46803 | 46804 | 46806 | 46807 | 46808 |
| 46811 | 46812 | 46813 | 46814 | 46822 | 46828 | 46829 | 46832 | 46833 | 46834 | 46835 | 46842 |
| 46844 | 46845 | 46849 | 46850 | 46853 | 46854 | 46863 | 46866 | 46867 | 46868 | 46869 | 46870 |
| 46872 | 46875 | 46885 | 46888 | 46889 | 46892 | 46894 | 46901 | 46904 | 46906 | 46907 | 46908 |
| 46909 | 46910 | 46913 | 46914 | 46917 | 46920 | 46923 | 46927 | 46928 | 46930 | 46932 | 46933 |
| 46934 | 46941 | 46942 | 46943 | 46946 | 46948 | 46950 | 46952 | 46957 | 46958 | 46959 | 46963 |
| 46968 | 46970 | 46973 | 46977 | 46979 | 46981 | 46982 | 46984 | 46985 | 46989 | 46991 | 46993 |
| 46999 | 47000 | 47003 | 47009 | 47011 | 47013 | 47016 | 47017 | 47018 | 47019 | 47021 | 47025 |
| 47030 | 47031 | 47036 | 47037 | 47039 | 47042 | 47045 | 47046 | 47047 | 47050 | 47051 | 47052 |
| 47053 | 47057 | 47058 | 47059 | 47063 | 47067 | 47068 | 47070 | 47071 | 47072 | 47078 | 47079 |
| 47081 | 47082 | 47084 | 47085 | 47088 | 47089 | 47090 | 47092 | 47094 | 47100 | 47101 | 47102 |
| 47110 | 47112 | 47113 | 47114 | 47116 | 47117 | 47121 | 47123 | 47127 | 47128 | 47133 | 47135 |
| 47136 | 47137 | 47139 | 47140 | 47144 | 47146 | 47150 | 47151 | 47152 | 47154 | 47155 | 47156 |
| 47157 | 47161 | 47166 | 47167 | 47171 | 47174 | 47175 | 47176 | 47178 | 47184 | 47185 | 47187 |
| 47189 | 47190 | 47192 | 47198 | 47199 | 47201 | 47202 | 47203 | 47207 | 47211 | 47213 | 47216 |
| 47218 | 47219 | 47221 | 47222 | 47223 | 47225 | 47226 | 47227 | 47233 | 47236 | 47237 | 47238 |
| 47239 | 47240 | 47247 | 47249 | 47252 | 47254 | 47255 | 47262 | 47269 | 47270 | 47271 | 47277 |
| 47278 | 47279 | 47282 | 47285 | 47288 | 47289 | 47291 | 47294 | 47297 | 47299 | 47300 | 47301 |
| 47302 | 47304 | 47305 | 47306 | 47309 | 47310 | 47312 | 47318 | 47321 | 47325 | 47327 | 47332 |
| 47334 | 47335 | 47336 | 47337 | 47338 | 47339 | 47340 | 47343 | 47345 | 47346 | 47349 | 47351 |
| 47353 | 47354 | 47355 | 47356 | 47358 | 47360 | 47361 | 47362 | 47363 | 47365 | 47368 | 47371 |
| 47373 | | | | | | | | | | | |

TABLE 20

Lignin Biosynthesis

Table 20A SEQ ID NOs of Polypeptides useful for improving Lignin Biosynthesis

| | | | | | | | | | | |
|---|---|---|---|---|---|---|---|---|---|---|
| 492 | 507 | 721 | 833 | 1355 | 1356 | 1472 | 1539 | 1878 | 1928 | 1932 | 2023 |
| 2335 | 2337 | 2880 | 2924 | 3135 | 3566 | 3749 | 3785 | 3812 | 3831 | 3857 | 4051 |
| 4167 | 4408 | 4456 | 4659 | 4680 | 4949 | 5302 | 5677 | 5678 | 5679 | 5897 | 6195 |
| 6275 | 6276 | 6277 | 6278 | 6290 | 6302 | 6303 | 6321 | 6507 | 6508 | 6965 | 7164 |
| 7216 | 7418 | 7439 | 7707 | 7993 | 8165 | 8236 | 8547 | 8639 | 8700 | 8722 | 8961 |
| 9079 | 9115 | 9117 | 9281 | 9309 | 9398 | 9399 | 10218 | 10562 | 10717 | 10803 | 10892 |
| 11040 | 11058 | 11065 | 11345 | 11395 | 11462 | 11527 | 11556 | 11684 | 11765 | 11860 | 11865 |
| 11934 | 12024 | 12263 | 12329 | 12460 | 12631 | 12670 | 12818 | 12853 | 12950 | 13012 | 13016 |
| 13060 | 13100 | 13135 | 13170 | 13288 | 13372 | 13381 | 13482 | 13557 | 13850 | 13927 | 14042 |
| 14080 | 14111 | 14179 | 14207 | 14280 | 14347 | 14420 | 14511 | 14593 | 14671 | 14728 | 14787 |
| 14789 | 14922 | 14948 | 14953 | 14961 | 15152 | 15208 | 15360 | 15727 | 16111 | 16399 | 16538 |
| 16543 | 17022 | 17479 | 17563 | 17612 | 17614 | 17735 | 17952 | 18204 | 18212 | 18262 | 18393 |
| 18493 | 18736 | 18975 | 18984 | 19400 | 19507 | 19509 | 19514 | 19684 | 19750 | 19972 | 20111 |
| 20427 | 20462 | 20499 | 20552 | 20590 | 20721 | 20851 | 21322 | 22735 | 22884 | 22908 | 22951 |
| 23041 | 23211 | 23680 | 23682 | 23685 | | | | | | | |

Table 20B SEQ ID NOs of Polynucleotides useful for improving Lignin Biosynthesis

| | | | | | | | | | | |
|---|---|---|---|---|---|---|---|---|---|---|
| 24179 | 24194 | 24408 | 24520 | 25042 | 25043 | 25159 | 25226 | 25565 | 25615 | 25619 | 25710 |
| 26022 | 26024 | 26567 | 26611 | 26822 | 27253 | 27436 | 27472 | 27499 | 27518 | 27544 | 27738 |
| 27854 | 28095 | 28143 | 28346 | 28367 | 28636 | 28989 | 29364 | 29365 | 29366 | 29584 | 29882 |
| 29962 | 29963 | 29964 | 29965 | 29977 | 29989 | 29990 | 30008 | 30194 | 30195 | 30652 | 30851 |
| 30903 | 31105 | 31126 | 31394 | 31680 | 31852 | 31923 | 32234 | 32326 | 32387 | 32409 | 32648 |
| 32766 | 32802 | 32804 | 32968 | 32996 | 33085 | 33086 | 33905 | 34249 | 34404 | 34490 | 34579 |
| 34727 | 34745 | 34752 | 35032 | 35082 | 35149 | 35214 | 35371 | 35452 | 35547 | 35552 |
| 35621 | 35711 | 35950 | 36016 | 36147 | 36318 | 36357 | 36505 | 36540 | 36637 | 36699 | 36703 |
| 36747 | 36787 | 36822 | 36857 | 36975 | 37059 | 37068 | 37169 | 37244 | 37537 | 37614 | 37729 |
| 37767 | 37798 | 37866 | 37894 | 37967 | 38034 | 38107 | 38198 | 38280 | 38358 | 38415 | 38474 |
| 38476 | 38609 | 38635 | 38640 | 38648 | 38839 | 38895 | 39047 | 39414 | 39798 | 40086 | 40225 |
| 40230 | 40709 | 41166 | 41250 | 41299 | 41301 | 41422 | 41639 | 41891 | 41899 | 41949 | 42080 |
| 42180 | 42423 | 42662 | 42671 | 43087 | 43194 | 43196 | 43201 | 43371 | 43437 | 43659 | 43798 |
| 44114 | 44149 | 44186 | 44239 | 44277 | 44408 | 44538 | 45009 | 46422 | 46571 | 46595 | 46638 |
| 46728 | 46898 | 47367 | 47369 | 47372 | | | | | | | |

TABLE 21

Galactomannan Biosynthesis

Table 21A SEQ ID NOs of Polypeptides useful for improving Galactomannan Biosynthesis

| 24 | 438 | 1074 | 1109 | 1177 | 1244 | 1264 | 1879 | 2511 | 2515 | 2611 | 2778 |
|---|---|---|---|---|---|---|---|---|---|---|---|
| 2897 | 3068 | 3100 | 3156 | 3389 | 3658 | 3703 | 4011 | 4017 | 4041 | 4722 | 4782 |
| 5038 | 5118 | 5582 | 6089 | 6115 | 6181 | 6511 | 6515 | 6520 | 6768 | 6780 | 6870 |
| 7481 | 7542 | 7763 | 8221 | 8246 | 8820 | 8937 | 9087 | 9210 | 9402 | 9680 | 10116 |
| 10458 | 10529 | 10549 | 10746 | 11191 | 11430 | 11543 | 11846 | 12090 | 12204 | 12230 | 12427 |
| 12730 | 12896 | 13091 | 13245 | 13474 | 13753 | 13847 | 14243 | 14505 | 14601 | 14906 | 14993 |
| 15309 | 15424 | 15675 | 15792 | 16065 | 16174 | 16699 | 16741 | 16765 | 16796 | 17119 | 17150 |
| 17493 | 18047 | 18398 | 18527 | 18948 | 19100 | 19219 | 19251 | 19598 | 19862 | 19982 | 20293 |
| 20311 | 20330 | 20678 | 21036 | 21048 | 21242 | 21548 | 21920 | 22066 | 22206 | 22242 | 22882 |
| 23056 | 23093 | 23411 | 23454 | 23611 | | | | | | | |

Table 21B SEQ ID NOs of Polynucleotides useful for improving Galactomannan Biosynthesis

| 23711 | 24125 | 24761 | 24796 | 24864 | 24931 | 24951 | 25566 | 26198 | 26202 | 26298 | 26465 |
|---|---|---|---|---|---|---|---|---|---|---|---|
| 26584 | 26755 | 26787 | 26843 | 27076 | 27345 | 27390 | 27698 | 27704 | 27728 | 28409 | 28469 |
| 28725 | 28805 | 29269 | 29776 | 29802 | 29868 | 30198 | 30202 | 30207 | 30455 | 30467 | 30557 |
| 31168 | 31229 | 31450 | 31908 | 31933 | 32507 | 32624 | 32774 | 32897 | 33089 | 33367 | 33803 |
| 34145 | 34216 | 34236 | 34433 | 34878 | 35117 | 35230 | 35533 | 35777 | 35891 | 35917 | 36114 |
| 36417 | 36583 | 36778 | 36932 | 37161 | 37440 | 37534 | 37930 | 38192 | 38288 | 38593 | 38680 |
| 38996 | 39111 | 39362 | 39479 | 39752 | 39861 | 40386 | 40428 | 40452 | 40483 | 40806 | 40837 |
| 41180 | 41734 | 42085 | 42214 | 42635 | 42787 | 42906 | 42938 | 43285 | 43549 | 43669 | 43980 |
| 43998 | 44017 | 44365 | 44723 | 44735 | 44929 | 45235 | 45607 | 45753 | 45893 | 45929 | 46569 |
| 46743 | 46780 | 47098 | 47141 | 47298 | | | | | | | |

Table 1 Column Descriptions

Seq num provides the SEQ ID NO for the listed polynucleotide sequences.

SeqID provides an arbitrary sequence name taken from the name of the clone from which the cDNA sequence was obtained.

cat_type indicates the classification scheme used to classify the sequence. GO_BP=Gene Ontology Consortium–biological process; GO_CC=Gene Ontology Consortium–cellular component; GO_MF=Gene Ontology Consortium–molecular function; KEGG=KEGG functional hierarchy (KEGG=Kyoto Encyclopedia of Genes and Genomes); EC=Enzyme Classification from ENZYME data bank release 25.0; POI=Pathways of Interest.

cat_desc provides the classification scheme subcategory to which the query sequence was assigned.

hit_desc provides the description of the BLAST hit which resulted in assignment of the sequence to the function category provided in the cat_desc column.

hit_p provides the E value for the BLAST hit in the hit_desc column.

pct_ident refers to the percentage of identically matched nucleotides (or residues) that exist along the length of that portion of the sequences which is aligned in the BLAST match provided in hit_desc.

qry_range lists the range of the query sequence aligned with the hit.

hit_range lists the range of the hit sequence aligned with the query.

qry cvrg provides the percent of query sequence length that matches to the hit (NCBI) sequence in the BLAST match (% qry cvrg=(match length/query total length)×100).

hit cvrg provides the percent of hit sequence length that matches to the query sequence in the match generated using BLAST (% hit cvrg=(match length/hit total length)×100).

Species provides the name of the organism from which the cDNA was isolated.

Product_concept column provides the plant biological properties that may be modified by expression of the listed polypeptides.

All publications and patent applications cited herein are incorporated by reference in their entirely to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (47374 sequences)

SEQ ID NO: 1 - protein, 304 aa, Aquifex aeolicus
MGVRKLKPVTNGTRHAVLYDFEEIEKLVRKGKEWVLLKKNQVEPEKSLLKWWHRAKGRSRQRGNITARHRGGGHKKLYRIIDFKRDKSLVPAKVVSIEYDPFRSARICLLHYADGEKRYIIWPEGLKVGDTVMSISWEDAEAGKPLPEIKPGNAMPLKYIPEGTIVHNIEFIPGKGGQIARAAGTWAQVLGRSTRKGYVLVRMPSGEVRMIHERCMATVGRVGLAEHELVKLGKAGRARWLGWRPHTRGTAMNPVDHPHGGGEGRTRGKHPESPWGWKTKGYKTRRGKKYSDQFIVTRRDGRPL

SEQ ID NO: 2 - protein, 219 aa, Aquifex aeolicus
MLIAVPLDDTNFSENLKKAKEKGADIVELRVDQFSDTSLNYVKEKLEEVHSQGLKTILTIRSPEEGGREVKNREELFEELSPLSDYTDIELSSRGLLVKLYNITKEAGKKLIISYHNFELTPPNWIIREVLREGYRYGGIPKIAVKANSYEDVARLLCISRQVEGEKILISMGDYGKISRLAGYVFGSVITYCSLEKAFAPGQIPLEEMVELRKKFYRL

SEQ ID NO: 3 - protein, 376 aa, Aquifex aeolicus
MTYLMNNYARLPVKFVRGKGVYLYDEEGKEYLDFVSGIGVNSLGHAYPKLTEALKEQVEKLLHVSNLYENPWQEELAHKLVKHFWTEGKVFFANSGTESVEAAIKLARKYWRDKGKNKWKFISFENSFHGRTYGSLSATGQPKFHKGFEPLVPGFSYAKLNDIDSVYKLLDEETAGIIIEVIQGEGGVNEASEDFLSKLQEICKEKDVLLIIDEVQTGIGRTGEFYAYQHFNLKPDVIALAKGLGGGVPIGAILAREEVAQSFTPGSHGSTFGGNPLACRAGTVVVDEVEKLLPHVREVGNYFKEKLKELGKGKVKGRGLMLGLELERECKDYVLKALEKGLLINCTAGKVLRFLPPLIIQKEHIDRAISVLREIL

SEQ ID NO: 4 - protein, 437 aa, Aquifex aeolicus
MKLSVIGGGYVGLVTAACFSHLGHEVLVVEKIPEKVELLRRGKSPIYEPGLEELLREGINEGRLSFTTDIKEGIEFSEVIFICVGTPSNPDGSADLSQVEEVARFTAKYMDSYKLLVNKSTVPVGTQRKVKRTVRLYLKNKELEFDVASNPEFLREGHAVKDFLEPDRIVVGVESERAKEVLLEIYKPITDKGFPILITNPPTAEIIKYASNTFLATKISFINMISDLCEKVGANVEEVAQGMGYDKRIGKEFLRAGLGWGGSCLPKDTKAFIRILEELGVDATILKGALGINESRVDRLLQKLKDALWILKGKTIAIWGLSFKPNTDDIREAPSLKVVERLLREGAKIRAYDPKATENFKRVFIEGEDLRYFDDKYKAVEGAEALLILTEWDEFKRANLERVKRLMELPIIIDGRNIYDPQEVRNLGFEYYSMGRP

SEQ ID NO: 5 - protein, 192 aa, Aquifex aeolicus
MREAEVFRETRETKIKLYINLDGSGNYEVNTPVGFLTHMLESFAKHGRFDLKVEAEGDVHVSHHHTVEDCGIVLGQAVLKALGDKKGIRRYGYSIIPMDEALVLSSIDISGRPLFFYEDKDLRGKITEFDFELIWEFFKGFALESRSTLHIKVLDGKILHHVAEACFKSFAITLKEAVKVEGSGVPSTKGVI

SEQ ID NO: 6 - protein, 306 aa, Aquifex aeolicus
MDLSVELFGIRFKNPVWVASGTFGYGVEAAEIYDISKLGAVVTKGLSLKERLGNETPRIVETPCGMLNSIGLQNPGVEKFLKEIYPKIKDVDTHFIANVFGETEEEYVEVCMALEDADKIVAYELNVSCPNVKKGGILFGHDPVILGNLVDRIKAKIKKPLLVKLSPNVTDVTEFAKVCIENGADGLVLINTLMGMKINIWKRKPDLATKTGGLSGPAILPIAVRMIYQVYEKFGDRIPIIGVGGITTWEDAMEHVMAGASAVQVGTANFYEPLAPLKVIEGIENFMKSQNIKDFKELIGIAHRVE

SEQ ID NO: 7 - protein, 150 aa, Aquifex aeolicus
MDIQEIMEILPHRYPILLVDKILEIEEGKRIIGLKNVSVNEPVFQGHFPGFPLFPGVYILEAMAQVGGILMIKSLNLEIGKYAVVFAGIDDARFKKPVYPGDQLILELEVISLKKALSKMKGVAKVDGEVVAQATLMAAARKLEDIKRNA

SEQ ID NO: 8 - protein, 322 aa, Aquifex aeolicus
MLTDLGLLTLGFFLLVKGADMLIEGAGGLARRFGIPEFVIGLTLVAFGTSLPEFTVNVSAALKDASGISLGNVIGSNIANILLILGVASLIKPLTVHATFVKKEIPVNFFLTLTLIVMANDVILNHAPVSLISRGDGLVLIITFLGYMYFLVAYLERDSILEGEMKESISPFKGFIYFILGLTGLSLGADWTVDGAVGLAKALGVSEAVIGLFVVAIGTSLPELFASAVSAYKGNPDIALGNVAGSNIFNATLVLGTSSVIRDIPVPERANVDLGVLFIATLLLLISSIWGKRKYTLDRMEGGIFLLAYFIYVIASWYRELS

SEQ ID NO: 9 - protein, 170 aa, Aquifex aeolicus
MKRPIMLIDLDRCIGCLSCEVACVQEKGLESLYIRPMKVFRVEGISEEPGAFYYPMNCFHCDPAPCVVACPTSAMRKREKDGIVYVEQTLCIGCKACIIACPYGAITFNPATQKVEKCDYCYKRVDKGLLPSCVEKCVTNCLYFVEVDEVPKERHKLKRIDEKLYEEIFS

SEQ ID NO: 10 - protein, 398 aa, Aquifex aeolicus
MSLRYLRFLTAGESHGKGLTAILEGIPANLPLSEEEINHELRRRQRGYGRGGRMKIEKDTAEILSGVRFGKTLGSPIALFIRNRDWENWKEKMAIEGEPSPSVVPFTRPRPGHADLSGGIKYNQRDLRNILERASARETAARVAVGAVCKKFLSEFGIKIGSFVVSIGQKEVEELKDKSYFANPEKLLSYHEKAEDSELRIPFPEKDEEFKTYIDEVKEKGESLGGVFEVFALNVPPGLGSHIQWDRRIDGRIAQAMMSIQAIKGVEIGLGFEAARRFGSQVHDEIGWSEGKGYFRHSNNLGGTEGGITNGMPIVVRVAMKPIPTLKNPLRSVDIETKEEMKAGKERTDIVAVPAASVVGEAMLAIVLADALLEKLGGDFMEEVKKRFEDYVNHVKSF

SEQ ID NO: 11 - protein, 801 aa, Aquifex aeolicus
MTMYVIKRSGRKEKLDINKIRIAIKFACEGLNVDPLELEADAQIQFRDGITTKEIQQLLIKTAAEKVSAERPDWTYTAARLLLYDLYKDVAHLRGYSLRDDLGKYKPYNRKNFYSFVKEYVEKGIYGEYLLENYSEEDFNKLANYIKPERDLYFTYTGIKILYDRYLVRDEEGRVIELPQEMYMLIAMTLAVPEKPEERLKWAKKFYDVLSEHKVTVATPTLMNARRPFTQLSSCFVLTVDDDLFDIFDNVKKAGMISKFAGGLGVYLGKIRATGAPIRKFKGASSGVIPVVKLINDTMTYVDQLGMRKGSASITLDIWHKDILDFLEVKTNVGDERKKAHDIHPAVSIPDLFMKRLKNREDWTLIDPYWARQYITRKIYDGKYKEVKPLPGSHYYVGIKEDGTQDILEPKGLEDFYGEEFEKWYLELEENLPSYAKKKVNSFELWKRLLTVAFETGEPYIFFRDEANRKNPNKHTGMVYSSNLCHEIVQTMSPSKHEKPVLDPETGEITYKKEAGDLPVCNLGSVNLGKVHTEEEIKEVLPLLVRMLDNVIEMNFYAIPEAEYTNKRYRAIGIGVSNYHYCLVKNGIKWESEEHLKFADKLFELIAFYALKGSLELAKERGRYKLFDGSNWSKGILFGRSVEEIEENSRQNGNNLPWRELAEEIKKYGIRNAYLLALMPTGSTSLILGATPSIDPIFARFYKEENMSGILPQVPPEVDRFYWHYKTAYTIDHEWTIRAAAVRQKWIDQAQSLNLFVDPQNIDGPRLSRLYELAWELGLKTIYYLRSRSAMDIEECEACSV

SEQ ID NO: 12 - protein, 397 aa, Aquifex aeolicus
MLRKKTLRDVDVKGKRVLVRVDYNVPLDEQGNIVDDTRIRASLPTVEYLLDANAKVILMSHLGRPKNRDPKYSLAPVAKRLSRYINKEVKLAPDCVGEEVKRIVNSMKEGDVVLLENLRFHKEETECDENFARELASLGEVYVADAFGTCHRKHASVYLVPKFLKPAVMGFLLEKEITYFEKAMVAPQRPVVAILGGAKVSSKLEVIKNLIRRVDKLFIGGAMAFTFLKAMGYKVGNSLVEDDLQDVARDLIDVAKKLEIKLYLPVDFVIGQEVSENTPTKVVPWQEIPDGWMGLDIGPVSVELVKEIISDAQTIVWNGPMGVFEIDKFKHGTIEVAKLLAQSSALTIAGGGDTDHAIHKAGVYHAFDFVSTGGGAFLELLAGKELPCLVNLDDKEA

SEQ ID NO: 13 - protein, 342 aa, Aquifex aeolicus
MKYDVAIVGAGPGGSTCAYVLAKKGVRVLLIDSRKEVGYPVQCAEFVPVQLSYEFPEFFPEETIAQKVKDMVHYTPWGEIVSMYSEGFILHREKWDKGIAKLAEKEGAHLRTKTKFIGFEGKYLILKDLNKREVFKVKADIVVGADGARSLVAKLTGEHTKEFLITAQYTLKLKKPLNDLLIFFRDYIPGGYGWIFPKQELANVGVGVDLSYGVNVVEVLNKFVKEVKDFVEPEPIYGRTGGFIPGEGIKNPFRGNVLLVGDAGGFCHPITGGGIANAVITGSIAARAILEGDLEEFEEEALDTLGPSINRAAQKRKKLMKEWDNLEWRIPRTWIAFEEYYK

SEQ ID NO: 14 - protein, 315 aa, Aquifex aeolicus
MKVFITGATGFVGRHIVRELLNRGYEVHAGVRNLSKLERLFGNQVKGYIVNFDEKDSIREALGKVNPDFVIHLIGILYEEKKKGITFERVHYGHTKNLVEVSKGFNVKKFLFMSALGTHDEAPSRYHQTKRWAEREVINSGLNYTIFRPSIILGPEQKLFFDMYKITKYIPVVALPDFGNYQFQPVDVRDVACAYAEALKNPETDRKIYELCGTKVVTFKELLADIFSYWDRKVLMIPMPKKLMYFAGLIVEKIIEPPPFSSDQIKMMWKPNVCGVLKDEAISNGIKSICKREPIPYEESLKWSLENFDIIIKGK

SEQ ID NO: 15 - protein, 265 aa, Aquifex aeolicus
MHAIILTMRVGIVGFGNMGQAFALCFSKKLGKENIIVTDKVQEKRNLATEMGIAFASDVKFLADNSDVVLVAVKPKDSQEVLQKLKDYKGIILSIMAGVSIEKMEKILGKDKKIVRVMPNVNVAVGSGVMAITDNGNLSEEERSKVEELLLSCGTLYRIEERLFDAFTALAGSGPAFVFSFIDALALAGVHQGFSYEQALRIALDTVMGSAKLLKEFQVNPNELIAKVTSPGGTTIEGIKYLEEKGFKGTVMECINRTSQKAKKL

SEQ ID NO: 16 - protein, 453 aa, Aquifex aeolicus
MWELDPKTLEKWDKEYFWHPFTQMKVYREEENLIFERGEGVYLWDIYGRKYIDAISSLWCNVHGHNHPKLNNAVMKQLCKVAHTTTLGSSNVPAILLAKKLVEISPEGLNKVFYSEDGAEAVEIAIKMAYHYWKNKGVKGKNVFITLSEAYHGDTVGAVSVGGIELFHGTYKDLLFKTIKLPSPYLYCKEKYGELCPECTADLLKQLEDILKSREDIVAVIMEAGIQAAAGMLPFPPGFLKGVRELTKKYDTLMIVDEVATGFGRTGTMFYCEQEGVSPDFMCLGKGITGGYLPLAATLTTDEVFNAFLGEFGEAKHFYHGHTYTGNNLACSVALANLEVFEEERTLEKLQPKIKLLKERLQEFWELKHVGDVRQLGFMAGIELVKDKEKGEPFPYGERTGFKVAYKCREKGVFLRPLGDVMVLMMPLVIEEDEMNYVIDTLKWAIKELEKEV

SEQ ID NO: 17 - protein, 476 aa, Aquifex aeolicus
MIEKKMLIGGEWVDKEEKIEVIYPYTRKPIGRVPKGDEKDVEKAIERAKEGFKEIFSLTAYERYEILMRAAQLLKERAEEFAKTLVLEVGKTIREARTEVQRAIQTLIFSAEEAKRVNGETFPIDAHPNGKGKLGFYIRVPVGIVSAITPFNFPLNLSMHKVAPALAAGNAVILKPSERTPLTPLMLGEILLEAGVPPKALSVIPGYGDVGKAMTTHPDVRVVSFTGSRKVGDIIARQVGIKKLVLELGSNSAIILHKDGNLEKAVEKTVQGGYAIAGQVCISVQRVFVHEDLYDEFIKRLKERVSKLKVGDPMNEDTDLGPMIAPSELERIQEWISEAVQKGAKIEAGGLRCAEDETIFSPTIVSLVPEDSKLFKEEAFAPVVAVNPYKDIEEAIRWVNSSDYGLQVGVFTNDVKLAWKCIKEIEAGGVLINEGPTFRADHMPYGGVKYSGIGREGPKFAIEDYTEIKTVIFDLT

SEQ ID NO: 18 - protein, 666 aa, Aquifex aeolicus
MKRFQCPYCGVGCGLYINEKGKVKGDFEHPANLGDICKKPLYLPKVLNRGRIAKPMYRENKSHSFREISWEEAYEILKEKLISFSPDETYFYLSGQLLTEDIYVANKFVKGFLRTNNVDANSRLCMASAVTAYKLAFGSDGVPCTYEDVDDADAFLFIGSNAAVAHPVLFKRVLKRRKEEEKVIIVTVDPLETETAKRSDVFIQIKAGTDTVFLNSVLYVLHKEGWIDYRFIYNYTEGFEEALEVAMKFPPDVAASICSVKPEDVYLVAELFAHSKKLISFWCQGLNQSLNGTMKNLALINLHLATGRLNEKGCPFSLTGQPNAMGGREVGYLTNGLPGYRDVRNKADRAFMEKFWGVKGIKKEPGPTITEAIDMILKDRIKFLWVVCTNPAVSLPNLEKVKRALEKVFLVVQDAYWNDTCEFANLILPAAQLGEKEGVMTGSDRTVTFCERFSEPFGESKPDWLIFTELARKMGAEELFPYSSPKEIFEEFKASTKGRLCDMSNLSYENLPARWGKRWLYEDLKFPTESGKARFHPARVDVAAEEGMFILLTGRLKNNWHTMTRTGKSPELLKGEIPPFVIMNPRDAEELGIEEGEEVILSAKGKEITRVVRFGNVKRGHIFAPFGYPSEYGEPTNLLTSDRTDPYSKEPDLKYSGVDVFVKVNR

SEQ ID NO: 19 - protein, 184 aa, Aquifex aeolicus
MAIDKEKIKQAVRLFLEGIGEDPDREGLKETPERVARMWEEFERMRNFDMKLFEEFGGYNEMVLVKDIKFYSLCEHHLLPFFGKVHIAYIPDKKISGLSKLVRTVRAFALRPQVQERLTEEIADFLEKELEPKGVGVVIEAEHLCMSMRGVMSPGHLTVTSALRGVFLKDIKTREEFLKLVKGV

SEQ ID NO: 20 - protein, 795 aa, Aquifex aeolicus
MNELFQTPQVEAGIKEYPLMPLRDIVIFPTMVQPLFVGRRFSIRAIEEANKKDKLIFLVLQKDKDVEEPKEEDIYKVGVVAYILRTVPIEDARVKVLVQGLKRGVIKKLEWKEDHYVAQVDVIEERDIPPESQTIEDKALIKAVKESIDKLVSLGKQIIPDLVVLIKELEEPGKLADMVASILDIKSSQAQEILETFDPRERLKKVYKFLQDEIGLLEVKQRISEIARERMEKEQREYYLRQQLKAIQEELGEAGGIKAEIEEYTKKFEEVKECMPEEGVKEVEKNIKRLERLHPESAEAGVIRTWLDWVLDLPWCTRTEDNYDLERAREILDRDHYDLEKVKDRIIEYLAIRKLTQGKEAPTQILAFVGPPGVGKTSLGRSIAEALGRKFVRIALGGIRDEAEIRGHRRTYVGAMPGRIIQAIKQAGTKNPVIMLDEIDKLAISFQGDPAAALLEVLDPEQNKKFTDLYIGIPFDLSEVIFICTGNRADTIPTPLLDRMELIMLSGYSEEEKLFIAKKHLIPKLIPLHGFSPEEIEFTDEAILEIIRGYTREAGVRNLQRQISAVLRKIAVKKLQGEKGPFNITPELVRKLLGVPRYRPEREKKPLVGVATGLAWTEVGGEIMFIEATKMKGKGSLVLTGSLGDIMKESAQAALSYIRSKAEDYGIDPDIFSQVDVHVHVPEGAVPKDGPSAGVAIATALLSLFTDIPVRMDVAMTGEITLRGRVLPVGGLKEKILAAKRAEIYEVILPAKNKDEVMEELPEYVREKMTLHFVDNLEEVFKIALVREPKPLKEA

SEQ ID NO: 21 - protein, 364 aa, Aquifex aeolicus
MKKYKIAVLKGDGIGPEIVEQALRVLDKIGEIYGVEFEYREGLIGGEAIDKTGDPLPEETLKICKESDAILLGAVGGPKWDNLPTDKRPEKGLLRIRKELDLYANLRPAKVWDALISSSPLKEEVVKGTDMIVIRELTSGIYYGEPRGIFEENGKRYAINTMKYTEDEIRRIVRKGFEIARKRRKKLTSVDKANVLEVSALWRQIVEEEKENYPDVELEHLYIDNCAMQLVRRPTSFDVIVTGNIFGDILSDEAGVVVGSLGMLPSASIGDRYALYEPVHGSAPDIAGKGIANPIATILSAAMMLKYSFNMDKAHDLIEKAIEETLNQGYRTPDIYSEGCIKVGTKEITDKILENLERLKDAYT

SEQ ID NO: 22 - protein, 323 aa, Aquifex aeolicus
MYPVWGTEGSNPSPSAIPAMKIRIGTRKSKLALWQANYVKDFLEKHWGVEVELVKITTTGDKITDVPLAKIGGKGLFVKEIEKALLEGSIDLAVHSLKDVPMVIPKGLKLGAITKRENPYDVLISRSGKKLYELPSGSVIGTSSLRRQVQIKKRRRDLKVEVLRGNVDTRMRKLKEGLYDAVILAYAGVKRMGYESEITEVLEDFIPAVGQGSLAIEIREGDKRIEELIKPLNNEESFLCAIAERTFLRRLEGGCQVPVGAFAKIENGTLKMKAFISDIEAERYIEGYREGNPEEAEKLGLSLAEELLKKGGEEILKEIYSSQ

SEQ ID NO: 23 - protein, 387 aa, Aquifex aeolicus
MFEFSDRLKVLPPYLFAELDRKKQEKIEQGVDVIDLGVGDPDMPTPKPIVEAAKKALENPENHKYPSYVGKYEFRKAVADWYKRRFDVDLDPNTEVITLIGSKEGIAHFPLAFVNPGDIVLCPDPAYPVYRIGAIFAGGTPYTVPLKEENNFLPDLDSIPEDVAKKAKIIWINYPNNPTSAPPTLEFYKKLVDWAKEYNVIIASDNAYSEIYTGQEKPPSILQVPGAKDVAIEFHSLSKTYNMTGWRIGMAVGNKELVAGLGKVKTNVDSGQFGAVQDAGIVALNLPEEEVEKIRDVYRERKKIMTEALEKIGLEIYRSDYTFYLWIKVPEGYTSAEFVGRLIDEAGIVCTPGNGFGEYGEGYFRISLTVPTERLLEAAERIKNLKL

SEQ ID NO: 24 - protein, 592 aa, Aquifex aeolicus
MCGIVGYVGRDLALPIVLGALERLEYRGYDSAGVALIEDGKLIVEKKKGKIRELVKALWGKDYKAKTGIGHTRWATHGKPTDENAHPHTDEKGEFAVVHNGIIENYLELKEELKKEGVKFRSETDTEVIAHLIAKNYRGDLLEAVLKTVKKLKGAFAFAVITVHEPNRLIGVKQGSPLIVGLGEGENFLASDIPAILPYTKKIIVLDDGEIADLTPDTVNIYNFEGEPVSKEVMITPWDLVSAEKGGFKHFMLKEIYEQPKAINDTLKGFLSTEDAIPFKLKDFRRVLIIACGTSYHAGFVGKYWIERFAGVPTEVIYASEFRYADVPVSDKDIVIGISQSGETADTKFALQSAKEKGAFTVGLVNVVGSAIDRESDFSLHTHAGPEIGVAATKTFTAQLTALYALSVRESEERENLIRLLEKVPSLVEQTLNTAEEVEKVAEKYMKKKNMLYLGRYLNYPIALEGALKLKEISYIHAEGYPAGEMKHGPIALIDENMPVVVIAPKDRVYEKILSNVEEVLARKGRVISVGFKGDETLKSKSESVMEIPKAEEPITPFLTVIPLQLFAYFIASKLGLDVDQPRNLAKTVTVE

SEQ ID NO: 25 - protein, 859 aa, Aquifex aeolicus
MEKSEKELTPMLSQYHYFKNQYPDCLLLFRLGDFYELFYEDAYIGSKELGLVLTSRPAGKGKERIPMCGVPYHSANSYIAKLVNKGYKVAICEQVEDPSKAKGIVKREVVRVITPGTFFERDTGGLASLYKKGNHYYVGYLNLAVGEFLGAKVKIEELLDLLSKLNIKEILVKKGEKLPEELEKVLKVYVSELEEEFFEEGSEEILKDFGVLSLQAFGFEEDTYSLPLGAVYKYAKTTQKGYTPLIPRPKPYRDEGFVRLDIKAIKGLEILESLEGRKDISLFKVIDRTLTGMGRRRLKFRLLSPFRSREKIERIQEGVQELKENREALLKIRQILEGMADLERLVSKISSNMATPRELVYLKNSLKKVEELRLLLLELKAPIFKEILQNFEDTKKIINDIEKTLVEDPPLHVKEGGLIREGVNAYLDELRFIRDNAETYLREYEKKLRQETGIQSLKIGYNKVMGYYIEVTKPNLKYVPSYFRRRQTLSNSERFTTEELQRLEEKILSAQTRINDLEYELYKELRERVVKELDKVGNNASAVAEVDFIQSLAQIAYEKDWAKPQIHEGYELIIEEGRHPVIEEFVENYVPNDTKLDRDSFIHVITGPNMAGKSSYIRQVGVLTLLSHIGSFIPARRAKIPVVDALFTRIGSGDVLALGVSTFMNEMLEVSNILNNATEKSLVILDEVGRGTSTYDGIAISKAIVKYISEKLKAKTLLATHFLEITELEGKIEGVKNYHMEVEKTPEGIRFLYILKEGKAEGSFGIEVAKLAGLPEEVVEEARKILRELEEKENKKEDIVPLLEETFKKSEEAQRLEEYEEIIKKIEEIDIGNTTPLQALLILAELKKKCSFSKKESGA

SEQ ID NO: 26 - protein, 338 aa, Aquifex aeolicus
MPKNDLLLRSLRGEPIGRFPVWLMRQAGRYMPEYRKIRNRVKNFLELCKNVDLATEISLLPLKILGVDAIIIFSDILVPLEPLGVKVEFVEGEGPKLSWSGKVSDLKKYDPSQNAYVYEIIKRVKEAQDEVPVIGFAGAPFTLLSYLIEGGASKDFKSTKLFMWENPKEYKRLMDILTETVLAYLKEQIKAGADVVQIFDSWVNNLSLEDYGEYVYPYVNYLISELKDFSDTPVIYFFRGSSSFIDLAVDYRADALSVDWSVDIPELFKIYDKGFQGNLEPAVLYASEEVIEEKTLGLLRRIPVKTRYVFNLGHGLAPDMELEKVKYLVDLVKSFPLT

SEQ ID NO: 27 - protein, 247 aa, Aquifex aeolicus
MRRLIAANWKMNKTVKETEEYINTFLKFVEHPESREILICPPFTSLYVAGKMLQGTGVKLGAQNCHYEKRGAFTGEISIPMLQEVGCEYVIVGHSERRHIFGESDELIHKKIVACLEMGIRPILCVGEKKEEREAGMTFKVIETQIKLALTGVEEHTDKIDIAYEPVWAIGTGTPATPEDAVEVHTFIRNLINQLNPKNEGKTRILYGGSVNPQNAKEFMKHEEINGLLVGTASLDPESFAKIVYSF

SEQ ID NO: 28 - protein, 291 aa, Aquifex aeolicus
MRSLISSLDLTREEVEEILKYAKEFKEGKEETIKASAVLFFSEPSTRTRLSFEKAARELGIETYLVSGSESSTVKGESFFDTLKTFEGLGFDYVVFRVPFVFFPYKEIVKSLNLRLVNAGDGTHQHPSQGLIDFFTIKEHFGEVKDLRVLYVGDIKHSRVFRSGAPLLNMFGAKIGVCGPKTLIPRDVEVFKVDVFDDVDKGIDWADVVIWLRLQKERQKENYIPSESSYFKQFGLTKERFEKVKLYMHPGPVNRNVDIDHELVYTEKSLIQEQVKNGIPVRKAIYKFLWT

SEQ ID NO: 29 - protein, 371 aa, Aquifex aeolicus
MRKTAILALEDGSYFVGYSFGAEGETGGELVFNTSMTGYQEILTDPSYKGQIVVMTYTQIGNYGVNDEDIESKSVQVNGFVVKEAFFRYSNWRAKKSLDEYLKENNVVGIYGIDTRALVKKIREKGSMKGVISTVEKDPKKLVQKARELPDISEQNLVEEVSAKDIYYWNQGDYDPRRGFLYRENEKPLVAVIDFGVKFNILRRLVSEGAKVVVVPPENAKEAIEKINPDAIFLSNGPGDPERVISGIRLTREYMEKKPIMGICLGCQIIGLALGGKTYKLKFGHHGGNHPVKDLRTGKIEITAQNHNFAIDPESLPEDVEVTHLNLLDNTVEGIKHKHLPIFAVQYHPENSPGPHDSYYLFKEFVKMAQG

SEQ ID NO: 30 - protein, 373 aa, Aquifex aeolicus
MDRLEKVSPFIVMDILAQAQKYEDVVHMEIGEPDLEPSPKVMEALERAVKEKTFFYTPALGLWELRERISEFYRKKYSVEVSPERVIVTTGTSGAFLVAYAVTLNAGEKIILPDPSYPCYKNFAYLLDAQPVFVNVDKETNYEVRKEMIEDIDAKALHISSPQNPTGTLYSPETLKELAEYCEEKGMYFISDEIYHGLVYEGREHTALEFSDRAIVINGFSKYFCMPGFRIGWMIVPEELVRKAEIVIQNVFISAPTLSQYAALEAFDYEYLEKVRKTFEERRNFLYGELKKLFKIDAKPQGAFYVWANISDYSTDSYEFALKLLREARVAVTPGVDFGKNKTKEYIRFAYTRKIEELKEGVERIKKFLEKLS

SEQ ID NO: 31 - protein, 492 aa, Aquifex aeolicus
MSVVISIDVGTTRVKVIAFSKNGKIVAISDREVSQIYPEPGWVEQDPLELWEAVRKSLSEVIQQVGLKEINSIGITNQRETVILWDKETGRPVYNAILWQDLRTEDICRKLSEYSEYIKENTGLLLHPYFSASKVNWIIENVNGVKKDIERGKVIFGTVDTWILWNLTGGKVHKTEPSNASRTLLFNIKRLEYDDELLKIFRIPKNILPEVNESSSLFGYTDKSITGVEIPITGILGDQQASLFAHGIRELEEVKNTYGTGLFLMLLTGSKPIIPERLLGTVAWVINGKVNYAIEGSVLTGGACIKWLMDRLKLIKQAADTEYLAKSISSNEGVYFVPAFSGLGAPYWDASARGIIIGITGRTRIEHIARAALEAIAYQTRDVIEEMEKETGVKIKILKADGGASQNNFLMQFQADILGIPVERPRHVELTALGAAGIAGIYSGMWKSKEEFIEDTREVELTFSPEMKKEERELYYSKWKDAVKRAMKWSML

SEQ ID NO: 32 - protein, 426 aa, Aquifex aeolicus [sequence omitted]

SEQ ID NO: 33 - protein, 431 aa, Aquifex aeolicus
MSSGDTELRKRIEFIIFGGTGDLSRNKLIPAILKLKDKIDLKKIYILGRNRKKFEEIKEKFKDFSELFVFVEFLAEREESYKNISSILGKESLKVFYLAVPPDLFKEILENVGKYLNFPEKRIVIEKPFGLSLKHAKDLNKIISVYFKEEEIFRIDHYLGKPQVQNILAFKFSNYVFSEVLNKCLVEKVEVIALEEVGVEGRKAYYEKVGVIRDMLQNHMLLLSSLIVMRLPPRAEDFHFELKNALKRAEFESESLILGKYKSYQGKAPTFALVKLHFDDERFTGVPFVLATGKKLKKKLTRVCIHFKNFPKEIERLLGCVPERNLLVFELYPEQEVSFRVNVISPLGFLRCTESINWRVSLKDVLGEIPEAYESLLLDVIRGDKTLFLDAEETEILWEKTEPLLKKEKEVLTYDDRVLIPEFAEDFISCL

SEQ ID NO: 34 - protein, 499 aa, Aquifex aeolicus
MEQGYRTISRKTLRPLQKDIRKITFLCKAECSRKRIIQYSIMIKFGTDGWRARIAEEFNFDNVRRVAKAHAEVLKEKGVKRVIVGYDWRFRSEDFAKAVYDVFRSEGLEAKLVGSACTTPMVSFAVKYLGYENGVMITASHNPPAYNGYKIKESFGGSATPEFVKNVEEKVKDIESVEIKEFEPEYQEVRKKYVEKIREFFDMDLFKEKKTLVVHDSMHGTSSGLLDFVLRDTKVSVINIRKDRDPLFGGHPPEPIEKYMEITKEKVRALGAELGIANDGDGDRIALVDDKGNYVNTQLIYAMLLLHLLENKGKRGKVVKTVSTTYLADRICKEFGVPLIEVGVGFKNINEIILKEGGVIFGGEESGGYGIPEYLPERDGIFSALNILELLYLKDKKVSEVVAEIFERFGEAYYKRVDLRVKEKIKGRIKELKENPPERIGEFKVREVKTIDGVKFVFEDDSWLLMRPSGTEPLIRVYAETPTKEEVEKIIQKGLELLK

SEQ ID NO: 35 - protein, 178 aa, Aquifex aeolicus
MKEIRGKKLKLLLKEEDIKRRVKELAKEIESSYSWEEPIVVVGLLKGAFIFLADLVRAFDRFVFVEFMQVSSYGKGMKSSGTIKIVKDLDMDIEGKEVLLVDDILDTGLTMKEIHDYLLMKKPKVLKTCVFLDKKERRKVDFNADFVGFEVPDKFLVGYGLDWGEYGRNLPEVYMVED

SEQ ID NO: 36 - protein, 230 aa, Aquifex aeolicus
MLFMHLKLKVFRYNPETGERKYDYFEVPYEEGMTFLRAFQKIKEEIDPSFSFRAFCRAGICGTCTVFIDGFPKLACKEQTLPYVLSEQIVTVEPLDKFEVIRDLVVDNEEVINRMKKFRTWIKEYQGEVRIPPEVNKKIEKGADCILCSACQSYCPQVLEEEYAGPLFFAKIYRFLEDPREEDKEFRIKEALEGHLYHCLSCNKCNNACPKEVEPATLIRELMLVKSEIS

SEQ ID NO: 37 - protein, 315 aa, Aquifex aeolicus
MLSEERVKELLKKLKDLKILVVGDVILDTYLYGNVERISPEAPVPVLEVEGEEFRLGGAGNVAKNLSSLGVETYLCGVVGKDEAGKRLRELIEGNSIRSFLIEDERPTTKKTRVVSRNQQLLRIDWEDRSYISGKALEKILDVIKNLQVDGIIVSDYAKGVITEEVIKTIREKGVFYSVDPRPKHRELYRKAYLMTPNEKELREMSKFEGSVEELGKKLKEELELETLIVTRGEKGMSLFTEKGVKHFPARARKVYDVTGAGDTVIASITAFKLAGATWEECCELGNVCGGIVVGEFGTATVTPEKLLKAVKLNS

SEQ ID NO: 38 - protein, 271 aa, Aquifex aeolicus
MEDFKSGDLILGYYKVLEKLGEGNFGKVYKVEALKGRYKGKVFALKVASNPYSVHYLWKEAQTLILFHHQNIVSLQSYLYKKDKKELYLIYEYMDFGTLKDYVEKKGKLSPEEALKVLRHVVNALEYLHSRGYIHSDLKPENVFGKRVLGGVLWKLGDFSLVRIRGDVSIIDVKGTIGFIAPEIFRGEIHRSSDIYSLGCLTLYMLTGKVPFEGKDFKERKEKNKRGEVEIPEEIPGKLKDLLERMLEVDYKRRFRTARELKEYMVKEGLI

SEQ ID NO: 39 - protein, 571 aa, Aquifex aeolicus
MEIKKYDVVVIGGGGAGLRTAIEVAKDPNISVALVSKVYPTRSHTGAAQGGMNAALGNVIPDDSPEVHAYDTIKGSDFLADQDAVFFMTEKAPEIIYELDRWGVPFSRLPDGRIAQRPFGGASFPRTVFAADKTGHVLLHTLFEQALARDNITFFNEYFLLDLIHDGERVKGVTIYDIRNGEVLFLQAKAVVLATGGFARIYWFRSTNAIGNTGDGQAVALRAGVPLKDMEFIQFHPTGLAKTGILLSEACRGEGGYLLNKEGERFMKRYAPDKMELAPRDIVSRAIETEIREGRGVGEGARAYVYLDLRHLGEEKIKERLPQVRQLAIDFEGVDPAKELVPIRPSAHYCMGGIHVENYKTSETPLKGLYAVGECACVSVHGANRLGGNSLTELVVFGKYCGMAVREFVKETDFAPVSESEPKKSEEFIEELMKREGNESLAQVRAQMGEITWAKMGIFRDEKSLKEAYDELSELLERWNNIPVVDKAKVFNTNLIEVLELRNMLELARVVAYSALHRRESRGGHSREDYPQRDDKNFLKHSLVYYDKNGNLKLEYIPVRITKYKPEERKY

SEQ ID NO: 40 - protein, 437 aa, Aquifex aeolicus
MIERYTRKEMGDVWSEVNKFKKWLDVEIAVCRAWAKLGKIPRDALKKIEEKTYVDKKVVEKIKEKEKVFKHDVLAFVSVIAEQVGEEGRYIHMGLTSSDVVDTALALLIREAIDIILKDIDKVMEEIKRLAFEHKDTLMMGRTHGVHAEPYTFGLKMCVWYDEMRRQKERLLFARENVLYGKISGAVGTYSNIPPEVEKLALEELGLKIEPASTQIVHRDRHAQLLTTLGLIASSLEKFATEIRHLQRTEVLEVLEPFTKGQRGSSAMPHKKNPIHSERICGLARVIRANSIPAMEDVVLWHERDISHSSVERVILPDSFIALDYILNLFYEILKGLVVNKERMRKNMELSKGLYASSKILVLLTQKGLSRDYAYDIVQRCAMKAWESDKTFKETLLEDPEVTKYLTEEEIEKALDPWEFLKNRDYVYEKVFGDEMG

SEQ ID NO: 41 - protein, 293 aa, Aquifex aeolicus
MTIPVALQGRDCLIQAKTGTGKTAAFGLPILNSLKEGEKALILAPTRELALQIRDNFRDFARYLNVRTFAFYGGTKVFGDLKVLRGGKVDVVIGTPGRIKDLIERGALKTDDVRYFVLDEVDVMLDMNFKEDIDFIYSQLPEEKQVFFVSATFPKEVRELSHRYTKKPEFIKVESRELEPQIEERLLRVYSIREKIELLEDVLRDFNKVIVFVNRKRDAKFLGEKLSTKGFRVGALHGDLPQRRREEILKKFRRGFINVLVATDVASRGLDISEVEAVVNFHLPEDPKFTFTE

SEQ ID NO: 42 - protein, 373 aa, Aquifex aeolicus
MRWIEEELKRIKEANLYRERILLEGVKDFCSNDYLGLRKHPEVVEESIRVLKEAGLGSGASQLVSGYTKHHRELEEKLAEFKGTESCVLFGSGFLANVGTIPALVEEGDLVLSDELNHASIIDGVRLSKAQKRVFKHKDYEELEEFLKKNRKKFRRVLIITDTVFSMDGDVADLKRLTQICEEYDCMLYIDEAHTTGTIGKGGLDYFGIEHKEYIIVMGTLSKALGSYGAFVCGTKLLIDYLVNKARSLIFSTSLPPSVCAGAKKAIEIIEENPKLIEFLRKKEKEILEILEQFSLDYKYYSTPIIPIMVYDEKETVRIKEELLKEGVFIQAIRYPTVPKGKARLRLTASLNYTRKDLEFLKNALEKVLKGRA

SEQ ID NO: 43 - protein, 1156 aa, Aquifex aeolicus
MEKRAYIEKIVVEGFKSYGTKRKEIPLGEGFIAVVGPNGAGKSNIGDAISFALGLSSAKALRAKNLSYLIFSKNGQKADHAYVEVHFKNLGAFPVEDEEVVISRKVSKDGRSIFKINGQVVRERDLKDFLAKAGIYETAYNVVYQGDIVKFLKMTPVERRKIIEEISGIGEYERKKEKALEELAEVELKIKEIDLILEEISNQLKRLKEEKEKLEKFKELQRIKRETEAKILLKEKEKLLKERERILNELSSLRESLEDITFQIQENEKELNERERLLKEVNEKIMPFKEKVGKFTAEIENAERSIKEKERELKESENRVKNLEELINNLLSDKENLEREVGTLQLELEKLKEEYKSLKEVEREKLRELEEEEERLKITFDEVKKLEEEKEKLTEKLNSLNKEKQELEIQRANLKNKIERIKEDINKLISEREEKIKEIKEKEQEIKRLKAIKKKEEEELRNLTQELNIYEKRLSEVRKKLEEVLKEKGAIEREVRSFSDVSDVFKDIKGVYGSVSELIRVKNPEHITAIEVAGGGRLKFIVVEDEEVAKECIQLAKRMNLGRFSFIPLNRVRVEERPLRYPRTKGAVDFAVNLVEYDPKFEKVVKFVFGDTLIVENFESAKAIGIGNYRMVTLEGELFEKSGVITGGAVKPSGELNKRYYEEELQRLNAEEEKLKNEESIIQKKIREIRNLISEKTALLKVSERKIEELSSEGLEQYEEKFKEKLENSKEYLKILEEKLLNVEDKLKELAEEIEYYEEKLNNLKLKEGDIKRHYSREGVEEKRREYSKVRKQVSEIEKSLNEIERELNKKTYELEYLEKEIQEKEREREYLTERIKSLKKEIENLILFKEKTLQEVKEAEVKVYDYIKQKEELEKEILNLKSKLGKLKIKEEELKEKIFEKEKNLKVLEEKIENLNEELKEYEDLKLGADEESIPKLKEKLKRVTEEIQKLGSVNFRAEEDYAEELKRFNDYKEKQQKLKEESKAIKKLIEETENKKRKVFLEAFNQINKSLKRIFSFLSPGGKAQMFLDNPEDPFSGGVQLTVKPRGKDVQYLEAMSGGEKTLAALSLIFALQEYKPSPFYYFDEVDAHLDEVNAKKVGELIREKSKEAQFIVVTLREVVTSFADKIVGVSARGGISEVFFLKNEGLEEIIKEA

SEQ ID NO: 44 - protein, 230 aa, Aquifex aeolicus
MKVKIKRYSDGDFRWEEYEVDGEGKTVLEILQNIKEIDPTLSFRAMCRAGICGTCVVKVNGEHKLACNTRVYDDITLEPVDVAPPIKDLVVEHEFIYEKLKKGRVWFEPLPTNIPLKPDELKNTEKSWDCILCGICNYVCPAIQADKNFGLPSTFTKAYGVVFDKRNKKGLDKLKDLVPLNIQSCTHCKNCTFSCPKDCNPELLIKILENNMVQRGLIQRKEQDFGFLGF

SEQ ID NO: 45 - protein, 540 aa, Aquifex aeolicus
MELFIVESPTKAKTIQKFLGKGFLVKATLGHVKDLPEKELGVDLRTLKAKYVYKRGKKKLVEQLKKLSRRSSIVYLGTDPDREGEAIAYFLKKDLEKVNKNIKRAVFYEITPEAIRESIRNAGDVNMNLVYAQFARRILDRLIGYLISPILWKEFKNYKLSAGRVQSPALRLIVEREREIQNFKVKKYYYVKALLRKGSEEFWAIYDYRYENPSDAKIIAKKLEKGYFSVYKVEKKKEKVSPPKPFITSDLQSEANAKFGFSSERTQKLAQELYEKGYITYPRTDSYRMNEKKAKEFMNYIEKKYGKEYVGRLRRFREKATAQGAHECIRPTSLREEIPEREELRLLYDLIFRRTIASLMKEMLLEREKVTVEAITPELKHPVYLVAKGLKIVFDGWSRVYPSEITEEKLPELYEGDLLDLVKTTLEERKTQPPPRYTEGTLIKTLEKLGIGRPSTYATIVKTLKERGYVEVKKKALVPTEIAFQVVEFLMERFPTLMDYKFTAQMEEKLDLVEEGKLNWKSVVYEFMEKIFGKELEMVR

SEQ ID NO: 46 - protein, 503 aa, Aquifex aeolicus
MATLTYEEALEILRQQIKDFEPEAKMEEVGVVYYVGDGVARAYGLENVMAMEIVEFQGGQQGIAFNLEEDNVGIIILGSETGIEEGHIVKRTGRILDAPVGEGLVGRVIDPLGNPLDGKGPIQFEYRSPVEKIAPGVVKRKPVHEPLQTGIKAIDAMIPIGRGQRELIIGDRATGKTTVAIDTILAQKNSDVYCIYVAVGQKRAAIARLIELLEREGAMEYTTVVVASASDPASLQYLAPFVGCTIGEYFRDNGKHALIIYDDLSKHAEAYRQLSLLMRRPPGREAYPGDVFYLHSRLLERAAKLNDDLGAGSLTALPIIETKAGDVAAYIPTNVISITDGQIYLEADLFNKGIRPAINVGLSVSRVGGAAQIKAMKQVAGTLRLELAQFRELEAFVQFASELDKATQQQINRGLRLVELLKQEPYNPIPVEKQIVLIYAGTHGYLDDIPVESVRKFEKELYAYLDNERPDILKEISEKKKLDEELEKKIKEALDAFKQKFVP

SEQ ID NO: 47 - protein, 376 aa, Aquifex aeolicus
MASSTKKDYYEILGVPRNASQEEIKKAYRRLVRKYHPDICKKPECEEKFKEINEAYQVLSDPEKRKLYDMYGHAAFEGAGAQQRVETTEIPPIEEILREFFDFDIGSIFERATGRRRARRRRSVKGEDIVVPVEITLEEAFKGTTVPIEVEREVPCSACGGTGYDESKSRTCPTCGGRGETVQGNWFFQVRQTCPTCGGEGVIYENCHACTGRGYGLVKETIKVKIPPGVRDGSKLVVEGKGHAGRYGGPPGDLYIIVKVKPHKIFERKGDDLYVDVNITYPEAVLGTEVEVPTLDGEKVKVKIPPGTKEGELIKVPGKGMPRLKGSGRGDLYVRVHIDVPKIGVLSKLLGDGKKVEELLKQLQEVLPKPERIVER

SEQ ID NO: 48 - protein, 692 aa, Aquifex aeolicus
MEEEKVKEGLWELAYNLWWTWNPPAKELFRSIDPLLWKETKENPIELLRKTKLLENKLKDEDFISHFKYVYSLYKTYMNRHSKYEDTYKKPIVFLSPEYGLHHTLLIYAGGLGFLAGDILKESSDLGFPLIGVGFMYPQGYVKQRIRVDGWQEDLDAQNQKELMPVKKVLDKEGKWLKCYVYVRDEKVYFGVWEVNVGKTKLYLLDTNVEENTPWNREISSRLYVPDKDLRLRQQIVLGFGTVILLEKLGIDAGGFHINEDYPSFVFLAEIFKLLKKGLTWDKAIEEVRKISLFTTHTPLRVAVNTYPFHMIEEQFLFVKDVYGIDVKKVLELGTNPEDPSEGFNSTIMSLRLAKYVNAVSKRHQEVSSKMWSFLFKEKENPIDYVTNGVHFPTWICSDLRRLYEEYLGENFVELHDHKSLWELIRDIPDEELWEYHIRNKERLIEHIKDRARERWVKEKADPSILMAEGLFLDSDVLTVGFARRMTGYKRPDLIFTDVERLKKIVNDSERPVQIIFAGKAHPADIEGKKIIQRIFNFAKDPEFGGRIAFVEDYDELLAHYMVRGVDVWLNNPLPPLEACGTSGMKASMNGVLHLSILDGWWIEGYNGKNGWAFGDYEVEGDRNRADAEAIYNILENEVIPLYYERDERGVPVKWISMMKEAIKSITPNFCSRRMLKDYINKFYSKILKEEG

SEQ ID NO: 49 - protein, 463 aa, Aquifex aeolicus
MRVLFCSSEIYPYAKTGGLADFSFCLIKYLKKYGVKVKGVMPYYKTLKAENLRKTDKGVTLNLNGKDYTFEVYESEDCYFLRNDELFGRDYIYGPPGWGYEDNDIRFGGFSRAVSELISTGQLEADVVHANDWQTALIPLFLKEVFKTPVKTVFTIHNLAYQGLFPKETVERVGIPPYLFHMEAVEFWGLVNFMKGGIVFSDLITTVSPTYAKEIQTQEYGYGLEGVLKKYSYKLRGILNGIDYEVWNPEKDKYIYQNYSLRNYSKKFKNKEFLSKELGIEAEKPLISFINRFTHQKGVELILNCAEEMSKLNANFVFLGTGEYENAFLDVSKIYKNFKVFAEFNEGFARKLYASSDFILMPSYFEPCGLTQMIGMRYGCVPIVRKTGGLRDTVKDISEGGYGITFEEPSKETFLCSLKRAIELYENAKKFRNSVKIVMSLDFSCDRMTKEYIECYEEVQSHQ

SEQ ID NO: 50 - protein, 630 aa, Aquifex aeolicus
MKKFSLISDYDVYLFKEGTHTRLYDKLGSHVIELNGKRYTFFAVWAPHADYVSLIGDFNEWDKGSTPMVKREDGSGIWEVLLEGDLTGSKYKYFIKNGNYEVDKSDPFAFFCEQPPGNASVVWKLNYRWNDSEYMKKRKRVNSHDSPISIYEVHVGSWRRVPEEGNRFLSYRELAEYLPYYVKEMGFTHVEFLPVMEHPFYGSWGYQITGYFAPTSRYGTPQDFMYLIDKLHQEGIGVILDWVPSHFPTDAHGLAYFDGTHLYEYEDWRKRWHPDWNSFVFDYGKPEVRSFLLSSAHFWLDKYHADGLRVDAVASMLYLDYSRKEWVPNIYGGKENLEAIEFLRKFNESVYRNFPDVQTIAEESTAWPMVSRPTYVGGLGFGMKWNMGWMNDTLFYFSKDPIYRKYHHEVLTFSIWYAFSENFVLPLSHDEVVHGKGSLIGKMPGDYWQKFANLRALFGYMWAHPGKKLLFMGGEFGQFKEWDHETSLDWHLLEYPSHRGIQRLVKDLNEVYRREKALHETDFSPEGFEWVDFHDWEKSVISFLRKDKSGKEIILVVCNFTPVPRYDYRVGVPKGGYWREIMNTDAKEYWGSGMGNLGGKEADKIPWHGRKFSLSLTLPPLSVIYLKHEG

SEQ ID NO: 51 - protein, 835 aa, Aquifex aeolicus
MLKAHSLSPEEILRILKTDRRGLSEEEAKKRLKIYGKNEIEEEEESLIKVFFRQFNNPFVYILFVASGISAYIGKKEDSLIILAIIFVNSLLGFFQEFRAITSLKALKKLTEVKTKVYRDGKLKVIPASELVPGDVVYIQEGDVVPADIRLIESVGLMVDESVLTGESVPVEKNADVVLPEDTPVYNRSNVVFKGTHVVKGWAVGVVYATGRQTEFGKISEKAKEKSPETPLMRALKKFSLAWMVIIFFLLSILFLIGIYQGRDIYEVLLLIVSELVSAVPEGLPLVITFTLVIGAIALSRRKVLIRYLPATETLGSTTFICSDKTGTITEGKLKVQEFFALNEKFLNLISALCNSSDGESGDPVDLALLRWLEENDIDWKKLREEYRTVKVFPFDTKKRYMAVIVEKEGKYYLLVKGAFETLSNFSEGISEELIKVHDVLAENGLRVLFFAYAEIPEPVEDIESLKLKPAGFVGFLDPPKEGVKEAVVNARRAGIRVIMITGDNLKTAVAVAKQTEIYREGDLAVEGKDLSKYSDAELYNLLKRVSVIARALPEDKYRVVKVLQEKGEIVAVTGDGVNDVPALKVADIGVAMGSGTEAAKSVAKMVITDNNLKVIVEAVRWGRIIVRNIKRAITYLLTTSFGEITLLSSAILMKLPLPLYPTQILWINIVTDGVQDKTFPFNKEEIDVMKEKPQKPEKVFLDKRLFLRFLTGGLFIGFINLILFKHLLSVYSYEVAVTITFTSMVVNQWAVGIQTVRDYPFFYKPWRNFQMNPYIFIGIFIGLILQLLAIYVFPNYFHAVPLSLEHWFYVILTTLSVFIFIEIRKLVFTIFSER

SEQ ID NO: 52 - protein, 390 aa, Aquifex aeolicus
MTKVVNYGEVQYGFAKRYFEEFLSERKGRIEKLLKPEKTPVLLMDIQGVKKKYLEVKYHFPEFNVYYAVKANDDESVIRALVEVGAGFEVASSQELEKVLRLGGKIEKVISSNPVKPPEFIEFAYQKGVRTFAVDSITEVKKIKDIAPRSKVYVRIAVPNEGSDWPLSRKFGVSVEEAVEILEYANDLGLVPYGITFHVGSQCNNLRNWFIAVKLSAQLWEKARAKGLKLQMLNMGGGIPVRYNYEALSVEDIAYYVKGLMRKYFPVQPYELQIEPGRGIVGDQGIMVTKVIGKAKRGSENWLYIDTGVFNGLAEALGGIRYPFFLEREGELKEWTIGGVSCDSMDVVAKNVYLPEPEVGDYLYILSAGAYTTVYASNFNGFPKPEVVPF

SEQ ID NO: 53 - protein, 465 aa, Aquifex aeolicus
MEFDLIIVGAGSGGYEAGLYAFRRGMKVAFVELSPETVGGNCLNRGCIPSKYMRHGAYLLDKFQKMEQYGIISKGYDIEYKKLKEGRDNVVVTIRENFKKFAQQLRIPIYYGKGVLKDPNTVFVEGPEETLKAKYILVATGSSPTSVGNLVPDGKYVIDTDQIWEIDYVPKKVLIVGGGAVGVEFAYIFRKYGSEVVLVEIKDRLLPTPDIPEDSGRYLARKLRELGVDIRTRTSVESWEKTQNGVKAKLTDGSEVVADFILLGVGRKPNTKGIGLEELGIEMDERGFVKTNEYAQTNIPNIYACGDITSPLMLAHKSMYEGKIAVSHILGERDWKKNERIIPKIIYSALEVASVGLTEEQAEDEDIEVRVGVASFVSNPKAMDDGENEGFVRIVADDETGEILGCHIVGPHAGELIHQVVHMIKDGKTVEFASKTMYSHPSLSENIGIASSEVYYGPISWVKRR

SEQ ID NO: 54 - protein, 424 aa, Aquifex aeolicus
MKVLVVGNGGREHAIAWKVAQSPLVKELYVAKGNAGIWEIAKRVDISPTDVEKLAEFAKNEGVDFTIVGPEAPLVEGIVDEFEKRGLKIFGPNKEAAKLEGSKAFAKTFMKKYGIPTARYEVFTDFEKAKEYVEKVGAPIVVKADGLAAGKGAVVCETVEKAIETLDRFLNKKIFGKSSERVVIEEFLEGEEASYIVMINGDRYVPLPTSQDHKRLLDEDKGPNTGGMGAYSPTPVINEEVEKRIREEIVERVIKGLKEEGIYYRGFLYAGLMITKEGPKVLEFNVRLGDPEAQPILMRVKNDFLETLLNFYEGKDVHIKEDERYALDVVLASRGYPEKPETGKIIHGLDYLKSMEDVVVFHAGTKKEGNFTVTSGGRVLNVCAYGKTLKEAKERAYEAIRYVCFEGMHYRKDIGDKAFKYLSE

SEQ ID NO: 55 - protein, 262 aa, Aquifex aeolicus
MERIETWKEKIEKRLNEILKPEGPEELIEAMKYYPLQKGKRIRPLFTVAVASALGGNEDDAITVGSGIELIHNYSLIHDDLPCMDNDVWRRGLPTCHIKFGEAMALLAGDALLTYTFEVLSQRENYKTLSCEEILEINKIIAQKAGSNGMVGGQVLDIKGYEDLYEVSVKKTGALFEACFMCGAVVAKRREKLKEMESIGRKVGLLFQMVDDYLDKDGFYEKLGECLKEEIKKLYEELKEKEIFKESQELRYLLDLIYKRIT

SEQ ID NO: 56 - protein, 510 aa, Aquifex aeolicus
MNYFLRFDTSLLPEEEAKVLICGSGIGGLATAISLKELGIEPLILTRGIGNTYYSQGGIAAAVLPDDSPYLHYCDTLRAGRYLNHELHTKLLTYEGIFRILDLERWGVDFDKKNGFYETTLEGGHSKPRVLKVKDYTGREIYTKLLKKTEELGIKILHGELQEIIIEENGVQGVIYSEEGSLKFIRTPLLILATGGAASMYYYTSNPKKVRGDAIGIAFRMGATVKNPEFVQFHPTVLKGTNLLISEAVRGEGAILVNDRGERFVNELLPRDEVARAIYNQIKRGREVYLDLRPVAQKGIKIEERFPTIYSFLRERGYDPYREPVPIIPAAHYYIGGIEVDDRGRTSIQGLYAVGECSCTGIHGANRLASNSLLEGVVFGHRTAYQVYLDLKILKPSKVNFRSERAGSDKPNLGIEELKKLMWNYVGLERDEEGLTYVKKRILSVLSQAKHWEPTPQNRQLYDILLVALCTVEGALMRKESRGVHYRKDYPTEREVYRRDTIITRDLFEL

SEQ ID NO: 57 - protein, 426 aa, Aquifex aeolicus
MRIEDLRKEDWKLNERLEYLAKRGEILEEEYEKSVKEILKRVREEGDRAVIEFTKKFDGVELTPENMEVPFEELEKAYEEIEPEVREALEFAENRIRVFHEKQLENSFFKEEEGIILGQKVVPLEKVGVYVPGGKAAYPSTVLMNVVPASVAGVEEIIMVSPKPNKYTLAAAYIAGVSRVFQVGGAQAIGALAYGTEKIPKVDKIVGPGNIYVALAKKLVFGTVDIDMIAGPSEVLVIADERANPTWVAADMLSQAEHDELAASILLTPSEELANKVKEEVERLLSQLERKEIAQKSLEKFGTIFLVKDLYHACEVANYIAPEHLEVMVREPMALLPELKHAGAIFLGDYTTEPLGDYVLGPNHTLPTGGSTRFFSPLGVYDFIKRSSVLYVSREGFKRVANQAEAIAKAEGLTAHALAVKVRKND

SEQ ID NO: 58 - protein, 669 aa, Aquifex aeolicus
MKLNTQQEEAVRHFGSPLLVVAGAGSGKTKTLTHKVEYLIKEKGLKPYEILCITFTNKAAKEIKERIKNTFGLELEWSGTFHSVALKILKKDGEKIGIPKDFSIADEKDTTLIVKEILKKYGLKKEPEEVKEKISKVKENFEEPEAWLGVLLEEYQRVLRENKLLDFSDLMRELYNLLLVDEVREKYRNTFKYIMVDEYQDTNNIQYEILKLLANKNICAIGDPNQCIYEWRDARPDNILRFIEDFNPKIIKLELNYRSREPILRVANAVLEASTLEWKDLIPKLRGVRGEGQKPYVRRFQDEEEEALWISRKIKELAGEYELKDIAVLVRVGYITDVFERTFFKAGIPYKVVGTIKFYERIEIKNLIALLRLIYNPSDEVAFKRLTEFFVKGFGDKSFEVVKKNFKGNWFKALKESLKKLPKNAAISAYEFLKAVVPLYKNPEKYHEGLEAFVEKIDYYELLKEKFKKDYEERIENVKEFLSSLKDFYAKAYTLEDLLAEITLTSEEEEEENAVKILTIHSAKGLEFPVVFLPRLEEGILPHHRSQESERELEEERRLFYVAITRAKDLLFMSYTKKENRKPSRFLSDIPKHLLDLSAFKKKKKVAYEENLRPNRLIKKGDKVIHRVFGKGVVLRIEEERAKVRFENGEEKVIHTSFLEPLKTPSGVP

SEQ ID NO: 59 - protein, 424 aa, Aquifex aeolicus
MKNEKLYREALQVMPGGVNSPVRAFKAVGGKPIFLVKGRGPRVWDAEGNEYIDFLASWGAIILGHAPKKVVKAVQEEAEKGLSFGLTNPHEVTLAKLVVEMVPSVEKVRFVNSGTEATMSAVRLARGVTGRKYIVKFEGCYHGHYDSLLVSAGSGVATFGIPGTPGIPEEIAKLTIVLPYNDVQALEEAFKEYGSEIAGVIVEPIAGNMGVVPPKKEFLIRLRELTKEYGSLLMFDEVITGFRLSKGGAQELFGIEPDITCLGKILGGGLPVGAYGGRREIMERVAPEGEVYQAGTLAGNPLAMVSGSETLKDLRDKEPYKELEEKMEKLARGVKDILTEKGIQHTINKVGSMMTVFFTDKKVVDFQTAKTSDTELFAKFFRALLNKGVLIPPSQFEAWFLTTAHEEEVIDEALERIRDAVKEL

SEQ ID NO: 60 - protein, 222 aa, Aquifex aeolicus
MEVVSLPRLGEPAPAFEAQTTFGPVKFPDDFKGQWVVLFSHPADFTPVCTTEFVAFAKNYEEFKKRNVQLIGLSVDSNFSHIAWVMNIKEKFGIEIPFPIIADHNMEVAKKYGMIHPAQSTTFTVRALFVIDDKGILRAMIYYPLTTGRNIREVIRLVDALQTADREGVATPADWVPEPQTWEFTEENTKVIVPPPTTYEDAVKRLQEGYECADWYICKKKV

SEQ ID NO: 61 - protein, 628 aa, Aquifex aeolicus
MLEKYEILKDYKGPFDIKNYDYETLQKLAQEVRDYIINVTSKNGGHVGPSLGVVELTIALLRVFNPPEDVIVWDIGHQGYPWKILTDRKEQFPTLRQYKGISGFLRREESIYDAFGAGHSSTSISAALGFRIGKDLKGEKEDYVIAVIGDGALTAGMAYEALNNAGHIRPDRFIVILNDNEMSISPNVGAISTYLNRIISGHFVQETRQKIKNFLQHFGETPLRIMKLTEEFLKGLISPGVIFEELGFNYIGPIDGHDIKALEDTLNNVKDIKGPVLLHVYTKKGKGYKPAEENPVKWHGVAPYKVESGEIIKKSSPPTWTSVFGKALVELAERDEKIVAITPAMREGSGLVEFAKRFPDRFFDVGIAEQHACTFAAGLAAEGLRPVAAYYSTFLQRAYDQVIHDVALQNLPVTFAIDRAGLVGDDGPTHHGVFDLSYLRCVPNMVVCAPKDEQELRDLLYTGIYSGKPFALRYPRGAAYGVPTEGFKKIEIGTWEELLEGEDCVILAVGYPVYQALRAAEKLYKEGIRVGVVNARFVKPMDEKMLRDLANRYDTFITVEDNTVVGGFGSGVLEFFAREGIMKRVINLGVPDRFIEHGKQDILRNLVGIDAEGIEKAVRDALKGGRLI

SEQ ID NO: 62 - protein, 326 aa, Aquifex aeolicus
MDATLIIGLLSKDMGKLAYVFPGQGSQYVGMGYEFYKQFHETADVVHAVEHSLRMSLDDIVDVMFKGPEEKLNKTVYTQPALFAISLGIYKALESMGFPKPDFVAGHSLGEYTALAVAGGIDVQLGARLTYYRGKYMQEAVPEGKGAMVAILKLPPEKVEEACERAKDVGVVEPANYNSSTQTVISGEKPAVEKAAQIAKEMGGRAIPLKVSVPSHCSLMKPAADAFRLKLAQAPIQNIKIPLVQNYTAKAHTMAHEIRNNLYHQIFSPVKWYQSVIWMHEQGVDTFVEIGPKNVLSKLIQQTLPNVRVFNVEKPEDAESVLKAIT

SEQ ID NO: 63 - protein, 304 aa, Aquifex aeolicus
MEILKAIEDRLVEELNPKVRLVLETGRYIVESGGKRLRPLFTLLVSGMCGGDPSKALPLGVALEYIHVASLLHDDVVDRAKTRRGRESANLVFGNGVAVLTGDYMYAKSLHLFSTYGNMEMIRLVSGVVMDMAEGQVLEISKVGDIISEEEYFQIIDGKTGVLFGACFGVGAMSGECGDWRELYEAGLRLGRAFQLIDDALDYEGDPKVLGKPVGNDLREGKCTYPLISVLDNLDREEVKRVLRGLEDSEKLRKKVVELGGVEKTKERAKEELKVVKEIISKYPENEYKREILKLIDFVVERKA

SEQ ID NO: 64 - protein, 269 aa, Aquifex aeolicus
MINAQTQLYGVIGFPVKHSLSPVFQNALIRYAGLNAVYLAFEINPEELKKAFEGFKALKVKGINVTVPFKEEIIPLLDYVEDTAKEIGAVNTVKFENGKAYGYNTDWIGFLKSLKSLIPEVKEKSILVLGAGGASRAVIYALVKEGAKVFLWNRTKEKAIKLAQKFPLEVVNSPEEVIDKVQVIVNTTSVGLKDKDPEIFNYDLIKKDHVVVDIIYKETKLLKKAKEKGAKLFDGLPMLLWQGIEAFKIWNGCEVPYSVAERSVRDLRG

SEQ ID NO: 65 - protein, 268 aa, Aquifex aeolicus
MIKVLSPAKINLGLWVLGRLPSGYHEILTLYQEIPFYDEIYIREGVLRVETNIGIPQEENLVYKGLREFERITGIEINYSIFIQKNIPPGAGLGGGSSNLAVVLKKVNELLGSPLSEEELRELVGSISADAPFFLLGKSAIGRGKGEVLEPVETEISGKITLVIPQVSSSTGRVYSSLREEHFVTPEYAEEKIQRIISGEVEEIENVLGDIARELYPEINEVYRFVEYLGFKPFVSGSGSTVYFFGGASEELKKAAKMRGWKVVELEL

SEQ ID NO: 66 - protein, 265 aa, Aquifex aeolicus
MSVRVVVCGALGRMGRRIIELALQDKDVEVVGGVEHPDCVPSIDLGEALGKEELKGKPLTSRLEELLPYTDVVIEFSGNPTAAVGHAELTTLEKKAIVIGTTGFTKQEIEQIKEFSKNAPVLLSPNMSLGVNLLFKLAEIAAKVLKDKNFDAEIMEIHHRFKKDAPSGTAMKLAEILSETLEKKNLVFGRKGEAPRKEDEIGVMALRGGDVVGDHTVYFLGFGERIELTHRATSRDTFAKGAVEAAKWIKGKEPGFYTMFDVLGL

SEQ ID NO: 67 - protein, 634 aa, Aquifex aeolicus
MNALKNFFIWAIIIGAAIVAFNLFEGKREFTTKVSLNEVVKLVEEGKVSYAEVRGNTAIIQTKDGQKLEVTLPPNTNLVDKMVEKGVRVEVANPEPPGGWLVNVFLSWLPILFFIGIWIFLLRQMSGGGNVNRAFNFGKSRAKVYIEEKPKVTFKDVAGIEEVKEEVKEIIEYLKDPVKFQKLGGRPPKGVLLYGEPGVGKTLLAKAIAGEAHVPFISVSGSDFVEMFVGVGAARVRDLFETAKKHAPCIIFIDEIDAVGRARGAIPVGGGHDEREQTLNQLLVEMDGFDTSDGIIVIAATNRPDILDPALLRPGRFDRQIFIPKPDVRGRYEILKVHARNKKLAKDVDLEFVARATPGFTGADLENLLNEAALLAARKGKEEITMEEIEEALDRITMGLERKGMTISPKEKEKIAIHEAGHALMGLVSDDDDKVHKISIIPRGMALGVTQQLPIEDKHIYDKKDLYNKILVLLGGRAAEEVFFGKDGITTGAENDLQRATDLAYRMVSMWGMSDKVGPIAIRRVANPFLGGMTTAVDTSPDLLREIDEEVKRIITEQYEKAKAIVEEYKEPLKAVVKKLLEKETITCEEFVEVFKLYGIELKDKCKKEELFDKDRKSEENKELKSEEVKEEVV

SEQ ID NO: 68 - protein, 432 aa, Aquifex aeolicus
MGMTITEKILAEHAGKKEVHPGELITAKIDLAMANDVTAPLAIKILEKYGIDKVFDPERIALVLSHFVPAKDIKSAEQAKIVREFVKKHGIKWFFEEGEGIEHAILPEQGLVVPGDLVVGADSHTCTYGALGAFATGVGSTDIAYAMATGEVWLRVPESMKFIFYGKLKPWVMGKDLILYTIGQIGVDGALYRAMEFDGETIRNLSMEQRFTIANMAIEAGGKSGIISPDEKTIEYVKQRAKRPWKVYQSDPDAEYHSVYEWDASQIEPLVAWPYLPSNVHPVSESTHITIDQAFIGSCTNGRIEDLRVAAKVFEAALKQGKKVHPYVRCIVIPASKAIYKQALKEGLIDIFMEAGCVVSTSTCGPCLGGHMGVLAEGERCISTSNRNFPGRMGHPKSESYLANPAVVAASAIMGRIAHPDEVVKAETLAGV

SEQ ID NO: 69 - protein, 309 aa, Aquifex aeolicus
MKKGVILINLGGPDSLEAVEPFLYNLFSDPDIFSLPFQKVLAKIIAKLRAKKTRHYYELMGGKSPQYEQTLEQAKALQERLGEDYKVVVGMRYWKPYIKDALSELLKEGINEVILLPLYPQYSKTTTGSAFNEFERSKKALKADHIKVKKIEHFYDHPLYIKAWAEQIKQSVEKPEEYHFLFSAHSLPKKLIEEGDPYQEQTEKTVKLIMENFPEVEYTLAYQSKVGFGKWLEPSTDEVIRNLIKKEVKKLLVIPISFVSEHSETLYELDKQYRELAQELGYEEFVRVPTLRTNPYFISALEDLVKNEV

SEQ ID NO: 70 - protein, 195 aa, Aquifex aeolicus [sequence omitted]

SEQ ID NO: 71 - protein, 379 aa, Aquifex aeolicus
MAEILMGVGNAGLKESGNPDILVVYLPYPCTASFVFTDNYFKAGSVIYSERIARDKERIRAFVVNSGNANCGTGEEGIKHAEMMAEKVAQILDIPKDEVFVFSTGIIGKYLPIENVLKGIEQACSNLELLDLKRASEVISTTDRFPKYDFAKAGEVETFGFAKGAGMIHPSMATMLAFVFTNANLEYLTLKRIHESVTEKTFNSITVDGCESTNDAFGIISLGEVEADPETVEFELLKVSESLAKQIVADGEGATKIIRVNVRSAITEIKAREIAEAIANSLLVKTAVFGRDPNWGRIAAAAGSTEFPIDPFKLEIYVGGYLLYDGKPHDENLEKAKKHLIEDREVDITVELNEGEYEWVCYSSDIGYDYIKLNAEYTT

SEQ ID NO: 72 - protein, 632 aa, Aquifex aeolicus
MAEKKEKIIGIDLGTTNSVVSVMMGDEAVVIQNQEGSRLTPSVVSWTKEKEILVGEPAKRRAILDPENTVYESKRFIGRKFEEVKEEAKRVSYKVVPDEKGDAAFDIPNAGKLVRPEEVGAHVLRKLKEAAEAFLGEPVKKAVITVPAYFNERQRQATKDAGKIAGLEVVRILNEPTAAAMAYGLHKKDNVRILVYDFGGGTFDVSILEGGEGVIEVKVTAGDTHLGGANIDERIMDWLIEEFKKETGIDLRKDRTALQRLKEASEQAKKELSFKMETEINLPFITIDPNTNQPLHLQKKLTRARLEEMIKDIVDRTIDIVKQALEDAKLKPSDIDEVVLVGGSTRIPLVQQRIKEFFGKEPHKGLNPDEVVAMGAAIQAGVLAGEVKEIVLVDVTPLSLGVETYGGVMTVLIPRNTPIPVRKCEIFTTAHDYQTEVEIHVLQGERPLAKDNKSLAKFYLTGIPPAPRGVPKIEVCFDIDADGILHVTAKDLGTGKEQSVRVEISSGLTPEEIERIIKEAEEHAEEDRKKKELIEAKNQLDHLVYQLEKALKEAGDKVPADVKSEAEKVIEEAKKTIETATEIEQVKQVTEKVLQVSSKMGTTLYGEAGKQAGGGEKKDEGGEGEVEAKPVD

SEQ ID NO: 73 - protein, 823 aa, Aquifex aeolicus
MEFLRDFGKTALIHQGNEISYAELLENIASFANLMDITPNERVGIVMENRPEWVYAFYGTWKKGGIVVPIDFMSTPQEIRYILEDAEPSIIFCSDETYPRVREASEDLKVEIVNVDNLVLPTPWEGIVRRDEDDVAVLPYTSGTTGNPKGVMLTFKNLMSNIRGVSEVGIAGKEDKTLAILPFHHMYPLMTTMLLPLYLGATVVFLDKLTPEDIIEKLQKYQITVLIGVPRLYQLFHRRIMEEINKNVLAKNLFKLMKKVKNQKIRKTVFKKVHDAFGGRIKYMVSGGAKLPLDIAQDLTTLGFTVIEGYGLTETSPIVSFNPPNRIKLGSVGVPIKGVEVMTTSEGEIIVRGDNVMKGYWKKPEETQKVIINGWFYTGDLGEIDEEGYIYITGRKKEIIVLGSGKNVFPEEIESKILAKAPYIKEVGVFEKDGKLLALIYPDFEKVKELGITNLEETIKWEVIDKVNRELPEWKRVVGFKIVKTELPKTRLGKLRRFLLPQIYEKAEEIKEEKTEDYSVFETEEGRIIKEFLEKISQKEVKPGDHLEIDLGLDSLAKVELLGFIETNFGVSLSEEELSKNLVVKDLIELVRSKKKSVDTKEVSWKDILTKAKPYELYHYPLIFELGRKLLKLYFKLYHRIDVRGLENLPKPPFIIAPNHQSYLDAFAIAAVLPKEIAHETYFLGDETYFRNPITSTFGKLAHVITVNVNKGLKESLQKTAYALMSGKVVVIFPEGARTRTEELMEFKKGVAILARELGVPIVPVAIEGAYEAWSVYDKFPKPKKIKIMFGKPVDPDEKSYEEITKELYEWIKSMLEFLKKES

SEQ ID NO: 74 - protein, 254 aa, Aquifex aeolicus
MEDIIVSFMNVALITGVRRIGKEVAKALIDKGYSLSVVYRSSREAVEELTEYAKGKGVKVKGFRADLCAYGDYEKLVKGTYEEFGRIDAFVHLASPYERKELTETTREDLYYHFIPIAEAFFFISVECYKVMLKNEGNVKGRIVAFGDWATNISPYKGFSAYFIAKGALHTAVKVLAKEFAPHVLVNCVAPGPVMKAENYSEEEWKKILARTPLRREVSVKDVVSTTLLLLETESITGEIICVDGGRHIAGSGV

SEQ ID NO: 75 - protein, 375 aa, Aquifex aeolicus
MKKVKLIGTLDYGKYRYPKNHPLKIPRVSLLLRFLDAMNLIDEKELIKSRPATKEELLLFHTEDYINTLMEAERCQCVPKGAREKYNIGGYENPVSYAMFTGSSLATGSTVQAIEEFLKGNVAFNPAGGMHHAFKSRANGFCYINDPAVGIEYLRKKGFKRILYIDLDAHHCDGVQEAFYDTDQVFVLSLHQSPEYAFPFEKGFLEEIGEGKGKGYNLNIPLPKGLNDNEFLFALEKSLEIVKEVFEPEVYLLQLGTDPLLEDYLSKFNLSNVAFLKAFNIVREVFGEGVYLGGGGYHPYALARAWTLIWCELSGREVPEKLNNKAKELLKSIDFEEFDDEVDRSYMLETLKDPWRGGEVRKEVKDTLEKAKASS

SEQ ID NO: 76 - protein, 1015 aa, Aquifex aeolicus
MNYMDISRRGFLKLSVGSVGAGILGGLGFDLTPAYARVRDLKITKAKVTKSICPYCSVSCGILAYSLSDGAMNVKERIIHVEGNPDDPINRGTLCPKGATLRDFVNAPDRLTKPLYRPAGSTEWKEISWDEAIEKFARWVKDTRDRTFIHKDKAGRVVNRCDSIVWAVGSPLGNEEGWLMVKIGIALGLSARETQATICHAPTVASLAPTFGRGAMTNNWVDISNSDLVFVMGGNPAENHPCGFKWAIKAREKRGAKIICIDPRFNRTAAVADIFVQIRPGTDIAFLGGLINYVLQNEKYQKEYVRLHTTGPFIVREDFGFKDGLFTGYDPKTRSYDTTTWDYEFDPATGYPKMDPEMKHPRCVLNILKEHYSRYTPEVVSQICGCSKEDFLRVAEEVAKCGAPNKFMTILYALGWTHHSYGTQLIRTACMLQLLLGNIGCPGGGINALRGHSNVQGMTDLAGQNKNLPTYIKPPKPEEQTLAQHLKNRTPRKLHPTSLNYWANYPKFFISFLKCMWGDAATPENDFAYDYLYKPEGGYNSWDKFIDDMYKGKIEGVVTAALNFLNNTPNAKKTVRALKNLKWMVVMDPFMIETAQFWKAEGLDPKEVKTEILVLPTAVFLEKEGSFTNSARWVKWKYKATDPPGDAKDEFWIFGRFFMKLKEFYEKEGGAFPEPILNLVWPYKNPYYPTAEEILTEINGYYTRDVDGHKKGERVRLFTDLRDDGSTACGGWLYCGVFPPEGNLAKRTDLSDPLGLGTYPNYAWNWPANRRVLYNRASCDEKGRPWDPERPLLRWDPERDMWVGDIPDYPATAPPEKGIGAFIMLPEGKGRLFAAKSYVTFKDGPLPEHYEPYESPVTNILHPNVPHNPVAKVYKSDLDLLGTPDKFPHVATTYRLTEHYHFWTKHLYGPSLLAPVMFIEIPEELAKEKGIQNGDLVRVSTARASIEAIALVTKRIKPLKVAGKTVYTIGIPIHWGFEGLVKGAITNFITPNVWDPNSRTPEFKGFLANIEKVKT

SEQ ID NO: 77 - protein, 342 aa, Aquifex aeolicus
MAIKVGINGFGRIGRSFFRASWGREEIEIVAINDLTDAKHLAHLLKYDSVHGIFKGSVEAKDDSIVVDGKEIKVFAQKDPSQIPWGDLGVDVVIEATGVFRDRENASKHLQGGAKKVIITAPAKNPDITVVLGVNEEKYNPKEHNIISNASCTTNCLAPCVKVLNEAFGVEKGYMVTVHAYTNDQRLLDLPHKDFRRARAAAINIVPTTTGAAKAIGEVIPELKGKLDGTARRVPVPDGSLIDLTVVVNKAPSSVEEVNEKFREAAQKYRESGKVYLKEILQYCEDPIVSTDIVGNPHSAIFDAPLTQVIDNLVHIAAWYDNEWGYSCRLRDLVIYLAERGL

SEQ ID NO: 78 - protein, 443 aa, Aquifex aeolicus
MTAVSQEIMNYIEEKVNRARSVLRELTSLKTSVKNETLLKVAELIDKNRDYIKEENRKDVEKAKEMGLRPAVVDRLVLNDKRIDGMVKVLKDVASLPDPVGEIIKMWNLPNGLKVGRMRVPLGVIFIVYESRPNVTIEASSLCMKSSNAVILRGGKEAINSNKALVNLIKEACRETGFPEDAVQFIDRSEREIVWEILKMEGKIDVAIPRGGESLIRAVVEHAKVPVIKHYKGVCNIYVDDEADLEKAYHIVYNAKVQRPSVCNAVENLVINRKILKEFFPKMAYYLGKAGVELRCDEESLQVIKENPKLSFVNAKPATEEDYYEEFLDLILAVKVVDDVDEAIAFIEKYGSKHSDAIITENYTKAMKFLREVDSAAVYVNASTRFTDGNEFGLGAEMGISTDKIHARGPMALEELTIPKFVILGEGQVRDNFGVPEEWMKEF

SEQ ID NO: 79 - protein, 304 aa, Aquifex aeolicus
MLLLLLLVSIAFSVPKLVSPEWLKENLSKKNLVIIEFGDTQSYLVEGHIPGAVLTEKEQWRKMDPETGALVRRSVEYYEKLFRSWGINNDSEVVIYYKGNTRNEILGAVYAYWVFHLLGHKRVGILDGGWKEWIKKGYPVSYEEPEINRGNFKAKYNKELETNWKYVYENIGKIPIIDGRLPDFYFGIGKFPAAKKYGHIPCSVPFSWEWWVKRDRETEKLYIEFPYYAKEFLRNQGLKPEDEVILFCFGGTGAAFLYWVFDVSGHKNMKVYDASKREWEALNLPLNRYVWETFRDCRKFFYTN

SEQ ID NO: 80 - protein, 546 aa, Aquifex aeolicus
MEKIKYLKSIQISQRSVLDLKLLAVGAFTPLDRFMGEEDYRNVVESMRLKSGTLFPIPITLPMEKEIAKDLKEGEWIVLRDPKNVPLAIMRVEEVYKWNLEYEAKNVLGTTDPRHPLVAEMHTWGEYYISGELKVIQLPKYYDFPEYRKTPKQVREEIKSLGLDKIVAFQTRNPMHRVHEELTKRAMEKVGGGLLLHPVVGLTKPGDVDVYTRMRIYKVLYEKYYDKKKTILAFLPLAMRMAGPREALWHGIIRRNYGATHFIVGRDHASPGKDSKGKPFYDPYEAQELFKKYEDEIGIKMVPFEELVYVPELDQYVEINEAKKRNLKYINISGTEIRENFLKQGRKLPEWFTRPEVAEILAETYVPKHKQGFCVWLTGLPCAGKSTIAEILATMLQARGRKVTLLDGDVVRTHLSRGLGFSKEDRITNILRVGFVASEIVKHNGVVICALVSPYRSARNQVRNMMEEGKFIEVFVDAPVEVCEERDVKGLYKKAKEGLIKGFTGVDDPYEPPVAPEVRVDTTKLTPEESALKILEFLKKEGFIKD

SEQ ID NO: 81 - protein, 345 aa, Aquifex aeolicus
MSGKRALITGIRGQDGAYLAKLLLEKGYEVYGADRRSGEFASWRLKELGIENDVKIIHMDLLEFSNIIRTIEKVQPDEVYNLAAQSFVGVSFEQPILTAEVDAIGVLRILEALRTVKPDTKFYQASTSEMFGKVQEIPQTEKTPFYPRSPYAVAKLFGHWITVNYREAYNMFACSGILFNHESPLRGIEFVTRKITYSLARIKYGLQDKLVLGNLNAKRDWGYAPEYVEAMWLMMQQPEPDDYVIATGETHTVREFVEKAAKIAGFDIEWVGEGINEKGIDRNTGKVIVEVSEEFFRPAEVDILVGNPEKAMKKLGWKPRTTFDELVEIMMEADLKRVRDREVSV

SEQ ID NO: 82 - protein, 309 aa, Aquifex aeolicus
MGTKIIGTGVYLPKNVLTNFDLEKIVDTSDEWITTRTGIKERRIAKEETITYMATQAAKEALREANLSPEELDLIILATLTPQKRFPSTACLVQAQLKAKGVYAFDISAACSGFIYALDIADSFIKSGKAKNVLVIGAEKLSEAVDWEDRSTCVLFGDGAGAVVVTRSEDKSDILATRMYAEGSLEELLHADNCGYIRMKGRELFKVAVRSMEEVCREVLEKAGVKPEEVSLVIPHQANVRIINALAEKLNIPKEKVFVNIQKYGNTSAASIPIALHEAIKEGKVKRGDLILMTAMGGGLTWGAVLLRY

SEQ ID NO: 83 - protein, 171 aa, Aquifex aeolicus
MEDFYVEDYLVKGDRYYTKEHEWVRVKNGFAEVGITDYAQKQLGDIVYVDLPEKGKEVDAGDTLANIESVKNVAPVYAPVTGTVVEVNEDLKDEPGIINDDPYEAGWIAVIEMKDPTEVEDLMTAQDYAEYLKEIVEEEKEEEVEVKEEELIETESIEELSEEELGYEENK

SEQ ID NO: 84 - protein, 401 aa, Aquifex aeolicus
MKKKRVILAYSGGLDTSIIVRWLTEKGYEVITYTADVGQGEELSEIPEKARRAGAIEAIVEDLKETFAENYCLPTLRALALYEGKYPLTAALSRPLIAERLVYYAEKFNADYVAHGSTGKGNDQVRFELSVWALNPDIEVLAPVREWEFKSREEQVEYAQRFNIPVKATKEKPYSIDRNLWGVSIECGPLEDPWQEPPQDAYQITQSPEEAPDEPEYVTVGFEKGKPVYLNGERYEEQWKLIANLNEIAGRHGVGRIDMVENRLVGIKSREIYEAPGAMVLYEAYRDLLSLVLDRFTFHYFLTHIPHEYAKLVYEGLWFTPLREALDAFTNKIAEFATGEVRLKLYKGSVSVVGRRSPNSLYVEELATYSEKDQFDQIAGKHFTKVWGLPLKVLGRVRKGK

SEQ ID NO: 85 - protein, 294 aa, Aquifex aeolicus
MFQGSIVALITPFKEGEVDYEALGNLIEFHVDNGTDAILVCGTTGESPTLTFEEHEKVIEFAVKRAAGRIKVIAGTGGNATHEAVHLTAHAKEVGADGALVVVPYYNKPTQRGLYEHFKTVAQEVDIPIIIYNIPSRTCVEISVDTMFKLASECENIVASKESTPNMDRISEIVKRLGESFSVLSGDDSLTLPMMALGAKGVISVANNVMPREVKELIRAALEGDFRRAREIHYYLHDLFKVLFIETNPIPVKTACWMLGMCEKEFRLPLTEMSPENENKLREVLKKYNLPLKN

SEQ ID NO: 86 - protein, 387 aa, Aquifex aeolicus
MTVVNEYRPVEVFFGEGAVKKAGEVGRRFGFKALIVTGRKSTKESGALDKLINSLKQNQIEYVVFDEITPNPTDKQVNKGAEIAVNEKVDFIVGIGGGSVLDAAKAISIVSSNEGYAWDYVRYPEGSRLIPFLNRPVITIPTTAGTGSEVNRYSVLTNPMTKEKMVISHSLNYPKVALVDPELTYSMPPRLTALTGFDALMHALESLTNKRENFIAEEYSVKAIELIRKWLPVAFEEPENKEARRYMSYAAMLAGIAIDHLGVALIHAMEHPVSGHYPEVAHAEGLSALAPYITAFNYRGNPEKYALFARLMGEEEKPHKAVDALVKFIERFSLPKTLKELGVEKEKLPRLAEDVYMCARHSFAVNPVEVGMEEVEELYERAYEGRL

SEQ ID NO: 87 - protein, 415 aa, Aquifex aeolicus
MKILVQKFGGTSVGTLERIELCAKRVIKALEKGYKPVVVSSAMAGETDSLIELAKKVHPRPPEREMDTLLAVGEQKAIALFAMTLNKLGYPAVSLCGWQVPIITDNVHTKARIRKIGISRLLSLIEEGYIPVVAGFQGVTEDWEITTLGRGGSDTTAVALAAALKADCEINTDVPGVFTADPRIVPNAKKIKKISYEEMLELASLGAKVMQIRSVEFAAKYNVRIHVRSTFSEEEGTWIVPEDEVMEKVAVRGITVDTKETRFTVVRVPDKPGIAAEIFKALGDAHIVVDMIVQNVSHEGYTDMSFTVNKTDADKAEEIVKKIAQKIGAKEVVRDDKVAKISIVGIGMKSAYGVAGRMFDILARNGINIKAISTSEIKISCLIDEKYAELAVRALHEEFIEEMEEFETINGKNKE

SEQ ID NO: 88 - protein, 376 aa, Aquifex aeolicus
MYNLRMAESVTEGHPDKIADQLADALLDEFIKKDPYSKVSLEIMVTTGLVMVGGELTTESYVDIPRVVRSVIKDIGYTRPELGFDADTCAVVQSIDEQSPEIALGISSEGAGDTAIVVGYATKEAPNLMPWPITIAHKITKRISEYRKIGKFPFLRPDGKVLVAMIYEDGKPSYVQSIVAYVHHDPDVSINHLRELIIEEIIKKEIPEEFLTEKTSIKVNPTGRFVIGGPVADTGLTGRKIVSDAYGDIGLSGGSAFSGKDPTKTDRSGSYLARMIAKHVVAGGWAERCLVQIGYAFGLTEPVAFDIETFGTEKISKEILEDAVKKVFPLRPAEIIEFLDLRKPIYRQTSVYGHFGKENLPWEKLTKLEELKELLD

SEQ ID NO: 89 - protein, 537 aa, Aquifex aeolicus
MSKKVVILGSGPNRIGQGIEFDYACVHAVFSLQEEGYYAVMVNCNPETVSTDYDTADKLYFEPIVFEHVMDIIEREKPEGVILQFGGQTPLKLALPLQKNGVKILGTKPESIDKAEDRELFRELIIELGLKQPPSGTARTKEEALKIAKEIGFPVLVRPSYVLGGRAMRIVYDEEELKEYLEEAVSVSHERPVLIDKFLDNSIELDVDAVSDGKDVLIGAVMEHIEEAGVHSGDSATSIPPYSLSKEIVEEVKEQTRKLAVALEVKGLINVQYAVQNNEVYVLEVNPRASRTVPFVSKSIGYPLAKIATKVAIGKSLREILPEVFERLEKGEAHFASDFLPKEKKIFSVKEVVFPWKRFPEVDPILGPEMKSTGEVMGIDKEFGLAYYKAQLSAGYRLPEKGNLFISVADRDKPKILELAKEFEKLGFGIYATSGTYKFLKEHGVNAKRVLKVSEGRPNVVDMIINGEIHLVINTPSGKREKSDAYYIRRACVQFNVPYYTTMRAGYAVLEAIKSIKKLKEEGKGLSVHSLQEIYNI

SEQ ID NO: 90 - protein, 418 aa, Aquifex aeolicus
MEFDVKDLSLAEEGLKRIEWAEMDMPVLRQIRERFSKEKPLKGKKISACLHVTTETANLMRTLKEGGAEVYLTASNPLSTQDDVAAALVKYFEIPVFAIRGEDRETYYKHLRAVIEKEPDVVIDDGADLISTLHKEYPGLAEKVLGGMEETTTGVIRLRAMAEQGVLKFPIIAVNDAYTKHMFDNRYGTGQSTIDGILRATNRLLAGSYFVVAGYGWCGKGVAQRARGMGAIVIVTEVDPIKALEARMDGFLVMPMEEAAKLGDFFVTVTGNIHVIRREHFEVMKDGAIVANSGHFNVEIDIPALEEMAVEKREIRKEVTEYKLKDGRRIYLLAEGRLVNLAAAEGHPASVMDMSFSNQALSAEYIVKHHKELEKKVYRVPREIDEAVARLKLNALGIKIDELTEEQKKYLSSWEMGT

SEQ ID NO: 91 - protein, 420 aa, Aquifex aeolicus
MELLKEYNPYLEYRDGELFIEGVSLKELAQTFGTPLYVYSSNFIKERFEAYRKAFPDALICYAVKANFNPHLVKLLGELGAGADIVSGGELYLAKKAGIPPERIVYAGVGKTEKELTDAVDSEILMFNVESRQELDVLNEIAGKLGKKARIAIRVNPDVDPKTHPYIATGMQKSKFGVDIREAQKEYEYASKLENLEIVGIHCHIGSQILDISPYREAVEKVVSLYESLTQKGFDIKYLDIGGGLGIKYKPEDKEPAPQDLADLLKDLLENVKAKIILEPGRSIMGNAGILITQVQFLKDKGSKHFIIVDAGMNDLIRPSIYNAYHHIIPVETKERKKVVADIVGPICETGDFLALDREIEEVQRGEYLAVLSAGAYGFAMSSHYNMRPRAAEVLVENGSVKLIRKRENYDYIVEPSLDI

SEQ ID NO: 92 - protein, 473 aa, Aquifex aeolicus
MSKVKTRFAPSPTGYLHLGNARTAIFSYLFARHNNGGFVLRIEDTDPERSKKEYEEMLIEDLKWLGIDWDEFYRQSERFDIYREYVNKLLESGHAYPCFCTPEELEKEREEARKKGIPYRYSGKCRHLTPEEVEKFKKEGKPFAIRFKVPENRTVVFEDLIKGHIAINTDDFGDFVIVRSDGSPTYNFVVVVDDALMGITHVIRGEDHIPNTPKQILIYEALGFPVPKFAHLPVILGEDRSKLSKRHGAVSVRAYREEGYMPEALFNYLCLLGWSPPEEGREIFSKEELIKIFDLKDVNDSPAVFNKEKLKWMNGVYIREVLPLDVLLERAIPFLEKAGYDTSDREYIKKVLEYTRDSFDTLSEMVDRLRPFFVDEFEIPEELWSFLDDEKAYQVLSAFLEKIREKKPETPQEVKKLAKEIQKALKVKPPQVWKPLRIALTGELEGVGIDILIAVLPKEKIEKRILRVLEKLS

SEQ ID NO: 93 - protein, 254 aa, Aquifex aeolicus
MPQYALVIDLNTCVGCHACATNCKEWNTQAAFGPLSDYDPYGREASGVWYNRIFTYETGEFPETQVFHLPKSCLHCQDAPCVPVCPTGASYKREQDGIVLVNYDDCIGCKLCSWACPYGCREFDEADKVMKKCTLCIDRIYDETLPPEHRQPACVLTCPARARFFGDIEDPNSEVYKLIKERNGFVLFPDMGTNPANHYLPRQETRINLEEFEKHILKPDNPLFLEVMRRHHTSSKAQAQETPQEEVTHSEELP

SEQ ID NO: 94 - protein, 984 aa, Aquifex aeolicus
MLIRPISFAYNPLRKCDCKWKSLRLILNGSTGGLKMEIGGSFYERKYYSTCYMCACRCGIEVYVRNGKVTYIKGNDDHPLNKGVLCAKGSSGIMKEYSPARLRKPLLRVGPRGSGQFKEIEWDEALEIAAKWIKEAAQKNPSKVAFFTGRDQMQAINGWFAGQIGTLNWAAHGGFCSVNVAAAGLMSVGYSFWEFGDPDFEHTKYFMMIGVAEDHASNPFKLGIQELKRRGGKFVFVNPVRWSYGAIADEWVPIKPGTDGAFILGLAHVLFKYNLIDWEFLKEFTNAPWLVIQAPGTPKDGLFYRNEEGKPMVFDKKSNSFKPADRIVPEDLDPAFIGEFETPEGYKVRPAFDIFAERIVKDYTPEKVEKITGIPAETIERIAKELGVTALYNPIELPIEWTDVWGRKHKKMVGRPVSFHIMRGIASHTNGYQTARAVFVLMMLLGCIDRPGGHLAKPPYPKHIEDLPKPKKIKSLDELEFGKPYGPHLGIPQSPDDLLVDEKGNPLRIDRAYSWEFPIAAHGCIQNVIPAAYQKDPYDIEVLMIYMANMAWNSSQNIPYILEALTAKDASGNYIIPKIITIDAFYSEMVAYSDLVLPDATYLEQWFALSLLDRPPSVASGPVDAIRQPIVEPQDLKGEKLDVLPWGEVMVRLGTKLGLPGFLNEDGTPKYKDWKDFLINWQPQPGVGALAGWRGKNGDKHFVGEPNPNQLEMYAKNKGFFYYPLPEHMRYYRHVNKDYLEWAKSVKFVKRTDPIIMNFYVETLQKFRLAGQGLWEGENQPPNDPAIRERLVRYFDPLPFWYPPFEEEVSGKDYPLYAFTKRPQWMYHSWDSQNAWLRQISTRNYLYMNPKTAKKLGIKHLDWVWVESRIGRVKCQVFLTECTEPNSVWTWNAIGKMIGAWGLKPEAEEGHQGFLLNHVIPHSIKMNGKEFYYGDPITGHLAWFDTKVRVYKAEDQTPETYPEFKVEPLPYIKERWVDVLRYKP

SEQ ID NO: 95 - protein, 241 aa, Aquifex aeolicus
MKLFITGIGSGLGKALVEEGIKRGYEVYALSRHLPEEFKEKIHFVKCDLLKVEEVQGCLFKLLSGVKELELAILNAGILGKFSDMKDISLHEIDEVMKVNLWSNKVIIDTLMELGIKVKTLIGISSGAARNCNRGWNAYSLSKAGLNCLLKLYSWELPETKVISLAPGLVLTPMLKEVMSQNEEKYPSIKRIKNAPKLTPEKTAEFIFSILPKLESVESGSFVDVRDFPEYEEYILRYGVY

SEQ ID NO: 96 - protein, 406 aa, Aquifex aeolicus
MGEIFVAGVNFKVAPVEVREKLACSLEETKKVLPILKRETPLEEVMLLSTCNRVEVYAYNFVENSEDLINKLLEIKRLNPSFKRYFFVKRGEEAVYHIFKVASSLDSMVIGEPQIVAQFKEAYRVAKEAGTVGKILNRVYEKALRASKRVRTETGISRSAVSVSYAAVELAKKIFGDLKEAKVLLIGAGEMGELAANYLRRFGAKLHITNRTYERALKLVKELSGNVLRFEELKEYLPLMDIVIVSTGAKDYILKREDFERSVRERHYEPQFVIDIAVPRNVDPEAGNVEGVFLYDIDDLKQVVEENLKERIKEAQRGEIILWDEVKKFMNWYESLKAEPYILELKASVEGKEVSPYIKKLVHRAIKEIKRNPEVADIILRIFKEVEKNEPRRKELSNVYNGTHGA

SEQ ID NO: 97 - protein, 432 aa, Aquifex aeolicus
MEKLIILGAQWGDEGKGKIVDLLSEHFDITVRYQGGSNAGHTVVVNSQKFILHLLPTGILHEHVKGVIAQGMVVDLEVLHKEVKNLEEKGIYVKERLFISDRAHLVMPYHKLLDSLFEKKKGIGTTLRGIGPAYMFKYGRKGIRISDLKDEKRFYTLLEDNLDFVKNICEKVFCEKFDLDINQIYEEQLRYFEEFKENVVDLLRFFNTQKGSVLFEGAQGTLLDVDMGTYPYVTSSNASALGLSNGTGMPPKYFSDAFFLGVAKAYTTRVGEGPFPTELKGEEGEKLRELGGEYGSTTGRPRRCGWLDLVALKYAVQVNGLDGFVITKLDVLDTFDEVKVCVAYELDGEVIDYFPASYSELIRVKPVYKTLKGWKKSTKGAKDVSELPKEALDYVKFIEEYTGVPVVMLSTGPKRDEYIWLKEILRTRSGYS

SEQ ID NO: 98 - protein, 810 aa, Aquifex aeolicus
MFEKFTERARQVILRAREEALELGHSYLGSEHILLALIKDEDIPVLVLSKLGVSPEKIRKAIMGQITKGSHSGEVLFAPDAKRVIEFAVEEARILHHQFVGPEHLLIGVVREKTGLGGRILRSFGLDEYSVRREVLQLLGELPPQESQRYVSTPNLDRFSRDLTQMAREGKLDPVIGREKEIERVIQILVRRRKNNPVLLGDPGVGKTAIVEGLAQRIANKEVPEPLLNKRVVALDLAALVAGTKYRGQFEERLKNILKELEKANNVILFIDELHTLVGAGSAEGSIDASNMLKPALARGEIQVIGATTVDEYRKYIEKDGALERRFQPVYVEQPSPEDTIQILYGLKPKFEEFHKVEYTPEAIEKAVELSVKYITDRNLPDKAIDVMDEAGALVKLKATQLPPELKEIEEKIKELEKEKEKAVKEQDYEKAAKIRDEELRLRAKFETMKAKWKEEMEKNRPKVTDEDVAEVVARWTGVPVKRVHESDAEKLLHIEEELKKRVVGQDEAIKAVAKAIRRSRVGLKGKHRPIGVFMFLGPTGVGKTETAKALAEYLFGTEDALIRFDMSEYMEKHTVSRLIGAPPGYVGYEEGGQLTEAVRRRPYSVLLFDEIEKAHPDVFNIFLQIFDDGRLTDGLGRTVDFSNTIIIMTSNLGARLITGGTMGFEKKQGLLNFEEMRKNVLDQVKRTFSPEFLNRLDEIIVFRPLEKKDIEQILELQLKEINEKLKDWNVRVKLHKSFVNWIIEKEYKPEFGARSLKRALQRHVEDLLAEELIKGTLKGVEEVEIRVRNDKPYLKPVKKKEKVEALLEK

SEQ ID NO: 99 - protein, 436 aa, Aquifex aeolicus
MDLYEYEAYDKIFKKYGIPTPKYMFVEHITDDVVEFVNQLGECVVKSQVLVGKRGKAGAVRVCSNPDEALEEIETLLRMTVYGEMPVGVLVVEKANILKELYASIVYSTDHRAPVLTLSLEGGMDIEEVPPDKVKSWPINPLKGLYPHMVRNYLLELGFPHEYMPVLRKLSEVIARMWDAFWGAEARLLEINPLAIVDRGGKPDVLALDAVVKIDDDASIPPAKIYGVRTALRRPPTEREIAAAEIDKDDHRGKAGSYVELDGDIAMMTFGGGGSTVTIETCYELGLKPANLTDIGGNPPAEKMYKITRIILSKPGIRAVLIAGGTANNTRIDVTLGEGVANALRDLKKEGKLDPNWIFVVRRNGPEAEKGLRMLYEAFKECGIKGEIYDSALPLTEAPVRLKELLDKCQAKKLEEEEQIKEGHTFTDEQASDLGM

SEQ ID NO: 100 - protein, 398 aa, Aquifex aeolicus
MKKLLSLENLTLLSLILAVFFGIYFKEIALNIKLFGDVFLSLLKMIIVPLVFTSVFTAILNLESLAKFRDLGLKAFLYYFTTTGMAVFTGLVLVNIIQPGKGASGVSAKPEEIPKVQEFSLENLILGLIPQNPFEAFSEGKVLQIIVFAVFIGLAVLTIDKFKQEIIKNFFEGFNEALIRLTKWVIVLTPVGVFALVSYLIAKVGYQVLISLWEYALTVLLGLLIHAFVNLPLIAYIFGRYNPYKYFIQVREALLLAFSTASSAATLPVSLELAIERGKVKKEVAGFVLPLGATINMDGTALYESVAAVYIANLYGIDLSISQMVTIFLTATLASIGAAAIPGAGLVLLTLVLSSVGIPLEGIGLIIAVDRFLDMLRTAVNVWGDLNGAKILNRYVNS

SEQ ID NO: 101 - protein, 213 aa, Aquifex aeolicus
MRVILFDLDGTLIDSAKDIALALEKTLKELGLEEYYPDNVTKYIGGGVRALLEKVLKDKFREEYVEVFRKHYLENPVVYTKPYPEIPYTLEALKSKGFKLAVVSNKLEELSKKILDILNLSGYFDLIVGGDTFGEKKPSPTPVLKTLEILGEEPEKALIVGDTDADIEAGKRAGTKTALALWGYVKLNSQIPDFTLSRPSDLVKLMDNHIVEF

SEQ ID NO: 102 - protein, 343 aa, Aquifex aeolicus
MKAVILTGFGGIENLKYVEDFPKPEPKEDEVLIRVKAVALNHLDIWVRMGALPVKPELPHILGSDVSGVVEKVGSLVKNVKEGEEVIIAPGLSCGVCWDCQSGRDNHCKDYDILGLKNKGGYAEYVAVPARNVIKKPKNLSFEEAASYPLTFLTVWNALVDKAQIKPYSRVFIWAGSSGVGVAGIQLAKAFNAFVITTAGNEEKAKKCKELGADLVFNHYKDDVVKKVREVFKEGVDVVVDHIGEATFWKSVQMLRKGGKLVFFGTTTGSKGEIDIRYVFVREIQLLGVYMGSRANLFKITELFERGVFKPVVDKVFPLKEVPQAHKYLEESKHFGKVVLKVE

SEQ ID NO: 103 - protein, 457 aa, Aquifex aeolicus
MEKPWSGRFKEETDKFVEDFTESVSFDKELAFEDIEQDIAHVKTLQKAGILTEEEARELIQELLKIKEEIKEGKFQWKKELEDVHMNIEAELINRLGDVGRKLHTARSRNDQVATDEKLYLKKEIKEVLQLLKELRKTLVELAETTVDFVMPSYTHLQRAQPIRVAHYFLAYREILLKDSERLMDTYRRVDELPLGSGAVAGVDFPLDRFYTAELLGFNRVTRNSMYATAERDFIIEFLSNCALIAQHLSRLAEDLIIWNTEEFNFVELPDKLCTGSSIMPQKKNPDVLELIRGKTGRIYGNLIALLTTMKALPMAYNRDMQEDKEPLFDTLKNLKNMIKGMTLVLSDLRVKEQNMRKASGNFLLITDIANYLVEKGVPFRTAHHIAGSIVAYLLEKGKKLEEMTLEEFKQFSEKFEEDVFDILSPERAADRKRVYGGTAKEEILRIIEVAKAEEGL

SEQ ID NO: 104 - protein, 310 aa, Aquifex aeolicus
MPLVSGKVLFEKANEYNFAIGAFNFNNMEFLKAILDAAEEEQAPVFIQTTESAIKYAGIEYLAGMVHAVKDKYSIPFALHLDHGKHVETILLAIRHGYTSVMIDYSDKSYEENLKVTKYVVSICAALGISVEAELGKLVSVEDEVVSREEVLVDPEQAKEFVDRTGIDALAPAIGTAHGAFKFKGEPKLDFERLKKVKELTGIALVLHGASGVYEEYVEKINKYGGDIKGAKGVPDEELKKAVELGINKVNTDTDLRLAFISKLRELMALEKKVIDPRKFLKPAMEEVKNIVKKRIRLYGSQGKAELFRV

SEQ ID NO: 105 - protein, 585 aa, Aquifex aeolicus
MMEYRILAEFYERIEKTTSRIEMVSSLVELFKQTPKELIDKVVYLSIGKIAPEYTGLDYNFGEKLAIRALSRVLKIPALEIEKRVRQEGDLGEAGRKLYEELGFKPEGTLTVEEVYNGLLNIAKAVGIGSQERKISIFASLLKKATPLEAKYLLRTITERLRLGIGDNTILEALSIAFTGSSVNREVVERAYNLTSDLGYVAKILAEKGLEGVKQVKIQVGRPVRPMLAERMSSPILILRKLGGKCGAEYKYDGERIQAHRKGDEFYLFSRRLENITHQYPDLIEFLKEAIPHDFIVELEAVVIDPASGEIRPFQELMHRKVKYVTKYHITKYPVAGFLFDIIYLDGEDLTLKPYPERREILEKVVKRTDRIGLVPRKIVDNVEDLENFFYQAIEEGCEGLVCKSLAPNSIYQAGKRGFLWIKYKRDYKSVLADTLDLVVVGGFYGKGQRKGTFGSLLMACYDPESDMFKTVTKVGTGFTEDDFKKLEEILMPRKLNHRHPRVNSILEADMWFEPYLVLEITGAELTLSPVHTCGWGKVSPNRGIGLRFPRFTGRYRFDKRPEDATTEQEIIEMYRMQRKIRVRS

SEQ ID NO: 106 - protein, 131 aa, Aquifex aeolicus
MRKLKYQRDFFPLLHLNYGSNWRCGMDRIAYFKSLLEKNPDNPMVHYSLGLEYFKVKDYENAIKHLERYLELQEDEGAAYRTLAKCYEELGEFQKAIEVLEEGIRQAMKYNHPSMAQEYQQWIEELKGMAF

SEQ ID NO: 107 - protein, 679 aa, Aquifex aeolicus
MRKAFKVYGMSCVNCARAIEITLKRTEGVKNVNVSFELGRVEVEFDEDLISEEEIVKKIEELGYSVERKKDYDKLFLGLGVLSSLFFLVGMFFTFPLKYELQFLLSSIVQFTAGWKFYRGAYSSLKKGIGSMDTLVALGTTGAYVYSVLSYFNLINSTPFFETNVFLITFVRLGKFIEEKAKERAVKGLKELVNLSFRKVKVLEGEKEVEKNVREVFKGEKVVYRSGEQILLDGVIIKGEGLVNEAVITGEPVPILKKEGDEVYSGSVLEKGYIITKVTKTFESSFINTMKKLVEESLKEKPKIQRISDKVSHYFVLFVVILSVITFLTWFIKTGEINRAVQFSLAVLVVSCPCAFGIAVPLAVSVGIYKAVKRGILPKKGTIFEVAPKVDTVIFDKTGTLTEGKLKVKEINVPEKYFDVLYSMENYSNHPVAKAVREYLKPYVKREAKLEGCEEILGVGVRCGEFIAGKAELWGKNSQNGVIRVGFGTKDKLIGEIILEDSVRKEAKEVVEFLKGKGINVILLTGDTKENAQRIAKELGIKEVIANVKPEEKLKVVKELQEKGRKVCMVGDGVNDAPALAQSDLGIAVAEGTDLAKLSGDVVIHKLSSLPQVFTLSERVYRKIKENFFWAFAYNVTFIPIAAGVLWSKGIYLKPEFAGLLMALSSVSVVLNTLRLLKD

SEQ ID NO: 108 - protein, 477 aa, Aquifex aeolicus
MFRKVLVANRGEVAVRIIRACKELGIKTVAIYSEADVRSLHVKKADEAYLITGDPIRAYLDYVRIVDLAKQVGADAIHPGYGFLAENADFARYCRRRGITFIGPTPEQIEMFGDKVKAKKVMKEVGLPTIPGTEEPVRTLEDAKHAVKEIGFPVMLKAAYGGGGRGMRVIRNEEELEKNFESAFREAETFFGKGDLFIEKYVENPKHIEVQILGDKYGNIIHLGERDCSIQRRHQKLIEIAPSPKLPQDLRMKILGNAVRAMTRVGYENAGTLEFLVDLKTGEYYFIEMNTRLQVEHTITEAITGVDIVEAMIRIAAGEPLPYLQSDITFRGYAIEFRINAEDPKKNFAPAPGKITSYYSPGGPGVRIDASVYKDYIIPPYYDSMIAKMTVWALTWEKAVARARRALDEFVVRGVPTNIPLYREIVRDPDFLKGDFGTRFLEEKIAKGEYDFEIEGEKPMEDVVLAISAAIAAHYGL

SEQ ID NO: 109 - protein, 696 aa, Aquifex aeolicus
MEKTEKNELVRKLIFNPQGDREASKRKIIKGNPTNIFELNEIKYSWAFDLYKLMGFTNFWIPEEIQMLEDRKQYETVLSDYEKRAYELVLSFLIALDSFQVDMLKEFGRMITAPEVEMAITAQEFQESVHAYSYQFILESVVDPVKADEIYNYWREDERLLERNKVIAELYNEFIRKPNEENFIKATIGNYILESLYFYSGFAFFYTLGRQGKMRNTVQQIKYINRDELCFIEGTEVLTKRGFVDFRELREDDLVAQYDIETGEISWTKPYAYVERDYEGSMYRLKHPKSNWEVVATEGHEFIVRNLKTGKERKEPIEKVKLHPYSAIPVAGRYTGEVEEYDLWELVSGKGITLKTRSAVKNKLTPIEKLLIVLQADGTIDSKRNGKFTGFQQLKFFFSKYRKINEFEKILNECAPYGIKWKKYERQDGIAYTVYYPNDLPIKPTKFFDEWVRLDEITEEWIREFVEELVKWDGHIPKDRNKKKVYYYSTKEKRNKDFVQALCALGGMRTVVSRERNPKAKNPVYRIWIYLEDDYINTQTMVKEEFYYKGKVYCVSVPKGNIVVRYKDSVCIAGNCHVTLFRNIINTLRKENPELFTPEIEKWIVEYFKYAVNEEIKWGQYVTQNQILGINDVLIERYIKYLGNLRITQIGFDPIYPEVTENPLKWIDEFRKINNTKTDFFQAKPQTYSKANELKW

SEQ ID NO: 110 - protein, 426 aa, Aquifex aeolicus
MNKTTFENVYYWEGKAQIPQEGQFIKLKEDKTLEVPDNPIIPFIEGDGIGPEITQAMLLIINTAVEKTYNGSKKIYWVELLAGDKAEEKTGERLPQETLDVLKESIVGIKGPLGTPVGKGVRSINSALRRAFDYYSAVRPVYWMGQATPIPNPERVDLVVFRENTDDVYAGVEFFAGTPEAKKVREFLIKEMGAKEEGFPEDVGITVKPMSEFKTKRHVRKALRYALENNKKNVAVIGKGNIMKATEGAFINWAFEVAEEPEFKGKVVTDPEAEPGEGQVKLTKVITDQMLMQLVLKPEAWDVIIAQNLNGDYVSDLAASLIGGPGFVPSGNIGDGYALFESTHGTAWDIAGKGIANPLSLTLSGAMMLEYIGWKEAAQKVYDAVRRTLAEHIGTPDIASGFQKQGIEAKAVGTMEFAEEISKRIE

SEQ ID NO: 111 - protein, 472 aa, Aquifex aeolicus
MFNKVLVANRGEIAVRIIRACKELGIPTVAIYNEVESTARHVKLADEAYMIGTDPLDTYLNKQRIINLALEVGADAIHPGYGFLAENAEFAKMCEEAGITFIGPHWKVIELMGDKARSKEVMKKAGVPVVPGSDGVLKSLEEAKALAREIGYPVLLKATAGGGGRGIRICRNEEELVKNYEQASREAEKAFGRGDLLLEKFIENPKHIEYQVLGDKHGNVIHLGERDCSIQRRNQKLVEIAPSLILTPEKREYYGNIVTKAAKEIGYYNAGTMEFIADQEGNLYFIEMNTRIQVEHPVSEMVTGIDIVKWQIKIAAGEPLTIKQEDVKFNGYAIECRINAEDPKKNFAPSTGVIERYYVPGGFGIRVEHAAARGFEVTPYYDSMIAKLITWAPTWDEAVERMRAVLETYEITGVKTTIPLLINIMKEKDFKAGKFTTKYLEEHPEVFEYEEHKDKEDFAALISAAIAAYHGL

SEQ ID NO: 112 - protein, 655 aa, Aquifex aeolicus
MVVNPEVIEEVKEKIKEVKNKGFKKKILITDLTPRDGQQCKLATRVRTEDLLPLCEALDKCGFYAVEVWGGATYDVCLRYLKEDPWERLRRIKEVMPNTKLQMLFRGQNIVGYKPRSDYVVKKFVEKAIENGITVFRVFDSLNDNRNIETAVKAIKEFGGEVHAEISYTRSPIHTYELWMRYAQELAEMEPDWISFKDATGIMQPFECYQIIKGIKEVTGGKIPVLLHNHDMSGMATMNHIMAVLAGVDMLDTVLSPLAFGSSHPATETIIAALEGTPYDTGLDLQKVSEAAEIAKKIKKKYKKYETEYAGVNAKVLIHKIPGGMISNMVAQLMEANALDKIEEALEEVPRVEKDLGYPPLLTPSSQIVGVQAVLNVITGERYKVITKEVRDYVEGKYGRPPGPISKELVEKILGPGKEPDFSKRAADYADPHEWDKAKKELEELFKREPTDEEVLLYILFPMQAKEFFELREKGELHPEPVEAELPEVAETKPGEVPGAAPVEFELTYHGEKFKVRIEGVSVDAESGKPRKYYVRINNRLEEIQLKPFKEAIPQGGGAQTVQSAEEEEGIPKATEPGDVTPPMPGKVVKILVKEGEPVQQGQTVATVEAMKMENEVHAPIDGIVKKIFAKPGDQVNPDQAIMRIVPHKEDKSYQ

SEQ ID NO: 113 - protein, 431 aa, Aquifex aeolicus
MKKIEKIKRVKGELRVPSDKSITHRAFILGALASGETLVRKPLISGDTLATLEILKAIRTKVREGKEEVLIEGRNYTFLEPHDVLDAKNSGTTARIMSGVLSTQPFFSVLTGDESLKNRPMLRVVEPLREMGAKIDGREEGNKLPIAIRGGNLKGISYFNKKSSAQVKSALLLAGLRAEGMTEVVEPYLSRDHTERMLKLFGAEVITIPEERGHIVKIKGGQELQGTEVYCPADPSSAAYFAALATLAPEGEIRLKEVLLNPTRDGFYRKLIEMGGDISFENYRELSNEPMADLVVRPVDNLKPVKVSPEEVPTLIDEIPILAVLMAFADGVSEVKGAKELRYKESDRIKAIVTNLRKLGVQVEEFEDGFAIHGTKEIKGGVIETFKDHRIAMAFAVLGLVVEEEVIIDHPECVTVSYPEFWEDILKVVEF

SEQ ID NO: 114 - protein, 285 aa, Aquifex aeolicus
MLRKLSKFSNKGEVFMGLLEGKRALITGVANERSIAYGIAKSFHREGAQLAFTYATPKLEKRVREIAKGFGSDLVVKCDVSLDEDIKNLKKFLEENWGSLDIIVHSIAYAPKEEFKGGVIDTSREGFKIAMDISVYSLIALTRELLPLMEGRNGAIVTLSYYGAEKVVPHYNVMGIAKAALESTVRYLAYDIAKHGHRINAISAGPVKTLAAYSITGFHLLMEHTTKVNPFGKPITIEDVGDTAVFLCSDWARAITGEVVHVDNGYHIMGVFGREEEIKKEVYGD

SEQ ID NO: 115 - protein, 554 aa, Aquifex aeolicus
MNNYRWLYNLSKPYILLFLLSLLGSLIQSSGATALALLVKQVVDNVLILKNQEELLKYVLLLFSSALIIQVGFFISSFTLSYISEKVIYSLRNEIYEKLLYAPINYVLYTPSGELISRIVSDLEQLRQVFADYIPKLLREPLVVLALFGVLLYRDLFLTLLILLLFPVMALFTKYFSEKKKKHLSRQREKVALLTSILSETLRGFENIKLFLAENRFIKDFKELSFRIFRSSVKINLYVVGNTVINYTFGYAVVSLILFAGGYRIVKGDITTGDFISFLTALFMIQKPLMETQKAIMNLRGSAPIFERIRNLLNVPEEKDGSEEFEGLKERIEFRDVSVKINRKEILKNVNLSVYRGSKVGIKGHTGSGKSTFVKLIPRLLEYEGEIFVDHTELREFKLKSLREKIGFLSQEVMVFRGSVRENLLIAKPDATEEEMLKALELAKCDFVLNSPEGLDKFLEEGGKNLSGGEKQRLALARIFLKNPEIVILDEATSALDPKTEEEVIYNLYKFLKEKTIFAVAHRPFIFNFCDVILEFEGGRLKEFSTSKENSIKL

SEQ ID NO: 116 - protein, 425 aa, Aquifex aeolicus
MFVKLLPPEVRKVIAAGEVIESPVDVVKELVENSLDAKATKVEVEIVKGGKRLIRVKDNGTGIHPEDVEKVVLQGATSKIETEKDLMNISTYGFRGEALYSISSVSKFKLRSRFFQEKEGKEIEVEAGNILGTRRVGMPVGTEVEVRDLFFNLPVRRKFLKKEDTERRKVLELIKEYALTNPEVEFTLFSEGRETLKLKKSSLKERVEEVFQTKTEELYAEREGITLRAFVSRNQRQGKYYVFINKRPIQNKNLKEFLRKVFGYKTLVVLYAELPPFMVDFNVHPKKKEVNILKERKFLELVRELAGKEKPIVDIPLSQPVKTYKPTYEILGQMDETFILVKDSEYLYFVDQHLLEERINYEKLKDENLACRISVKAGQKLSEEKIRELIKTWRNLENPHVCPHGRPIYYKIPLREIYEKVGRNY

SEQ ID NO: 117 - protein, 142 aa, Aquifex aeolicus
MAVERTLIIVKPDAMEKGALGKILDRFIQEGFQIKALKMFRFTPEKAGEFYYVHRERPFFQELVEFMSSGPVVAAVLEGEDAIKRVREIIGPTDSEEARKVAPNSIRAQFGTDKGKNAIHASDSPESAQYEICFIFSGLEIV

SEQ ID NO: 118 - protein, 443 aa, Aquifex aeolicus
MKGIRRNLQKSYLKRCSEMYLRGLKVSGEIVSAKGIYLEAILPFANIGNEVEIQSNSRRIRGEVIGFSGDKVLVMPYEPVFGLRKGDKVLLKNELVSTKTGNGVVGKVVDPFGNPLDGGFIGFVEEKGLELPQINPLYRERIREVFDTGVRSVNALFTLGKGQKIGIFAGAGVGKSTLLGMITRHSKADVVVLALIGERGREVKEFLEEVLGEEGLKKSVVVVSTADQSPILKVKGAISAVVHAHHFASQGKDVLLLMDSITRLALAQREIGLAAGEPPTLKGFTPSVFQLLTRIAESCGAFKKGSITGIFTVLVEGDDISLDPIADSLMGVLDGHIILSRKRAVRGLFPAVDPVRSLSRLMPKLVSEEHFMKANFFKEVLSKFEDVEELVRIGLYKGGSNPLVDKVINNLEKVESFFKQKPEEKVNFEESLKALDEIYSLLK

SEQ ID NO: 119 - protein, 620 aa, Aquifex aeolicus
MREIKVTDVSLRDGIQSLLATRVRTEDMLDVIEILDKCGFWSLEVWGGATFDVCLRYLKEDPWERLRKFKERAKNTKLEMLLRGQNVVGYRHYPDDVVEEFVKKAYDNGIEVFRIFDALNDTRNMRKSIETAKKLGAIVKGVLSYTISPVHTIEYYVKVARELVDMGIDIISIKDQAGILSPKVCYELVSALKSEFPNYPVHLHTQTTADLAEMAQLKGIEAGADMIDTACYSLSGQTSHPPGETMIYVLREFGYEVKVNTELYKKAGDIMREVRKKYKKYDVLPPYPDVSVLIHQIPGGMISNFISQLREQNLEDKLEEVLEEVKRVREDLGYPPLVTPTSQIVGTQAFLNVLHGERYKVVTKETKDYVKGLYGRPPAPIKEEIIRKILGDEKPIYDIRPADLLEPELDKIRDEAIEAGARSEEDILSYALFPVVAKEFFEWREKVEKGELPPVPMEETVEETTECKAPVEFYVTVHGEQYHVQIAGKGEEDPTRRTFFIRLDGQLQEVQLQPIREVSVKEAFATEATEGGTVISKRPKPKGIGDVTSPITGKVVNIKVNVGDEVKEGDVLLVVEAMKMENEIHSPVDGIVEEIFVRVGETVNPDEVLIRIKPKRGKRK

SEQ ID NO: 120 - protein, 385 aa, Aquifex aeolicus
MKLHEHQAKEIFAKYGIPVPEGKVAFSLKEAKEVAEELGEFPLVVKAQIHCGGRGKAGGVKIVKDMDELEKAVESLLGKVLKTFQCPDGKPVNRVLIEKATNIDKEYYLAITLDRSKSKPVIMASAAGGMEIEEIVKENPEAIIIETIDPELGLMPYQARELAFKLNLPVKEFASIALKLYQIYSDLDASLVEINPLVLTKEGNLIALDAKLDIDDNALFRHKDLEEMEDETQLPQLEVEAKKYGLNYIKLNGNIGCMVNGAGLAMATMDIIKLAGGEPANFLDVGGGANVEQIANAFRILMADPDVKAVFINIFGGILRVDRLAQGLIEASKMVELRVPIVARLEGTNVEEGKRMLQESGLNFIIAEDMWDGAKKAVEIANKQS

SEQ ID NO: 121 - protein, 305 aa, Aquifex aeolicus
MAILVNKDTKVVVQGITGKEGSFHAKQCKEYGTQVVAGVTPGKGGMEVEGIPVFNTVKEAVKETGANCSLIFVPAPFAADAIVEALDAGIELVVCITEGIPVKDMMMVKDYMLKNYPNAKLVGPNCPGVITPGEAKVGIMPGHIFKRGKIGIVSRSGTLTYEAAYQLTKYGLGQSTAVGIGGDPVHGLTHRDVIEMFNKDPETEAILMIGEIGGTEEEEAAEYIEKEVDKPVFAYIAGITAPPGKRMGHAGAIIMGGKGTAKAKMEALEKAGAYVIENPAKIGETVAKILKVIELEEEERTSDAE

SEQ ID NO: 122 - protein, 313 aa, Aquifex aeolicus
MGNTLATHLDRKGHEVLLYDINEEVVKKINEGIHPYVEGIRFKNVKATTDLNQINEFKNLICALPVQVIPKVITKVNLKGKNFISASKGIIHENLKRISQLVKEIEPKLKFFVLSGPSFAEEVSKGLPTAIVLAYEDKEEAMKLQDALDSENFNVYLNDDITGVELGGALKNVIAIAVGLSDGMGYGYNARSAIITRGLHEMANVGEKFGARRETFFGLSGAGDLILTSTSDLSRNRTFGKLLGQGYSVEEALKKINQTVEGVKTAEALYEIIKRENIFAPICEGVYRIIKGEDPKKVYPHFLSNHLREEFQR

SEQ ID NO: 123 - protein, 311 aa, Aquifex aeolicus
MNGVKIIAGTSNKTLSEEIAGYLGLRLTDALITTFSDGEIRVQINESIRGYHVYVITSLSNPVNHNLMELLLTLDAVKRSSPKEITAVVPYYAYGRQDRQDKPRTPISAKLVADLIQKAGANRVIVVDLHSPQIQGFFDIPVEHLTAIPVLYDYIRKNVVLENPIVVSPDAGGVKRARDLANKLGCGIGVILKRRPEPNKAEVMDVVGDIEGKEAIIVDDIIDTAGTLVAAANLLVNKGVKRVIACATHGIFSGPAVERLTNSPIEKVIVTNTLPVYEKKFGKLEVVSIAPLIGEAIRRIQEGTSVSSLFT

SEQ ID NO: 124 - protein, 444 aa, Aquifex aeolicus
MFKRVLIANRGEIAVRAIRACRELGLKTVAIYSEADKNSLHVELADEAICIGPPDPSKSYLDIPRIMSALEVSKADAVYPGYGFLSENPKFAEIVEKSGAKFIGPRSEVLAKIGDKVLAKKVAKEVGLPLVPGSDEPLEFSEAVKLASKIGYPVVIKAAAGGGGRGIRIIRDEKELREKFPLAKKEAESAFGDGRLYIEKYVINPKHIEFQVIADEHGNVYVLGERECSIQRRHQKLIEEAPSVSVSEEKRKEISEKVAEFCKRLGYTSAGTVEFLMDEEGNFYFMEMNGRIQVEHPVTEMVTGVDIVKLQLIAAMGEEIKLEKVETNGFAIEFRINAEDPVTFIPSPGQVEKLILPGGPGVRVDTHLYQGYTVPPYYDSLLAKIIVWGNTRQEAIARGKRALGELKIEGKGLKVNTEFHLRVLDQKEFIEGKHDITFVERIMV

SEQ ID NO: 125 - protein, 334 aa, Aquifex aeolicus
MKGKLINSFLMKKPKISVIGAGKVGENVAYLLTILGLGDVYLFARYKKGLEPAKAKALDLKQMAVLMDIDINVKGISYDKEGFEELKGSDIVVITAGIPRREGMSREDLLYENLKILKKFTDAIKEYAKDSIIIVVSNPVDTLTYATIKLTGFEPRRVIGMAGVLDSARFKNFVKEKIGISNADIRTLVLGTHGDLMVPVTSHSFIGDKPIEEVFSASEIDELIEKTRKGGAQIVSLMGTSAYYAPAASVVIMVESIINDRKRVMPCSVYVEGEAAKHYEIEGVCIGLPVVLGKKGVEDFELVNLSGYEKRELLRSAKTLKEMVSLADKLLNEL

SEQ ID NO: 126 - protein, 1006 aa, Aquifex aeolicus
MISENLFSAKSLEYLEKAKEIARENKDTKVDTDHLLIALLLDEKSPLSKYIEKRGIDRKEFLKRVSEYLENLNKQLEKAIEAEAQNLINLRTQIMEVKSNIGNVQTELSKIRKAKERILRELEYARRYGDWWTAETLELELRQLEATEQSIRRQLEQVEKSLSTVFAPEDVKAFLENKLSIDGLIRKALEKSPLIEQVKELGISPDRIIDKVAEKVFGKKPTFDYSQYLTQVLEKAQDKAVSEGEAQVQPSHISAALIEAKDTIGGKLINQVLGGEKEMKKDVTQELKEEEKSPLERFGVNLNELARQGKLDPVIGREREINQVIEILLRRTKNNPVLVGDPGVGKTAIVEGLAQRIVNKEVPPELQDKEIWSIDMASLLAGSKYRGEFEERLKALLDEVKEKGNVILFIDEIHTVVGAGAAEGAVDAANIMKPALARGEIRVIGATTVDEYRKYIEKDPALERRFQPVFVDEPTEEQTIEILKGLRPRLEQFHKVKISDEAIEAAVKLTKRYVTFRRLPDKAIDALDQAAARKKLKVIGTPPEIQEIERKIKALEEQIIEANLKGDYEKEAQLKIEKAKLEKEKQELLGKVGGVEAKIAELKKKIEELDEKIKEAAEKGDYEKEAELKIEKAKLEKELKKLEQEKSKELVVTWDDVAEVVSEWTGIPVSRLKEEEMQKLLKLEDELHKRVVDQEHAVKAVAEAIRRARAGLKDPKRPIASFLFLGPTGVGKTELSKALAELLFGDEDALIRLDMSEFKEEHSVAKLIGAPPGYVGYEEGGKLTEAVRRKPYSVILLDEIEKAHPRVLDLFLQVLDDGRLTDSHGRTVDFRNTVIIMTSNIGSQYLLNIPVDADEETLNREFEKAKEKVLEELKLYMRPEFINRIDEIIVFKPLTMRELSKIIDLLIANVNKRLAERNIKIELTEEAKKELVRRGYDPAFGARPLKRTIQKYVETPLADKIIRGEIKDGMTVVVDYKDGEFVFIPKEEYEKQKAEVSASSEEKKES

SEQ ID NO: 127 - protein, 297 aa, Aquifex aeolicus
MREIRKVVLPVAGWGTRFLPATKAMPKEMLPIIDKPIIQFIVESFINIGIENIIFVTGRHKKAIEDHFDHNHELEEHLKKAGKEKLLREVVKISSLINPIYVRQKEQLGLGHAVLMAEPAVSQEPFFVALGDIIVENEEEELKKMIHLFRKFGNSIVALMEVPKEEVSKYGIAKVKKLDEETYIIVDLVEKPSPEEAPSNLAIVGRYIFTPTIFEKLKVTKPGKGGEIQLTDAMRLLLEEEAIYACKVNNTVYDTGNPKDYLKTVISFALRREDINGELIEFIRGLIKEEPKKEKAK

SEQ ID NO: 128 - protein, 321 aa, Aquifex aeolicus
MRIGILTAGGDAPGMNAVIRAVVRSAEREGHEVIGIKRGYKGLIEGDFIKLTSRDVGGILDRGGTILLSSRDPRYKKLEYREKAYKNLNEQGIEALIILGGEGTLAGAKLTAEETGIPVIGVPCTIDNDVGGTEYCIGYDTALRNAVDAIDKIRDTASSHERIFIVEVMGRNRGFIAVEAGLATGAELILIPEERFPREQIPEEIEKAKKLGKLHFIIVLAEGYCRAKELEDFLLEKIGDKYGEIRSTVLGHIQRGGIPTHFDRIMGTKFGVVAYESLIAGERSGFVAYEKGKFYIEDFEKAQEYKPIDREAYKLNTRLAI

SEQ ID NO: 129 - protein, 761 aa, Aquifex aeolicus
MVKTYAFGFPKLGEKREFKRLLENYWKGKISQEELIKGMEELNLWRANLYRENVEIIPSNELSYYDFMLDTTVMVGAIPSRFGEYRGLDTYFEMARGKNALELTKWFNTNYHYLVPELEGENFKLLINRPLEDYKFFKEKGINTVPHVIGLFTFLKLSKAPKRVEEEGLPVIILEKLDTKERLEKFTKALLPVYKELLESLKNEGVNRVHFEEPALVTDLEDYDWEILNEIYSELSKVGVDLGILTYYDSVSDYDKFVNLPVKALHFDLVSNEENLKNIKEKGFPEDKELIAGIINGRQPWRANLREKVKLLEELLKVSANLVVSNSCPLYHLPVTVEPEDELPEGLKERLSFAKEKLREIRLIKEALEGKEEALREVESSEKVMTAVFAQNPEVRRRLASLSEKDFQRELPYKERDKIQRDILKLPLFPTTTIGSFPQTEDVRKMRTAYRTGKISEEEYKNFIKQKIKYAIEVQEDIGLDVLVHGEFERSDMVEYFAIKLDGIATTKHGWVLSYGSRVYRPPIIYGDVSRPAPMTLEEITYAQSLTNKPVKGMLTGPVTILNWSYYREDVPKREIAYQIALALLDEVKDLENAGIKVIQIDEPAFREGAPLKKRDWPEYFDWAVKAFRLASRAKPETQIHTHMCYSEFNEIIEYIYQMDFDVISIEASRSKGEIIEVFEKFKGWDRQIGIGVYDIHSPAIPTKEEMKAIMLRAMKVLPKELLWVNPDCGLKTRRWEEVIPALRNMVDMAKELREEVGVKV

SEQ ID NO: 130 - protein, 306 aa, Aquifex aeolicus
MKRDFVDLWDLSPKEAWEIVKKTLKVKKGEEELGKPLSGKTIALLFTKPSTRTRVSFEVGIYQLGGNSLFFQEKELQVSRGEDVRDTARTLSKYVDGVIVRNHSHTWLKEFANFASVPVINALTNMSHPCQILSDVFTLYEHYGEELKNLKVAYVGDGNNVCNTLMVGAGMFGLKLFVATPEGYEPNSYYYKKALEFSKENGGSVELTNNPVESVKDADVVYTDVWVSMGEENKNIEAFLPYQVNEKLLSFAKSSVKVMHCLPAKKGQEITEEVFEKNADFIFTQAENRLHTQKTLMEFLFREPQA

SEQ ID NO: 131 - protein, 248 aa, Aquifex aeolicus
MEIKLQGKVSLVTGSTRGIGRAIAEKLASAGSTVIITGTSGERAKAVAEEIANKYGVKAHGVEMNLLSEESINKAFEEIYNLVDGIDILVNNAGITRDKLFLRMSLLDWEEVLKVNLTGTFLVTQNSLRKMIKQRWGRIVNISSVVGFTGNVGQVNYSTTKAGLIGFTKSLAKELAPRNVLVNAVAPGFIETDMTAVLSEEIKQKYKEQIPLGRFGSPEEVANVVLFLCSELASYITGEVIHVNGGMF

SEQ ID NO: 132 - protein, 78 aa, Aquifex aeolicus
MSLEERVKEIIAEQLGVEKEKITPEAKFVEDLGADSLDVVELIMAFEEEFGIEIPDEDAEKIQTVGDVINYLKEKVGG

SEQ ID NO: 133 - protein, 415 aa, Aquifex aeolicus
MKRRVVITGIGAVTPLGTGVKKFWENLVKGVSGVDYIKSFNPDEYGIPVKIAAEVKDFNPEDFMDKKEARKASRFVQFAIAAVKEALEDSGLLESEYDPYRVGVIIGTGIGGLKDIEDQTLILKEKGARRVSPFFIPYGISNMASGLVAIKWGFKGPNYCVTSACATGNHAIGDAFRLIQKGDIDIAIAGGTEAAITPLGVAGFASMKALSTRNDEPQKASRPFDRDRDGFVMGEGAGILILEEYERAKARGAKIYAELVGYGATDDAYHITSPHECGEGAYECMRLALEDAGIKPEEVDYINAHGTSTPLNDKTETMAIKQLFGEHAYKLKISSNKSMIGHLLGAAAAVEAVATIKTIETGVIPPTINLENPDPECDLDYVPNKAVEYPVRVALSNAFGFGGTNATLVFRKIEE

SEQ ID NO: 134 - protein, 364 aa, Aquifex aeolicus
MSQAVKDYYEILGVNRDATKEEIKKAYRKLVRIYHPDINPDPSAQEKFKEINEAYHVLIDDERRSEYDAILSRNDVGKFRDFLEYIQEFVESIIQGEKGKKRRPRKGQDIKMKLPLTLEEAGLGCEKEIIYSRWMDCPVCEGMGVKGEAETVVCHACNGEGRRVSGIFNFPRPCSVCKGKGFIVKNPCPTCYGRGRVSAQHKIKVHIPPGTEEGEVLKVPEKGHLGYFGGKPGDLYLKVVLKEHPIFKKVGKDLHMEKVVSFPLAVLGGTVKVPTLEGEEIDVFIQPGTECGATKVVKEKGYPYENGRGDLIIHIRIGVPKNLSKSERKLLEKLAESIKEEGEEVYREGGSLVEKLSSLFKKNA

SEQ ID NO: 135 - protein, 689 aa, Aquifex aeolicus
MVVQLDQIHFFIFHEVLKIFKTMPQLFKTSKKIDELVINTIRFLSVDMVERAKSGHPGMPLGASHIVYLLYDRIMKYNPKNPNWFNRDRFILSAGHGSAMLYAAFYMFGFDLTLEDLKAFRQLNSKTPGHPEYGLTPGVEVTTGNLGQGFGNAVGMAMAEKFLSHYFNREGYPVIDHYTYVLVSDGDLMEGVSYEAASLAGHFKLNKLIAIWDNNHITIDGDTKLTWTEDVLKRFEALGWEVYHLEDGYNLDLLEETILKAKESDKPTFISVRTHIGYGTPLQDTPEVHGKPMGKEIVEETKKKFGWPLEEFYVPEEALNYTRRKVEEGKALEEEWNKLYAEYREKYPDLAQTLEKALNKEWSLDWLEKVEEFKEDMPTRKASGKVLNVMADYIPTMIGGSADLSESVNTVLKKYGDFEADTPTGRNVHYGVREHAMGTILNGMAYHGGILPYGGTFLIFSEYMRPAIRTAALANLQVIFVYSHDSIGLGEDGPTHQPVEQLWSLRSIPNLWVVRPADANEVKYAWEIALKRKNGPTAIILTRQKVKTIDRSKYASPEGVRKGAYVIADTEGKPDVVIIATGSEVQVALGAKEILEQKGIKTRVVNMACCELFEEQPEEYKREVLPPEVTKRVAVEAGRDTGWYKYVGSDGLVISLNEFGKSAPGSVLFEYYGFTPENVANKVIEKWFS

SEQ ID NO: 136 - protein, 482 aa, Aquifex aeolicus
MLNEINYFPLFSFILYINSMEVLTNSKVEKLKKALGEKKVKDSIVERKLYAYDATPIPIQRAIPSAVVFPENKEDVIKLVEVCYEEDIPIFPRGAGSGLTGGAVPTIEEGIVVSFEKMDKFTVDVDNATAVVQPGVITYQFQEYVEKLGLFYPPDPSSFKYSTIGGNVAENAGGPRCLKYGVTREYVLGLETVIKNGEVIRTGRPVLKDVAGYDLTKLLVGSEGTLGLFTEITLKLIPKPKARMTALALFDDLETVGKAVTKILTSGVFPSALEFMDRDAIRAVEDFKPVGLPRDVEALLLIEVDGHPLTVKEEIKEVGKILEELGAKVQVAQSEEEAQKLWSARKNLGPALGNLKTGKINEDIVFPRTYLHEALPKLREIAKKYNLTMVVFGHIGDGNLHVNLLYDKSNKEEEERAERAVDEVFELALNYNGSITGEHGVGLTKRKFLKWQFGETGYELLKGIKKLFDPKNLFNPGKVLEL

SEQ ID NO: 137 - protein, 250 aa, Aquifex aeolicus
MWMYIHKIMKLSYKRVILTRELEDIKKDKPLFEREGFKVLELPLIQTKVLEFNLPDEEFDYIVFQSKKAVKIFLGKVNLKGNKKIVAVGKKTAEELEKLGYKADFIPENESAKGLIELFKRLPKGKVLIPRSKIGRTELIKFLKETSFEVFALDVYTTEYVFYTREELLEKLNKGDFIIFYSPSAVKAFFANLQMHKIPKDSLSLKFVAIGKTTKEELQKHSVKNVITSERPSTEDIVKKLKELARDLQK

SEQ ID NO: 138 - protein, 335 aa, Aquifex aeolicus
MRMKKTVAVIGAGNVGEHVASLILLKNLANVKMFDLPRKTEEKVFEPVKGKALDMKQMLAAMDIDARVEGYTVTPEGEGYEPLEGSDIVVITAGFPRRPGMSREDLLEANIRIISVIADRIKRYAPDAIVIVVTNPVDVMTYVAYKLLNFPKNRVMGMAGVLDSARFKTFISEELMVSPKDIHAYVIGGHGDEMVPLISISNVGGIPLKDLLPKEKLEKIIERTRFGGGEIVNLMGTSAYYAPAAAIVDMIEALVQNSKRILPCSVYLDGEAGEYYGVQGFCVGVPVKLGSNGVEEIIKVPMIEEEREMWRRSVESVKKTVEVAEGILSAGSSRQ

SEQ ID NO: 139 - protein, 659 aa, Aquifex aeolicus
MAKGTVAWKIIKNHLVSGKMEPGEEIAIKIDQTLTQDATGTMCYLEFEAMGVPEVKTELSVSYIDHNMLQTDFRNADDHKYLMSVAKKFGIWLSKPGNGICHQVHLERFAKPGKTLLGSDSHTPTAGGMGMLAIGAGGLDVAAAMAGEPFYLKMPKIVGVHLKGKMPEWVTAKDIILELLRRLTVKGGLGKIFEYFGEGVKELSVPERATITNMGAELGATTSIFPSDEITRAYLRAQGREEDWVELLPDPDAEYDEVIEINLSELEPLIAQPHSPDNVVPVREIEGIKVDQVVIGSCTNSSFVDLTRAAKLLEGRRVHPDVVFAVAPGSKQALELITQNGALLNFLKAGARILESACGPCIGMGFAPPTNGVSVRSFNRNFKGRAGTPDAKVYLASPETCVAAAIAGEIIDPRKLAEREGVKWIRVEMPEKFPYGDEAFIPPLPKEEREKVEIYRGPNIKPLPEFEPLPETIEGEVALIVEDNITTDHIMPAGAKILPLRSNIYAISEYVYHYVDPEFVPRMKKLKEKGKAGIIIGGENYGQGSSREHAALAPRFLGVRAVIAKSFARIHHANLVNFGVVPLEFKNKEDYDKFSLGDEIEIPNLIERLKKGEDILVINKTTGEEILCTYNLTPVQKEILIAGGRLNYIKNKHRKEVSA

SEQ ID NO: 140 - protein, 293 aa, Aquifex aeolicus
MRGVILFLLFFTLSFAKIYLISPEELHKLIKEEKNLVIIDLRKSIKEYWKEHIPGAQWVHFEAFRFPKGGTPAFFLHTEIFVKKLEKLGIDKNTPVVLYDAEGTFIPFYVAWGLDYINHKKVYVLHGGFNHWKDKDLPTTKDYPKVKEKRYGKYTINKSIRADLDYVKKALNREDVVFLDARTPELYEGKAGFWKRLGHIKGAVNRFWKQDFEEHVNKYGKKYYLLKPKEDISLFYESLGIGKGKEVILYCGQGLMSAATYYVIKYYLGLTDKVRLYDGSWNEYSQTNLPKEP

SEQ ID NO: 141 - protein, 435 aa, Aquifex aeolicus
MGFVRVGIIGCGTVGTGTAKLLIQNADLIKKKTGIEFKLVKVADIDWERKREFEVPKELRTTDYKEVIDNSDVVVELVGGKTFAKKVILEALEAGKCVVTANKHLLAEEGKEIFEEAKKRNLFIGFEASVGGGIPVIKALREGLAGNKILNILGILNGTTNYILTRMFEENLDFETALKEAKEKGYAEADPSLDIDGWDAAHKIAILAMLAYGGYLDFNDVYVEGIRNVDKLDVELGKELGYTLKLLAIAKKVDSEVEVRVHPTFIHSEEALAKVSGVYNAVMIEGDFVGKTMFYGQGAGSHPTASAVVADVIDAGRFLLCSSKVLPPVNWEEGELKVRKNFYSRYYLRFDVPDKPGVLAKIANVLADYNISIASVLQKEMVCKIAGREGETIVPLVILTHKAFEEDIQNALKEIQKLPVVVDKPVLIRVEEEAY

SEQ ID NO: 142 - protein, 279 aa, Aquifex aeolicus
MEFWKLQGSGNDFVVIDDRDEKLESFLKERGVSKEDFVRKVCAFHTGVGADGLILIKNPDNPENDFKWEFFNSDGSVAEMCGNGSRCAVRFAYERGIVGNKVRFETLAGVIKAEVYENGRKVKVQLTPPSKPEEKTLTVDGEEVIGVFINTGVPHFVVPVEDVEKVNVIKLGRAIRFHEEFQPKGTNVNFVQPVSEDTIKVRTYERGVESETLACGTGATACAIVSYLKGLVKKKPVNVLTRSGEVLTIDFSEDLKEVFLTGSVYKVFEGRLSEEVLEY

SEQ ID NO: 143 - protein, 340 aa, Aquifex aeolicus
MGYRVAIVGATGEVGRTFLKVLEERNFPVDELVLYASERSEGKVLTFKGKEYTVKALNKENSFKGIDIALFSAGGSTSKEWAPKFAKDGVVVIDNSSAWRMDPDVPLVVPEVNPEDVKDFKKKGIIANPNCSTIQMVVALKPIYDKAGIKRVVVSTYQAVSGAGAKAIEDLKNQTKAWCEGKEMPKAQKFPHQIAFNALPHIDVFFEDGYTKEENKMLYETRKIMHDENIKVSATCVRIPVFYGHSESISMETEKEISPEEAREVLKNAPGVIVIDNPQNNEYPMPIMAEGRDEVFVGRIRKDRVFEPGLSMWVVADNIRKGAATNAVQIAELLVKEGLI

SEQ ID NO: 144 - protein, 340 aa, Aquifex aeolicus
MEQTLRVSVFGATGYTGIELLRSLLTHPHFEVKNLISQSYKGKKVREVLPFFSNTYISEIEFLEEPVEDYELAFLCLPHEVSYEIVPKLLSQGKKVVDLSGAYRIKSPKAYEEFYGFKHEREDILQRAVYGLPEVFREEIKNSDLVANPGCYPTATLLAIYPFLKERVGIESVIVHALSGVSGAGRKPKQQFHFPEMTENFFNYAVEKHRHTPEMEDVIRRVYGREVKVRFTPTVVPTSRGMISTVYLKSEKLNVKELFKEVYEDEIFVKVVDEPPQTKWVLGTNYCFIYPHYDERTGYYVIISAIDNLGKGASLQAVQNANLMFGLAEDDGLLQLPVFP

SEQ ID NO: 145 - protein, 368 aa, Aquifex aeolicus
MAKSLLFITSFLKPRYNKPIMEKNWNVGTKYLNDKTRIIVVGITGREASQVVTESEALYPGFIKVGVTPGKGGTEVAGVPVFNTVKEALSSPEGKDVNTGLVYVPPASVKDAVIELIDAGIKLIYIVTEHVPIRDTVYFYHYAKERGVTIVGPTSLGCIVPRIPARIGAIGGKNPSIAYADGGLVILSKSGGLTTTTAEMFKRRGWGVYMALALGGDVISCTTFADVLEEIADDPNVKGVVIQGEVGGTYEEQAAETILRLYKEGRWNKPVAAFVAGKFQEKMEGVSFGHAGAIVERGKGKATDKIRMFNEVGKETGLVKVAEFYHDLVNCIEELGVPRDFEDSTPGGKVEPLYRTIDPETCEFKPQD

SEQ ID NO: 146 - protein, 291 aa, Aquifex aeolicus
MALILDGKSLSKKIREEIKKEVENFTSKGFRPPALAVILVGNDPASEIYVNNKRKACEKVGIKSLFYHLPQDVSEEKLLGLIYELNMNEEVDGILVQLPLPKHIDQTRVILSISPEKDVDGFHPENMGKLVAQIEDGFIPCTPLGIDILLKHYGIDVKGKDVTIVGAGFIVGRPLSLLMLWRNATVSVCHIHTKDVKKFTKEADILISATGVPHLIKEDMIKEGAVVVDVGISRLNGKIVGDVDFERVKEKASAITPVPGGVGPMTVTALLLNTLKSYKRKFAHLISTTNP

SEQ ID NO: 147 - protein, 1574 aa, Aquifex aeolicus
MSEARRGIFPFSKIKLMLASPEDIRSWSHGEVKRPETLNYRTLKPEKDGLFCAKIFGPIKDYECLCGKYRGKRYEGKICEKCGVEVTTSYVRRQRFGHIELAAPVVHIWFLKSTPSKIGTLLNLTSRDVERVAYFESYLVIEYPNEEEEEKFEKDEHTIPLNDGISTKWVKLHVVNEEEFEEKYAFTIDEKYEHGMGAEILKEVLSKLDLDAYSRKLKEIVKPYSIGFEDLGKEIEQKYKNLYQKLIKVIADDFRAYGVEIKGLEDHGLSLEQAIHRILNEELYLNVETGEISLEDCGDSCLTGRDALKEYYERVREHKKDIPIFEKIKEDIRSTVLREISEARIRKALRTLQLVEGFKKSGNRPEWMILEVLPVLPPELRPLVALDGGRFATSDLNDFYRRVINRNNRLKRLIELNAPDIIIRNEKRMLQEAVDALIDNGKRGNPVKQNGRPLKSLADYLKGKQGRFRQNLLGKRVDYSGRSVIVVGPELQMHQCGLPKIMALELFKPFVYRRLEEKGYATSIKHAKRLVEQKTPEVWECLEEVVKEHPVLLNRAPTLHRPSIQAFEPVLVEGKAIQLHPLVCPPFNADFDGDQMAVHVPLGIEAQLESYILMLSTQNVLSPAHGKPLTMPSQDMVLGTYYITHDPIPGRKGEGKAFGTFEEVLKALELGHVDIHAKIKVKVGNEWIETTPGRVLFNSIMPEGQPFVNKTLDKKGLSKLITELYIRVGNEETVKFLDRVKELGFLRSTLAGISIGVEDLQVPKAKKKIIEEALKKTEEIWNQYVQGIITNKERYNRIIDVWSEATNLVSKAMFEEIEKSKRIENGKEYPGTFNPIYMMAISGARGNRDQIRQLAGMRGLMAKHSGEFIETPIISNFREGLSVLEYFISTYGARKGLADTALKTAFAGYLTRRLVDVAQDITITERDCGTVKGFEMEPIVEAGEERVPLKDRIFGRVLAEDVKDPYTGEIIARRNEVIDEKLAEKITKAGIEKVRVRSPLTCEAKHGVCAMCYGWDLSQRKIVSVGEAVGIIAAQSIGEPGTQLTMRTFHIGGAATAQKVQSFVKAESDGKVKFYNVKLIVNRKGEKINISKDAAIGIVDEEGRLLERHTIPYGARILVEEGQEVKAETKLADWDPFNTYIIAEVGGKVELRDIILDVTVREERDPITGKTASVISFMRPRDAMLHTPRIAVITEDGKEYIYDLPVNAILNIPPEKISLEWRVCPTCSESEETTIQHQYYVVKDLEVQPGDILARIPKETAKVRDIVGGLPRVEELFEARKPKNPAILSEIDGYVKIYEDADEVIIFNPRTGETAKYSIKKDELILVRHGQFVKKGQKITETKVAEIDGQVRIKGRGFKVIVYNPETGLQREYFVPKGKFLLVKEGDFVKAGDQLTDGTPVPEEILRIKGIEELEKFLLKEVQMVYKLQGVDINDKHFEIIIKQMLKKVRIIDPGDSRFLVGEEVDKEELEEEIQRIKLEGGKLPKAEPVLVGITRAALSTRSWISAASFQETTRVLTDASVEGKIDELRGLKENVIIGNIIPAGTGVDEYREVDVIPAEEKVLEEKKEPKEGS

SEQ ID NO: 148 - protein, 205 aa, Aquifex aeolicus
MLKLKFNEEGLIPVIAQDYRTGEVRMLAYANEEAIKKTLETGYAHYYSRSRKKIWKKGETSGELQKVIEVRVDCDEDALIYVIEQEKDRACHTGERNCFFRDIEGNKVEKPLPFEVLPRLQDVIREKIERKEENSYTAKLVSQGKERVFQKFGEEAVETLIALMKGEKEEVIYESADMLYTFLVSLSVSGIDIKEVMEELIRRFK

SEQ ID NO: 149 - protein, 394 aa, Aquifex aeolicus
MRKGLASRVSHLKPSPTLTITAKAKELRAKGVDVIGFGAGEPDFDTPDFIKEACIRALREGKTKYAPSAGIPELREAIAEKLLKENKVEYKPSEIVVSAGAKMVLFLIFMAILDEGDEVLLPSPYWVTYPEQIRFFGGVPVEVPLKKEKGFQLSLEDVKEKVTERTKAIVINSPNNPTGAVYEEEELKKIAEFCVERGIFIISDECYEYFVYGDAKFVSPASFSDEVKNITFTVNAFSKSYSMTGWRIGYVACPEEYAKVIASLNSQSVSNVTTFAQYGALEALKNPKSKDFVNEMRNAFERRRDTAVEELSKIPGMDVVKPEGAFYIFPDFSAYAEKLGGDVKLSEFLLEKAKVAVVPGSAFGAPGFLRLSYALSEERLVEGIRRIKKALEEI

SEQ ID NO: 150 - protein, 436 aa, Aquifex aeolicus
MDMREVVVIGAGISGLSTAYRLKKEGVDVVVYEKDDRIGGTIHTVKEKGYLFEVGAQTILADQEVIDFLKEAGIEPVEASPSSKYRYIYKKGRLIPLPMSPVEFLKTPLLSLKTKLKVLTEIFKRGVDEDISIADFVREHFGEEFLNYVVAPFISGVYAGDPEKLSLKHATPKLYEAQKKYGSLIKAFIKEKTAGPKGKLISFGEGLGELINALAQKLEVHTENVVLRMRKFEDFFRLDVRGKKVETKSVVVASPAYTSSYLLKEVSFSASEEFDKIDYPPVVVVNVGVEGKFPKVRLLSSESGKKRILGAMFMSKLFPGRAPQGKELLTVFLGGATDREVIELSEEEIENIVERELKEILQIDCIDFMHVQKWKRAIPQYTLGYDRFLNLAQEMEKDYPGLFLTGNWLYGVSTADCIRASKKVAQKVLSFLRPQA

SEQ ID NO: 151 - protein, 490 aa, Aquifex aeolicus
MVEVEKKIKEGLTFDDVLLVPQYSEVLPHEVDVSTYLTKRIKLNIPIVSAAMDTVTEARLAIALAREGGIGIIHRNLPIKKQAEEVEKVKKSESGMIINPVTVKPDTRVKEALDIMAKYKISGVPVVDEERKLIGILTNRDLRFIKPEDYSKPVSEFMTKENLITAPEGITLDEAEEIFRKYKIEKLPIVDKEGKIKGLITIKDIVKRKKYPNACKDELGRLRVGAAVGTGEETLDRVAALVEAGVDVIVVDTAHGHSKRVLETVEKIKANFPEVDVIAGNVATAEGTKALIEAGADAVKVGVGPGSICTTRIVAGVGVPQLTAIMEAASAAREYDIPIIADGGIRYSGDIVKALAAGASAVMLGNLLAGTEEAPGETIYYQGRAYKVYRGMGSLGAMSSRLSSDRYGQEKMEKFVPEGIEGRVPYKGKLADVVYQLVGGLRSGMGYVGARNIKELQEKAKFVRITWAGYRESHVHDVQITREAPNYWVD

SEQ ID NO: 152 - protein, 805 aa, Aquifex aeolicus
MSLTKTKRVSDVAKELGVKSKEIIEFLNEYYPRPDGKPWKASHGLDEQALEMIYDAFGIKEEEEKEEVVTEQAQAPAEVEEKKEEEKKEEVIVEEVVEEKKPEVIVEEIEEKKEEEEKKEEEKPKKSVEELIKEILEKKEKEKEKKKVEKERKEEKVRVVEVKKEERKEEKKEEKKEEEKPKIKMSKKEREIMRKLEHAVEKEKKKQEKREKEKKKKEEEVKIIYIPEVITVRELAELLDVPANKVIAELMKRGVLATINQPVPPEVAVEVAESFGYLAEVKKEEEELEEEALLKEEEEREEELQPRPPIVVVMGHVDHGKTTLLDRIRKTNVAEREKGGITQHIGASQVELPDGRKITFLDTPGHEAFTTLRARGAKVTDISVLVVAADDGVMPQTIEAINHAKAFNVPIIVAVNKIDKPNADPMKVRRELSEHGLIPEEWGGDTIFVDISAKTGQNVDQLLEMILLLADILELKANPNKKARGTIIESKLDRKRGPVATVIVEDGTLRVGDHFVAGTTYGRVRAMFDDKGRQVKEAPPSTPVEVLGFEELPEAGDELIVVDDERTAREIAEKRKEKKEREEKLQTIRLEDIYKKIQTGETKELRIVLKTDTMGSLEALKKSLEELSNEKVQVKIIHGAVGGITENDIMLAKASGAIVIGFNTRPDPKARELMEKEKVDVRLYGVIYEAIEDVKKALVGLLEPIKKEEVIGMAEVRATFKIKKVGTVAGCYVLNGKLVRGAKARLIREGVVIYDGEIESLKRFKEDVQEVTAGYECGVKLKDYNDVKVGDQIECYEIRYEKPTL

SEQ ID NO: 153 - protein, 478 aa, Aquifex aeolicus
MAEVIKGKVVQVIGPVVDVEFEGVKELPKIKDGLKTIRRAIDDRGNWFEEVLFMEVAQHIGEHRVRAIAMGPTDGLVRGQEVEYLGGPIKIPVGKEVLGRIFNVAGQPIDEQGPVEAKEYWPMFRNPPELVEQSTKVEILETGIKVIDLLQPIIKGGKVGLFGGAGVGKTVLMQELIHNIARFHEGYSVVVGVGERTREGNDLWLEMKESGVLPYTVMVYGQMNEPPGVRFRVAHTGLTMAEYFRDVEGQDVLIFIDNIFRFVQAGAEVSTLLGRLPSAVGYQPTLNTDVGEVQERITSTKKGSITAIQAVYVPADDITDPAPWSIFAHLDATTVLTRRLAELGIYPAIDPLESTSKYLAPEYVGEEHYEVAMEVKRILQRYKELQEIIAILGMEELSDEDKAIVNRARRIQKFLSQPFHVAEQFTGMPGKYVKLEDTIRSFKEVLTGKYDHLPENAFYMVGTIEDVIEKAKQMGAKV

SEQ ID NO: 154 - protein, 291 aa, Aquifex aeolicus
MAKLSPRDIKRKIQGIKNTKRITNAMKVVSAAKLRKAQELVYASRPYSEKLYELVGHLAAHVDTEDNPLFDVREERNVDVILVTADRGLAGAFNSNVIRTAENLIREKEEKGVKVSLILVGRKGFQYFTKRGYNVIKGYDEVFRKTVNFNVAKEVAEIVKERFLNGETDRVYLINNEMVTRASYKPQVRVFLPFEAQEKEVEELGTYEFEVSEEEFFDYIVNLYLNYQVYRAMVESNAAEHFARMIAMDNATKNAEDLIRQWTLVFNKARQEAITTELIDITNAVEALKAQ

SEQ ID NO: 155 - protein, 272 aa, Aquifex aeolicus
MIKYGGSAMHDEELRESFARDVVLLKYVGINPVIVHGGGPQISKTLEKFGIKPKFVGGMRKTDEETMHVVEMVLSGDINKDIVALINRYSGEKIYAVGLSGRDGRLLKAKKLDKERYFSELGLPVPEEDIGFVGEIVDVNEELIFTLLSHNFIPVIAPVGVGEEGEAYNVNADLAASEIAGEIKAEKLIYLTDTKGVLDEKGELISSLSKDKAEELIKKGVIREGMIPKVRSALRALEKGVKKVHIIDGRVKHSILLEVFTKEGVGTEITLE

SEQ ID NO: 156 - protein, 204 aa, Aquifex aeolicus
MVKVKICGITNLEDALFCAKEGADYIGVITYPKSPRYTSKEKRLEIIKALEGLNVKKVAVVVNEPYEFIKELLDEGFDLIQLHGDEDIELGKRVGLDKVIKVFRVKEEIPKVGEWEKAYAILLDTFSKEAYGGTGKTFNWEIAKKLVEEGHKVFLSGGLNPENVKEGIEFVKPYGVDVSSGVEKEKGKKDFKKVREFIKRTKSE

SEQ ID NO: 157 - protein, 513 aa, Aquifex aeolicus
MEVKREHWATRLGLILAMAGNAVGLGNFLRFPVQAAENGGGAFMIPYIIAFLLVGIPLMWIEWAMGRYGGAQGHGTTPAIFYLLWRNRFAKILGVFGLWIPLVVAIYYVYIESWTLGFAIKFLVGLVPEPPPNATDPDSILRPFKEFLYSYIGVPKGDEPILKPSLFAYIVFLITMFINVSILIRGISKGIERFAKIAMPTLFILAVFLVIRVFLLETPNGTAADGLNFLWTPDFEKLKDPGVWIAAVGQIFFTLSLGFGAIITYASYVRKDQDIVLSGLTAATLNEKAEVILGGSISIPAAVAFFGVANAVAIAKAGAFNLGFITLPAIFSQTAGGTFLGFLWFFLLFFAGLTSSIAIMQPMIAFLEDELKLSRKHAVLWTAAIVFFSAHLVMFLNKSLDEMDFWAGTIGVVFFGLTELIIFFWIFGADKAWEEINRGGIIKVPRIYYYVMRYITPAFLAVLLVVWAREYIPKIMEETHWTVWITRFYIIGLFLFLTFLVFLAERRRNHESA

SEQ ID NO: 158 - protein, 354 aa, Aquifex aeolicus
MIPQRIKELEAYKTEVTPASVRLSSNEFPYDFPEEIKQRALEELKKVPLNKYPDPEAKELKAVLADFFGVKEENLVLGNGSDELIYYLSIAIGELYIPVYIPVPTFPMYEISAKVLGRPLVKVQLDENFDIDLERSIELIEKEKPVLGYFAYPNNPTGNLFSRGKIEEIRNRGVFCVIDEAYYHYSGETFLEDALKREDTVVLRTLSKIGMASLRVGILIGKGEIVSEINKVRLPFNVTYPSQVMAKVLLTEGREFLMEKIQEVVKERERMYDEMKKIEGVEVFPSKANFLLFRTPYPAHEVYQELLKRDVLVRNVSYMEGLQKCLRVSVGKPEENNKFLEALEESIKSLSSSL

SEQ ID NO: 159 - protein, 557 aa, Aquifex aeolicus
MPKRTDIKKILIIGSGPIVIGQAAEFDYSGTQACKALKQEGYEVILVNSNPATIMTDPEMADKTYIEPLTADILEEIIKKERPDALLPTLGGQTGLNLAVELYENGVLERYGVELIGANYEAIKKGEDRELFKETMESIGLKVPESAVVRSVEEGLKAVEKIGFPVILRPAFTLGGTGSSVAYNVEEFKEKLKVALETSPIHEVLLDKSLIGWKEIEFEVVRDKADNVIIVCAIENFDPMGVHTGDSITVAPTQTLTDKEYQMLRDAAIAVIRAIGVDTGGSNIQFALSPESGDFYVIEMNPRVSRSSALASKATGFPIAKVAAKLAVGYTLDELKNDITKFTPASFEPSIDYVVVKIPRFDFAKFPEADRTLTTMMKSVGEVMAIGRTFKEALLKAVRSLELDRYGLAFPKLTNVDKVELERNLINPNDQRLWYIAEAFRRGYSVDEVYELTKIDRWFLYNIEEIVKFEEVLRKEELTPEILRQAKEMGYSDWEIAKIKGITEEEVRKLRKEEGIVPTFKGVDTCAGEFVAYTPYYYSSYERPYYTVDGQEILDED

SEQ ID NO: 160 - protein, 510 aa, Aquifex aeolicus
MAEEKSEVLLKIQEKYYPPKEIVERAWIKDYEKVYEESIKDREGFWAKVAEELHWFKKWDKVLEWNFPYAKWFVGAKTNITYNCLDRHVQNGKRNKVAYIYVDENDNEKKITYGELLELVNRIANGLKSLGVKKGDRVSIYMPTTIEAIATMLACARIGAIHSVVFAGFSEGALRTRIEDAKAKVVVTASYTQRRGKKIDLLTTVERAIDGLDFVEKVVVWDRDGDALEEKGGLFVDFNEMVKNASPECEPEVMDAEDPLFILYTSGTTGKPKGVLHTTGGYMVQTYYTSKIVFDLHEDDIYWCTADIGWITGHSYIVYGILANGVTSVITEGAPDYPDPGRWWRYVEKYRVNVFYTAPTAIRMFMRYGEEWPMKYDLSSLRILGSVGEPINPEAWLWYYKYIGREKCVIVDTWWQTETGAHMITTIPSYPAKPGKAGKPFFTIEPEIVDKDGNKVPPNTVGFLVIKSPWPSMLRTCWGEPERYEKYWNTIKGVWRPSLLRRRRVHNDPR

SEQ ID NO: 161 - protein, 330 aa, Aquifex aeolicus
MIVGRFPSSRPRRLRRNENIRRLVRETHLTLDDLIYPIFVRWGENVVEEVPSMPGVYRYSVDKVVDAVKEVRDLGIPAIILFGIPEHKDEVGSDTWSEEGIIQRALRKIKKEVPDIYVITDVCFCEYTTHGHCGVLHDHDVENDLTLENLKKQVVSHAENGADMVAPSGMMDGMVKVIREALDEAGFKHIPIMAYSAKFASAYYGPFREAAESAPAFGDRRTYQMDPANSREALKEVLMDVEEGADVVMVKPALAYLDIIAKVKENVLVPVCAYNVSGEYSLIKAAGKLGWIDEKKVMWETLLSIKRAGADMIITYFAKDAARMIIEGEV

SEQ ID NO: 162 - protein, 305 aa, Aquifex aeolicus
MELLSIQNLTKVYKVPAGFLRKKNFFALKEVSLSIKQGDFLAIVGESGSGKSTLGKIILRLEKPTKGKVSFKGKDIFSMGKEYTRKVSAVFQDPRSSLNPRMKVEEILEEPLIVHRVKGRKERVLKVLQRVRLSEELLEKRPLQISGGQAQRVAIARALILEPELIVADEPTASLDVSVQEEILELFKELNSKGISFFFVTHDIRVVEKVANMVGVIYAGILMELGKKEEVLKNPLHPYTKFLLENVPVRHPKDRKPLKYLQEEEVSIPEEGCPFYPRCPEAMEECKKFIRRSEVNGRLLACNLY

SEQ ID NO: 163 - protein, 856 aa, Aquifex aeolicus
MSVDKSKALVLWLDEVTIEDIPIAGGKNASLGEMIRNLSPLGVKIPYGYVVTANAYYYFLDYNNLRDKIRKILEGLNTDDLKDLQRRGHEVRELIRGGTFPPDLEEAIKDYYNKLSEKYKTHAVDVAVRSSATAEDLPDASFAGQQETYLNVVGAENVLVAIKNCFASLFTDRAIVYRERFGFDHFKVGIAVGVQKMVRSDMGASGVMFTLDTETGFKDVVVINAAYGLGELLVRGEVTPDEYIVFKPTLMKGYSAIIEKKLGRKDRKMIYGTGDERVKIVNVPKEDQKKFALNDDEILQLAKWGVLIEEHYSKKNGRWTPMDIEWAKDGILNELFVVQARPETVHSRKKENVVKIYKIKTPEEERKNRVIVKGIAVGDKIATGKARVLFDLKEADQFQEGEILVTDITDPDWEPVMKKAAAIVTNRGGRTSHAAIVARELGIPAVVGTGNATEKIKTGEEITVSCAEGETGYVYEGKIDYEVEEINLENIPKPKTKIMMNIGNPESAFRYASLPNDGVGLAREEFIIANYIKIHPLALLHYEDLKELYEKLERENLIDEKGFVQFKLIYHYANGRLANKLAKGKDKLRVNLRKILQDIENLTFGYEDKATYYIKKLSYGIAKIAAAFYPNPVIVRFSDFKSNEYANLIGGILFEPEEENPMLGWRGASRYYSDVFKEAFGMECKAIIRVRNKMGLTNTKVMIPFCRTPEEGEKVLQVMEEYGLRKGENGLEVYVMAELPSNIVLADRYAQIFDGFSIGSNDLTQLTLGLDRDSELVAHLYDERNEAVKRLIAQLIKTAKEYGRKVGICGQAPSDFPEFAQFLVEQGIDSISLNPDSVLKTMLAVVEMEKKLGVLK

SEQ ID NO: 164 - protein, 512 aa, Aquifex aeolicus
MENIEIVSSGKHTLHGLNFYLSYFDDVAKVLPREHYCFIVGGWVRDRILGEPVGYNIDVDFLTTADPVELAKNFAKRIGGHFFVFEKRGFLIKRPTIASVVLHLPPYRYRFDFSPLKGKDLEKALIEDLKERDFTANAIAVNLDDVLSIGAKQTIVYDPTGGIKDLEQGLLRPVSIENLKRDPVRVLRGFRIAIEKNLQLTEDFYEFVKEDPRIVLKSAVERITHELFKIMKEKTAHKVIRELYEYGVLEAIIPEIGRLREVKDQGEHHIYPLDEHTLKTLEYLEQVIEDRAKYLSAELLENFGKKRVLGEFTDVELLKWGALFHDIGKPQTFAVREGKVTFYEHDKVGAQIVREIGERLRWGDEATEFVAKLVRHHLRPFFLREAFKKGELKRRGMANFWRECGDIAPHLFLLSIADAMASGDEEEDIKALMETIAELESFNRNEMKEEIQKPLLNGDEIMEILGIKPGKIVGILKKALLEAQIDGKVETKEEAIEFIKRSTKNLKPLDEG

SEQ ID NO: 165 - protein, 168 aa, Aquifex aeolicus
MRIYLIGFMCSGKSTVGSLLSRSLNIPFYDVDEEVQKREGLSIPQIFEKKGEAYFRKLEFEVLKDLSEKENVVISTGGGLGANEEALNFMKSRGTTVFIDIPFEVFLERCKDSKERPLLKRPLDEIKNLFEERRKIYSKADIKVKGEKPPEEVVKEILLSLEGNALGG

SEQ ID NO: 166 - protein, 122 aa, Aquifex aeolicus
MKLRPLYDKIVVERLEEKEEKTPSGIIIPDTAKEKPQLGKVVAVGPGKLLDNGELKPLSVKEGDVVLFNKYAGNEVEIEGKIYLVMSEDEVLAVVEDYSSLIGGEVRWQQRQLSTTRKQGQN

SEQ ID NO: 167 - protein, 545 aa, Aquifex aeolicus
MAAKAIIYNEEARAKLKAGVDKLANAVKVTLGPKGREVILGKNWGTPVVTKDGVTVAKEIELKDKFENIGAQLVKEVASKTADVAGDGTTTATVLAQAIFHEGLRVAASGANVMEVKRGIDKAVKKIVEELKKLSKDVKERKEIEQVATISANNDPEIGKIIADAMEEVGKDGVITVEESKSAETTLEVVKGMQFDRGYLSPYFVTDPEKMECVLENPYILIYEKKITNVKELLPILEQVVRSGRPLLVIAEDVEGEALATLVVNHIKGVLKACAVKAPGFGQRRKDYLGDIAVLTGGQAITEDLGIKLESVTLDMLGQAEKVVVDKEHTTIIGGKGDPEQIKARIEQIKRQIQETTSDYDREKLQERLAKLSGGVAIIRVGAATEAELKEKKYRVEDAVHATKAAVEEGIVPGGGVALVRASEALEDLKGDNHDQQLGIDIIKKAVRTPLKQIAYNAGYDGSVVLEKVIELGKEKGVSWGFNAATGEYVDMYEAGIIDPTKVVRTAIENAASVAGTMLTAEALIADLPEEKKKDITPTDMPELD

SEQ ID NO: 168 - protein, 419 aa, Aquifex aeolicus
MRNFLFLLLVISLPLFGGQRIMDKTLENGVKVIIKETKGRGLVSGVIFFKGGVHGEEKRGETQLLFTMLLKGSKNYPNASAVSYPFEKYGGYIYSSSEDDFSEIGFSTKVEGLKEGLKVIRDIIQNPLFKEEVLELEKRNQIVAIRSKRERGMSYAYEELRTLTYKGTPYEYSSLGKDEDVERVSREDLIRRFNQIKKGENVVVVLVGDFKAEDVLPLLEEAFSDIPKGKFELSSVNKKIEKNEVKRVKREGTQATILCAFNAPPKDSKDYFVFKVYNAVLGEGMTSKLFKVLREEKGYAYATYSFYPTRYSSPRLFAYVGTSPEKKENALQDLIKVVSEGRVSEEDVELAKRKIIGDFLLDHQTRLRQAWYLGFFEVMGLGWKMDEEYTKRISEVKREEVEEAVRKYIDFHHCVVVEP

SEQ ID NO: 169 - protein, 433 aa, Xenorhabdus nematophilus
MSKIVKVLGREIIDSRGNPTVEAEVHLEGGFVGLAAAPSGASTGSREALELRDGDKSRFMGKGVLKALSAVNGSIAQALVGQDAKDQANIDKIMIELDGTENKSNFGANAILAVSLANAKAAAAAKGMPLYEHIAELNGTPGRFSMPLPMMNIINGGEHADNNVDIQEFMIQPIGASTLKEAVRIGSEVFHNLAKVLKAKGMSTAVGDEGGYAPNLESNAAALAAIKEAVEQAGYVLGKDITLAMDCAASEFYNKETGNYELKGEGRTFTSQEFTHYLEGLTKEYPIVSIEDGLDESDWDGFAYQTKVMGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGNRATFNGLKEVKGQA

SEQ ID NO: 170 - protein, 426 aa, Xenorhabdus nematophilus
MNQSEMLYSQAKQVIPGGVNSPVRAFNGVGGTPVFIQRADGAYLYDVDGNAYIDYVGSWGPMVLGHNHPAIRNAVIEAAERGLSFGAPTAAEVEMAKRVTELVPSMDMVRMVNSGTEATMSAIRLARGYTGRDKIIKFEGCYHGHADCLLVKAGSGALTIGQPNSPGVPADFAKHTLTCVYNDLNSVREAFEKYPEEIACIIVEPVAGNMNCIPPRPEFLPGLRKLCDEFGALLIIDEVMTGFRVALGGAQEYYNVKPDLTSLGKIIGGGMPVGAFGGRQDIMEKLAPTGPVYQAGTLSGNPIAMAAGLACLNEVAQPGVHPRLSELTDKLASGLKNAASAAGVPLVVNHVGGMFGIFFTDAESVTCYQDVMACDVERFKQFFHLMLDEGVYLAPSAFEAGFMSIAHSDEDIQRTVDAAARCFARL

SEQ ID NO: 171 - protein, 818 aa, Xenorhabdus nematophilus
LPIYDVLDSVITKLKTSKQVLLHAPTGAGKSTGLPLAILNKAQLTGRIIMLEPRRLAARSVAERLAEQLNEPVGVTVGYRMRAETKVSASTRLEVVTEGILTRMLQQDPELSDVSLVILDEFHERSLQADLALALLLDVQEGLREDLRILVMSATLDNQRLSSLLPDAPVIVSEGRRYPVARSYHPLPIHQHFEQSVASAVLRLLQQETGSLLLFLPGAGEIQRVLAQLEQKINDDTLLCPLYGALSLSDQRKAIAPAPAGMRKVVLATNIAETSLTIEGIRLVVDSGLERTSRFEPKSGLTRLMTQRISQASMVQRAGRAGRLEEGVCWHLFSREQAERATEYSEPEILHSDLSSLLLSLLQWGCRDSNQLNWLDSPPQPALAVAQSLLLRLGTLDDNQQLTARGWQMAEAGSEPRLAAMLCAGKEQSDEALVTAAKLVAILEEPPRSGLPDLTHWINSNQPHWQQRTNQLIRNLASKTAKIGSKKISTEKINAAFVPELLVQGFPDRIAKNRDNLGRFQIANGLGVALEPGDPLSGEQWLIAPTLQQNSKNPDARVLLACPLNIEHIIHQYPSLFTEQTAVEWDDSKGTLRAWKRLQCGRLTVKAQLLAKPSQAELQESLLNWIRQEGLAALNWSPEALQLRIRLQRATEWLSEIEWPAVDDDNLLDSLEQWFLPMLAGVGDLKGLRQVELSCALLALLDWQQRQILDNELPTNYTVPTGSRITIQYFHDKPPLLSVRMQEMYGEQQNPVLAKGRVPVVVELLSPAHRPLQITQDLAAFWQGAYREVQKEMKGRYPKHLWPDDPANTAPTRRVKKY

SEQ ID NO: 172 - protein, 230 aa, Xenorhabdus nematophilus
MAYALELTQLTKTYAGGVKALRGIDLRVEEGDFYALLGPNGAGKSTTIGIISSLVNKSSGKIKVFGYDIDTDLVNAKRQLGLVPQEFNFNPFETVIQIVLNQAGYYGVPRNVAYSRAETYLSQLDLWEKRNERANRLSGGMKRRLMIVRALMHQPKLLILDEPTAGVDIELRRSMWEFLKALNAQGTTIILTTHYLEEAEMLCRNIGIIQYGELVENTSMKDLLSQLERE

SEQ ID NO: 173 - protein, 177 aa, Xenorhabdus nematophilus
KHIVEVMISEQEIKQRIAELGQQITEHYRNSDRELVLVGLLRGSFIFMADLCREVQVPHEVDFMTASSYGNEMNSTRDVKILKDLDEDIRGKDVLIVEDIIDSGNTLNKIREIFALREPNSLAICTLLNKPSRREVDVPVEWIGYSIEDKFVVGYGIDYAQHYRHLPYIGHVTLLEE

SEQ ID NO: 174 - protein, 748 aa, Xenorhabdus nematophilus
MLMRLREIVEKVAMAANLSEALELLVNETCLAMSTDVCSIYLADHQRHCYYLMATRGLKKPEERAISLAFDEGVVGVVGRLSELINLADVRDHPSFKYIPQVKEEGLRAFLGVPIVYRRQLQGVLVVQQNERRLFDESEESFMVTLAMQLAVILAQAQTKGLFGQYRQTRIKALAISSGIVMAQGWQDGSQPSLEQVFEASTLEYQAERSRLTEALEQATAECRRISKRFTSSSQKESAAIFDLYSHLLNDPKLKQDLFFSVDNGFVAEWAVKSVVEKYAEQFASLQDPYMRERASDLRALGQRVLFHLDGSFTGDSEWPERFILVADELSANLLAEMPQEQLAGVIVRDGATHSHSAILVRAMGIPAIMGADIQPELLHNRMLILDGYRGEFFVEPEPLIIQEYRQIIEEEQVLSELAEGELKQKAQLKNGERVLVQLNAGLSLKYEQQIGGSIDGIGLYRTEIPFMLHRGFPSEDEQKNRYQEMLALLPDKPVVLRTLDIGADKQLPYMPISEENPCLGWRGIRITLDQPEIFLIQLRAMLKANVLIGNLKILLPMITSIEEIDEARKLIDRAKAEVEQTIGSTITMPQIGIMVEVPSTIFLLPQLKKRINFISIGTNDLTQYLLAVDRNNTHVAALYDNLHPAVIKALKLAFDESQRVGLPVSICGEMAGLPMGALILIGLGYRSLSMSGRSVPRIKYLLRHLDTNDLELLIKEILKAETSRQVKALSTEFMEANGLGGLVRGGI

SEQ ID NO: 175 - protein, 349 aa, Xenorhabdus nematophilus
  unsure (1)..(349): unsure at all Xaa locations
MKIIGISGLLPSRCVTNGDVLNLIEQHSKKTFQGDFPKTLRTIQRLLEKTGLESRYWLGEGEKPMRLMEEAFEQALRQANIKKSEIDLLIYPNVTRGFTEPANSTFIAKALGLNCRNYDVLDACNGWVTAMDIINGKMKAGEIRYAAIINMEFGMSEGGPFRKNFSLNSASELAYKYPSFTIGEAASVTILSNEDTDNFKFDYISRPDLCDICNISLPNWELFCNDSDIELISPLGGKYQFNSYAAALHEYAGEEVPKVFKQHNIASSDIHKIFIHTGAPNMWDGFGKAVDAADKMHNIGQKTGNIITASIPFGIADALGKDQVERDKLCMGWAGSGGMVFSAMSFKLX

SEQ ID NO: 176 - protein, 956 aa, Xenorhabdus nematophilus
MPKYIIRIMTMLFLLFWGTTAYAKLPWQPLPETINKSERDLRQYKAIQLPNGMTVLLVSDEKAIKSLAAISVPVGHMENPDNQLGLAHYLEHMVLMGSKRYPQSGGFTEFLQKHGGSHNASTSSNRTAFYLEVENGSLTEATERLSDALAEPLLDPVNADRERHAIDNEMTIARAGEGHRIWQVRSETLNPAHPNARFGGGNLETLKDKPDSKLQAALIDFYQRYYSANLMKGVLYGQQPIDKLAHIAVETFGRIPNRQASVPAITVPAITDKEKGIIIHYVPSKPYKSLQLEFSIADNSADFRSKTDAYLGYLIGNRSANTLSDWLQKQGLAEGISASASPTTDGNSGTFGIYVSLTDKGLEQRDRVIAAIFSYINLLKQKGIEKSYFDEMAKVLNLSFEYASIVRNMGYIQWLSDVMQDIPVSHVLDAGYLADEYNPQAIFSRLAELTPENARIWFTGPKEPHNKEAYFVHAPYQVNKITPQQRTEWRKLEKEVSLSLPELNPYIPDDLSLIKASGSQKHPKMILEQPNVRLLYMQSQYFMDEPKSIITLNMRNADGMSHAKDQVTYSLLAYLSDMGLDQLGYQASVGGMGLTLGYSEGLQIGVSGYTQHLSELLTSAISQYIAFTPTQEELNQAKSRYRDQVEAVNNGKAYEMATHPVSRLSRVPYFEQTDRLKALDTITIDDIVKYRQRMIQHSALQAGIFGNLTEKQSIDIVKSAHKQLANQGTTWWSGDHIVVDRDYAVNFKGTASSTDNALSEVYIPTGYDRINGYIYSNLLGRILSPWFFEQLRTSEQLGYVASAFNTSVGEQSGLGFLLQSNSKQPDYLHQRYQSFYQQAAKKLQAMPDADFEQYKKALLTEMRQPPETFYAEASHYNYDFGSNNFKFDTHEKTIAATEKVTKAQLIAFYDKAVIKRQGLALISQITGKKGAAHQYAELKGWKTYSNVSDFQKQLPV

SEQ ID NO: 177 - protein, 441 aa, Xenorhabdus nematophilus
MKERCTELVEVFRHSVPYINAHQGKTFVIMLDGEAIAHENFPNIVNDIGLLHNLGIRLIVVYGARPQIDQKLAEYHSQPIYHKHIRVTDAKTLELVKQSAGLLQLDITARLSMSLSNTPLQGANINVISGNFIIAQPLGVDDGIDYCHSGRIRRIDEEAINQQLDNHAIVLIGPVAVSVTGESFNLTSEDIASQLAIKLKAEKLIGFCSSQGVLDAEGNILSEIVPNEGEARLNELGSEGDYSSGTARFLRGAIKACRRGVRRSHLISYQENGSLVQELFSREGSGTQIVMERSEQIRRANINDIGGILELIRPLEQTGILVRRSREQLEMEIDKFTLIEHDNVTIACAALYSYPDEKIGEMACVAVHPNYRNSSRGEVLLNSIAGQARQAGLEKLFVLTTRSIHWFQEKGFEPAEINMLPVEKQALYNYQRCSKILMLNL

SEQ ID NO: 178 - protein, 208 aa, Xenorhabdus nematophilus
MLSRSMKNLLTQLRQQGIQDEHLLEIIARVPRECFVDEALAHKVYENTALPIGHGQTISQPYIVARMTKLLSLTPEANVLEIGTGSGYQTAILAHLARHVFSVERIKGLQWQAKRRLKQLDLHNISTRHGDGWNGWPSKGPFDAIIVTAAPPEIPQALLYQLADNGVMVLPVGERSQSLKVVHRYGSDFHSEVIEPVRFVPLIQGELA

SEQ ID NO: 179 - protein, 850 aa, Xenorhabdus nematophilus
SPAKDLDSHTPMMQQYLRLKAQHPDILLLYRMGDFYELFFDDAKKAAKLLDISLTKRGQSAGQPIPMAGVPYHAIENYLAKLVQLGESAALCEQIGDPATSKGPVERKVVRIVTPGTVTDEALLHERQDNLLAAIWHDSQGFGYATLDITSGRFRVSEMADEDTIAAELQRTRPAELLYPESFGSMALIERCSGLRRRPMWEFELDTARQQLNLQFGTRDLIGFGVEKSTLALRAAGCLLQYVKDTQRTALPHIRNITVERQQETVIMDAATRRNLELTQNLAGGTENTLASVLDQCVTPMGSRMLKRWLHTPIRDRNVLQNRQQAISALQEIGFELQPFLRQVGDLERVLGRLALRSARPRDLARMRHAFQQLPDIHQIMASSDSPYIQALQQRVGHFDELQTLLEKAVVETPPVLVRDGGVIAPGYHAELDEWRALADGASDYLDRLEIRERDKLGLDTLKVGFNAVHGYYIQVSRGQSHLVPIHYVRRQTLKNAERYIIPELKEYEDKVLTSKGKALAIEKALYEELFDLLLPHLAELQTSAEALSELDVLANLAERAETLNYTCPTLSDKTGIQITGGRHPVVEQVLSEPFISNPLTLSSQRRLLIVTGPNMGGKSTYMRQAALITLLAYIGSFVPAEKVLIGPVDRIFTRVGASDDLASGRSTFMVEMTETANILHNATEHSLVLMDEIGRGTSTYDGLSLAWACAESLANRIKAMTLFATHYFELTTLPEKLEGVVNIHLDAVEHGDTIAFMHSVQEGAASKSYGLAVASLAGVPRDVIKRARQKLKELESLSNNATAGHVDTPQLTLLTEEVSPAVEALENLNPDTLTPRQALEWIYRLKNMV

SEQ ID NO: 180 - protein, 478 aa, Xenorhabdus nematophilus
KKVLMSNNIRIEEDLLGKREVPAEAYYGIHTLRAIENFYISDRTINDVPEFIRGMVLVKKAAALANKELHTIPGKIADIIVKACDEVLNTGKCLDQFPVDVFQGGAGTSLNMNTNEVLANIGLELMGHPKGEYEYLNPNDHLNRSQSTNDAYPTGFRIAVYNSIITLITSIELLQVGFDKKAVEFSDILKMGRTQLQDAVPMTLGQEFRAFSVLLKEEIKNITRTAELLLEVNLGATAIGTGLNTAPGYQTLVVEKLAEVTGLPCLPAEDLIEATSDCGAYVMVHSALKRLAVKMSKICNDLRLLSSGPRTGLNEINLPELQAGSSIMPAKVNPVVPEVVNQVCFKVIGNDICVTMASEAGQLQLNVMEPAIGQAMFESISILSNACRNLVEKCVNGITANKEVCESFVFNSIGIVTYLNPFIGHHNGDIVGKICAETGKSVREVVLERGLLTEAQLDDIFSVENLKHPTYKAKRFDD

SEQ ID NO: 181 - protein, 540 aa, Xenorhabdus nematophilus
MAAKDVKFGNDARGKMLRGVNVLADAVKVTLGPKGRNVVLDKSFGSPVITKDGVSVAREIELEDKFENMGAQMVKEVASKANDAAGDGTTTATVLAQSIVTEGLKAVAAGMNPMDLKRGIDKAVIAAVEELKKLSVPCSDSTAIAQVGTISANSDETVGKLIAEAMDKVGKEGVITVEEGTGLEDELDVVEGMQFDRGYLSPYFINKPEAGSIELENPYILLVDKKISNIRELLPVLEGVAKASKPLVIIAEDVEGEALATLVVNNMRGIVKVAAVKAPGFGDRRKAMLQDIATLTNGTVISEEIGLELEKATLEDLGQAKRIVINKDTTIIIDGVGEAAAIAARVTQIRQQIEESTSDYDREKLQERVAKLAGGVAVIKVGAATEVEMKEKRARVDDALHATRAAVEEGVVAGGGVALVRAAAAISALTGDNEDQNVGIRVALRAMEAPMRQIVENAGEEPSVVVNNVKASQGNHGYNAATEEYGDMIEMGILDPTKVTRSALQFAGSIAGLMITTEAMITDLPRDDKADLGGAGGMGG

SEQ ID NO: 182 - protein, 325 aa, Xenorhabdus nematophilus
RNLLRLHDYTPSEINVFLTLSSELKSNKKSGKESPLLSGKNIALIFEKDSTRTRCAFEVAAHDQGASVTYLSSNGSQIGHKESIKDTARVLGRLYDGIQYRGYGQEVVETLAKYAGVPVWNGLTNEFHPTQLLADLLTMQEHSQKPLTEIKLAYLGDARNNMGNTMLEAAALTGMELRLVAPKTCWPDAALIAECQTLAEKTGGRIALTEDIATGVKDADFLYTDVWVSMGEPKTVWQERIALLKPYQVNMDVIQLTENPEVKFLHCLPAFHDEETTLGKQLAEEFNLYGGLEVTSEVFESKHSIVFDQAENRMHTIKAVMVATL

SEQ ID NO: 183 - protein, 287 aa, Xenorhabdus nematophilus
YAVTIGAANMDFTSYASEKLVYEDSNPGKIISTPGGVGRNIAQNIAALKSESHFISVVGNDYNGKVLFEQTKLAGVNIRYFHKLDEEKTSICNSIIDENGKCIVSVNDMDIMEKLTPTLLSQSEELIRRASVLVIDCNLTEGALEWLFNHAGNVPIFIDTVSTFKATKIRHWLSYIHTLKPNRSEAEILSGIEIETQKDAAIAASWFHQQGVQRLILSMGAEGVYYSELDNKSGYSRAITTSVLNASGAGDAMMAGLAHCWLQSMSLEDSIRYAQRCSALTLSSEDT

SEQ ID NO: 184 - protein, 497 aa, Xenorhabdus nematophilus
SINLAQRFVMENSSLDKDCFIGPDGSLSYSQLAFFVQKSASAMSLKKIEKNTAVILCLNDSRELAIIFFASLAIGALPVVINPKLPANTLDYILGEFDTPFIFLDEDNQISIAAEAKENTIRIKRSADLSAFCDWMPENTNDKWHDFLEKTHFEPAFIQYTSGSTGKPKGVIHSVTSILSSCEHFSKHQLGLTTTDIIYSTPKTFFGYGMGNTLFFPLFIGATAIIDSLWPSITRVTDNIKQFQPTVLLAGPMIFRLLLEDDEFKQNCHLRLVVSSGSMLPAPLKESWFQRLNIVIHDAFGATETCHAFATTYGHPSRSGSIGKFIAGCTGKIVDKDGKTVPAGETGVLMLSSESLALGYWNNHQDTKIKFSNGWYRTGDLFSQDDEGFLYYHGREDEQFKVLGRWLVPVEIEKLVHSAFPEIGDAFMIPWMDSIQECRPVLCLKTSSSEFEAISQQIANFISHQVESYKHPYVYLNLEQFPLNGNGKIDRKSMIEI

SEQ ID NO: 185 - protein, 311 aa, Xenorhabdus nematophilus
MANPLYRKHIISINDLSRTDLELVLQTAAALKANPQTELLKHKAIASCFFEASTRTRLSFETAIQRLGASVVGFADSNNTSLGKKGETLADTISIISQYTDAIVMRHPQEGAARLASEFSGHIPVINAGDGANQHPTQTLLDLFTIQETQHKLDNLKIAMVGDLKYGRTVHSLTQALAKFSGNHFCFIAPDALAMPSYILHMLDEKQVSYSIHHNFEDVMPELDILYMTRVQKERLDPSEYANIKAQFVLHAADLVNVKENLKVLHPLPRIDEITVDVDKTPYAYYFQQAGNGIFARQALLALVLNENVVI

SEQ ID NO: 186 - protein, 154 aa, Xenorhabdus nematophilus
MTQDHQLQVEAIKCGTVIDHIPAHIGFKLLSLFKLTETEQRITIGLNLPSNQLGRKDLIKIENTFLTEQQANQLAMYAPHATVNNIENYEVVKKIPINLPKQIDNVLVCPNSNCISHNEPVESSFYVIPTADDVIVRCKYCEKEFDRQAVINND

SEQ ID NO: 187 - protein, 261 aa, Xenorhabdus nematophilus
MNINLKGKIALVTGSTAGIGLAIAQGMHKAGASVILNGRSEERLIQAVNKFNCLDRVFTVAADVGTKEGCELINKNFPDIDILVNNAGIFSPKPIFEISDDEWINYFNINVLSGIRLARSYIPLMIGKRWGRVVFISSESALQIPVEMPHYGLTKTAQVAAARGFAQAATGTGVTVNSVLPGPTESEGVERFVRELITDPTLSMEEAGKRFIETARPASLLGRLATAEEVANAVLFLASPLASAITGTALRVDGGVIQSIL

SEQ ID NO: 188 - protein, 254 aa, Xenorhabdus nematophilus
LAGKAVIITGAGSGIGLAATTEFLNAGAYVIGADINLEKLYELQRGEYLFPYQFNVRDPSDIDGLINTAISQFGKIDILINNAALVEPRKSFLDVTDDDWNSTIETNLLGYIRMARGVLPYMCNQKKGILLHIASEAALMPNLILPDYSILKSSVLTLSKVISREFGKYGIRSNVISPAFIHTSIYDKPEGLITQLEQKYKVGREEALQRYIEEVDIAVGRLGQPEEVAVLLLFLASESAAFITGANYLVDGGV

SEQ ID NO: 189 - protein, 736 aa, Xenorhabdus nematophilus
EQPFSGDDKNGQGVHPANSDSLLARFTQNMTEQARQGKLDPVLCRDNEIDLMIDILCRRRKNNPIVVGEAGVGKSALIEGLALRIINDRVPDKLRHSELMTLDLGALQAGAAVKGEFEKRFKGIMAEISQSSKPIILFIDEAHTLIGAGNQAGGLDISNLLKPALARGELKTIAATTWSEYKKYFEKDAALSRRFQLVKVSEPSAEEATVIMRGLRAIYEQAHGVLIDDEALKASAVLSDRYLSGRQLPDKAIDVLDTACARVAINLTSPPRQISSLTTELHQMQMEIDVLKREQRMGLNEHADRLEELQNQQVEIQEELVTLEKNWRQQQELVTQIIELRGQLLADSDESVAAETTDKTIENAVEETAQDAKEQEAIAQDEPEAAADEQSLIEKLALLNAQLTELQQKQTLVSPHVDKTQIASVIAEWTGVPLNRLSQSELSIVTELPTHLGQSIKGQDVAIQNLHKHLLTARADLRRPGRPLGAFLLVGPSGVGKTETVLQIAELMFGGRQYLTTINMSEFQEKHTVSRLIGSPPGYVGYGEGGVLTEAIRQKPYSVVLLDEVEKAHPDVLNLFYQAFDKGELADGEGRIIDCKNVVFFLTSNLGYQTIVDHAEQPDQLNDLLYPELAAFFKPALLARMEVIPYLPLGHETLKTIIQSKLARLDSLLSQRFNAEVTISDDVSEEILQRATRAENGARMLESIIDGALLPPVSLLLLQKMAAGTAISAIRLTVAE

SEQ ID NO: 190 - protein, 253 aa, Xenorhabdus nematophilus
DIAGSKIQVRDLNFYYGKFHALKNITLDIEQNKVTAFIGPSGCGKSTLLRTFNKMYELYGEQRAEGEIILDDTNILTDKQDIALLRAKVGMVFQKPTPFPMSIYDNIAFGVRLFEKLPRAEMDERVQWALTKAALWNETKDKLHQSGYSLSGGQQQRLCIARGIAIRPEVLLLDEPCSALDPISTGRIEELISELKSEYTVVIVTHNMQQAARCSDHTAFMYLGELIEFSDTDTLFTTPRKKQTEDYITGRYG

SEQ ID NO: 191 - protein, 495 aa, Xenorhabdus nematophilus
METKDLIVIGGGINGAGIAADAAGRGLSVLLLEGQDLASATSSASSKLIHGGLRYLEHYEFRLVSEALAEREVLLKLAPHIAFPMRFRLPHQPHLRPAWMIRIGLFLYDNLGKRVSLPSSKGLKFGANSVLKPSIRRGFEYSDCWVDDARLVVLNAQEVQKHGGEVRTRTQVTRAWREKGYWMVEAKDLTTGKTDTWRAKGLVNATGPWVKNFFDDGLKLKSPYGIRLIKGSHIVVPRAHDEPQAYILQNEDNRIVFVIPWNDEFSIIGTTDVEYKGDPKEVKIDDQEIGYLLKVYNNHFKKQLNRSDVVWTYSGVRPLCDDESDSPQAITRDYTLDVQDEQGQMPLLSVFGGKLTTYRKLAEHALEKLVQYYPNAGKAWTKNGKLPGGELEGHDRDGYARLLRQRHNWLPEGVAQRYARTYGSNCQIILKGAEALTDLGEFFGHGLYEAELRYLVEHEWVTQLDDAIWRRTKLGMWLTDEQKQRVADWLAQNVQ

SEQ ID NO: 192 - protein, 237 aa, Xenorhabdus nematophilus
MSMILTDIEAGVLSITLNRPERINSFNEEMHQQLSEALKIAEQDESVRCVLLSGAGRGFCAGQDLNDRNAIISEGDVPDLGQSVERFYNPLIRRLTSLPKPVICAVNGVAAGAGVSVALACDIVIASRTASFIQAFCRIGLTPDAGGSWFLPHKIGHARAMGMALLGDKISAEQALEWGMIWQVVEPEALEDKTRELAQHLATQPTVALSCIKKATYAAAANSLDQQLNLERDLQRL

SEQ ID NO: 193 - protein, 537 aa, Xenorhabdus nematophilus
  unsure (1)..(537): unsure at all Xaa locations
DAVKTSVKVSVHSXTNASHSSKGDTMNTPAHHHPILHGPIAVIGAGTMGIGIAQVAAQAGYSVLLFDVNNEAAQRALETLHTRLHQRVEAGKAAAGATQALLQRITRVDSLQALAPSALVIEAIIEQLEVKQNLFRQLEPLCSAGTIFASNTSSLSITAIARVLASPQRMAGLHFFNPAPLMKLVEIIQGLETSSQTITTLKSLVTDWQKQPVVCRSTPGFIVNRIARPFYAETLRALEENVASPATLDAVMKESGGFAMGALQLTDLIGHDVNYAVTESLFHAFHGDPRFQPSLRQKELVEADHLGRKRGQGFYVYDSKEKHQPLPRLETLQEQIRPARIQATGDWGTLPHFAALLKPLLQQYGIAPEESKNTDSQPPALQLDDVILTLTQGKTSAQLADEIRAPVVQFDLAANHQTASIITLSSACQNTRPQTAKVISFLQSLGKQVILLPDYPALLTMRTVAMLCNEALDAINKSIASAADIDLAMCYGVNYPIGPLAWGEQLGWRHILSTLENLQQFYGEPRYRPAPLLRQLA

SEQ ID NO: 194 - protein, 403 aa, Xenorhabdus nematophilus
MTHAFICDGIRTPIGRYGGALSGLRADDLAALPLQALLARYPSLDWQQIDDVILGCANQAGEDNRNVARMAVLLAGLPYSVSATTLNRLCGSGLDALAFAARGIKAGEAQLMLAGGVESMTRAPFVMGKTDSPFSRQAQIFDTTLGWRFINPLMQQQFGTDSMPETAENVAAQFQISRDDQDAFALRSQQRTANAEQRGIFAEEITPITLPSTDKKGTPTIVSRDEHPRPETTFEQLQRLKTPFRVDGTITAGNASGVNDGAAALIIASETAALQQGLTPRARIIATATCGVEPRMMGIGPLPATRKVLELTGLSLNQMDVIELNEAFAAQSLAVMRQLGLPDDAEQVNPNGGAIALGHPLGMSGARLALTATLELERRTGRYALCTMCIGVGQGIAMIIERI

SEQ ID NO: 195 - protein, 549 aa, Xenorhabdus nematophilus
MTEQQPWWLDSVIYQIYPKSFQDSTGSGTGDINGITQRLDYLQHLGVEAIWITPFYPSPQVDNGYDVADYCAINPDYGSMEDFDNLVENAHRRGIRIILDMVFNHTSTEHPWFQAAQDINSPSRQFYIWREGSSDSLPNNWKSKFGGNAWQWHAESQQYYLHLFAIKQADLNWEHEPVRAELKKICEFWADRGVDGLRLDVVNLVSKQQDYPSDDHGDGRRFYTDGPRIHEFLQEMSRDVFQPKGLMTVGEMSSTGLEHCLRYSALDSSALSMTFNFHHLKVDYPNGEKWTLAKPDYIALKKIFSTWQQGMHQKAWNALFWCNHDQPRIVSRFGDEHQHHRTSAKMLAMVLHGMQGTPYIYQGEELGMTNPHFERIEEYRDIESLNMYQERIEQGMAPEEILAILAQKSRDNSRTPMQWDGSANAGFTSGTPWIASCDNYPELNAEAALQDKDSVFYCYHELIKLRKQQPILTYGDYLDLLPDHPSLWCYLRRWQNQVMLVIANLSDENQLWSPEPSLTDKEWQVLISNYPSPSSIEKEMSIKPYESIY

SEQ ID NO: 196 - protein, 280 aa, Xenorhabdus nematophilus
  unsure (1)..(280): unsure at all Xaa locations
MEITHVIRGEDHINNTPRQINILKALNAPVPEYAHVSMILGDDGKKLSKRHGAVSVMQYRDDGYLPEALLNYLVRLGWSHGDQEIFTVEEMTELFSLDAISKSASAFNTEKLLWLNHHYINTLPAEEVAVHLAWHIEQQGIDTRTGPELVDLIKLLGERCKTLKEMASAGRYFYEEFAEFDADAAKKHLRPVARQPLEVVRTKLAAITEWTPENIHHAIQATADELEVGMGKVGMPLRVAVTGAGQSPSVDVTIHAINQARSLARIDKALAYIAQREAQX

SEQ ID NO: 197 - protein, 390 aa, Xenorhabdus nematophilus
IGNNQKEVLKSLKEGLSGITFSEEFKEMGLRSQVWGNIKLDTTGLIDRKTQRFMSDASVYAYLAMDEAIKDSGLSDDQVSNLRTGLVVGSGGGSPHNQVVCADGMRARGLRGVGPYMVTRTMASGISACLATPFKIKGVNYSISSACSTSAHCIGHAVELIQLGKQDVIFAGGGEELSWEIACEFDAMGALSTKYNETPDRASRTYDQNRDGFVIAGGGGIVVVEELEHALARGAHIYAEVIGYGANSDGMDMVAPSGEGAVRCMRMAMDGIDGEVDYINTHGTSTPVGDLKELEAIREVFGDNTPAISATKAMTGHSLGAAGAQEAIYSLLMLEHGIIAPSINIEELDEKALGMNIITEPTERELTTVMSNSFGFGGTNASLVMRKYSD

SEQ ID NO: 198 - protein, 346 aa, Xenorhabdus nematophilus
MISGILVSPGIAFGKALLLKEDPIIINHKKITPEQVEQEISCFKQGRDKASAQLEVIKNTAEKNLGAEKAEIFEGHIMLLEDEELEQEIITLIKKNLATADAAVHSVIEDQAKALEELDDEYLKERAADVRDIGKRLLKNILGMPIIDLGSIAEEVILVANDLTPSETAQLNLDKVLGFITDLGGRTSHTSIMARSLELPAIVGTTNATTQIKNGSYLILDAVNNHIYIDPSDTEIEQLKKIKNEYLSEKTELAKLKDLPAITLDGHQVEVCANIGTVRDIAGAERNGAEGVGLYRTEFLFMDRDSLPTEEEQFEAYKAVAESVGNQAVIIRTMDIGGDKELPYMN

SEQ ID NO: 199 - protein, 250 aa, Xenorhabdus nematophilus
NECLQAGINEIILVTHSSKNSIENHFDTSFELEAILERRVKRQLLDEVQSICPSHVTIMQTRQGIAKGLGHAVLCAKPLIGDEPFAVILPDVILDEYSTDLSKYNLSEMLSRFNENGASQILVEPVPYESVSDYGIVDCFGENLQPGDSKPIARVVEKPKPEEAPSNLSIVGRYVLSEKIWPLLAKTAPGAGDEIQLTDAIAMLMEKEPVEAYHLKGRSHDCGNKLGYMQAFVEYGMKHKQLGESFKDWI

SEQ ID NO: 200 - protein, 205 aa, Xenorhabdus nematophilus
MKIPSFFRLLPLSAVLLTACTVTQAPDGTGSMSSPQWNDRKTQLQNLTHYQTRGSFAYLANEKKVYARFFWQQYAANNYKLLLLNPLGTTELELSVQPNITQITDSEGKKYISNNPEELIYKLTNMNIPLDNLKSWIIGLPGNAQNFELDKNYLLKSVSDKENGEIWQVNYQGYDTSMTPALPNRLELTQGKNRIKLKMDNWTTQ

SEQ ID NO: 201 - protein, 279 aa, Xenorhabdus nematophilus
MTLTWPSPAKLNLFLYITGRRSDGYHELQTLFQFLDYGDEITITPRQDNQIRLLTPVKGVPNDDNLIVRAARLLQDHAEKQSTGTQYRGADIHIHKRLPMGGGLGGGSSNAATVLIALNYHWQTNLSDDELAQLGVTLGADVPVFVKGHAAFAEGIGEKLQPASPEEKWFLVAHPGIEIPTPKIFTDPELKRNSPIRTLPALLQAPFKNDCEPIARKRFREVEQLLSWLLEYTPSRLTGTGACVFGEFESPASARKVLNQAPEWMQGFVARGVNISPLH

SEQ ID NO: 202 - protein, 430 aa, Xenorhabdus nematophilus
DTKTGAKRAENMLWHKIPKSIYFRRGSLPVALEEVARDGAKRAFIVTDSFLFNNGYADQVIRVLKSHNVETEVFFEVEADPTLSIVRKGAEQMRLFKPDIIIALGGGSPMDAAKIMWVMNEHPETHFEELALRFMDIRKRIYKFPKIGIKAKMVAITTTSGTGSEVTPFAVVTDDITGQKYPLADYALTPDMAIVDANLVMDMPKSLCAFGGLDAVTHALEAYVSVLANEYSDGQALQALKLLKDFLPASYQQGAQNPVARERVHNAATIAGIAFANAFLGVCHSMAHKLGSEFHIPHGLANALLICNVIRYNANDNPTKQTAFSQYDRPQARRRYAEIAEHLGLSKTGDRTATKIEKLLAWLEELKSQLNIPDSIRAAGVQESDFLAKIDKLAEDSFDDQCTGANPRYPLIAELKQLLLDSFYGRKFIE

SEQ ID NO: 203 - protein, 418 aa, Xenorhabdus nematophilus
MTLLALGINHKTAPVSLRERVAFSPDTIGLALDNLLQQPLVRGGVVLSTCNRTELYLSVEQQDNLKEQLINWLCEYHQLSHDELNTSLYWHLGSDAVSHLMRVASGLDSLVLGEPQILGQVKKAFSESQSYQSLSGELERLFQKSFSVAKRVRTETEIGANAVSVAFAACTLARQIFESLSQLNILLVGAGETIELVARHLKEHRVNHLMIANRTKERAYTLANEVNAEVISLSEIDTRLAEADIVISSTASPLPIIGKGMVERALKLRRNQPMLLIDIAVPRDIEPDVEKLSDAYLYSVDDLQAIIQQNLAQRKAAAVIAEGIVQQESTHFMDWLRSQGAVNTIREYREQAEKIRAEMTAKALMSIQQGADAEQVINQLTHQLTNRLIHTPTKSLQKAASDGDLERLNLLRDGLGLD

SEQ ID NO: 204 - protein, 320 aa, Xenorhabdus nematophilus
KDVVLQKMHEKRVEKALVVDDNFHLLGMITVKDFQKAERKPNACKDEQGRLRVGAAVGAGAGNEERVDALVAAGVDVLLIDSSHGHSEGVLQRIRETRAKYPNLQIIGGNVATGEGAKALVEAGVNAVKVGIGPGSICTTRIVTGVGVPQITAIADAVEALEGTGIPVIADGGIRFSGDIAKAIAAGAACVMVGSMLAGTEESPGEIELYQGRSFKSYRGMGSLGAMSKGSSDRYFQTDNAADKLVPEGIEGRVAYKGLLKNIVHQQMGGLRSCMGLTGCATIDELRTKAEFVRISGAGIQESHVHDVTITKESPNYRLG

SEQ ID NO: 205 - protein, 97 aa, Xenorhabdus nematophilus
MKIRPLHDRVIVKRQEVESKSAGGIVLTGSAAGKSTRGEVLAVGHGRILESGDVKALDVKVGDIVIFNEGYGVKAEKIDNEEVLIMSESDILAIVEA

SEQ ID NO: 206 - protein, 297 aa, Xenorhabdus nematophilus
LSNRLYTSLGDAAVGRFSDGEVSVQINENVRGGDVFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQKGLENPIVVSPDIGGVVRARAIAKLLNDTDMAIIDKRRPRANVSQVMHIIGDVAGRDCILVDDMIDTGGTLCKAAEALKERGAKRVFAYATHPIFSGNAVENIKNSVIDEFIVCDTIPLSDEVKALNKVRTLTLSGMLAEAIRRISNEESISAMFEH

SEQ ID NO: 207 - protein, 157 aa, Xenorhabdus nematophilus
  unsure (1)..(157): unsure at all Xaa locations
IDRKSIXMSDNHTLQIEEILKLLPHRYPFLLVDRVLDFEKGKFLRAVKNVTVNEPFFQGHFPGKPIFPGVLILEAMAQATGILAFKTVGTLEPGELYYFAAIDGARFKRPVLPGDQMIMEVEFIKERRGVARFRGVAKVDGEVACEAEMMCARRREA

SEQ ID NO: 208 - protein, 458 aa, Xenorhabdus nematophilus
MSHNPTATLGTVQASASNRVQLRRTLTLFQVVMMGLAYMQPMTIFDTFGIVSKLTDGHVATSYAIALIAILFTALSYGKLVKRFPSAGSAYTYVQKSMNPHLGFMVGWSSLLDYLLMPMINILLAKIYLQAIFPGIDPWVFVVGLAVLMTVFNLSGINVVANLNGLIVVVQIAVMVVFVGLLMHGIYNGEGAGTLWSARPFTSEEAQLIPMITGATILCFSFLGFDGITSLSEETPNAGKVIPKAIFLTALIGGVIFIAVSYFLQLYFPDVSRFQNPDESQPEIMLFVAGALFQAIILVFSCVTVMASGMAAHAGVARLLYVMGRDGVLPEKVFAYVHPKWRTPSINVILVGIVALSSGFLDLVTATALINFGALVAFTFVNLSVIAQFYVRERRNTTLKDTINFLLLPLFGAGTVGVLWMNLEASSMELGLIWGGVGLLYMFFLTRSFRQPMPQFSE

SEQ ID NO: 209 - protein, 896 aa, Xenorhabdus nematophilus
MSSKLKTDCASTLSINSETSGSKTYHYYSLPLLSEQLGEISRLPKSLKVLLENLLRNIDGDSVVEDDLKALVAWQRSGHAEREIAYRPARVLMQDFTGVPAVVDLAAMREAVLRLGGNVDQVNPLSPVDLVIDHSVMVDKFGTEQAFEENVQIEMERNYERYLFLRWGQKAFNRFRVVPPGTGICHQVNLEYLGKAVWYENRDGRDFAYPDTLVGTDSHTTMINGLGVLGWGVGGIEAEAAMLGQPISMLIPDVVGFKLTGKLREGITATDLVLTVTQMLRKHGVVGKFVEFYGDGLADLPLADRATIANMSPEYGATCGFFPVDDITLSYMRLTGRSEDEITLVEAYSKQQGLWRHAGDEPIFTSSLELDMSTVEASLAGPKRPQDRVALGGVPHAFQSSIDLDINRKQGLQSSIPVTVDNQTFSLQEGAVVIAAITSCTNTSNPSVLMTAGLLAKKAVEKGLQRQPWVKTSLAPGSKVVTEYLNLAGFMPYLEKLGFNLVGYGCTTCIGNSGPLQDEIEAAIKQSDLTVGAVLSGNRNFEGRIHPLVKTNWLASPPLVVAYALSGSMKRDLTSEPIGQDQQGRDIYLKDIWPSSKEVAEAVEKVRTEMFHKEYSAVFDGDENWQALEVESSATYSWQPDSTYIRLPPFFSHMTQEPEPVTDIHQANILAILGDSVTTDHISPAGNIKADSPAGRYLQDHGVAPKDFNSYGSRRGNHEVMMRGTFANIRIRNEMVPGIEGGYTRHIPSQSQLAIYDAAMRYQEEKKPLAIIAGKEYGSGSSRDWAAKGTSLLGVRVVIAESFERIHRSNLIGMGVLPLEFPQGITRKTLNLTGDEFIDIGGLNDIKPGQIIVVKITYPNGEVTQVNAHCRIDTNTELAYFYNGGILHYVIRNMLK

SEQ ID NO: 210 - protein, 596 aa, Xenorhabdus nematophilus
  unsure (1)..(596): unsure at all Xaa locations
NWMINGKSFQFFGGKIHPXRVPSQNWDHRIKMIKALGCNTISLYLMWNFHELPDGSFDFSSSDKNIAHFINLCATNNMWVLLRPGPYSCAEWDFGGLPPRMLADPQFHDSSDKLQIRGNFPNYMSAVLKWNTALYKQIIKGRTLTSGGPIMLIALENEYTSWSPDDPAHPTALASQWVSLGYTEKFCVCEGWANAFKNNNIPLPANTAYGLTAEGDSVSHHNEAKQYYQIASFGAECYPGWICHWTEEKQTINIDTFADIVATLAKAGCSFVIYVGHGGTNFGFTAGSNGKLISSAPVITSYDYGAPVSENGRQNANFQVIKAAYAENASYIVPSNPIPTPIPSITDGEISPISNSQFVFSDFLSNVIPTIPNPIPQTIEXIALTLNSQQPASAGIYPAGIAVYQTELPKSGYDLSVEFNRPPDFALAFLNGVRVTSDVLTTVKGGKISPVISFKIDDVPPNSILQIVCMPFGRANYGGDEMRTDGRGLSSNVILNGDMLTNWKMTLYPLLASQLAKLPFGINKPTGPRPFFAKAILTIDIPKDMYIDMSSWGTGYVLVNGHNLGRYWTLAGPQTRLYCPGVWLNSGSNTIIIFEF

SEQ ID NO: 211 - protein, 309 aa, Xenorhabdus nematophilus
VMSVAKLAVMGSINVDHILNLKFFPQPGETVQGKQYQVAFGGKGANQAVAAGRCGADITFIACVGQDDVGKNICQQLGKDNINTSAIRMIEGESTGVALIFVNQQGENIIGINAGANGSLTPECIHHHEVVIKEADALLLQLEIPLNTVLLAAEMAKKHLTKVILNPAPAQEVSDKLLSLVDIITPNETEAEHLTGIAITDNTEAGKAAQFLHDRGIETVIITLGSRGVWLSEQGKQGKVISGFPVKAIDTIAAGDTFNGALVTGLLEGKDILSAIRFAHAAAAIAVTRRGAQPSIPWRSEIDAFLAEQ

SEQ ID NO: 212 - protein, 469 aa, Xenorhabdus nematophilus
MKKTKIVCTIGPKTESEEKLTELLNSGMNVMRLNFSHGDYEEHGQRIKNIRSVTAKIGKKAAILLDTKGPEIRTMKLEDGNDVSLTAGQTFTFTTDQSTIGNQERVAVTYSGLPADLSVGNTVLVDDGLIAMTVKEIAGTEVICEVLNNGDLGENKGVNLPNVSINLPALAEKDKQDLIFGCEQGVDFIAASFIRKRSDVLEIREHLKAHGGEHIQIISKIENQEGLNNFDEILEASDGIMVARGDLGVEIPVEEVIFAQKMMIEKCNSARKVVITATQMLDSMIKNPRPTRAEAGDVANAILDGTDAVMLSGESAKGKYPVEAVSIMATICERTDRVMGSRIENTKTQKLRVTEAVCRGAVEIAEKLEAPLIVVATYGGKSARSVRKYFPNARILALTTNEITARQLLLVKGVSTQVVKEIASTDDFYRIGKEAALASGMASKGDIVVMVSGALVPSGTTNTSSVHVL

SEQ ID NO: 213 - protein, 315 aa, Xenorhabdus nematophilus
GNFMRVQKPINSGFSSSSTASDVLKGIDIKGKTAFITGGHSGLGYEATKALSEAGAHVVVGARDILNASNALSKLSNITVLPLDLSDINSVRKLANYIYANRCLFDYVICNAGIMASPEKRVGPGWESQFATNHVGHYVLVNLIWNNIRVGGRVVCVSSAGHHNSPIRWDDIQFTSGYDKWVAYAQSKTANILFALQLDEYGKDKNIRAFSLHPGKIFTPLQRHLSYEEMESEGWMDKDGNPIDPTFKTPAQGAATEVWAATSSALNGLGGLYCEDCDVAGLASDYKEPFAGVCEYAIDLSEALKLWNFTANLTG

SEQ ID NO: 214 - protein, 248 aa, Xenorhabdus nematophilus
EMNSFKGKTVWVTGAGSGIGYRTALGFHEAGAKVFGFDLKFPDSMPFETLILDVSNDCAVQKICPPLLKENGLDVLVNGAGILRLGSAETLSREDWESSINVNAGAAFNLFKILIPHFQRQRNGNIVSIVSNAAHVPRVNMAVYCASKAAMRSLCLSVGLELAPFGVRCNIVSPGSTLTPMLEGMLNGDIAHQRLIHGITEQFKLGIPLGKIAQPDEIANVILFLASEQASHITLQDIVIDGGATLGA

SEQ ID NO: 215 - protein, 525 aa, Xenorhabdus nematophilus
FNRWPQDLAERYRLKGYWIDRPLSDILDIHCENDAKALFCGERSWNYRELNESVNRLAASLHRRGVRQGQTALVQLGNEAEFYIVFFALLRLGVVPVNALYSHQSSELTAYALQIKPQILIADRQHRQFHDDVLIDRLIDKCPELNIVVLHHTDSDHSLSRLISEEPGDFTPTPTPADEVAFFQLSGGSTGTPKLIPRTHNDYYYSIRASNPICNVSSKTRYLCALPAAHNYPMSSPGALGVFYAGGQVILVPDPSPDGCFPAIERHQINLVALVPPAVSIWLEYTTLRGHADELASLEVMLVGGAPLGETLARRIPAELGCQLQQVFGMAEGLVNYTRLDDDDTHTFTTQGRPISEDDEIWVASQEGLPVPLGEPGLLMTRGPYTFRGYYRSPEHNQTVFDSHGFYCSGDVVIQLPGGYLKVVGREKDQINRGGEKIAAEEVEHLLLRHPAVVYAALVAILDPLMGEKTCAYVVTREHESVKPVVFRRWLREQGIADYKIPDRFESLPKLPLTPVGKINKQALR

SEQ ID NO: 216 - protein, 251 aa, Xenorhabdus nematophilus
MKLIRLPALSDNYIWLLCDENRHCVIIDPAESQPVMDTLAANQLIPIAILLTHHHHDHVGGVAGLLKQYPTLPVYGPEETQSKGATHVVHENDLIVTGNFSFQVLALPGHTLGHIAFYQAPYLFCGDTLFSAGCGRLFEGTAEQMFSSLEKIASLPDETLICCAHEYTAANMKFALAVLPENQAINDYHKKIIELREKDQATVPTTLKIEKKINVFLNCHDIDLQKNIGIKPNSIPLSSVFQQLRAYKDRF

SEQ ID NO: 217 - protein, 569 aa, Xenorhabdus nematophilus
MRILLPFLALYRRHWFLISLGMVLATLTLLASIGLLTLSGWFLAGTAVAGFAGKYTFNYMLPAAGVRGAAIFRTAGRYGERLVSHDATFRVLAHLRVFTFQKILPLSPGGIARFRQGELLNRIVADVETLDHLYLRVLSPLLAALAVIVVLTLGLGFLDWTLAYTLGGIMLGLLLILPFVFYHTGKPYGRNITALRGQYRTLLTSTLQGQAELTVFGALKRFRQTMSEVEYQWLKSQQQQANLTGLSQAIMIFATGMTVTLILWLAAADVGGNNQPGALIALFTFCALSAFESLGPVTVAFQHMGQVISSATRVSQLMHQKAEVIFPADGPKSTDNLSLEIKNIEFTYPNQPMPVLQNISLSLQAGEHIALLGKTGCGKSTLLQLLTRAWDVDNGEILLNQQPISLYDEATLRSMISVVPQRIHVFSHTLRENLLMAKPGAPDEELETVLQQVGLGNLLENNEKLNCWMGEGGRQLSGGEQRRLGIARALLHNSPLMLLDEPTEGLDADTEQQILALLRHSCQDKTLIVITHRLTGLQHMDRICVMDGGRIIEQGQHDVLLSQQGRYYQ

SEQ ID NO: 218 - protein, 542 aa, Xenorhabdus nematophilus
ILQALIMDHVPRENLISQFAMLLASFTLRAIVSAIRERIGFICGKVVRQQIRSMVLDKLTQLGPVWVKGKPAGSWATIILEQIEDMQDFYSRYLPQMTLAATIPVLILMTVFPINWAAGVILLVTAPLIPLFMALVGLGAADANRRNFTALSRLSGNFLDRLRGLETLRLFHRGKAEVKQITESTEDFRLRTMEVLRMAFLSSAVLEFFAAVSIAVVAVYFGFSYLGELHFGSYGLGVTLFAGFLALILAPEFFQPLRDLGTFYHAKAQAVGAAESLFTLLTSGEEHASYGGKKILSDKNAVSIEANELEILSHDGHRLAGPLNFTVEQHQRIALVGKSGAGKSSLINVLLGFLPYRGSLKINGSELNELDLDKWREQLSWVGQNPHLPEQTILDNIRLGQFDATQEQIQSVMQQAYVTEFVSELPDGINTVIGDNAARLSVGQAQRIAVGRALLHPCQLLLLDEPAASLDAHSEQRVMTALNQASSQQTTLLVTHLLEETPEYDQIWVMESGLIIEKGNYESLRQSQGAFSRLLSHRSMEL

SEQ ID NO: 219 - protein, 153 aa, Xenorhabdus nematophilus
MYHHYLNTPEGFPKPYVHVTANDEGVTSIYFVNEKKELESKNAITKQCVKELQEYFKGKRDTFTVPLSMQGTEFQQRVWKQLCNIPFGEMWSYKQLALTLGSVNYCRAVGMANSRNPISLIVPCHRVIGHDGKLVGYTGGLNIKEWLLEHEKK

SEQ ID NO: 220 - protein, 444 aa, Xenorhabdus nematophilus
MSNRKYFGTDGIRGKVGNSPITPDFVLKLGWAAGKVLARHGSRKIIIGKDTRISGYMLESALEAGLAAAGLSASFTGPMPTPAVAYLTRTFRAEAGIVISASHNPYYDNGIKFFSIDGTKLPDDVEEAIEAEMEKPLTCVESAELGRANRIVDAAGRYIEFCKGTFPSEQSLNGLKIVLDCANGATYHIAPNVLRELGAEVIAIGCEPNGININEECGATDVRLLQKRVLEEQADVGLAFDGDGDRIIMVDHLGHKVDGDQILYIIAREALRQGQLRGGAIGTLMSNMGLELALKQLGIPFERAKVGDRYVLEKLQEKGWRLGAENSGHIILLDKTTTGDGVVAGLQVLSAMVRNDMTLHDLCSGMKLLPQVLVNVRFAGNNDPLQSEQVLEVVKEVENELNGRGRVLLRKSGTEPLIRVMVEGEDEEQVTALAHRIADSVKGM

SEQ ID NO: 221 - protein, 648 aa, Xenorhabdus nematophilus
  unsure (1)..(648): unsure at all Xaa locations
MAKNLILWLVIAVVLMLLFQSFGPGDSSGRRVDYSNFISELSQNQISEVRISGRDIDFTKKDNGGKYSTYMPVPDEKLLDTLLNKQVKVVGEPPEQQGLLASIFISWFPMLLLIGVWIFFMRQMQGGGGKGAMSFGKSKARMLTEDQIKTTFADVAGCDEAKEEVGELVEYLREPGRFQKLGGKIPKGILMVGPPGTGKTLLAKAIAGEAKVPFFTISGSDFVEMFVGVGASRVRDMFEQAKKAAPCIIFIDEIDAVGRQRGAGLGGGHDEREQTLNQMLVEMDGFEGNEGIIVIAATNRPDVLDPALLRPGRFDRQVVVGLPDVRGREQILKVHMRRIPLDTDIDASIIARGTPGFSGADLANLVNEAALFAARGNKRVVSMVEFEKAKDKIMMGAERRSMVMTEEQKESTAYHEAGHAIIGRLVPEHDPVHKVTIIPRGRALGVTFFLPEGDQISASRQKLESQISTLYGGRLAEEIIYGPENVSTGASNDIKVATSIARNMVTQWGFSEKLGPLLYAEEEGEVFLGRSVAKAKHMSEDTARLIDQEVKVLVDRNYQRARQILMDNLDILHSMKDALMKYETIDAPQIDDLMNRTTVRPPAGWEGDNRNGGNSNNSNNRQDTSSQQQSAKPADGNPTAXPTQTKGN

SEQ ID NO: 222 - protein, 199 aa, Xenorhabdus nematophilus
IMRIIAIRHAETQWNIERILQGRLDSPVTENGFRQINSLLSAIKDFPISKVISSSSGRACTTGQVLADYFGCRMEINENLCEQNFGILEGLPFGQADYHYPNITSRLFAGDPTVTIPEGESTIEVAQRAISCIQNLATNNSNATICLVTHGRTLQSLLWQLKGGNLQEETTRYSHQNCSYSVIDVKNERIHVVRWGVAT

SEQ ID NO: 223 - protein, 347 aa, Xenorhabdus nematophilus
MYKTDELRTRPIDKLITPKTLSEQYPISEKIRQNVTLSRKRIEDILTGKDQRLLVIIGPCSIHDTDAALDYASRLQVLREKYQHSLEIVMRTYFEKPRTVIGWKGLISDPMLDGSCQVNKGISLARNLLININELGMPTATEFLDMVTGQYIADLISWGAIGARTTESQIHREMASALSCPVGFKNGTDGNTHIAIDAIRAASARHMFLSPDKDGQMTIYQTSGNPYGHVIMRGGKKPNYYAEDITATCQKLREFRLPERLIIDCSHSNCQKIHRRQLDVARDISQQLNSGSTAIAGVMAESFLVEGSQKIMLGEPLTYGQSITDSCLSWQDTEEFLHILAEAAKKR

SEQ ID NO: 224 - protein, 527 aa, Xenorhabdus nematophilus
LNEYDGNALSPILFLKRAILSNGDYLAVIDGENVVTWRQYGERCERVAVALQQMGIGKGCVVSALLPNIHELLELHYAVPLSGGILNALSIRTDAATLNFIFEKINPTILIIDKNYLALLDGVSFKNPVKIVVITENNTPLPESALDLISYESLISEYPSETLNFYPIDEQEAISINSTSGTSGTPKLVVYSHRGAYLNAISNILDWDMPKYPIYLWTLPMFHCNGRCFPWTIAARAGTHVCIRKFDAQKAIQIMLKHQVTHYCGAPIVHYSLGREAQKLGISFNNNVYGLIAGAPPTEKMFSLLDAAGIRATHVYGLTETYGPVVVCEDKPDWATLPKSETILKKMRQGIVSNLQGEISVIDENNGLAVPFDGQSIGEIAIRGNIVAAYGPVDRVTFDMTSQWFFTGDLAVIDSDGYIKIIDRKKDIIISGGENISSLELENALSSYPGVLAVAVVAKPDEYWGEVPHAFIEIDDNTSITEQELDDYLRTIVARYKRPKGYTFSALPRNASGKILKETLRKLANNL

SEQ ID NO: 225 - protein, 241 aa, Xenorhabdus nematophilus
NLTGKVAFISGGTKGIGKGIAQVFKRVGAITIISGTDKTKGMPVAEELGVDFIALDVTDPSACKNVINEIVEKYGRLDILCSNAGIFPQHNIKDMTVEDWDLVYSVNLKGTFLLTQAALNVMEKQQYGRIVITSSITGEIVGMQGYSHYGASKAGQLGFMRSAALEYAKQGITINSIMPGMIMTEGLMAFGEDNLKQIETVIPMGALGSPEDIGYTACFLASDEAKNITGQTIVVDGGQVL

SEQ ID NO: 226 - protein, 321 aa, Xenorhabdus nematophilus
  unsure (1)..(321): unsure at all Xaa locations
IAALGIWHPSTVVDNNWFIEYYAEQGIDVRGLLNSLGYKNRYLIRDSSDTTLTMSVAASNNAIRQLGCQANDLDLVVFASQTPEYLIPSTALKIHHAIGGGERAXAFDINANCAGLLVAVETVSRVMMVHPSCQLALVVGGDYLGAHSSHSPVYHSCFSEAAVAVILHKTEQGNGFIDSENRIQTSVINNSLFPECGLSNIHQHNISAQVKFTPFDDSICIDVAVGSIQLLLSRNNLIIEDIKGFMFSQFSISNIRLLCKVLGVDQSKALFIGDKYGYTATNSPFVALYEALERKEIARGDLIVFWSVGAGWQSTAILMEY

SEQ ID NO: 227 - protein, 477 aa, Xenorhabdus nematophilus
QAPKNLRRELKARHMAMIAIGGSIGTGLFVASGATISQAGPGGALLSYALIGLMVYFLMTSLGELAAYMPVSGSFSTYGSKYVDEGFGFALGWNYWYNWAVTIAVDLVAAQLVMGYWFPDAPGWIWSALFLSLIFLLNFISVKSFGEAEYWFSLIKVSTVIVFIIVGILMIVGIMKGAEGAGWHNWTIGEAPFAGGFAAMIGVAMIVGFSFQGTELIGITAGESKDPAKNIPRAVRKVFWRILLFYVFAILIISLIIPYTDPSLLRNGVKDISVSPFTLVFENAGLLSAAAVMNAVILTAVLSAGNSGMYASTRMLFTLAREGKAPKIFGHLSKGGVPRNALYATTVVAGLCFLSSMFGNQTVYLWLLNTSGMTGFIAWLGIAISHYRFRKGYVAQGRNINELPYVSGFFPVGPIFAFVLCLLITLGQNYQAFLQDTIDWYGVTATYIGIPLFLLIWFGYKLKNKTRFVKYNEMDFP

SEQ ID NO: 228 - protein, 327 aa, Xenorhabdus nematophilus
  unsure (1)..(327): unsure at all Xaa locations
SRAWRENDHWMVEAKDLVTGESKTWRAKGLVNATGPWVKNFFDNGLQLKSPYGIRLIKGSHIVVPRVHDEPQAYILQNEDNRIVFVIPWNDEFSIIGTTDVEYKGDPKDVKIDDQEIDYLLKVYNDHFKKQLNRTDVVWTYSGVRPLCDDESDSPQAITRDYTLDVQDEQGQTPLLSVFGGKLTTYRKLAEHAMDKLAQYYPNAGQAWTKNGKLPGGELEGQDRDGYARLLRQRYDWLPEGIARRYSRTYGSNSNIILGDAKELADLGEFFGYGLYEAELRYLVEHEWVTQLDDAIWRRTKLGMWLTDEQKQRVADWLAQNVKSAXS

SEQ ID NO: 229 - protein, 129 aa, Xenorhabdus nematophilus
MSHVPVELKYTESHEWVRSEGNGEYTVGITEHAQQLLGDMVFIDLPEIGMQVNIGDDCAVVESVKAASDIYAPLSGEVIAVNPALEGSPELVNSEPYNDGWLFRIKVTDESKLSELLDAEKYRALLVEE

SEQ ID NO: 230 - protein, 198 aa, Xenorhabdus nematophilus
MISLYTDSSPNGFKITIALEELELPYVVNHVHIEKGENLLPEFLQLNPHGRIPVLSDSETNTTIFESAAILLYLADKTNKLLPSEHNARWQAIQWLIFHASSVGPIIGQRVNFEIFDEGKNKEATERYKKLTERAFSTMDNHLANNLYFGGKEYSIADIANFGWTHIARIINFDFHHYKNLSEWHHRIAARPAVQRGI

SEQ ID NO: 231 - protein, 322 aa, Xenorhabdus nematophilus
GRVIQELLFGSTSAIVTEKRARTVQSPGGTGALRTAADFIAKQTNAKRVWISNPTWPNHKGVFSSAGLEIREYNYYDAEKHALNFEGMLASLSEAQAGDVVLLHGCCHNPTGIDPTPEQWQKLADLSAANGWLPVFDFAYQGFAKGLDEDAEGLRIFAKNHNELIVASSYSKNFGLYNERVGACTIVAADSDTAEKAFSQAKFIVRTNYSNPPAHGASVVTTILSNEELKAEWIQELATMRERIQRMRQLFVNTLQEKGAKQDFSFICAQNGMFSFSGLTKEQVERLREEYAVYAVSSGRINVAGLTLENMVPLCEAIVAVL

SEQ ID NO: 232 - protein, 424 aa, Xenorhabdus nematophilus
MNPSDIDFDLRHIWHPYTSMSNPLPTYPVDSASGVELVLSDGRKLIDGMSSWWAAIHGYNHPVLNEAAKSQIDKMSHVMFGGITHPPAVELCKQLVAMTPASLECVFLADSGSVAVEVAMKMALQYWQAKGQQQKRRQKFLTLRHGYHGDTFGAMSVCDPENSMHSLYQGYLPNHLFADAPQSRFDGEWQPEDISSFQQLLLQHHDEIAAVILEPIVQGAGGMRIYHPEYLRQVRNLCDEYQILLIADEIATGFGRTGKLFACEHANIEPDILCLGKALTGGYMTLSATLTTRHVAETISQGEAGCFMHGPTFMGNPLACAVAGASLKLLTESPWQQRIHSIESGLKAELLPLKSYNSVEDVRVLGAIGVVEMKQPVDVAALQRHFVQQGVWIRPFGRLIYLMPPYVIQPEQLLKLTNAIADAV

SEQ ID NO: 233 - protein, 329 aa, Xenorhabdus nematophilus
MSWSDSLSRRLAERRGTSLWRRRQAHQSSNGRHLYTSDGQQYLNFSSNDYLGLSQHPEVIAAWQQGAEQYGVGSGGSGHVTGYTSAHHALEQQLAEWLGYSRALLFISGYSANQGVIAALMEKEDRIIADRLNHASLMEAAMHSPAQFRRFLHNNPISLKQHLGKACAGKTLVVTEGVFSMDGDSAPLSEITRLAQSTGSWLMVDDAHGIGIYGDEGRGSCWLQNVKPEILIVTCGKAFGLSGAAVLCDEQTAEYFVQYSRHLIYSTSMPPAQAVALSEATRQIRAGDELRQRLQNNIQYFRREAQNLSFSLTDSETAIQPVIIGNNER

SEQ ID NO: 234 - protein, 491 aa, Xenorhabdus nematophilus
MNRIPVIGSGFGGIALAIRLQAANIPTLLLDKRDKPGGRAYVYQDKGFTFDAGPTVITDPSAIEELFLLAGKKMSDYIELLPISPFYRLQWQSGEIFDYGGDQVKLEKQIARFNPGDVQGYREFIRYSKAVFKTGYLKYGMSPFLSFRSMVCAMPSLVQLSAWKSVYGIVSKHIKNEHLRQAFSFHSLLIGGNPFTTSSIYTLIHTLEREGGVWFPRGGTGALVNALVKLFIDIGGVCKLNTQVESFITNDNQITAIKLNDQREIYCKAAASNADVIHTYEKLLGRHCVGKRRSDSLKEKKMSNSLFVIYFGLNKLHIQLAHHTICFGNRYKELLDDIFEGNSIPGDFSLYLHSPSVTDPTLAPPGCASYYVLAPVPHLGNAQINWLEESPRLRDRIFSYLEKYYIPGLRDQLVTHKIFTPFDFRDELNAYHGSAFSIAPLLLQSAWFRPHNRDSDIENLYIVGAGTHPGAGIPGVLASAKITANLMIEDL

SEQ ID NO: 235 - protein, 477 aa, Xenorhabdus nematophilus
LYRHLVGLPLPYFKQRQTGQIIARVREMAQIRQFLTGSTLMLLLDLIFIVLFLGVMFHYSSLLTWIVTGSLVLYFLLWVTVGPIIRHKVEAEYEADAQATSFLTEAVTGIETIKTTATEKRFLHQWQAVLSRQLIQRFSAQKSGLAAGQGIALIQKIVAALLLWWGVKSVLAGELSPGELIAFNMLAGHVTQPILRLAQVWQDFQHTLIALRRVGDILDEPMENSKQGLVSSPELAGQIEFKNIRFRYHEDTPEVLANLSLSISAGEFIGITGPSGSGKSTLTRLLQRLYIPQHGQVLVDGMDLAIADPVSLRRNMSVVLQESILFSGSIADNIRLCKPNATDEELYRAAALAGAIDFINQFPHKFAHPVGEKGGNLSGGQRQRIALARALLNDPKILILDEATSALDYESEAAIMSNMDEIRQNRTIISIAHRLNTLRHADKIFVLDQGRIIESGSHADLLQQHGLYAQLWHQQTE

SEQ ID NO: 236 - protein, 225 aa, Xenorhabdus nematophilus
MSAPLTWHDVIGNEKAQPYFTDTLTYVANERKAGKTIYPPQQDVFNAFRYTELADVKVVILGQDPYHGPNQAHGLAFSVQPGIPAPPSLVNMYKELESDIAGFQRPNHGCLLSWAKQGVLLLNTVLTVERGNAHSHANLGWETFTDKVIAAINEHRSGVIFLLWGAHAQKKGRIIDTQRHHVLKAPHPSPLSAHRGFLGCKHFSQANHLLEAQGLASIDWNPVLP

SEQ ID NO: 237 - protein, 246 aa, Xenorhabdus nematophilus
YMRFQNSVVIITGGASGIGEATAKAFAAEGAHVVIADFSDHGKKVAEELHPKGNESIFIKTDVTSEESIKYMVSKTIEKFKRIDVLFANAGIAADNSADKLTVASWQKTIDVNLTGVFLCDKFVIHEMLKQESGGVIVNCGSIHSFVSREAITAYTASKGGVKLLSQTLAIDYAKNNIRVNTVCPGYINTPLLSKIPEELKEQLISLHPLGRLGKPEEVAKAVLFLASDDASFITGTTLLVDGGYT

SEQ ID NO: 238 - protein, 208 aa, Xenorhabdus nematophilus
MLSRLMKNLLTQLHQQGIHNELLLEVISKVPRECFVDEALAHKAYENTALPIGHGQTISQPYIVARMTELLDLTPESKVLEIGTGSGYQTAILAHLAGHVFSVERIKGLQWQAKRRLKQLDLHNISTRHGDGWNGWPSKGPFHAIIVTAAPPEIPQALLHQLADGGVMVLPVGESSQSLKVVHRYGNDFHSEVIESVRFVPLIQGELA

SEQ ID NO: 239 - protein, 827 aa, Xenorhabdus nematophilus
YLEVDNGALSEATDFMADALAEPVLYPVNADRERHAVDNEMTIARAGEGHRIWQIRSETLNPSHPNARFAGGNLETLKDKPDRKLQTALEDFYQRYYSANLMKGVLYGKQPIDKLAQIAAETFGRIPNRNASVPAITAPAITEKEEGIIIHYVPSKPYKSLQLEFSIPNEIANFRSKTEGYIGYLIENRSENTLSDWLLKQGLSEGISASANPNVDGNSGSFSIYVELTDKGLQQRDQVIAAIFSYINLLKQKGIQQSYFDEMVKVFNLSFKYASIVRDMNYIESLADTMLIVPVSHVLDAPYLADKYNPQAILRRLDQLTPENARIWFTSPEEPHNKEAYFVQAPYQVNKISPKQFEEWQELEKGMSFSLPELNPYIPDNLTLIKTSGSQKHPRMILEQPNVRLLYMPSQYFADEPKANIVLELRNADGMKSAKEQVTYSLLSYLSDLALHQLGYQASVAGMGASVGYADGLQIGVYGYTQHLPELLTSTISQYMAFTPTQTELQQAKSWYRNQLEIANEGKAYEMAMQPVSRLSGVPYIEQAELLKSLDGVSIDDVIKYRQKMIQSAALQAMIFGNLTEKQGIDIINSAHKQLGNRGTEWWSGEHIELDRNYAVNFEGTASSTDNALAEIYIPTGYDRSTGAVYSNLLSSILSPWFYDQLRTTEQLGYAVFAFNTRVGEQWGLGFLLQSNSKQPDYLHQRYLSFYSAAEKKLQAMSDAEFEQYKTSLLTEMRQPPQTFSGEASRYSHDFGRNNFSFDTREKLLTSLEKVTKAQLMEFYDKAVMKRQGLALISQITGKKGSLHQYAQLKGWKTYPNVSTFQKKLPV

SEQ ID NO: 240 - protein, 757 aa, Xenorhabdus nematophilus
VMKVLIAKNEVGTKHHSHYIENAIHRLADKLIERDVEVVIADSFDDSYTIIAANEPIDCLMVSCALMDEDLYQQIQKLLNKLFERQEDVPVFLLSDREKAVFLLDHAMLEQLTEFAWILEDSSDFITGRAIAAMHRYRQQLLPPLMSALMNYRKIYEYSWAAPGHQAGVGFNKTPVGRIYHDYYGENLFRSDMGIERSSLGSLLDHTGAFGESERNTARVFGADHSYSVVVGTSGSNRTIMQACMTEDDIVLIDRNCHKSIEQGLILTGAKPVYMLPSRNRYGIIGPIYPQEMETKTLQKKLKQNPLTKDMVKKKPVYTVVTNCTYDGVCYNAKHVQNLLDKSVDRIHFDEAWYGYARFNPIYHDHYAMRGDPKTHKGPTVFATHSSHKLLNALSQASFIHVRDGRNPIDFSRFNQAYMMHATTSPLYAICASNDIATSMMDGNSGYSLTQEVIEEAVDFRQALARLYRDFSKKGDWFFKPWNQEQVTDPATGKKMLFADAPRDLLTTKQSCWTMNPGDSWHGFEDLPNDWSMLDPIKVSILTPGMGDNGKLLKQGVPAALVTAWLSQHGIVPTRTTDFQIMFLFSMGITKGKWGTLLNTLLSFKHHYDANTPLSKVFPDLVHDYPDVYSTSGVRDLGDKMFAYLHKNNPGEKLNQAYAILPEVDMIPRAAYQAIVTNDVELVALDKLPHRIAANSIIPYPPGIPMLMSGENFGDKNSPQISYLHALQKWDHEFPGFEHETEGTEIINGIYHVMCVK

SEQ ID NO: 241 - protein, 361 aa, Xenorhabdus nematophilus
MAGNSIGQFFRVTTFGESHGLALGGIVDGVPPGIVISEADLQIDLDRRRPGTSRYTTQRREPDEVRILSGVFEGVTTGTSIGLLIENTDQRSQDYSAIKDVFRPGHADYTYEQKYGLRDYRGGGRSSARETAIRVAAGAIAKKYLFEKHGIRIRACLTQMGDIHCEMKDWDLVEQNPFFCPDESKLTQLDKLLRALKKEGDSIGARVTVVAENVPAGLGEPVFDRLDADIAHALMSINAVKGVEIGDGFGVIGLRGSENRDEITSQGFTSNHAGGILGGISSSQPIVAHIALKPTSSIMVSGKTINRQGEEVDMVTRGRHDPCVGIRAVPIAEAMMAIVLMDHLLRQRAQCADVSPSLPSW

SEQ ID NO: 242 - protein, 445 aa, Xenorhabdus nematophilus
MQNTSQLKRGLSVRHIRFMALGSAIGTGLFYGSAGAIQAAGPAVLLAYIIGGAAVFMVMRALGEMAVHNPVPGSFSHYASHYLGPLAGFLTGWTYVFEMLVVCLADVTAFGLYMKFWFPHVDQWIWVLGIVFFIGAINLCNVKVFGEMEFWLSIIKVVAIIAMIIGGFAIMMYGFEQGTGLSNLWEHGGFMPNGVTGIIASFTIVMFAFGGIEVIGITASEAKNPVYSIPRAINAVPVRILLFYVLTLFVLMCIYPWNQVGQNGSPFVQIFSSLQFNYAAHILNLVVITAAISAINSDIFGAGRMMYGMAQKKQAPAFFNKLTKHGVPWVTVLVMSAILLVGVWLNYILPEEIFLIIASIATFATVWVWLMILLSQYMMRRKMPAEEAKQLQFPVPFWPIAPMLTIAFMAFIILVLGYFPHTRVALYVGLGWVALLTACYFLWVK

SEQ ID NO: 243 - protein, 375 aa, Xenorhabdus nematophilus
RIAGRAKNINASVTVGLADIVAKLKSEGRDIIGLNEGELDFSTGAAIVNDTIRALIDGRTRYSWLNGEPELREKICQKVFEDNRIKATPENVIVTNGSKQVIYEILQTVINPGDEVIIPVPCWATYLEAVKLAGGKAVLIENIGVDLDVEKIKQAITENTKLIIINTPNNPTGAVYSKAALQTLCQIVKEKQIFMLSDEAYEQIVFDGEHHSLAALDDNEYIITVQTFSKSFAMTGYRIGYMIAHPELINRVSDLHGHMTDNVCTFAQYGAIASLEMPKDFYQERLEILKQRRDRAYRYTRELFDCELPAGAFYLFPNVEKYLNDRCRDATQFCEYLLTHAGVALIPAEACLYRGHVRVSFAAPMDAIEQGFERI

SEQ ID NO: 244 - protein, 544 aa, Xenorhabdus nematophilus
DNVLILALLKKALSDIDAIRFNDLQSGRQLSWRQLLCSIARIYRYMHELNVTRGQRVVTISHNCWELLAIEFACQLKGAIYAPVYANYSEEMMTYCLSLAEPALVITEKVSLAQTLAQHSPWQVMTLEQAGPFPDFAGIDRETDLISPDKAVSHEAIGEALLRAITTDLQATQAEQAFCLMFTSGSSGKPKGVLLSQNNILSQQQALQTLWHFDGPQSFLSYLPWHHSFGGLFEKYTAIFSQAMLHIDNSRGMDIDRMCTNLSQLKPTRFFSVPKILTVVANKMKHSEAFHRAVAPTLQMIFSAASKLPPDIEDYFKHCGIYVAEGWGLTETSPCLTLKGPGYEEHNSVGRPLPNVILSIDEDSGEILAKGPNVMLGYYADEAANQRCFRQGWFRTGDLGKMIKGELVLLGRLDSVKKLSNGEKVSSDAIEQSLFEKTDIINHAIIDIEQRPYATALLFINPELCRQRFGENCTLQHSSRLQEHIAEVVQQHNQQVEDSSFKLIAVAVTETSLSLEKGEVTPSFKVSQRTVRENYQAVRDALYD

SEQ ID NO: 245 - protein, 428 aa, Xenorhabdus nematophilus
  unsure (1)..(428): unsure at all Xaa locations
RRQVXLSKMALFFAAIIFAAPHATRNSDSEYPYRQHSDFLYLTGFNEPESVLILIKSDETHNHSVLFNRVRDLTAEIWFGRRLGQEAAPEKLGVDRALPFDALDEQLYLLLNGLDVVYHAQGEFEYADEIVFSALDKLRKNSRRNLTVPSIIADWRPWLHEMRLFKSEAELEIMRKAGKISAQAHTRAMQHCRPDMFEYQLEAEIHHEFTYHGARYPAYNTIVGSGENACILHYTENDRCMKAGDLVLIDAGCEYKGYAGDITRTFPVNGKFTRPQREIYDIVLKSINVSLELYKPGTSMREVTGQVVRIMVEELVKLGILHGEVEYLIETNAYRQFFMHGLSHWLGLDVHDVGHYGVDRDRILEPGMVLTVEPGLYIAPDADVPPEYRGIGIRIEDDILITESGNENLTEYVVKDPDEIEALMAQAK

SEQ ID NO: 246 - protein, 341 aa, Xenorhabdus nematophilus
MQSLTLQPISHIHGTINLPGSKSVSNRALLLAALAQGTTCLTNLLDSDDIRHMLNALTALGVAYRLSEDRTTCEVDGIGGVITDKNELELFLGNAGTAMRPLAAALCLGNNDVVLTGEPRMKERPIGHLVDALCQAGAKIDYLEQENYPPVRIRGGFSGGKVTVDGSVSSQFLTALLMAAPLALNDSEIDIKGDLVSKPYIDITLALMNSFGVTVENDHYQVFRIKGQQKYQSPGHYLVEGDASSASYFLAAAAIKGGTVRVTGIGKNSLQGDTKFADVLEKMGATIRKGDDFVECERGTLTGIDMDMNAIPDAAMTIATTALFAKGETVIRNIYNWRVKE

SEQ ID NO: 247 - protein, 361 aa, Xenorhabdus nematophilus
MSQVYNFSAGPAMLPAEVLRRAEQELCNWHGLGTSVMEISHRSKEFMSVASEAEKDLRDLLSIPENYKVLFCHGGARGQFSALPLNLLGDKTSADYIVGGYWAESAAKEAAKYCTPNVINILTETDGVKSVKPMNEWDLSNDAAYVHYCPNETIGGIAIFEEPDFGDDKIVVADYSSTILSAPIDVSRYGVIYAGAQKNIGPAGITVVIIREDLLGKAHKHTPSILDYTVQVNNDSMYNTPPTFAWYLSGMVFKWLKEQGGLQEIKKRNHAKAKSLYHAIDNSDFYINRVAPQNRSIMNVPFQLANPALDGKFLEEAYAHGLHALKGHKVAGGARASIYNAMPHEGVMALVEFMADFERRN

SEQ ID NO: 248 - protein, 478 aa, Xenorhabdus nematophilus
KKVLMSNNIRIEEDLLGKREVPAEAYYGIHTLRAIENFYISDRSINDVPEFIRGMVMVKKAVALANKELHTIPGKVADIIVKACDELLNTGKCMDQFPVDVFQGGAGTSLNMNTNEVLANIGLELMGHQKGEYEYLNPNDHLNRSQSTNDAYPTGFRIAVYNAIMQLVNSIELLKAGFDKKGIEFDDILKMGRTQLQDAVPMTLGQEFRAFSMLLKEEIKNITRTAELLLEVNLGATAIGTGLNTAPGYQKLAVEKLAEVTGLPCIPAEDLIEATSDCGAYVMVHSALKRLAVKMSKICNDLRLLSSGPRAGLNEINLPELQAGSSIMPAKVNPVVPEVVNQVCFKVIGNDTCITMAAEAGQLQLNVMEPAIGQAMFESITILSNACRNLVEKCVNGITANKEVCESFVFNSIGIVTYLNPFIGHHNGDIVGKICAETGKSVREVVLERGLLTEAELDDIFSVENLKNPTYKAKRFDD

SEQ ID NO: 249 - protein, 284 aa, Xenorhabdus nematophilus
MFLISNSKMLKKAQREGYAVPAFNVHNLETVQVVVETAAKMESPVILAGTPGTFTYAGLEYMVSICKEAAMINKLPLALHLDHHEDINDIRHKVETGIRSVMIDGSHFPFEKNISTVAEVVRLCQRFDTSVEAELGRLGGQEDDLTVDSKDSFYTDPLAAKEFVERTGIDSLAVAIGSAHGLYHGEPHLDFSRLAEIHRHVEVPLVLHGASGIPEEMIHKSIALGICKVNVATDLKIAFADAVKAYFAQYPDANDPRKYITPGKIAMQKVVEKKITICGSAGRV

SEQ ID NO: 250 - protein, 454 aa, Xenorhabdus nematophilus
MTARLGRWLATLDGMEKRLEKTPKVRRYGRLTRATGLVLEATGLHLPLGATCLIERQNGNTLEEVESEVVGFNGEKLLLMPLEELEGIVPGARVYARAYGEEAGSGRRLPLGPELLGRVLDGAGRPLDGLPAPDTGYRAPLTTPPINPLQRTPISDVLDVGVRAINALLTVGRGQRMGLFAGSGVGKSVLLGMMARYTQADVIVVGLIGERGREVKDFIENILGEEGRARSVVVAAPADVSPLLRMQGASYATRIAEDFRDRGKHVLLIMDSLTRYSMAQREIALAIGEPPATKGYPPSVFAKLPALVERAGNGVSDGGSITAFYTVLTEGDDQQDPIADSARAILDGHIVLSRALAESGHYPAIDIEASISRAMTSLIDNTHYRRVQHFKQLLSSYQRNRDLINVGAYAAGSDPLLDRAIELYPHMAQFLHQNIEERSEYDAACAQLQQLLPS

SEQ ID NO: 251 - protein, 178 aa, Xenorhabdus nematophilus
LKHIVEVMISEQEVKQRIAELGQQITEHYRNSDRELVLVGLLRGSFIFMADLCREIQVSHEVDFMTASSYGNGMDSTRDVKILKDLDEDIRGKDVLIVEDIIDSGNTLNKIREILSLREPNSLAICTLLNKPSRREVDVPVEWIGYSIEDKFVVGYGIDYAQRYRHLPYIGHVTLLEE

SEQ ID NO: 252 - protein, 308 aa, Xenorhabdus nematophilus
MAYALELTQLTKTYNGGVKALRGIDLRVETGDFYALLGPNGAGKSTTIGIISSLVNKSSGKVNVFGYDIDTDLVNAKRQLGLVPQEFNFNPFETVIQIVLNQAGYYGVPRNVAQSRAETYLSQLDLWGKRNERANRLSGGMKRRLMIARALMHQPKLLILDEPTAGVDIELRRSMWDFLKSLNEQGTTIILTTHYLEEAEMLCRNIGIIQHGELVENTSMKDLLSQLEVETFLLDVAPEGNMPTLEGYSYRLVDTATLEVDVKRGQGLNDVFSQLSTQGIQIHSMRNKANRLEELFVGLTNNSQGARS

SEQ ID NO: 253 - protein, 253 aa, Xenorhabdus nematophilus
RMSRQIAVVTGAGGGFGTAIARTLLDIGYQVAATDISIQKLTLLKERLGQPESLAIFEMDVTDPASVEQAAQQITETWGKTITVLVNNAGIIHRTFCLSGQGLPEVAKMIDVNLTGAFNCTSIFVRYMAAQKYGRIINIASIAGIWGAAGGAAYGASKAGLISATESWGRELGPLNISVTAIAPGVCKTDMLEQFVNSSPMESAAEDKIVRSIVPVGRWGTSDDVAEVVGFLASCKTNYLNTAVIPLDGGMRV

SEQ ID NO: 254 - protein, 316 aa, Xenorhabdus nematophilus
IPFNRGEKSRVWDLDGNEHLDMFCKFGALLVGHHNEAYNSSLIEYMNKVTSVDTCDLEVAVCETMVRHIPCAEMVRFCLSGTEAVQNALRLARAFSGKNRFIRFHGHYHGNADNIMGWRKKQDLTYPVPEQFRGDLLDTLGRDPNVMTDQSFMLPWNDIDILTATIERYHDEIGAVLMEPICINGGGIFPVEGYLEKTKALCEKYNIVLIFDEIITGVRIGLGGAQKILGVTPHLATFGKALGGGAMPISAIAGRRDIMNLYTRGKVIHAGTFNGYPLGLAAIKTTFSLIEQDPGCYDRMGDIMRQISNIFVKAAE

SEQ ID NO: 255 - protein, 306 aa, Xenorhabdus nematophilus
VIEFNQVRKHYKDYQALKGISLDVYRGEFIGLLGPNGAGKTTLVEILEGLKKADSGSVRVLGKTWQHDAPYLRRRLSGVLQETLFINKLRVKEVLTLFGSFYGCSRHRVQEVMELVELSEKHRTYVEGLSGGQRQRLALGVAIMNEPEILILDEPTTGLDPRFPHDTWDILRKLNREKKSTMLLTTHYMEEAEYLCDRICIMNKGEIIAQGGMDELLKKYCNGDLIELTTRFPERLQELSLHNRVSSYEYDESKNRIRMIIDDSASFVTELFECAKKAGTDINELVIRKKTLDDLFMVLAGRRFHE

SEQ ID NO: 256 - protein, 199 aa, Xenorhabdus nematophilus
VLVTRQAPDFTASAVLGNGEIVNNFNLKKHLNGRPAVIFFWPMDFTFVCPSELIAFDHRYEEFQKRGFEVIGVSFDSEFVHNAWRKTPISEGGIGEVKYPMVADIKRDIMKAYGIEHSEAGVALRGSFLIDKNGVVRHQVVNDLPLGRNIDEMLRMVDALQFHEEHGEVCPAQWAKGQEGMGASPEGVAKYLTKNADKL

SEQ ID NO: 257 - protein, 491 aa, Xenorhabdus nematophilus
MAVTSTAQACDLVIFGAKGDLARRKLMPSLYQLEKAGYIHPDTRIIGVGRADWDKKAYIKLVEEALTTFMSEKLDPELWKKLSSRLEFCNLDVNETEHFSRLAKILNQDKLPAIHYFAMPPNTFGSVCHGLGVAGLNKEPNRVVMEKPLGTDLASSRAINDEVAKYFSENQIYRIDHYLGKETVLNLLALRFANSLFVNNWDHRTIDHVQITVAEEVGIEGRWGYFDQAGQMRDMIQNHLLQILTMIAMSPPSDLSADRIRDEKVKVLRSLRRIDHTNVREKTVRGQYTAGFVHGKKVPGYLEEEGANKASKTESFVSVRVDIDDWRWSGVPFYLRTGKRLPAKCSEVVVYFKEPALNLFAGSYQQLPQNKLTIRLQPDEGIDIEVLNKAPGLEHKHRLQTTKLDLSFSETFNQTHLADAYERLLLEAMRGIQALFVRRDEVEEAWKWVDSIMEAWAADNEPPKPYQAGTWGPVASIAMITRDGRSWNEFE

SEQ ID NO: 258 - protein, 480 aa, Xenorhabdus nematophilus
MSRRLRRTKIVTTLGPATDRDNNLEKVINAGANVVRLNFSHGTAEDHILRANKVREIAARLGCHVAILGDLQGPKIRISTFKEGKIFLNIGDKFLLDANLGKGEGDKEKVGIDYKGLPSDVTTGNILLLDDGRVQLKVLDVQGMKVFTEVTVGGPLSNNKGINKQGGGLSAEALTEKDKEDIITAAKIGVDYLAVSFPRSGEDLNYARRLARDAGCETQIVAKVERAEAVSSDEIIDEIILASDVVMVARGDLGVEIGDPELVGVQKKLIRRARQLNRVVITATQMMESMITNPMPTRAEVMDVANAVLDGTDAVMLSAETAAGQYPAETVAAMAQVCLGAEKMPGINASKHRMDITFDSIEEAISMSAMYAANHLKGVKAIIAMTESGRTARMMSRISSGLPIFSMSRHESTLNRAGLYRGVTPVYCSSHIDGIAAASEAISRLRDRGYLASGDLVLVTQGDQMGTIGSTNTCRVLEVE

SEQ ID NO: 259 - protein, 164 aa, Xenorhabdus nematophilus
MKQTLFIVGARGTGKTTIGNVLAEVLSYQFVDTDEDVQISCGMTIAELVEQRGWDYFRKLESETLKAVSQRNRVVSTGGGMVLAAENRQYMRQNGIVVYLQAPASVLVERLSLNPENSQRPSLTGKSITEEITGVLAEREPLYCECAHLIVDAALSIENIVLEI

SEQ ID NO: 260 - protein, 416 aa, Xenorhabdus nematophilus
MLEQMGKAAKAASWQLAQLSTSQKNQALSHIADLLEKEAQVILTANQQDMEQARKQGMNEALLDRLLLTPERLSAIANDVRQVCRLADPVGQVMDGQLLDSGLQLSRRRVPLGVIGVIYEARPNVTIDVASLCLKTGNAVILRGGKETHHTNQAMVKVIQQSLEQSGLPASAVQAINKPDRELVAEMLKMDRYIDMLIPRGGAGLHKLCREQSTIPVITGGIGVCHTFVDEHVNFEKALEVITNAKIQRPSACNALETLLVHEKIAADFLPELSARMKAQGVTLHAGASAMALLQDGPAKVVAVTEEDYCDEWLSLDMNVEIVSNIDKAIEHIRHYGTAHSDAILTECLQHADYFVHRVDSSAVYVNASTRFTDGGQFGLGAEVAVSTQKLHSRGPMGLDALTTYKWMGYGDYLSR

SEQ ID NO: 261 - protein, 397 aa, Xenorhabdus nematophilus
  unsure (1)..(397): unsure at all Xaa locations
SYPIEXITXMIINRGNIMMEEPIREASLAAVKTASDIAYQYVSEIRNQRVYPDSDALLGLQNFDRPLPQNGTDCQEVLAQLHKYGSPATVASTGGRYFGLVVGGSTPAAMGANIVTSAWDQIALMESSSPVAHQLEKIAGRWVLELLNLPSDAFVGFVSGTTMAHVSALGAARQYLFQKQGYDLAEQGLHNAPPLKVVLSEETHVSVLKALKLLGFGRSQFIFVPCDNQGRIIASAVPELSDNMILVLQAGNVNSGSSDPFQSLIPQAKKAGCWVHVDGAFGLWARASKEKSELAGGVEGADSWAVDAHKWLNTPYDCGMCIVRNKQALRDVMTTSAAYVETQEVWQAKDMLPEFSRKARAVEVWAAISELGVQGIEALIDRCCLYAEMLADGLKSL

SEQ ID NO: 262 - protein, 417 aa, Xenorhabdus nematophilus
MESKVVVPAEGKKITIDTKGKLNVPNNPVIPYIEGDGIGVDVTPVMLKVVDAAVQKAYSGERKISWMEIYTGEKSTQVYGKDVWLPEETLDLIREYRVAIKGPLTTPVGGGIRSLNVALRQQLDLYVCLRPVRYYQGTPSPVKHPELTDMVIFRENAEDIYAGIEWKAGSAEADKVIKFLQDEMGVSKIRFPQQCGIGVKPCSEEGTKRLVRSAIEYAIDNDRESVTLVHKGNIMKFTEGAFKDWGYELARTEFGGELLDGGPWVKIKNPKTGKDIIIKDVIADAFLQQILLRPAEYDVIACMNLNGDYISDALAAQVGGIGIAPGANIGDECALFEATHGTAPKYAGQDKVNPGSVILSAEMMLRHMGWFEAADLIVKGMEGSIAAKTVTYDFERLMEDAKLLKCSEFGDAIISHM

SEQ ID NO: 263 - protein, 850 aa, Xenorhabdus nematophilus
SPAKDVSTHTPMMQQYLRLKAQHPDILLLYRMGDFYELFYDDAKKAAKLLDISLTKRGQSAGQPIPMAGVPYHAIENYLAKLVQLGESAAICEQVGDPATSKGPVERKVVRIVTPGTVTDEALLQERQDNLLAAIWHDSQGFGYATLDITSGRFRVSEMADEDTIAAELQRTRPAELLYPEAFEHMGLIERYHGLRRRPMWEFELDTAKQQLNLQFGTRDLIGFGVEKAPQALRAAGCLLQYVKDTQRTALPHIRNITMESQQETVIMDAATRRNLELTQNLSGSTENTLASVLDQCVTPMGSRMLKRWLHTPIRNRDILENRQQAISALQEIGFELQPFLRQVGDLERVLARLALRSARPRDLTRMRHAFQQLPDIHQIMDSSDSPYIQALQQRIGRFDELQQLLENAVVETPPVLVRDGGVIAPGYNAELDEWRALADGASDYLDKLEIREREKLGIDTLKVGFNAVHGYYIQVSRGQSHLVPIHYVRRQTLKNAERYIIPELKEYEDKVLTSKGKALAIEKALYEELFDLLLPHLAALQTSAEALSELDVLANLAERAETLNYTCPTLTDRTGIQITGGRHPVVEQVLSEPFISNPLTLSSQRRLLIITGPNMGGKSTYMRQAALITLLAYIGSFVPAEKAVIGPVDRIFTRVGASDDLASGRSTFMVEMTETANILHNATEHSLVLMDEIGRGTSTYDGLSLAWACAENLANRIKAMTLFATHYFELTTLPEKLEGVVNIHLDAVEHGDTIAFMHNVQDGAASKSYGLAVASLAGVPRDVIKRARQKLKELESLSNNATAGHVDTPQLTLLAEETSPAVEALENLNPDSLTPRQALEWIYRLKDMV

SEQ ID NO: 264 - protein, 754 aa, Xenorhabdus nematophilus
MTVLNHTLGFPRIGLKRELKKAQESYWAGKISQQELLETGRELRARHWQQQKEAGVDLIPVGDFAWYDQVLTTTLLLGNVPPRHQNEDGSIDLDTLFRIARGRAPTGTPAAASEMTKWFNTNYHYIVPEFQEGQEFKLGWTQLLDEVDEALALGHNVKPVLLGPVTYLWLGKVKGKAFERLSLLADILPVYQQVLGELAKRGIEWVQIDEPALVLELPEEWLAAFQPAYQALQGQAYLLLTTYFDSISHNLATIKSLPVQGLHVDLVAGQDSLDELHKSLPETLLLSLGVVNGRNVWRADLSAKYELVVPLLGKRDIWVGSSCSLLHSPIDLNDETGLDEEVKSWFAFALQKCAELSLLSQALNAPQGSRQSELDDYSAPIRARRSSARVNNPAVAERLNKIRPQDSERNQVYEERARLQRQRYKLPLWPTTTIGSFPQTTEIRGLRLDFKKGRVDGNHYRTNISEHIKQAITEQERLGLDVLVHGEAERNDMVEYFGEHFDGYVFTQNGWVQSYGSRCVKPPVIIGDISRPEAITVDWATYAQSLTDKPVKGMLTGPVTILCWSFPREDISRETIAKQIALALHDEVDDLQKAGIGIIQIDEPALREGLPLRREEWQAYLDWAVDAFKLSAAIAEDETQIHTHMCYCEFNDIMPSIAALDADVITIETSRSDMELLDSFEDFSYPNEIGPGVYDIHSPNVPSVEWIEALLRKAAERIPVERLWVNPDCGLKTRGWAETRQSLANMVEAAKRLR

SEQ ID NO: 265 - protein, 216 aa, Xenorhabdus nematophilus
AVSQLNAELFGGSVTGLVGPDGAGKTTLIRMLAGLLKPNRGTIEIMGLDPIKDSVEVRSKLGYMPQKFGLYEDLTVQENLNLYADLRSVTGEERQSTFRKLLTFTDLTRFTGRLAGKLSGGMKQKLGLACTLVGSPKVLLLDEPGVGVDPIARRELWQMVHELASDGMLILWSTSYLDEAELCPDVLLLNQGELLYRGQPQKLTQGIAGRSFLLDI

SEQ ID NO: 266 - protein, 492 aa, Xenorhabdus nematophilus
MTHFGLQKLYIHGAYVDSTHPDKNIFDAVNPANGEIIAQLQSATEQDVQLAVESAQKGQKIWAAMTATERSRILLKAVDILRERNNELAELETLDTGKPLSETQQVDIVTGADVLEYYAGLIPALEGQQMPLRESSFVYTRREPLGIVAGIGAWNYPIQIALWKSAPALAAGNAMIFKPSEVTSLTALKLAEIYTEAGLPDGVFNVLTGMGHEAGHYLAVHPKIAKMSFTGGITTGKKVMANASGSTLKEVTMELGGKSPLIIFDDANLDRAADIAMMANYFSSGQVCTNGTRVFVPKTLLPDFENKIMERVKRIRVGSPLDLNTNFGPLVSFPHMESVLRYIESGKNAGARLLYGGQRLMDGELAKGAFVAPTVFTDCTDDMLIAREEIFGPVMSILAYETEDEIIVRANNTDYGLAAGVVTNDLSRAHRVIHQLEAGICWINTWGESPAVMPVGGYKHSGVGRENGLVTLQHYTQTKSVQVELGNFESLF

SEQ ID NO: 267 - protein, 525 aa, Xenorhabdus nematophilus
VLLLEAGGPDYRFDFRTQMPATLAYPLQGTRYNWAYETDPEPYMNNRRMECGRGKGLGGSSLINGMCYIRGNALDFDHWAKQPGLEDWSYLDCLPYFRKAESRDIGQNDYHGGDGPVSVTTPKADNNELFHAMVEAGIQAGYPATDDLNGYQQEGFGPMDRTVTPKGRRSSTARGYLDQARQRANLTIITHALTDTITFEGKTAVGVTFYQGNNSTLTQATAQKEVLLCAGAIASPQILQRSGVGPEEVLQESSIPAVHILPGVGQNLQDHLEMYLQYECLKPVSLYPSLKWYNQPMIGAEWLFKGTGVGASNQFEAGGFIRTSEKFDWPNIQFHFLPVAINYNGSNAVNEHGFQAHVGSMRSPSRGHVKIKSRDPRQHPSILFNYMSTEQDWQEFRDAIRITREIMAQPALAPYCGREISPGANIQTDDQLDAFIRERAETAFHPSCSCKMGLDEMAVVDGQGRVHGVENLRVIDASIMPEIITGNLNATTIMMAEKIADKIRGNAPLPRSQAKYYVANGAPAR

SEQ ID NO: 268 - protein, 398 aa, Xenorhabdus nematophilus
MLNQELELSLNIAFAKARDNRHEFMTVEHLLLALLSNTSAREALEACKVELAVLRQELENFITQTTPLLPENDDRDTQPTLSFQRVLQRAVFHVQSSGRSEVSGANVLVAIFSEQESQAAYLLRKHDVSRLDVVNFISHGTRKDELDNESHHNVNPVQEEQAIGEDRLENFTTNLNQSAQKGQIDPLVGRQHELERTIQVLCRRRKNNPLLVGESGVGKTAIAEGLAWRIVQKDVPAVMKDCTIYSLDIGSLLAGTKYRGDFEKRFKTLLKTLEQDSKSILFIDEIHTIIGAGAASGGQVDAANLIKPLLSSGRIRVIGSTTYQEFSNIFEKDRALARRFQKIDILEPSSEETVQIINGLRAKYEAHHDVRYTAKAIRAAVELSVKYITDRHLPDRAI

SEQ ID NO: 269 - protein, 268 aa, Xenorhabdus nematophilus
MKFISFNINGLRARPHQLAAIVEQHQPDVIGLQETKVHDEMFPLEEVSQLGYHIFYHGQKSHYGVALLTRQQPTAVRKGFPTDDDDAQRRIIMADIETPSGLLTVINGYFPQGESRNHEIKFPAKEKFYQDLQTYLETNQSPGSNILIMGDMNISPTDLDIGIGENNQKRWLKTGKCSFLPEEREWMERLKNWGLVDTFRAHHPEISDQFSWFDYRSKGFNDNRGLRIDLLLASQPLAEKCLSAGIDYDIRAMEKPSDHAPVWAEFKI

SEQ ID NO: 270 - protein, 640 aa, Xenorhabdus nematophilus
MRLFIAEKPSLARAIADILPKPHRRGDGFIECGDSQVVTWCVGHLLEQAEPDVYDRRYARWVLADLPIIPEKWQLKPREAVAKQLNTIKSLLARADEIVHAGDPDREGQLLVDEVLDFLQLEDNKKQNVQRCLINDLNPQAVLKAVERLRSNREFIPLCVSALARARADWLYGINMTRAYTLLGRNAGYQGVLSVGRVQTPVLGLVVRRDEEIEHFIPKDFFEVKAHIITPKEERFTAVWQPSESCIDFQDEEGRVIHRPLAEHVVMRIMGQPAYVAAYQDKRESETAPLPFSLSSLQIEAARRFGLSAQDVLDICQRLYETHKLITYPRSDCRYLPEEHFAGRQAVLNAISVHASHLLPQDALDTEKKNRCWDDKKVDAHHAIIPTARSSQVKLTENEQHIYGLVARQYLMQFFPDAIFRKCTIELDIAGGKFIAKARFLAEAGWRTLLGNKERDEENEGTPLPIVAKGDELLCEKGEVVERQTQPPRHFTDATLLSAMTGIARFVQDKALKKVLRATDGLGTEATRAGIIELLFKREFLYKKGRYIHATPAGCALIHVLPDMAVLPDMTAHWESKLTQISEKQFRYQDFMSPLHETLQQLIWQAKQYRNLKAFRDLPPAPVKGKKSKGKQAKTKQTNK

SEQ ID NO: 271 - protein, 376 aa, Xenorhabdus nematophilus
MSYTTFSQVKNDQLQEPMFFGQPVNVARYDQQKYPIFEKLIEKQLSFFWRPEEVDVSRDRIDYNALPDHEKHIFISNLKYQTLLDSIQGRSPNVAFLPLISIPELETWVETWSFSETIHSRSYTHIIRNIVNDPAVIFDDIVTNEQILKRAQDISKYYDDLIEMTNYYHQLGEGTYNVAGQEITVSLRALKKQLYLCLMSVNALEAIRFYVSFACSFAFAERELMEGNAKIIKLIARDEALHLTGTQHMLNLLRSGQDDPEMAEIAQECEQQCYDLFVQAAEQEKEWAEYLFKDGSMIGLNKDILSQYVEYITNIRMQAVGLKLPFEIRSNPIPWINSWLVSDNVQVAPQEVEVSSYLVGQIDSEVNTEDLSGFEL

SEQ ID NO: 272 - protein, 763 aa, Xenorhabdus nematophilus
MNQSLLVTKRDGHKEQIDLDKIHRVVAWAAEGLKNVSVSQVELRSQIQFYDGIKTSDIHETMIKAAADLISGDAPDYQYLAARLAIFNLRKKAYGQFEPPALYDHVVRMVDLGKYDKHLLEDYSKEEFEQMDSFISHLRDMDFSYAAVKQLEGKYLVQNRVTGEIYESAQFLYVLVAACLFSTYPKETRLDYIRRFYDAVSTFKISLPTPIMAGVRTPTRQFSSCVLIECGDSLDSINATSSAIVKYVSQRAGIGVNAGRIRALGSPIRGGEAFHTGCIPFYKHFQTAVKSCSQGGVRGGAATLFYPMWHLEVESLLVLKNNRGVEGNRVRHMDYGVQINKLMYERLIKGQDITLFSPSDVPGLYDAFFADQDEFERLYTQYENDSNIRKERIKAVELFSLMMQERASTGRIYIQNVDHCNTHSPFDPAIAPVRQSNLCLEIALPTKPLDNITDENGEIALCTLSAFNLGAIENLSELEELADLAVRALDSLLDYQDYPIVAAKQGSMGRRTLGIGVINFAYYLAKNGVRYSDGSANGLTHKTFEAIQYYLLKASNKLAKEQGACPWFGETTYSRGILPIDTYKKSLDTLTSEPLHMDWEALRSDILQYGLRNSTLSALMPSETSSQISNATNGIEPPRGYVSIKASKDGILRQVVPEYDRLKRSYELLWQMPSIDGYLQLVGIMQKFIDQSISANTNYDPARFPNGKVPMNQLLKDLLLAYKYGVKTLYYHNTRDGAEDAQDDLEEVVESADSDCEGGACKI

SEQ ID NO: 273 - protein, 449 aa, Xenorhabdus nematophilus
DNENQLKQGLSVRHIRFMALGSAIGTGLFYGSAAAIQQAGPAVLLAYLIGGAAVFMVMRALGEMAVHHPVSGSFSQYASHYLGPLAGFLTGWLYVLEMLFVCLADITAFGLYMKFWFPDVDQWIWVLSIVCFIGALNLCHVKIFGEMEFWLSIVKVTAIIAMIIGGLAIMIFGFGQTTEHATGIANLWEHGGFMPNGISGVVASMAIVMFAFGGIEVIGITASEAKDPAKTIPKAINAVPFRILIFYVLTLCILMCIYPWDQIGQNGSPFVQIFSDLKISAAAHVLNVVVITAAISAINSDIFGAGRMMYGMAQEGQAPEAFKKLTRNGVPWMTVLVMIVVLLLGVMLNWLLPGNIFILIASVATFATVWVWLMILLSHVAMRRKMSAEEIRTLKFPVPMWPIAPIITIAFMGAIILLLGYFEQTRDAIYIGAGWVIILTIAYFFSIKK

SEQ ID NO: 274 - protein, 121 aa, Xenorhabdus nematophilus
IMSTTIFKDFQFEAAHRLPHVPEGHKCGRLHGHSFMVRLEITGEIDPHSGWLMDFADVKAIFKPIWERLDHHYLNEIPGLENPTSEVLAQWIWRELQPALPQLSAVMVKETCSAGCIYRGE

SEQ ID NO: 275 - protein, 1407 aa, Xenorhabdus nematophilus
VKDLLKFLKAQTKTEEFDAIKIALASPDMIRSWSFGEVKKPETINYRTFKPERDGLFCARIFGPVKDYECLCGKYKRLKHRGVICEKCGVEVTQTKVRRERMGHIELASPTAHIWFLKSLPSRIGLLLDMPLRDIERVLYFESYVVVEGGMTSLERSQILTEEQYLDALEEFGDEFDAKMGAEAIQSLLKNLDLENECETLREELNETNSETKRKKLTKRIKLLEAFIQSGNKPEWMVLTVLPVLPPDLRPLVPLDGGRFATSDLNDLYRRVINRNNRLKRLLDLAAPDIIVRNEKRMLQEAVDALLDNGRRGRAITGSNKRPLKSLADMIKGKQGRFRQNLLGKRVDYSGRSVITVGPYLRLHQCGLPKKMALELFKPFIYGKLELRGLATTIKAAKKMVEREEAVVWDILDEVIREHPVLLNRAPTLHRLGIQAFEPVLIEGKAIQLHPLVCAAYNADFDGDQMAVHVPLTLEAQLEARALMMSTNNILSPASGEPIIVPSQDVVLGLYYMTRDCVNAKGEGMVLTGPKEAERVYRAGLASLHARVKVRITEEVRDGEGNVTVNTGLVDTTIGRAILWMIVPRGLPYSLINQPLGKKAISKMLNTCYRVLGLKPTVILADQTMYTGFAYAARSGVSVGIDDMVIPEKKEGIIAEAEAEVAEIQEQFQSGLVTAGERYNKVIDIWAAANERVAKAMMENLSSETVINSKGEEEQQVSFNNIFMMADSGARGSAAQIRQLAGMRGLMATPDGSIIETPITANFREGLNVLQYFISTHGARKGLADTALKTANSGYLTRRLVDVAQDLVVTEDDCGTHNGIMMTPVIEGGDVKEPLRERVLGRVTAEDVLKPGSADILVPRNTLLNEKWCDLLEENSVDSVKVRSVVSCETDFGVCANCYGRDLARGHIINKGEAVGVIAAQSIGEPGTQLTMRTFHIGGAASRAAAESSIQVRNKGQLKLTNAKFVTNSAGKLVITSRNTELRLIDDFGRTKESYKVPYGSVLSKGDGEKVAGGETVANWDPHTMPVVSEVSGIIQFSDMVDGQTITRQTDELTGLSSLVVLDSAERTGSGKDLRPALKIVDAQGNDVLIPGTDMPAQYFLPGKAIVQLEDGITISAGDTLARIPQESGGTKDITGGLPRVADLFEARRPKEPAILAEISGIVSFGKETKGKRRLVISPLDGSDAYEEMIPKWRQLNVFEGEVVERGDVISDGPESPHDILRLRGVHAVARYITNEVQEVYRLQGVKINDKHIEVIVRQMLRKVTIASAGSSEFLEGEQVEYARVKVANRKLDQDGKVPATFHRDLLGITKASLATESFISAASFQETTRVLTEAAVAGKRDELRGLKENVIVGRLIPAGTGYAYHQDRMRRRHENEVVEAPQVTVDEATANLAELLNAGFGSSSNE

SEQ ID NO: 276 - protein, 317 aa, Xenorhabdus nematophilus
MYTKILGTGSYLPSQVRTNADLEKMVDTTDEWIVTRTGIRERRIADEGETVATMGFRAAEQAIEMAGIDKTQIDLIVVATTTGTHAFPSSACQIQKLLGINGIPAFDVAAACAGFTYALSVVDQFIKTGAAKCALIIGSDTLSKTVNPEDRGTVILFGDAAGAMVVGASEEPGILSTHLHADGQYGELLSVPHHDRQKMDTPAYLTMVGNEVFKVAVRELANIVDETLEANGLAHSQLDWLVPHQANLRIISATARKLNMTMDKVVVTLDRHGNTSAASVPTAFDEAIRDGRIQRGQLVLLEAFGGGFTWGSALVRF

SEQ ID NO: 277 - protein, 274 aa, Xenorhabdus nematophilus
MAIVKCKPTSPGRRHVVKVVNPELHKGKPYAPLLEKNSKTGGRNNNGRITTRHIGGGHKQHYRLIDFKRNKDGIPAVVERLEYDPNRSANIALVLYKDGERRYILAPKGLKAGDQIQSGADSAIKAGNALPMRNIPVGSTVHNIEMKPGKGGQLARSAGAYAQIVARDGSYVTLRLRSGEMRKVLADCRATLGEVGNAEHMLRVLGKAGASRWRGIRPTVRGTAMNPVDHPHGGGEGRNFGKHPVTPWGIQTKGKKTRSNKRTDQYIVRRRSKK

SEQ ID NO: 278 - protein, 377 aa, Xenorhabdus nematophilus
LDEKRLLLRDKAERFAHEQLKTDISASDRNGTFFQKGWQKCADFGLLKMGIPEEYGGEGASLSDLLSIMEGLGYGCEDMGLLFSLNAHLWTVTMQLAIHGTPAQRSRFLPGLLNGTLIGANGSTEDEAGSDVFSMRTHAVRSGDCYILNGMKTYITNAPIADLYVIYATIDPTLGPLGITAFLVESSTPGIEVSQPLEKMGLRTAQMGRVIFKDCRIPADAILGREGRGIKIFESAMEYERGCILATVLGAMRRSLDGCITHARTRKQFGQPIGKNQAISHRIADMKVNLDAARELVYRVGRLKDAGKDATMEAACAKLFVSETYTQLSIDALRIYGAKGYLADSHAERELRNSIASVIYSGTSDIQRNIIANGLGL

SEQ ID NO: 279 - protein, 301 aa, Xenorhabdus nematophilus
  unsure (1)..(301): unsure at all Xaa locations
DAAMERYLDDPFFGSVERRIAATNEGSVELGVKAAHRVLGAAGVSPAEVDCLISVSMFPDRIGSGDAGYLAQLIGTGGGAFNIEATCGGSMTALLTACAWVQAGLKERVLVITTSRLSRAIEPDDVTLRLCGDASAAFLVGPVEAGSGLLGAESLHTGKTCGTWLLDAVEIPQENPPRAKNPLACRSFYLPRITRYGXEYLVQTTKGALAKAGLELNDIDFVVVNTPTAWHAEFSASVLGVELNRVVNTFPQVANIGPVLMPFNAYTAAAAGDIKPGDTVLLYGFGGQAEASAAILRWPDV

SEQ ID NO: 280 - protein, 589 aa, Xenorhabdus nematophilus
GIDLGTTHSLVATVRSGQAETLADSENRHLLPSVVQYCKDEIQIGWQARQQAAFDPVNTISSVKRMMGRSLADIQQRYPNLPYQFQASENGLPLINTAAGLVDPIQVSSDILKSLAQRAEETLDGKLDGVVITVPAYFDDAQRQGTKDAARLAGLHVLRLLNEPTAAAIAYGLDSGQEGVIAVYDLGGGTFDVSILRLSRGVFEVLATGGDTALGGDDFDHLLADWIREHAGITDTNHGLQRQLLDVATQTKIALSDADSVSINFADWQGNITRTEFNELITTLVKRTLLACRRALKDAGVTADEVLQVVMVGGSTRVPLVRSMVGEFFDREPLTSIDPDKVVAVGAAIQADILAGNKPDSEMLLLDVIPLSLGLETMGGLVEKVIPRNTTIPVARAQEFTTFKDGQSAMSIHVVQGERELVADCRSLARFTLRGIPPLPAGGAHIRVTFRVDADGLLSVSALEKSTGVEASIQVKPSYGLSDEEIARMIKDSMSNAQEDIQARKLAEQKVEAARVLESLTGALEKDADLLSQEEHAAIDAAVQVLIESAQGTSPEAIESAIKQLDKQTQEFAARRMDTSIRRALAGHS

SEQ ID NO: 281 - protein, 576 aa, Xenorhabdus nematophilus
INKTTKKNKTTKKVLIANRGEIAVRIIRACRDYGIQTIAVYADTDVNALHVQLADEAYSLAGNSPAETYLNIPRLLDIAKQAQATMVHPGYGFLSERAEFARAVIEAGLIWIGPESDTIDELGNKVKARQIAQKVGAPLVMGTAEPVKNAQEVITFAEKHGLPIAIKAAFGGGGRGLKVAWRHDEVEELYHSAVREATAAFGRGECFIEQFLDKPRHIEAQIIADKHGNVVVLGTRDCSLQRRNQKLVEEAPAPFLTQQQRERIHQSAKAICAEANYVGAGTVEFLLSVDGTLSFLEVNTRLQVEHPVTEETTGIDLVIEQLRIAEGYPLSIQETPISRGHSFEFRINAEDAGKGFLPASGALTEFIPPSGPGIRLDSGVINGSVIPTTFDSLMAKLIVTGATREQALVRARRALREFKISGVASVLPFHQAVIEHPDFVSEDTFNVHTRWIETEFANQLAALLRQDLAESKGIIRTFIEIDGRRHEMGLPADLLAGLTPLVPAGEPQSSSPVVQQIPEDPHQVKTPISGILHSWLVQEGEQVNEGDVIAIMEAMKMEVQINAHRSGKITFRAQEG

SEQ ID NO: 282 - protein, 455 aa, Xenorhabdus nematophilus
MNLLLIINVLVFTALLVILAKTSSDQWSLSKKVLIALVVGVFFGLVLNVIYGAHNPIVKESIKWFNIVGNGYVQLLQMVIMPLVFASILSAVARLHKASSLGKISLLTIGTLLFTTAISALISVVIANMFGLTAAGLVQGTQETARLSAIETNYINRVSDLSVPQLILSFIPKNPFADLTGANPTSIISVVIFATFLGIAALQMLKDDHERGERALIAIDTMQAWAMKLVRLVMRLTPYGVMALMTKVVASSNIHDIAQLGNFVVASYIAIGLMFVVHGILLAITGINPLKFLKKAGPALTFAFTSRSSAASIPLNVETQTRRIGVPESIASFSASFGATIGQNGCAGIYPAMLAAMIAPTVGIDPFDPLWIATLVGIVTISSAGVAGVGGGATFAALIVLPAMGLPVTLVALLISVEPLIDMGRTALNVNGAMTAGTITSQLMGKTDKKLFDQD

SEQ ID NO: 283 - protein, 274 aa, Xenorhabdus nematophilus
VDNATVTYNNGHTAIYDASFDITGGTICALVGMNGSGKSTLFKTIMGLVTPSQGKVTLNEQSIKTALKKNIIAYVPQTEDVDWNFPVLVSDVVMMGRYGKMGFLRRPSKLDHQIVNRSLERVGLIELRDRQIGELSGGQKKRAFLARALAQEGKVLLLDEPFTGVDVKTENAIIDLLRDLRDEGHLILVSTHNLGSVPEFCDHVILINRTVLASGPTETTFTQKNLETTFGGVLRHINLSGPELHDDDDPRSLTVITDDERAAVFYGHDNHVPP

SEQ ID NO: 284 - protein, 925 aa, Xenorhabdus nematophilus
MTEVTVKLLAEEIQTSVERLIQQFTDAGIQKTATDSVSQKEKEALLAHLNREQGGTGGQPGKLTLQRKTRSTLNVPSTGGKSKSVAIEVRKKRTYVNRDAIEQAKAEEQAQREAEEQARREAEEKARLETEAKKLAEEQAQREAEEQAKREAEKQAKREAEEKAKREEAEKAQREAAEKEKVTTKQHTETKSKSVQTEAAAQNEKARREAEAANLKRKAEEEMRRKVEAEAKRVAEEARRMAEENKDKWSNDADVNDNSNSDYHVTTSRHARDAEDENDAKVEGDRRTRSRGGKNTRQKKNNKHSESKADREEARAVGRTKGKQRKPSALQQSFNKPVVAVNRDVVIGETITVAELANKMAVKGSQVIKTMMKMGAMATINQVIDQETAQLVAEEMGHKVILRRENELEEALMSDRDTGETQAEPRAPVVTIMGHVDHGKTSLLDYIRSTKVASGEAGGITQHIGAYHVKTEKGMITFLDTPGHAAFTSMRARGAKATDIVVLVVAADDGVMPQTIEAIQHAKAANVPVVVAVNKIDKPEADPDRVKNELSQYGIIPEEWGGETQFMHVSAKAGLGIDELLEAILLQAEVLELNAVHSGMANGVVIESFLDKGRGPVATILVQSGTLNKGDIVLCGFEYGRIRAMRNELGQEVMTAGPSIPVEILGLSNVPSAGDEATVVRDEKKAREVALYRQGKFREVKLARQQKSKLENMFANMEEGKVSELNIVLKTDVQGTCEAICDSLLKLSTDEVKVKIIGSGVGGITETDATLAAASNAIILGFNVRADASARRIIENESVDLRYYSVIYSLIDEIKQAMSGMLAPEYKQQIMGLAEVRDVFKSPKFGAIAGCMVTEGNIKRNNPIRVLRDNVVIYEGELESLRRFKDDVNEVRNGMECGIGVKNYNDVRVGDMIEVFEVVEVKRSI

SEQ ID NO: 285 - protein, 532 aa, Xenorhabdus nematophilus
IVIGTALLAGCATKPANESSNIVDVRVLGLNDFHGALKAPKNQSGGIEHMATLIKELKQDNPNNIVVAAGDLIGASPLLSSMFHDEPSIEALTLAGLEATSVGNHEFDKGKTELLRKQNGGCHPVTGCQGPAPFKGAGFQYLSANVTVNETGKTLFPEYVIKEFEGIPVAFIGLTLEGTPAIVTPQGTAGLSFSNEVKTINALVPELQKKGVKAIGVLIHEGAMQRRDAGGVDVNACNGITGKIIDIVNQLDQEVDFVISGHTHQAYNCVINGKSVTSAQANGALLTKLDLKLDKTTRDVVDFKAKNIWVDNYKYGKDPKVTELLSSYEKIATPLANRVIGKLESDLNKKPTSGGESALGKVIADAHLYATTAKESGGAVIAFVNNGGIRAPMDAGDVTYNAIYTVQPFSNVMVTKTLTGEQIKRALEQQWDRTRPSVMAVSHTLEYSWDSSKPAGQRVIASSMKINGKPVDMKAKYRVAANEYLATGGSNFSVFKEGTDPVYSVPDVDAVVKYFAEKSPIAYPKKDRITDI

SEQ ID NO: 286 - protein, 210 aa, Xenorhabdus nematophilus
MNSKFIVIEGLEGAGKTTAIQTVSDTLKQSGISDLVFTREPGGTPLAEKLRQMIKQGIEGEILTDKAEVLMLYAARVQLVENVIKPALAKGCWVVGDRHDMSSQAYQGGGRNIDQHLLASLREAALGDFSPDLTIYLDLPPEVGLQRARERGELDRIEKESLDFFHRTRTRYLELVAQDKSIIKIDATQPLEKVQDDIRQALQYWLEKQE

SEQ ID NO: 287 - protein, 396 aa, Xenorhabdus nematophilus
VFQNVDAYAGDPILSLSEEFKKDPRPEKVNLSIGLYYDEQGITPQLQAVATAEEQISTLPQSASLYLPMEGLMAYRQVVQELLFGKDHLMLQQNRIATIQTVGGSGALKVGADFLHRYFPDSEVWCSDPTWENHASIFSGAGIKVNYYPYFDDKTKGVKFDEMLATFRQLPAKSIILMHPCCHNPTGSDLTNDQWDQVIQVVKEQKLIPFLDIAYQGFAEGIEEDVYAIRAMASAELPCFVSNSFSKIFSLYGERVGGLSVICDDKETKECVLGQLKACVRRIYSSPPNFGGQVVARVLADPLLREQWLREVEQMRLRIREMRTVLVSALKEALPEKNFDHLLKQRGMFSYTGFSTEQVVRLREEFAVYLIESGRVCMAGVNHHNVQRVVEAFVAV

SEQ ID NO: 288 - protein, 79 aa, Xenorhabdus nematophilus
MPQKKNSDELRAELQSLADTLEEVLNSSGEQSKAELEKIRNKAEKMLKDARTVISDAGDKLTGQTKEIAGRADNYVRDN

SEQ ID NO: 289 - protein, 380 aa, Xenorhabdus nematophilus
IYISAVGMLNALGNNVDDIAQNLVSGHAPGMYARSGWLQPDKTCCLGGVDAELPAIPPHLHQHNSRNNQLLLAALMQIKPQVDKAIAQYGRERVAVIMGTSTSGLNEGDTHVNRTVNQQPDESYHYYQQELGDPSRFIANYLELTGPAFTISTACSSSSRAIISGQRLIEMGMVDVAIVGGADTLSRMPINGFNSLEALSETLCEPFCQDRQGITIGEASTLLLLTREPHSVALLGTGESSDAWHMSAPHPEGKGATEAINMALSNAGLSTQEIGYINLHGTGTKLNDQMESLIINQLFGESTPCSSTKHLTGHTLGAAGACEAGLCWLLLSRKLPLPAQDFSRSGIDTSLASCGLLAQSVLLEKPVIMSNSFAFGGNNT

SEQ ID NO: 290 - protein, 239 aa, Xenorhabdus nematophilus
SVLVTGASKGIGRAIACQLAADGFTTIVHYHRDAKGAEATLEQIQANGGNGRILSFDISDRDACRTTLEKDIEVHGAYYGIVCNAGIAKDGAFPALDGSDWDSVIHTNLDGFYNVIHPCMMPMIGLRQGGRIITLSSVSGLMGNRGQVNYSAAKAGIIGATKALAIELAKRKITVNCIAPGLIDTDMIQIEEIALKEAMNMIPMKRMGQANEVAGLASYLMSDIAGYVTRQVISVNGGM

SEQ ID NO: 291 - protein, 407 aa, Xenorhabdus nematophilus
RRVVITGMGGITALGHDWQSVSSGLKSGVNAVQQMPEWAEYDGLNTHLGAPVTDFTLPDHYTRKRIRSMGRVSLMSTRATELALEMAGLIGYPILTNGETGIAYGSSTGSTKPVSEFATMLTEKHTNNITGTTYVQMMPHTTAVNTGLFFGLRGRVIPTSSACTSGSQAIGYAWEAIRNGYQTVMVAGGAEELCPSEAAVFDTLFATSQKNSEPKTTPSPFDANRDGLVIGEGAGTLILEELEHARARGAKIYGEIIGFATNCDASHITQPKSETMQICMEMALKSAGLQPADIGYISAHGTATERGDVAESQATFNIFGNRTPISSLKSYFGHTLGACGALEAWLSIEMMNEGWFAPTINLNEVDPACGELDYIMHQPRTIQTEFIQSNNFAFGGINTSLVIKRWQ

SEQ ID NO: 292 - protein, 270 aa, Xenorhabdus nematophilus
  unsure (1)..(270): unsure at all Xaa locations
MDKFAVFGNPIAHSKSPYIHQLFAKQTGIEHQYGRILAPLEHFEQTLKQFFEQGGLGANITVPFKERAYEYAHQLSERAKHCGAVNTFKLIENNQLLGDNTDGVGLLADXQRLNFISKGQHILIIGAGGAAKGVISPLLDFGCTVTITNRTFARAQGIVNIFSSFGHIQAVEMKSLLTPYFDLIINATASGLDGSVPEISPSIFRNGGACYDMYYQKGLTPFLSFAKESGASFLADGLGMLVGQAAHAFELWHGVLPKVEPVLAALREEL

SEQ ID NO: 293 - protein, 267 aa, Xenorhabdus nematophilus
MSVPAFGLGTFRLKDDVVIASVKNALELGYRAIDTAQIYENEAAVGQAIEESGIAREDIYITTKIWTENLSKEKVISSLKESLVKLRTNYVDLALIHWPSPNNVVSVAETMNALLEAKEMGLTREIGVSNFTIDLMQQAIDAVGAEHIATNQIELSPYLQNRDVTAWAQEHGIHITSYMTLAYGKAIHDEVIGRIAEKHQSTPAQVILSWAMSLGYSVIPSSTKKENLASNLKSTALKLDADDMAAIATLECNERIVNPEGLAPQWD

SEQ ID NO: 294 - protein, 604 aa, Xenorhabdus nematophilus
  unsure (1)..(604): unsure at all Xaa locations
LLNIDQLSVHFGDEDAPFRAVDRISYSVEQGQVVGIVGESGSGKSVSSLAIMGLIDYPGKVMAGKLEFDGCDLTKISEKERRQLIGAEVSMIFQDPMTSLNPCYTVGYQIMEALKVHQGGSRKTRYQRAIDLLTLVGIPDPASRLEVYPHQLSGGMSQRVMIAMAIACRPKLLIADEPTTALDVTIQAQIIELLLELQQQENMALILITHDLALVAEAAQHIIVMYAGQVVEAGRATEIFKAPRHPYTQALLRALPEFAVDKARLASLPGVVPGKYDRPVGCLLNPRCPYATERCYQVEPALQLVGERQVKCHMPLDDKGRPTIXVFKKRLCTNRLFTTRSGQEKASVPLLKATELKKYYPVKTGVFSPERMVKALDGVSFELEKGKTLAVVGESGCGKSTLGRLLTMIEKPTEGELYYLGQDLLLPDKEAEKLRRQKIQIVFQNPYASLNPRKKVGQILEEPLLINTTLTSEERREKVLQMMEKVGLKSEHYQRYPHMFSGGQRQRIAIARGLMLNPDVVIADEPVSALDVSVRAQVLNLMMDLQQELGLSYVFISHDLSVVEHIADEVMVMYLGRCVEKGDKHTIFNNPSHPYTQALLSATP

SEQ ID NO: 295 - protein, 447 aa, Xenorhabdus nematophilus
MNVPSSLVSFLESVQYHNPHQPEYLQAVREVLTSLWPFLERNPQYREQGLLERLVEPERVIQFRVSWVDDQGKVQVNRAWRVQFNSAIGPFKGGMRFHPSVNLSILKFLGFEQTLKNALTTLPMGGGKGGSDFDPKGKSQGEIMRFCQALMTELYRHLGPDTDVPAGDIGVGGREVAFMAGMMKKLSNNTACVFTGKELSFGGSLIRPEATGYGLVYFIHAMLKRHGMALDGMRVSVSGAGNVAQYTIEKCLELGAKVVTVSDSGGTVLDEEGFTPEKLAHLEEIKNKRYGRVEDYAKERGLTFLEGQNPWSVPVDIALPCATQNELHLEDAKILIQNGVKLVAEGANMPATIAATDAFLEAGVLFAPGKAANAGGVATSGLEMSQNAIRQNWKAEKVDIRLHHIMLDIHQSCVEYGGEGKQINYVQGANIAGFVKVADAMLAQGIL

SEQ ID NO: 296 - protein, 254 aa, Xenorhabdus nematophilus
SRLKAQSLSLAYGKKTIIEDINLAIHDNEFSVIIGPNGCGKSTLLRAISRSMQPQHGEIQLDGINIHRYKPKAVARELSLLTQGAIVTEALTIYDLVSRGRYAYQTFLRQWSEADERIVREALQAVDLWDMSEKFVSELSGGQHQRAWFAMTLAQQTPIILLDEPTTYLDISHQIEMLDLCQRLHQQGKTLVLVLHDINLSLRYATRLIMMKSGHIYAEGKPEEIITEQSIADVFGLACRIIRDPESDKPLIIP

SEQ ID NO: 297 - protein, 354 aa, Xenorhabdus nematophilus
MQKDALNNIHILDEQVLITPEELKLKYPLSSSDLNAITNARNTIADIIHHDDPRLLVVCGPCSIHDVDAALDYAQRLKSLSAELSDCLYIVMRVYFEKPRTTVGWKGLISDPYMDGSFDMDGGLHIARRLLLNLVEMGLPLANEALDPNNPQYLGDLFSWSAIGARTTESQTHREIASGLSVSVGFKNGTDGNLNTAINAMKAASMPHRFMGINQSGQVCLLQTRGNPNGHIILRGGAEPNYSAEHVRDCENQMVKAGLVPSLMIDCSHGNSNKDFRRQSVVVDSVAEQIMQGNQSIIGIMLESHINEGNQSSELTRSEMQYGVSVTDACISWETTEQVLKKLHQQIKPHLSKR

SEQ ID NO: 298 - protein, 584 aa, Xenorhabdus nematophilus
MRLDRLTNKFQLALADAQSLALGRDNQFIEPIHLMSAFLSQEGGSVRPLLMSAGIDTGNLHDRLNLALDRLPKVEGSGGDVQVSNELGRYLNLCDKLAQKAGDNFISSELFVLAALEERGTLSDILKAAGATKDKITKAIEMMRGGEKVNDQSAEDQRQALKKYTIDLTERAEQGKLDPVIGRDEEIRRTIQVLQRRTKNNPVLIGEPGVGKTAIVEGLAQRIVNGEVPEGLKNKRVLSLDMGALLAGAKYRGEFEERLKGVLNDLSKQEGSVILFIDELHTMVGAGKADGAMDAGNMLKPALARGELHCVGATTLDEYRQYIEKDAALERRFQKVYVAEPTVEDTIAILRGLKERYELHHHVQITDPAIVAAATLSHRYISDRMLPDKAIDLIDEAGASLRMQMDSKPEALDRLERRIIQLKLEQQALKKESDEASKKRLDMLNEELVEKEREYSELEEEWKAEKAELTGTQNIKAELENARIELEKARRSGDLARMSEIQYGKIPELEKQLAAATTAENHPMKLLRNKVTDAEIAEILARWTGIPVSRMLESEKDKLLRMEHELHKRVIGQNEAVDAVANAI

SEQ ID NO: 299 - protein, 173 aa, Xenorhabdus nematophilus
MSDTQRPNHVFILMGVSGSGKSAVANGVARELSAAFLDGDFLHPRANIQKMAEGHALNDDDRQPWLKALNDAIFAMQRTNSVSLLVCSALKKHYRDILRSGNKNLSFLYMQGNLELIESRLKARKGHFFKPQMLISQFETLEEPTIDEKDVHFIDIKPSLDEVIKNTMTTIER

SEQ ID NO: 300 - protein, 343 aa, Xenorhabdus nematophilus
MKALVYHGAGKKLWEEKAPPQLIEPTDAIVRIVKTTICGTDLHILKGDVPTVEQGRTLGHEGIGIVELIGDSVRNLKVGDKVIISCITVCGSCPYCKRQLYAHCKDGGWILGHKIDGTQAEKVRIPHADNSLHRLPEDVDEEAALMLSDILPTGLEIGVINGRVQPGHTIALIGAGPVGLSALLASQFYSPAHIIMIDTDDNRLSVAQQFGANTIINPTRQNVVETIHKLTDGIGVDVAIECVGIPATFQICQDIIAAGGFIANVGVHGKSVDLHLENLWIKNITITTGLVNTSSTPMLLKSVQSGKISPEKLVTHHYSLSEIETAYDIFGNAAKEKALKIVL

SEQ ID NO: 301 - protein, 432 aa, Xenorhabdus nematophilus
MGKNVVVLGTQWGDEGKGKIVDLLTERAKYVVRYQGGHNAGHTLVINGEKTVLHLIPSGILRENVISIIANGVVLAPDALMKEMKQLESRGIPVRERLLISEACPLILPYHVALDNAREKARGAKAIGTTGRGIGPAYEDKVARRGLRVGDLFDKETFAAKLKEIIDYHNFQLVNYYNEPAVDFQKTLDDILAIADILTGMVVDVSDLLYKATQKGELVMFEGAQGTLLDIDHGTYPYVTSSNTTAGGVATGSGLGPRYVDYVLGIVKAYSTRVGAGPFPTELFDETGEYLRQKGQEFGATTGRSRRTGWLDIVAIRRAIQINSLSGFCMTKLDVLDGLKEVKICVGYRQADGTVIDTTPLAAENWEGLEAVYETLPGWDESTFGVKEHSQLPEAALNYIKRVEELSGVPVDIISTGPDRSETMILRDPFDA

SEQ ID NO: 302 - protein, 350 aa, Xenorhabdus nematophilus
MNYQNDDVKIRKITELLPPVALLEKFPATKDTATTVREAREAIHNILTGADDRLLVIIGPCSIHDPKAALEYAERLNKLRRELKADLEIVMRVYFEKPRTTIGWKGLINDPKMDCSFDINDGLRTARKLLLDINDIGLPAAGEFLDMITPQYLADLMSWGAIGARTTESQVHRELASGLSCPVGFKNGTDGTIKVAIDAINAAGSSHCFLSVTKWGHSAIVNTTGNQDCHIILRGGKEPNYSAEHVSAVKEGLLKAGLKPQVMIDFSHANSAKQFKRQMDVGADVCGQISAGENAIIGVMVESHLVEGNQSLDDDEPLVYGKSVTDACIGWDDTETLLQQLSQAVRTRRG

SEQ ID NO: 303 - protein, 250 aa, Xenorhabdus nematophilus
MAVTKLVLVRHGESEWNKENRFTGWTDVELSDKGRNEAQQAGQLLKQEGFAFDFAYTSVLKRAIHTLWNILDQVDQQWLPVEKSWKLNERHYGALQGLDKAETAAKYGDDQVKLWRRGFAIIPPDLTKDDERYPGHDPRYANLKPEELPVTESLATTIERVVPYWEEVIKPRVANGEKVIIAAHGNSLRALVKYLDNMDEDEILELNIPTAVPLVYEFDENMKPIKHYYLGNADEIAAKAAAVANQGKAK

SEQ ID NO: 304 - protein, 398 aa, Xenorhabdus nematophilus
QKDITKKRLLTIAGLGWMFDALDVGLLSFLLAALKQDWGLSSEQLGWIGSINSIGMAVGAFVFGVMADKTGRKSAFIVTLLLFSVGSGLTALVTTLAALLVLRFIIGMGLGGELPVASTLVSESVEPHERGRLVVILESFWAFGWLAAALIAYFVIPSYGWRVAMLLSALPAFYAIYLRLHLPDSPRYTQMRSRKPLNSIMHNIREVWSADYRRATVMLWILWFCVVFSYYGMFLWLPSVMMLKGFSLIKSFQYVLIMTLAQLPGYFTAAWMIERYGRKFVLASYLIGTAVSAYFFGTADSITQLLIFGILLSFFNLGAWGAIYAYTPEQYPTAIRATGAGMAASVGRIGGIIGPLMVGYLVAMNSSISLIFSLFGFSILVAVGAVIWLGKETRQIEL

SEQ ID NO: 305 - protein, 308 aa, Xenorhabdus nematophilus
  unsure (1)..(308): unsure at all Xaa locations
MIHIILAPTNLGLSPLWEGHIPGTWRAPQVLMEHGLAQKLRANTISKLMSPIYSLEAQIGTRIRNGYGIRAFNLQLAEEVAKVQESGNFPLVIGGDCSILLGALAGSRRTGPISLIHIDGHSDYRHPDNYDTNQMLGAVAGMDLALATGRGEALLTDWPDIESPLVPEQQVLQLGERENRDADFAWPDINQTAISQIDVFTANSIGEKGILNKIEQMLGAQPTWRFWVHLDVDVLDQSIMPAVDSPGSPGIELNWLKNIGAQLINNPLCCGMTVSVFDPDLDPDGYYAELIIEILEEMFLRCTSPSLX

SEQ ID NO: 306 - protein, 464 aa, Xenorhabdus nematophilus
MAATRIEKDSMGPIEVPADQLWGAQTQRSLEHFRISQEKMPVALIHALALTKQAAASVNMDLGLLPKERGDAIIAAAKEVLKDKHPTEFPLAIWQTGSGTQSNMNMNEVLANRGSEILGGQRGNERLIHPNDDVNKSQSSNDVFPTAMHVAAVIALREHLLPELEVLQKTLADKAEAFRDIVKIGRTHLQDATPLTLGQEISGWAAMLAHNLKHIENSIPHVCELALGGTAVGTGLNTHPEYAVRVAKKIAKLSGQPFIISPNKFEALGTCDALVHSHGALKGLVSSLMKIANDVRWLASGPRCGIGEISIPENEPGSSIMPGKVNPTQCEAMTMLCAQVMGNDVAVNIGGASGNFELNVFRPMVIHNFLQSVRLLADGMRSFNEHCAIGIEPNRDRITQLLNESLMLVTALNTHIGYDKAAEIAKKAHKEGLTLKQSAMQLGYLTEAEFDAWVRPEDMVGSMK

SEQ ID NO: 307 - protein, 417 aa, Xenorhabdus nematophilus
ISVVGLQFGDEGKGKFVDYLSGGVNNIARFNGGANAGHCVQYGNVRGSFSQLPASLNKKNLYICQGALISLPVLVKEIDFIKRENINSSISIDPRCHIVLPLHAELNKASEKYKGKNKIGSVGVGVGACVEDKSNRHGIRLIDTLDKEKLRSKLEFLWDIREKQINHVFNDNSTLDFEEMLEITHQYGKKIEPYFTFTNEAIRDLLSAGEDILLETSQATFLDNSFGTYPYTVAYQTLVQTCFAMIGIPAQKMHIVGVMKAYMIRVGNGPFPTELQAEQADYIRERGNEYGTVSKRPRRCGWLDLCLIKHAVKLNGVTELAITNTDVLAGLEEIKVAIAYEIDNEQVCCDKALLQLEKVKPVYKVFKGWGELNASYAHFTELPAELIDFLNFIQDYAGVPIKYISHGPDREQTLIVQ

SEQ ID NO: 308 - protein, 680 aa, Xenorhabdus nematophilus
MTNPLLDFSGLPKFASIKAEHVVPAVKEILAKYRQVIEKVVNENSQFTWDNLCQPISEARNQFERVWSPVSHLNSVKNTPEFRVAYEQCLPMNSEFSTWMGQHKGLYQAYKSLKESPEFEKLSQPQRKAVEDKLLDFTLSGIALPEEKQKRYGEITARLSELSARFGNNVLDATMGWTKLVTDVCDLSGLPENIKSSAKAAAKAKDLKGWLLTLDPPVYSAVMSYADDCELREEVYTAYMTRASDQGMNACKWDNNPIMEEILALRHELALLLGFKNYAENSLATKMAKTTKEVLDFLNGLVDRAHGQGEREMEELCEFAQSHYCVDELESWDVRYYSEKQKQHDFSFDEEQLRAYFPEKRAIEGLFEVVRRIYGITAKERNDVDTWNSDVRFFELYNDKEELLGSFYMDLYARAGKNGGAWQSSYVDRMRLASGELQKPVAFINCNFSGPAGGKPALFTHSEVSTLFHEFGHGLQTLLTTIETLDVAGTNGVPWDTVECPSQIMENWCWEAEALEFISGHYETNAPLPKEMLDNMLEAKNYQAAMKMLRQLEFGLFDFRLHVEYDPEEGAQILPILESVKEHVSVVPSSDWERFPNSFSHIFNGGYAAGYYSYMWADVLAADAYSRFSEEGIFNRTTGQSFLDDYLGRGGSEDPLTLFIRFRGREPKLDALLKRLGITG

SEQ ID NO: 309 - protein, 680 aa, Xenorhabdus nematophilus
MTNPLLTSSVLPKFADIKPEHVVPAVKETLANYRQVIEKILTENSAFTWDSLCQPLSEEQDKLSRMWSPVGHLNSVKNSPELREAYEQSLPLLSEFSTWLGQHKGLYQAYKSLKESEVFNSLSQPQRKSIEDTLRDFELSGIGLPEEKQKRYGEIAARMSELGSQFGNNVLDATMGWSKLITDENDLAGLPESAKAAAKAAAEAKEQEGWLLTLNMPSYLPVMAYADNRELRQEMYHAYTTRASDQGPDAGKWDNNAIMAEMLALRHELAQLLGFASYAEKSLATKMAKNPQQVLDFLNDLANRAHGQGKKELEELTDFARSHYGVDKLEAWDVTYYSEKQKQHHFSIDDEQLRPYFPEQRAVEGLFEVVRRIYGITAKERNDVETWHSDVRFFELYDEKGELRGSFYLDLYAREHKRGGAWMDDCAGRMRFASGELQKPVAYLTCNFNKPVGDKPALFTHDEVITLFHEFGHGLHHMLTEIETLDVAGINGVPWDAVEQPSQFMENWCWEPEALAFISGHYETNEPLPQEMLDNMLAAKNYQSAMFILRQLEFGLFDFRLHAEYDPAKGAQILPTLYSVKEQVSVVPSPEWNRFPNSFSHIFNGGYAAGYYSYLWADVLAADSYSRFSEEGIFNRTTGQSFLDNILSRGGSEDPMTLFIRFRGREPKLDAMLKSAGITG

SEQ ID NO: 310 - protein, 142 aa, Xenorhabdus nematophilus
MTIERTFSIIKPNAVKKDVIGSIYARFESAGFKIIAAKMLHLTREQAEGFYAEHKGRPFFDGLVEFMTSGPIMVQVLEGENAVQRHRDLMGATNPDNALAGTLRADYADSFTENAVHGSDSIESANREIAYFFSDDEVFSRS

SEQ ID NO: 311 - protein, 585 aa, Xenorhabdus nematophilus
LQQQVSKYPEKIAFRQWSASEQLEMSWQDVDSKTKSIARSLLSLEVGIQEKIGIFADNSMAWSLSDLAILQLRAVTVPLYATSSRDQAAFILNDAGVRILFVGGQEQYDIALILLALCPQLNHLVVLDESVDLKECPQALYLSAFIADDRPLYQAELDSRIAGLDLHDLFTLIYTSGTTGEPKGVMLDYQNIAAQLYLHDQRLTLTEQDISLSFLPLSHIFERAWSYYVMHTGALNVYLTDTNFVREAMLDVRPTVMCSVPRLYEKIHSAILEKVSRAPFWRRIIFQWAIKRGERRWSRQLNDKKSCPFSLCGEKLADRLVLNKLRQLLGGRIRFLPVAGARLEDSIMRFFLSVGLNIKYGYGMTETCATVSCWEEKNYLLGSIGTPLPGVDVRISTAGEIQVRGPIVMKGYYNRPEDTVHAFTEDGWLRTGDAGGLDETGNLFITERLKDLMKTSTGKYIAPQLIEGTLGQDRFIEHIAVIADARQFVSALIVPSYEALEDYAKSINLHYQNRLELLRNHQVIGLFEQRLKELQKNIAKFHQVKRFTLLPESFSMEKGELTPTLKLRRKVISQRYQSEIESMYR

SEQ ID NO: 312 - protein, 819 aa, Xenorhabdus nematophilus
MRVLKFGGTSVANYQRVLSVADIAESELPLGQVALVLSAPAKITNHLVAMVAKTVAGQDIVSNISDTIQIFTDLLSGLKEHQPNFDYENLKTLMEREFAHLKQTLHGISLLKQCPDSINASLICCGEKLSIAIMAAVLQARGHKVSVIDPVQNLLAHGHYLESTVDIHESSKRIAALNIPSDHIILMAGFTAGNDNSELVVLGRNGSDYSAAVLAACLRADCCEIWTDVDGVYTCDPRSVADARLLKSLSYQEAMELSYFGAKVLHPRTIAPIAQFQIPCLIKNTVNPDAPGTFIGNGQKDDSMLIKGITNLNHMAMINVSGPGMKGMVGMAARVFAVMSRSGISVVLITQSSSEYSISFCVPQKELNRAQKALTEEFYLELKDGALDPIDVIDNLAIISVVGDGMRTQRGISARFFSALTRANINIIALAQGSSERSISAVIDNDNATTAVRLCHQMLFNTAQVVEVFVVGVGGVGNALIEQIRRQQSWLKQKHIDLRVCGIANSRAMLTDMQGISLDNWQQALSEASEPFSLSRLIRLEKEYHLLNPVIVDCTSNQSIAEQYSSFLSDGFNVVTPNKKANTLSMAYYREIRRAAENSKRKFLYDTNVGAGLPVIENLQNLLNAGDELVQFNGILSGSLSYIFGMLDEGMTLSQATLLAKEKGFTEPDPRDDLSGMDVARKLLILARESGYELELEDIHVEPVLPASFDSNGDVTDFLQRLPQLDQEFIRRVADAAEQGKVLRYVGIIEQGRCMVKIAAVDGNDPLYKVKNGENALAFYTRYYQPIPLVLRGYGAGNDVTAAGVFADILRTLSWKLGV

SEQ ID NO: 313 - protein, 317 aa, Xenorhabdus nematophilus
MTDKLTSLRKLTTVVADTGDIAAMKLYQPQDATTNPSLILNAAQIPKYRQLIDDAIEWARAQSDSREQQIIDAGDKLAVNIGLEILKLIPGRISTEVDARLSYDTEASVAKAKRLIKLYNEAGISNDRILIKLASTWQGIRAAEQLEKEGINCNLTLLFSFAQARACAEAGVFLISPFVGRILDWYKANSDKKEFAPNEDPGVISVSEIYQYYKEHGYNTVVMGASFRNSGEILELAGCDRLTISPALLKELSETAGEVEHKLSYEGEIKPRPAAMTEAEFYWEHHQDAMATEKLAEGIRKFAIDQGKLESMIADLL

SEQ ID NO: 314 - protein, 463 aa, Xenorhabdus nematophilus
MKQFPTHFLWGGAIAANQVEGAYLADGKGLSTSDVQPQGIMGPVIERESESTQYLKDIAIDFYHRYPGDIALFAEMGFTCLRTSIAWSRIFPQGDEMQANEAGLAFYDRLFDEMAKYGIQPVITLSHYEMPWALVKKHGGWGNRKLIDFFERYARTVFTRYQKKVKLWLTFNEINMSLHEPLTGVGLPKNSTQSEIYQAIHHQLVASARAVKLCHEIIPDARIGNMLLGGLMYPLTCKPDDVLATLRQNQKWLFFGDVQVRGAYPGYMLRYFREHGIEVTITEQDKLEMQNTVDFISFSYYMSGCTSGNEADYQKKQGNILNMIPNPHLASSEWGWQIDPVGLRTLLNLLWDRYQKPLFIVENGLGAKDTVEADGTIQDDYRISYLNDHLVQVREAIEDGVDVMGYTSWGAIDLVSASKGEISKRYGYIYVDQNEQGTGTLERRRKKSFYWYKQVIETGGGSL

SEQ ID NO: 315 - protein, 337 aa, Xenorhabdus nematophilus
MKNVGFIGWRGMVGSVLMQRMIEEGDFNEINPVFFTTSQHGQAAPEFTGKSGVLQDAFDIEALKALDIIISCQGGDYTNNIYPKLRATGWQGYWIDAASALRMNDDAVIILDPVNHQHIQDSLNNGIKTFVGGNCTVSLMLMSLGGLFANNLIEWASVSTYQAASGGGARHMRELLTQMGMLHNQVADELQNPASAILDIEKRVTDFTRSGTLPTDQFGVPLAGSLIPWIDKQLENGQSREEWKGQAETNKILNTGNNIITVDGLCVRVGALRCHSQSFTLKLKRDIPIHEIETLLASHNEWVRVIPNDRELTMRELTPAAVTGTLNTPVGRLRKLN

SEQ ID NO: 316 - protein, 311 aa, Xenorhabdus nematophilus
MANPLYRKHIISINDLSRTDLELVLQTAAALKANPQTDVLKHKVIASCFFEASTRTRLFFETAIQRLGASVVGFADSSNTSLGKKGETLADTISIISQYADAIVMRHPQEGAARLASEFSGHIPIINAGDGANQHPTQTLLDLFTIQETQGKLDNLKIAMVGDLKYGRTVHSLTQALAKFEGNHFCFIAPDALSMPNYILHMLDEKQVSYSIHNNFEDVLPELDILYMTRVQKERLDPSEYANIKAQFVLRAADLVSVKENLKVLHPLPRIDEITVDVDKTPYAYYFQQAGNGIYARQALLSLVLNENVVI

SEQ ID NO: 317 - protein, 1326 aa, Xenorhabdus nematophilus
MGSTTMGVKLDEATRNRIKAAAQRIERTPHWLIKQAIFNYLERLENEEKIPEISAAQDNKEEKISEEESPIEARYQPFLDFAEHILPQSVKRSAITASYRLPETQAVPMLLQQAQLPEEQSKAAHKLAYSIAEKLRQQKQGIGRAGLVQGLLQEFSLSSQEGVALMCLAEALLRIPDKATRDALIRDKISNGNWHSHLGQSPSMFVNAATWGLLFTGKLVSTHNEAKLSKSLTRIIGKSGEPLVRKGVDMAMRLMGEQFVTGETIAQALANARKLEEKGFRYSYDMLGEAALTEEDAQAYMVSYQQAIHAIGKASNGRGIYEGPGISIKLSALHPRYSRAQYERVMTELYPRLLSLTLQARQYDIGINIDAEEADRLEISLDLLEKLCFEPQLEGWNGIGFVIQAYQKRCPFVIDSIIDLAQRSRHRLMIRLVKGAYWDSEIKRAQIDGLEGYPVYTRKVYTDVSYIACARKLLSVPNLIYPQFATHNAHTLSAIYHIAGQNYYPGQYEFQCLHGMGEPLYEQVVGKIADGKLNRPCRIYAPVGTHETLLAYLVRRLLENGANTSFVNRIADTNLPIDELVADPVKVVHELAKSEGQIGLPHPKIPLPIDLYGKNRANSSGLDLSSEHRLASLSSALLSSSMEIWNSEPLLGGDYTHTGELPVASPVNNPAKSSDIVGYVRETTEQEVRHALEVATNAETIWFATPPSERAAILVRAAELMEDNLQSLLGILVREAGKTFNNAISEVREAVDFLYYYADQVRQDFANDTHRPLGPVVCISPWNFPLAIFTGQIAAALAAGNSVLAKPAEQTPLIAAVAVKMLHQAGIPREVLQLLPGQGETVGSMLVGDERVRGVMFTGSTEVASLLQRNIAGRLDAQGRPTPLIAETGGMNAMIVDSSALTEQVVTDVVASAFDSAGQRCSALRILCIQDDVADRTLTMLKGAMAECRMGNPEHLFTDIGPVIDAEAKANIERHIQAMRTKGRTVYQATHENAADSREWPQGMFVKPTLIELESFDELKKEIFGPVLHVVRFKRDELDQLLDQINASGYGLTLGVHTRIDETISQVTGKAKVGNLYVNRNMVGAVVGVQPFGGEGLSGTGPKAGGPLYLYRLLSQRPVNGATQALTRQDEEYPLDATIRTALHSPFNKLAEWATSNNHSELNHIIQEYALLAQGGTTRLLPGPTGERNTYTLLPRGQVLCLADNEQDTLIQLAAVLSVGCQAVWEKDELHQQLLKQLPKEVRHAIYLVNDWQSEDTVMEAVIYHGDCDQLRQVCETVAQRKGPIVSVQGFARGETNLLLERLLHERSLSVNTAAAGGNASLMTIG

SEQ ID NO: 318 - protein, 429 aa, Xenorhabdus nematophilus
VAQQKERVAIVSGLRLPFAKQATNYHGIPAVDLGKAVVSELVIRSGLPPEKIDQLVFGQVVQMPEAPNIAREIVLGAGLSVSTDAYSVSRACATSFQAIANVAESIMAGTVNVGIAGGADSSSVLPIGVTKSLARTLVDMNKAKSLSQRLKLLSKLKLKDLLPVSPAVAEYSTGLRMGDTAEQMAKTYHISREAQDELAHRSHLMAAKAWEKGLLRDEVISAHFPPYRESLQEDNNIRKNSELTSYAKLRPAFDRKYGTVTAANSTPLTDGAAAVILMSESAAKELGMVPLGYLRSYAFSAIDVWQDMLLGPSYATPLALDRAGITLNDLSLIDMHEAFAAQTLTNLKMFASDKFAREKLGRSQAIGEVDMDKFNVLGGSIAYGHPFAATGARMVTQTLNELRRRGGGLGLATACAAGGLGAAMVLEVE

SEQ ID NO: 319 - protein, 217 aa, Xenorhabdus nematophilus
QLSEAQSALSDAVYACQSQKMRTLIFGGGHETAFAHGMGIYRAFPTQRVGIINFDAHLDLRNAPQATSGTPFRQLADYCHQQQRPFNYSCVGASLASNTQALLDEANHLDVTIIWDTQCIDSMLDKVQQQIQDMLNQAEIIYMTIDLDVLPIWQMPSVSAPAALGVPLERLLSLIQPICQSKKLQAVDLVELNPLYDIQGMGGKAAARLAWQIVHWW

SEQ ID NO: 320 - protein, 390 aa, Xenorhabdus nematophilus
QPEHYIGTPLLISVLLALTGLTVVGQIYIPIPILTEITQHFNNNKNMAGWVSSAFSIGYSAGFLLSGPLSDRFGRRLVMLTGFIFFLLFTVLVGFCSNFSLLLTLRVLQGLAASCYPPIILAYLNEKLSSTLKSRAISFMSLGFLTASIVAQLYAIKFSHYGFNTIELALVPVYFVSIILIYFVVHRDKESNQVEEHNKTTLFDIYRKIPGILFEKNLKWLYLSTLCTLSALVAFYIMMDESYGKKFAIMGIEPFTTRLIVLPVMFLSLLAPWIIQKIGAISLVRWSFLIAAAGLIVASVTVSFGSAWGLLFASIIFIGGRAFSVPSLVGVIAVLAEQQYRGTAISLYTFVLFVGASIGPLIAHLLLMMNYSISLLILAFIAGLPVLLTL

SEQ ID NO: 321 - protein, 206 aa, Xenorhabdus nematophilus
  unsure (1)..(206): unsure at all Xaa locations
MLTVWGRKNSSNVKKVLWCLEELKVPYQQIDIGGKFGKLDDPNYLHMNPNGVIPCLQDGDFILWESNVIVRYLAEKFGENTLYPNDIKXKYNIEKWMDWTGCNLFSPIKQLMISLVRTPEAQRDQKVIAQALAEIERLLKIADEALSQQTYLSGDKFGMADIALAPFIYPWINVVTERPSLPNLERWYQLMTERPAFQKIVMIEIN

SEQ ID NO: 322 - protein, 430 aa, Xenorhabdus nematophilus
VDFSTIIRWQACTPKQQEMLLTRPAVTASEDITYTVRQILEAVKERGDSVLREYSQRFDNTTIDAVRVPEEEINAAGRHLTTEIRQAIQQAMDNIRLFHEAQKPVVIEVETMPGVCCQQITRPIDSVGLYIPGGSAPLPSTVLMLGIPASIAGCRKVTLCSPPPIANEILYAAQLCGISDIFQIGGAQAIAAMAFGTESVPRVDKIFGPGNAWVTEAKKQVSQHIDGAAIDMPAGPSEVLVIADSGANPVFTAADLLSQAEHGPDSQVILVTPDESYAGEVIHEIEKQLPTLPRQQIAIQALQSSRIIVADDIAQCVAISNQYGPEHLIIQTRQPEQIVDKITSAGSIFLGDWSPESAGDYASGTNHVLPTYGYTSTHSSLGLADFLKRMTVQKLTPQGLKKLAPTIETLAQAEQLTAHKNAVTLRIAAL

SEQ ID NO: 323 - protein, 354 aa, Xenorhabdus nematophilus
MSTVFDVTSLARENIRKLVPYMSARRLGGNGDIWLNANEYHAAPDFQFSEKTLNRYPECQPATVIQRYADYAGLQPEQVLVSRGADESIELLIRIFCEPGKDAVMFCPPTYGMYSVSAETFGVAQKKILAGIDWQPNITTIKNNLDRVKLIYICSPNNPTGNLIAPSTLRQILELARNRAIVAIDEAYIEFSLQNTTTRWLKEYPHLVILRTLSKAFALAGLRCGFTLASADIIALMLKVIAPYPIATPVADIAAQALTASGIRVMQERVEETIANRAYLQDALDKLILVEKVFPSETNYILVRFTNAEFVFKALWDQGIILRDQQKQPKLENCLRITVGSRSECEQLITAIDA

SEQ ID NO: 324 - protein, 355 aa, Xenorhabdus nematophilus
MSQKILFIDRDGTLITEPPTDYQVDSLDKLAFESGVIPALLALQKSGYKLVMVTNQDGLGTDSFPMTDFEPPHALMMQVFSSQGIQFEEILICPHKPADNCNCRKPKLGLIEKYLADGMLDTKNSYVIGDRETDLQLARNMGIQGLLYQPESFGWSAICEQLTRKDRYSSVNRTTKETAINIEVWLDREGKSRINTGVGFFDHMLDQIATHGGFRMNIQVDGDLYIDDHHTVEDTGLALGEALKQALGDKLGIARFGFTLPMDECLARCALDISGRPHLEYKAEFKHQRVGDLSTEMIEHFFRSLSYTMGCTLHLKTKGKNDHHRAESLFKVFGRTLRQAIRVEGDTLPSSKGVL

SEQ ID NO: 325 - protein, 258 aa, Xenorhabdus nematophilus
MLARRIIPCLDVRDGQVVKGVQFRNHEIIGDIVPLAQRYAQEGADELVFYDITASSYGRVVDKSWVAKVAEVINIPFCVAGGIKTVEDAGQILSFGADKISINSPALSDPSLINRLADRYGVQCIVIGIDTWFDEKSNSYQVYQFTGDEKRTTATTWQTLDWVREVQQRGAGEIVLNMMNQDGVRNGYDLAQLKQVRETCSVPLVASGGAGAPVHFLDAFKQANVDGALAASVFHKQIINIGELKQYLAEQEVEVRIC

SEQ ID NO: 326 - protein, 201 aa, Xenorhabdus nematophilus
LTPQEIEKLDWEKVDNLMPVIVQHAVSGTVLMMGYMNREALNATLNSGKVTFFSRTKQRLWTKGESSGHFLELSEIYPDCDNDTLLILANPIGPTCHKGTESCFGSAQTQWGFLYQLEQLLASRKNASPDSSYTARLYASGTKRIAQKVGEEGVETALAATVNDREELTNEAADLLYHLLVLLQDQNLDLSCIIRQLQKRH

SEQ ID NO: 327 - protein, 379 aa, Xenorhabdus nematophilus
MAISTFFIPPVNKIGEGCLNEAIQLAKTYGYKQALIVTDRVLNEIGVVGKVQNLLTNVGIKSALYDGTNPNPTTINVEEGLAILHQHSCDFVISLGGGSPHDCAKGIALVAANGGDIRDYEGVDVSAKPQLPLIAINTTAGTASEMTRFCIITDVERHIKMAIVDKNVTPILSVNDPSLMIGMPKGLTAATGMDALTHAVEAYVSTAANPITDACALKAVEMISSYLRRAVENGSDVEARENMAYAQFLAGMAFNNASLGYVHAMAHQLGGFYDLPHGVCNAVLLPHVQRFNAKVAAPRLKDIAAAMGANVENVSDQEGAEACIREIRRLAKDVNIPAGLTELNVKVEDLPVLSANALKDACGFTNPIQASHEDIVAIF

SEQ ID NO: 328 - protein, 468 aa, Xenorhabdus nematophilus
MSKQQIGVVGMAVMGRNLALNIESRGYSVSIFNRSSDKTDEVIAENPGKKLVPSYSIEEFVDSLEKPRRILLMVKAGEATDKTIASLTPHLDKGDILIDGGNTYFQNTIRRNRELSAQGFNFIGTGVSGGEEGALKGPSIMPGGQKEAYELVAPILKEIAAQVDGEPCVTYIGADGAGHYVKMVHNGIEYGDMQLIAEAYSLLKHSLNLGNQELADVFSGWNEGELSSYLIEITADIFRKKDEEGKYLVDVILDEAANKGTGKWTSQSSLDLGVPVTLITESVFARYISSLKDQRVAASKVLSGPEAQPFAGDKAEFIEKVRRALYLGKIVSYAQGFQQLKASSDEYNWDLNYGEIAKIFRAGCIIRAQFLQKITDAYNENPAIANLLLAPYFKQIADEYQQALRDVVSYGVQNGIPTPTFSAAISYYDSYRSAVLPANLIQAQRDYFGAHTYKRTDKEGVFHTEWLE

SEQ ID NO: 329 - protein, 387 aa, Xenorhabdus nematophilus
MENVVIIDGIRTPMGRSKGGVFRQTRAEDLSAHLMKSLLKRNPSVQPEQIDDISWGCVQQTLEQGFNIARNAALLAGLPHSVPAVTVNRLCGSSMQSLHDATRMIMTGDANIAMIGGVEHMGHVPMTHGVDFHPKLSRNVAKAAGVMGLTAEMLAKMHGISREMQDEFAMRSHQRAAQATESKAFASEIAPLHGHDADGNIQLVNFDEVIRPDTNLKDLAGLRPVFDPVTGSVTAGNSSALSDGASAMLVMSESKARELGLKPRARIRSMAVVGCDPSIMGYGPVPATQMALKKAGLALSDIDLFELNEAFAAQSLACMKGLNLLDSMDDKINLNGGAIALGHPLGCSGTRITTTLLNLMERKDVQFGLATMCIGLGQGIATIIERV

SEQ ID NO: 330 - protein, 644 aa, Xenorhabdus nematophilus
MEKLASLYQEHIKILQKRAKEILARSQLDALLIHSGELLRVFLDDSHYPFKANAHFKAWVPVTKVPNCWLWIDGVNKPKLWFYSPVDYWHSVEPLPHGYWTEEVEMFHLASAEDINTALNGFSKQHMAYIGEQVERAKSLGISEHNLNPKAVLDYLSFHRSYKTDYELACMREAQKTAVNGHMAAHDAFLSGVSEFEINMFYLIATGHRDTDVPYDNIIALNENAAVLHYTKLQQTVPAEIRSFLIDAGAEYNGYAADITRTYAAKSNSEFASLIKGLNDEQQAIITTIKAGTRYTDYHINMHYRIARLLKKHYIINGISEEAMVEKGLTAPFFPHGLGHPLGLQVHDSAGFMQDDTGTHLAAPEMYPYLRCTRVLEPRMVLTIEPGLYFIETLLAPWRVSEYSKHFDWKKIEALKPYGGIRIEDNIVIHDGKIENMTRDLQVAVMKPYLIPAASVSFTEEIKKSRFITLLERTSGVDEAKSFIQRIKQQYPDARHHCWAFVAGAPDDSQQLGFSDDGEPTGTAGKPMIAQLIGSGLGEITAISVRYFGGIKLGTGGLVKAYGNGVQQALKLLEKEYKVPQKQYQIQCEYAQISMVEQLLQQFSGQVLASEYTENVTLQVSLPATLADEIGNKLRDLSRGSLFL

SEQ ID NO: 331 - protein, 169 aa, Xenorhabdus nematophilus
  unsure (1)..(169): unsure at all Xaa locations
MNYLLLYSTQDGQTKKIIMRIAENIRRAGINCDLRDLATVNHMNLLPYNKVMIGASIRYGNFNSVLHKFVVRHQKQLNQLTTAFFSVNLTARKPEKRTPETNAYVRKFLVKSPWQPDLCDVFAGALLYPRYRWFDRIMIQLIMRMTGGETDTTKEIEYTDWAQVDLFXR

SEQ ID NO: 332 - protein, 336 aa, Xenorhabdus nematophilus
MYYPLLKKALFQLDPEQAHELTFRQLKLVTGTPFEFLIRQSVATKPVTCMGLSFKNPLGLAAGLDKNGDCIDAFGAMGFGFVEIGTVTPRPQAGNDKPRLFRVVEAEGIINRMGFNNLGVDNLVENVKKAKYDGIIGINIGKNKDTPVENGKDDYLICMDKVYPHAGYITINISSPNTPGLRTLQYGEALDDLLSAIKNKQSELQQKYQKYVPVAVKISPDLTESELVEIADSLMRHQIDGVIATNTTLDRKIIEGLNHCQQAGGLSGRPVQLRSTEIIRRLSQELKGEIPIIGVGGIDSLVSAREKMEAGASLIQIFSGFIYKGPKLIKDIVNHI

SEQ ID NO: 333 - protein, 572 aa, Xenorhabdus nematophilus
TMSNEKQGPLIVEGKLADSERMKSESNYLRGTISEDLKNGLTGGFEGDNFLLIRFHGMYQQDDRDIRAERAEQKLEPRHAMMLRCRLPGGIITPRQWLGIDQFATESTLYGSIRLTNRQTFQFHGILKNNVKPAHQLLAQMGLDSLATANDVNRNVLCTSNPVQSALHQQAYEWAKKISEHLLPRTNAYAEIWLDKEKIATTDEEPILGKTYLPRKFKTSVVIPPQNDVDLHANDMNFVAIAENDQLIGFNVLVGGGLAMTHGDKNTFPRLASEFGYIPLEHTLAIAESIVTTQRDWGNRTERKNAKTKYTLERVGVETFRQEVEKRAGVKFEPVRPYEFTGRGDQIGWLKGIDDQWHLTLFIENGRLLDYPDKPLKTGVAEIARIHKGDFRLTANQNLIVAGVAENEKARIESIARAHGLIDDGVTSLRHHSMACVSFPTCPLAMAEAERFLPTFVDHVDALMAKHGVSHEHIVLRVTGCPNGCGRAMLAEVGLVGKAPDRYNLHLGGNRNGSRIPRMYQENITSAEILTILDELIGRWATERNENEDFGDFLIRTDIIKPVLNSAIDFYD

SEQ ID NO: 334 - protein, 244 aa, Xenorhabdus nematophilus
MSRPHLAELLALPPEQRTEVLAETNQQLELLDARQRVLWALEHLPGEFVLSSSFGIQAAVCLHLVTQEYPDIPVILTDTGYLFPETYQFIDKLADKLNLNLKIFRAEQSPIWQEARFGKLWEQGVDGIERYNQINKVEPMNRALKTLDAQTWFAGLRRQQSESRANLPVLAVQRSVYKILPIIDWDNRKVHQYLTEHGLEYHPLWEQGYLSVGDTHTTKKWEPGMSEEQTRFFGLKRECGLHEG

SEQ ID NO: 335 - protein, 569 aa, Xenorhabdus nematophilus
QRVSIMELEHESKRPLYIPYAGPILLEFPLLNKGSAFTEEERSNFNLHGLLPQAVETIEEQAERAYRQYRDFKNDADKHIYLRNIQDTNETLFYRLLDAHLSEMMPIIYTPTVGEACEHFSDIYRRARGLFISYPNRAYIDDMLQNATKQNVKVIVVTDGERILGLGDQGIGGMGIPIGKLSLYTSCGGISPAYTLPVVLDVGTNNPQRLNDPLYMGWRHPRITGKEYDDFVDEFIQAVKRRWPNVLLQFEDFAQNNAMPLLTRYRNDLCCFNDDIQGTAAVALGSLIAASRAAGRQLKDQTVTFLGAGSAGCGIAEQIIAQMKSEGLSDEQARARVFMVDRFGLLTDKQPNLLDFQSVLVQKSSALDSWDVDKDSLSLMDVVRNAKPTVLIGVSGQSGLFTEEIIREMHKHCERPIVMPLSNPTSRVEARPEDIINWTEGKALVATGSPFSPVQYEGQEFPIAQCNNSYIFPGIGLGVIASGARRVTDDMLMAASRSLADCSPLAQTGSGPLLPLIDDIQDVSRKIAKEVAKKAQIQGVATVTSEDALEEAIERNFWKPEYRIYKRTS

SEQ ID NO: 336 - protein, 342 aa, Xenorhabdus nematophilus
KIAVQELRELGQAALIRANTPAEVATLVMDDLLENELTSYPSHGVLRLADYIGDIQSGVLNPAAIPAVSLTMPNIAIVDGCRAFGVLVRQELILVLQKLALKHGIAIACLRDAHHLGRLAAIGRSLAGFNDQPLAVIGFSNYQGNGARVAPTGGHLARLCTNPLLLAFPTNTADPFVLDMSTSTVSEGFIRRHVQENKPVPPGCLVDAKKNDILDPSSLYDVPPRATIQPLGGNLAGHKGYGLAVAMELFCGALAGAGHVARPGAPGNGGLFLVIDPSRMPGGIDTIRSEAEAIMNYCRDSGRPEAPARMPGEGYFTRHNEAKNTITLSLPTSVLTEIRHLA

SEQ ID NO: 337 - protein, 292 aa, Xenorhabdus nematophilus
FTGSMVAIITPMDSTGRVDKSSLKKLIDYHVASGTASIVSVGTTGECATLNHDEHVDVVLTTLELADGRIPVIAGTGANATAEAISLTRCFENTGVVGCLSVTPYYNKPSQEGLYQHYKAIAENTDLPQILYNVPSRTGCDLLPPTVARLAKLKNIVAIKEATGNLSRVSQIQELVNDESFILLSGDDASFLDFMYLGGKGTISVTANVAAAEMAQICQLASRGEFAKARSLNSSLQELHHKLFVEPSPAPAKWACHKLGLIASDTLRLPMVPLTQEGQISVENALKMAELL

SEQ ID NO: 338 - protein, 505 aa, Xenorhabdus nematophilus
TEQQPWWLDSAIYQIYPKSFQDSTGNGTGDINGITQRLDYLQHLGVGAIWITPIYPSPQVDNGYDVADYCAINPEYGTMEDFDNLVENAHRRGIRIILDMVFNHTSTEHPWFKAAQDANSPYRQFYIWKEGGGQDNPPNNWKSKFGGNAWQWHAASQQYYLHLFAVEQADLNWEHEPVRSELKKVCEFWADRGVDGLRLDVINLVSKQQDYPDDDRGDGRRFYTDGPRIHEFLQEMSRDVFQPKALMTVGEMSSTSLEHCVRYSALSGNTLSMTFNFHHLKVDYPNGEKWTHAKPDYIELKKIFSVWQQGMHQKAWNALFWCNHDQPRIVSRFGDEKQHHKTSAKMLAMVLHGMQGTPYIYQGEELGMTNPHFKRIEEYRDIESLNMYQERIEQGMSSEEILTILAQKSRDNSRTPMQWDNTDNAGFTSGTPWIATSDNYREINAESVLQDKDSVFYCYQDLIQLRKTQPILTYGDYLDLLPEHPSLWCYLRRWQDQTLLVIANL

SEQ ID NO: 339 - protein, 562 aa, Xenorhabdus nematophilus
HSKGEMTDIIRARSKVFWTIGLFTAFINLLMLVPSIYMLQIYDRVLPSSNTMTLLMLTLITLGMYAIIGGLEYIRSQVVIRIGSQFDMCLNQRVYTASYESNLKNGSTDAGQMLNDLSTIRQFLTGSALFAFFDAPWFPVYLGVIFLFSPYLGLLALVGALILIALAVLNQWLSHSPLAQASHLSLRSANLASTNLRNAEVIEALGMLPALRRRWFGLHERFLNFQRIASERSASITAITKTVRMALQSLILGLGGWLAIEGNITPGMMIAGSILMGRALSPIEQLIQAWKSWNAARLSWQRLDNLLKAQPERKSGMTLPAPNGTLLLEKVFASPPGKIKAAKSTEKNKPVLQDINFSLEAGDILGVIGPSASGKSTLARLLVGVWQAQEGVVRLDGADIYQWNKDELGSHIGYLPQDIELFAGTIAENIARFNDIDAEKVIEAAEKAGVHDLVLNLEQGYDTPIGAGGMGLSGGQKQRIGLARALYGNPSLIVLDEPNSNLDDIGEKALSRAINQLRQQGKTVVVITHRPALLSQTNKVLLLVQGKTKLFGPSQQVMAALA

SEQ ID NO: 340 - protein, 433 aa, Xenorhabdus nematophilus
MSKIVKVLGREIIDSRGNPTVEAEVHLEGGFVGLAAAPSGASTGSREALELRDGDKSRFMGKGVLKAIAAVNGPIAQALAGQDAKDQANIDKIMIELDGTENKSNFGANAILAVSLANAKAAAASKGMPLYEHIAELNGTPGRFSMPLPMMNIINGGEHADNNVDIQEFMIQPVGASTLKEAVRIGSEVFHNLAKVLKAKGMNTAVGDEGGYAPNLESNAAALAAIKEAVEQAGYVLGKDITLAMDCAASEFYNEETGNYELKGEGKTFTSQEFTHYLEGLTKEYPIVSIEDGLNESDWDGFAYQTKVLGDKIQLVGDDLFVTNTKILKEGIEKGIANSILIKFNQIGSLTETLAAIKMAKEAGYTAVISHRSGETEDATIADLAVGTAAGQIKTGSMSRSDRVAKYNQLIRIEEALGNRAPFNGLQEVKGQA

SEQ ID NO: 341 - protein, 477 aa, Xenorhabdus nematophilus
YRMLIGGEWVDSTSKETMKSYNPATGELLTEYAAGNAQDVELAVRAAKKALPAWRKTSAEKKQSLLLKIADLLEAEAERFITLETLDGGKTQSLCRNFDIPFAIDHFRYFAGVIRAHSDASDVIDENTLSLVIREPIGVIGQIIPWNFPLLMAAWKIAPALAAGNTIVINPASLTPITLLELGRIINQVLPAGVVNIVTGRGSAVGQAILDHEGIDKVAFTGSTEVGYNVAAAAAKRLIPATLELGGKSANIVFPDANIKKAVKCAAHAILLNQGQACESGARLFLHKDIYDSFLQSLKTVFESIRVGDPMDPATEMSCQVSEEQMNTILGYIDLAKQEGATILTGGKRITGAGYDDGFFVQPTILTNVTNNMRVAQEEIFGPVLCVIPFSNEEEVVEMANDSEYGLAGAVWTQDINRALRVAKAIEAGRIWINTYHELPAHTPFGGYKKSGLGRETHKMILDAYTEVKNIYISTKE

SEQ ID NO: 342 - protein, 384 aa, Xenorhabdus nematophilus
MTTHLFTSESVSEGHPDKIADQISDAVLDAILEQDPKARVACETYVKTGMVMVGGEITTSAWVDIEEITRSTVREIGYTSSEMGFDANSCAVISAIGKQSPDINQGVDRADPLEQGAGDQGLMFGYATNETDVLMPAPITYAHRLVERQAHVRKNKTLPWLRPDAKSQVTFQYDNGKIVGIDAIVLSTQHSEEIGQKELQEAVMDEIIKPVLPAEWLTPMTKYFINPTGRFVIGGPMGDCGLTGRKIIVDTYGGMARHGGGAFSGKDPSKVDRSAAYAARYVAKNIVAAGLADRCEIQVSYAIGVAEPTSIMVETFGTEKVPTSTLVQLVREFFDLRPYGLIKMLDLLHPIYRDTAAYGHFGREQFPWEATDKAEILRDAAGLK

SEQ ID NO: 343 - protein, 642 aa, Xenorhabdus nematophilus
LYSMKETAMNDNIARKMRQTYNIAYWGGNYYYVNDLGNVSVCPNPDLPEAQVEIVDLVKKVQQEKKQLQLPALFCFPQILQHRLRSINAAFKRARESYGYKGDYFLVYPIKVNQQRRVIESLANSGEPVGLEAGSKAELMAVLAHAGMTRTVIVCNGYKDREYIRLALIGEKLGHKVYLVIEKMSEIAMVLEEAERINVVPRLGVRARLASQGAGKWQSSGGEKSKFGLAAAQVLQLVETLRAAGKLDSLQLLHFHLGSQLANIRDIATGVRESARFYVELHKLGVNIQCFDVGGGLGVDYEGTRSQSECSVNYGLNEYANNVIWGIGDACEENGLPHPTVITESGRALTAHHTVLVSNVIGAECNEFTETTPPAEDAARPLTSLWDTWLEMQDDGYKRSLREWLHDSQFDLYDVHTQYAHGILSLSERAWAEELYLNICRRIQQDLDPSNRAHRPIIDELQERMADKLYVNFSLFQSMPDAWGIDQLFPVLPLEGLDKPLDRRAVLLDITCDSDGIIDHYVEGDGVATTMPMPAYDPENPPLIGFFMVGAYQEILGNMHNLFGDTAAVDVYVTENGEVTYQQSEEGDTIANMLQYVKLEPQVLLTRFRDQVKSTDLAENLQEQFLQEFESGLYGYTYLEDE

SEQ ID NO: 344 - protein, 669 aa, Xenorhabdus nematophilus
EAAECGLASLAMIFHYHGLQIDLSSLRSQFGISTRGVTLTTLINIATVLKFKTRAVALDLDELQALKTPCILHWDMNHFVVLVNVKKNKITIHDPAFGQRVMTFAEVSKHFTGIALEVWPGSEFVPIKKQNKLRIISLLTNIQGIKSTLSKIFFLSLVIEAINILLPVGTQLIMDHVIIAQDHSLLKIICCGLLFFILFRVSVSTLRSWTSITMEAFVDVQWKSGVFDHLMKLPLAYFEKRKLGDIQSRFGSLSVIRTTFTQNVINSIIDTIMLVSVFIMMLLYGNWLVWVVLGFTIIYIIIRFITYQYFRQLSEEQIVKDARANSHFMETLYSINTLKALGLCDSRAKSWLNLNIDTLNSNTRLNKIGSIFNIIKTFISTSEQIIILWLGASLVIDNHMTLGMFVAFNSYRGQFADRASNLIDMAMKLRMLNLHNERIADIVLTDTEKETPDRELGFSGKAVNLTIHDLHYQYDNLSKPIISGFNLHINAGESIAIVGPSGAGKTTLMKLMSGLLEPNKGTILMNGLDINIIGLNNYRKCIACVLQDDKLLSGSIAENISGFTHSPDVHFIQECAKRANIHDDILLMPMGYETLIGELGNGLSGGQIQRLLIARALYRRPSILFMDEATSHLDLDNESYINESVSSLKITRIIIAHRPSTIQSAERVI

SEQ ID NO: 345 - protein, 355 aa, Xenorhabdus nematophilus
YHIAVLPGDGIGPEVMKQAYKVLDAIRRRFSIRITTSEYDVGGIAIDRHGCPLPEATVAGCEKADAILFGSVGGPKWEHLPPASQPERGALLPLRKHFKLFSNLRPAHLYTSLTSFCPLRHDIAEKGFDILCVRELTGGIYFGQPKGREGEGRYERAFDTEVYHRFEIERIARIAFESARKRRHKVTSIDKANVLQSSVLWREIVSEIAKEYPDVEINHMYIDNATMQLIKAPSQFDVLLCSNIFGDILSDECAMITGSMGMLPSASLNEKGFGLYEPAGGSAPDIAGKNIANPIAQILSTALLLRYSIKRDDIADAIETAVNAALEQGYRTADLAGNGEAISTDEMGDIIAQNI

SEQ ID NO: 346 - protein, 709 aa, Xenorhabdus nematophilus
MALSSSIKNQISQWYKALSTHIDGFIPRAPQRQMIAEVAKTLADDEGRHLVIEAPTGVGKTLSYLIPGIAVSRAEQKLLVVSTANVALQDQIYSKDLPLLRKIIPDLKFTGAFGRARYVCPRNLEAICAAEGEQIDLMLLVEDQTAVANSEERELCRRLRNDYSTFGWDGLRDHHQLALSDSLWSKVSTDKMNCLARNCQFYHRCPFFLARRQIEDSDVVVANHSLVMAALESESVLPEAKNMLLVLDEGHHIPDVARDSLEVEGEITLFQLNGQLDSFVRHVEQYLLQFRPTKPPALAEITRLQAHCEKIRECFRELADITQALLPERGDAEEYLFELGKLPDNLLLCCQTLFKLTDGLRSLSEAILNDLTDQTAKQDIVRLHRAILLTSRTLGYFENMAKLWRLASQEESSHAPISKWLTRRYEKNQSHLYFHCAGIRVSEQLTQLLWRNIPHIVVTSATLRSLNSFSRIQELTGLHENYDDRFVTLTSSFEHVRQGRLIIPRMTLEPTIHNEMQHLEEMARYFRSQILLGAHQGMLVLFSSQRAMEGFLQFVKDLRLMLLVQGDQPRYRLVETHCKRIDEGQPSVLVGLQSFAEGLDLKGNYLSQVHIHKIAFPPVTNPVIITESEWLKSLKRYPFEVQSLPSASFSLIQQVGRLIRSHECHGDVVIYDKRLLTKRYGSRLLDALPVFPIEQPDIPSEEILLKMKK

SEQ ID NO: 347 - protein, 329 aa, Xenorhabdus nematophilus
  unsure (1)..(329): unsure at all Xaa locations
QQKRHNKYSKKRYIRKTDNPGNSNSRYTLRFIAVPNLVVXRTEYPMTGRLMNSQYFVIPQWLSEHLNDENVVVIDASAPMPTESIDYQQKWLEKHIPGSGFFDLDKIADLQSPLPHMLPAPETFQKAVSEMGISENHLIVIYDQGNMFSAPRAWWTFKTFGAKNIRILEGGLQGWQRAGYPTESGEVSHHAQVFNIHFSPEHVISRQQILDILHNEEEKTQVVDARSVERFQARAPEPRPGLRMGHVPGSKNVPWTALLENGHYKSPDEIKRIFKQQGVDLGQPIITSCGSGMTAAVLVLGLDIIGHKKAALYDGSWAEWGADDNLPSE

SEQ ID NO: 348 - protein, 416 aa, Xenorhabdus nematophilus
TLSIHAGYSPDPTTKAVAVPIYQTTSYAFDDSQHGADLFDLKVEGNIYTRIMNPTNDVLEKRIAALEGGVGALAVASGMAAITYAIQTITGLGDNIVSVAKLYGGTYNLMTHNFQNIGIEVRFIDHDDLAALESMIDERTKAVFCETITNPSGNIADIRAFADIAHRHGIPLIVDNTVATPYLCRPFEHGADIIVHSLTKYIGGHGNSMGGMVIDSGNFPWADHKDRFAVLNTPDPSYHGINYLEHFGVAAFIARCRVGQLRSTGASLSPFNAFLILQGLETLALRMERHTENALKVAQYLEQHPLVSWVKYAGLPTHPEYDLAVRYMGGKPSAILSFGIKGEEKAATRFIDALQLITRLVNIGDAKSLACHPASTTHRQLNEKELIKAGASRDLIRLSIGIEHSDDIIADLAQAL

SEQ ID NO: 349 - protein, 449 aa, Xenorhabdus nematophilus
  unsure (1)..(449): unsure at all Xaa locations
MNFESLGLKADILRAIEEQGYAEPTPIQQQAIPVVLSGKDLLASAQTGTGKTAGFTLPILQLLSESPIQSKGRRPVRALILTPTRELAAQVGENVHNYSKYLRLRSFVVFGGVSINPQMMKLRGGVDILVATPGRLLDLEHQNAVDLSHVEMLVLDEADRMLDMGFIHDIRRVLNKLPAKRQNLLFSATFSDEIKNLANKLLRDPASVEVARRNSASEQIEQAVHFVDKKRKGELLSYMIGSQNWQQVLVFTRTKHGANRLAEQLNKDGVTAAAIHGNKSQGARTRALADFKSGQIRALVATDIAARGLDIDQLPHVVNYELPNVAEDYVHRIGRTGRAEATGQAISLVCVDEHKLLKDIERLLKREIPRITTPGYEPDPSIKAEPIQNGRNGRSNQPRAQRTGDKQGATRQNHGHSRNKNVWPKNASSQKPRNRRSVKAVAGEXYHAR

SEQ ID NO: 350 - protein, 216 aa, Xenorhabdus nematophilus
LKCRGFLFDLDGTLIDSLPAVERAWIKFADKLGIDRDEVLNYVHGTPALLSIRHFMPDATEEEIISTFKWIEKIETEDMEGITALPGAIALIDKLNALEIPWAIVTSGTIPLASARHKEAELPEPAHWVTAESVKNGKPNPEPYLLGAQKLGLLPEECVVFEDAAAGIHAGLDAGCQVVVVHDEPGISRRDEIHMTVTNLEDIEIVKSGGYVTIYQ

SEQ ID NO: 351 - protein, 655 aa, Xenorhabdus nematophilus
LDKFTLDVTAKAKVGNIDPVFGRDDEIRQMIDILSRRRKNNPILVGEPGVGKTALVEGLALRITEGNVPESLKTVSLRTLDLGLLQAGAGVKGEFEQRLKNIIDAVQQSPTPILLFIDEAHTIIGAGNQAGGADAANLLKPALARGELRTIAATTWSEYKQYFERDAALERRFQIVKVDEPDDEKASLMLRGLKPRYAKYHGVHITDDALKAAVTLSRRYLTGRQLPDKAVDLLDTASARVRMSLDTQPDELVRLRSSLAALDLEAEALQEDHFVGNAVEVSRLIDITQQREALENQLQLTEAQYQQEKALTEQLLDCRQSGSNAGENARLQQQLAEIQNGAPLLGLDVDVRTVATVIADWTGVPLSSLMKDEQADLLSLEQHLEKRVVGQSAALESMAQRLRAAKTGLASENGPLGVFLLVGSSGIGKTETALALADSLFGGEKSLITINLSEYQEPHTVSQLKGSPPGYVGYGQGGILTEAVRKRPYSVVLLDEVEKAHRDVMNLFYQVFDRGFMRDGEGQEIDFRNTVIVMTSNLGSDHLMQLLDEQPESTDSTLHELLRPILRDHFQPALLARFQTVIYRPLGAQALRTIVEMKLAQVAKRLKLHYRLDCVVEESLYNTLVEACLLPDTGARNIDSLLNQQILPVMSQQLL

SEQ ID NO: 352 - protein, 441 aa, Xenorhabdus nematophilus
MKESSAELVEIFRHSVPYINAHRNKTFVVMLGGEAIAHENFPNIVNDIGLLHSLGIRLVVVYGARPQIDQNLTEHHCQPVYHKYTRVTDARTLDLVKQAAGLLQLDITARLSMSLSNTPLQGAHINVVSGNFIIAQPLGIDDGIDYYHSGRIRRIDDEAINQQLDNNSIVLIGPVAVSVTGESFNLTTEEIAAQLAIKLKAEKLIGFCSSQGVTDAEGHTLSEMFPNEGEIRLNNLENAGDYSSETVRFLRGAIKACRRGVRRSHLLSYQENGSLIQELFSREGIGTQIVMERSGQIRRANINDIGGILELIRPLEQKGILVRRSREQLEMEIDKFTLIELDNITIACAALYSYPEEKIGEMACVAVHPDYQNSARGEVLLGAIINQARQSGLEKLFVLTTQSIHWFQEKGFEPAEITMLPVEKQALYNYQRRSKILMLDL

SEQ ID NO: 353 - protein, 451 aa, Xenorhabdus nematophilus
RYLSENVLNQVMPVSSPAFVGHMTSALPLHLPVLGKILTALNQNVVKLETSHVLTALERQVLGMMHKLVYNCDDNFYQKWLHNGDHALASFCSGGTVANLTALWACRNQLMPADGDFAGLTREGLARGLIHYGYSGLAILVSELGHYSLKKAVDVLGLGQDALVKIATDKDGKICLDDLLIQLQELRRRNIKPMAIVGIAGSTETGSIDPLDALADIAEREQCHFHVDAAWGGASLLSERYRHLFKGIERADSVTIDAHKQMYVPMGSGMVLFRQPTMADAIEQHANYILRKGSKDLGRHTLEGSRSAMSLMLHSNLHLLGRQGMAALIDAGIEKAHQFADFIHQQEDFELISEPQLCLLTYRYAPPAAIKLMRESSEPIRQKVQDMLNALNQNIQTMQRSAGKTFVSRTSIKPAQWDKQPTTVFRVVLANPLTTPEILEDMIEEQRQLAR

SEQ ID NO: 354 - protein, 398 aa, Xenorhabdus nematophilus
MSASFYQKINEQLEQTRAEGLFKSERIITSAQDADIAVADGNNVINFCANNYLGLANHPDLIAAAKAGMDSHGFGMASVRFICGTQDSHKELENKIAEFLGFEDAILYSSCFDANGGLFETLFGPEDAIISDALNHASIIDGIRLCKAKRYRYANNNMQELRAQLEKAKAEGAQNILIATDGVFSMDGVIADLKSICDLADEFGALVMVDDSHAVGFVGKHGRGTHEYCDVMGRVDIITGTLGKALGGASGGYTAARKEVVEWLRQRSRPYLFSNSLAPSIVAASIKVLDMLKDGDELRERLWRNANLFREKMTAAGFTLAGADHAIIPVMLGDAKLAQEFAAELLKEGIYVIGFFYPVVPKGQARIRTQISAAHTKEQIELVVDAFTRIGKQLNIIA

SEQ ID NO: 355 - protein, 341 aa, Xenorhabdus nematophilus
MKALSKLKPEEGIWMTEVPTPELGHNDVMIKIRKTAICGTDVHIYNWDEWSQKTIPVPMVVGHEYVGKVVAIGQEVKGFKIGDRVSGEGHITCGYCRNCRGGRTHLCRNTTGVGVNRPGSFAEYLVIPAFNAFKIPDNISDELAAIFDPFGNAVHTALSFNLVGEDVLVSGAGPIGIMAAAVCKHVGARHVVITDVNEYRLELARKMGVTRAVNVSKENLTDIMSELGMTEGFDIGLEMSGAPPAFCTLLNAMNHGGRIALLGIPPSDMAIDWNQVIFKGLFIKGIYGREMFETWYKMAALIQSGLDLTPIITYQFSIDDYQKGFDIMRSGQSGKVILNWD

SEQ ID NO: 356 - protein, 330 aa, Xenorhabdus nematophilus
ASMIVIGAGSYGTALAITLARNGHNVVLWGHNPEHVLALQQARCNQAFLPDVSFPDSLQLEAELKSAISASRNILIVVPNHVFGDVLQQIKPHLQPDSRIVWATKGLEAETGRLLQDVAREILGNEIPLAVVSGPTFAKELAAGLPTAIAVSATTSEFGEELQQLFHCGKSFRVYKNPDFIGVQLGGAVKNVIAIGAGISDGMGFGANARTALITRGLAEMSRLGVALGADPSTFMGMAGLGDLVLTCTDNQSRNRRFGMMLGQGVNVDAAQSDIGQVVEGYRNTKEVRALARRVGVEMPITEQIYQILYRNKNVLEAAQALLGRATRDE

SEQ ID NO: 357 - protein, 419 aa, Xenorhabdus nematophilus
LMKQIVIAILLGVITGWGFNHYLEASQAKEIASYINIITDVFLRLIKMIIGPLIFSTIVAGLMSIGGSSSVGRITIKAMIWFIVAGLISISIGTLIANLFQPGVGLNIAIPQHGNIDTSLNAGEFSLKNFISHIFPSSFVEAMANNEILQILIFSLFFGSALSYICRNSQKTSPIVTMIEDLGRIMFRITDYVMSLAPIAVFAAIASAITIEGMGLLYEYGELIALFYLGIFLLWCILLTVGFLFLGKDIFLLMQLIREPTILAFATASSESAYPKTMNALNCFGVPKKISSFVLPLGYSFNLDGSMMYQSFAILFIAQAYNIDLSITEQILIMLTLMVTSKGMAGVARASVVVIAATLPMFKLPEAGILLILAIDQLLDMGRTATNVVGNCIATSVIAKLEGKRSSSESEVQEKEFVG

SEQ ID NO: 358 - protein, 353 aa, Xenorhabdus nematophilus
REVLHLGSYNYSGLNGHQKIIESSINAIHQYGTTSSGVRLLNGTSDLHLEMEQRLAKFLGVEEVITFSSGFSANLAALSTLCREGDIVFSDMLNHQSIVDGLKLSGATTRIYQHASLKSLENKLSQTSFQARKFIITDGVFSMDGDLAPLPGIVDLARKYNAFVIVDDAHGTGHIGPNGRGSCAYFGITDQVDVITGSLSKGLPGVGGFIATNKKTGNIIRIAANPYIYSASLPPAVLASIISAIDILESSPQLTLELQAKAEYFRQKLRDAGFNILNSETAIVPLITGDEHCCFAMARMLHEKGIYVNPVTYPAVSKTRARIRINLSANLNNEELDYSIRTFIQIGQKLALI

SEQ ID NO: 359 - protein, 1074 aa, Xenorhabdus nematophilus
MAKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLQEFGVTMIGATADAIDKAEDRQRFDKAMKKIGLDTARSGIAHTMEEALAVAEDVGFPCIIRPSFTMGGTGGGIAYNREEFEEICERGLDLSPTNELLIDESLIGWKEYEMEVVRDKSDNCIIVCSIENFDAMGIHTGDSITVAPAQTLTDKEYQIMRNASMAVLREIGVETGGSNVQFAVNPKNGRLIVIEMNPRVSRSSALASKATGFPIAKIAAKLAVGYTLDELMNDITGGLTPASFEPSIDYVVTKIPRFNFEKFAGSNDRLTTQMKSVGEVMAIGRTFQESLQKALRGLEVGATGFDPKVNLDDVQSLTKIRSELKDAGAERIWFVADAFRAGMSVDGIFNLTNIDRWFLVQIEELVRLEDMVAEQGINGLTSGFLRQLKRKGFADARLAKLAGVSEKEIRKLRHDYGLYPVYKRVDTCAAEFSTDTAYMYSTYEDECEANPNNDKPKIMVLGGGPNRIGQGIEFDYCCVHAALALREDGYETIMVNCNPETVSTDYDTSDRLYFEPVTLEDVLEIVRVEQPKGVIVQYGGQTPLKLARELEAAGVPIIGTSPDAIDRAEDRERFQQAVNRLGLKQPANATVTTIEQAIEKGNNLGYPLVVRPSYVLGGRAMEIVYDETDLRRYFQTAVSVSNDAPVLLDRFLDDAVEVDVDAICDGERVLIGGIMEHIEQAGVHSGDSACSLPAYTLSKEIQDVMRNQVEKLAFELRVRGLMNVQFAVKNNEVYLIEVNPRAARTVPFVSKATGMPLAKVAARVMAGQSLQSQGVTKEIIPPYYSVKEVVLPFNKFPGVDPILGPEMRSTGEVMGVGRTFAEAFSKAMLGSNSIMGKKGRALLSVREGDKERVVDLAAQLVKQGFELDATHGTAVVLGEAGINPRLVNKVHEGRPHIQDRIKNGEYDYIVNTTAGRQAIEDSKLLRRSALQYKVHYDTTLNGGFATTMALSADPTEQVISVQEMHAKITK

SEQ ID NO: 360 - protein, 378 aa, Xenorhabdus nematophilus
LIKSAILVLEDGTQFHGRAIGAEGVAVGEVVFNTSMTGYQEILTDPSYSRQIVTLTYPHIGNVGINSADEESPAIQAQGLVIRDLPLITSNYRSENNLSDYLKNHNIVAIADIDTRKLTRLLREKGAQNGCIIAGNEADVQVALEKAKAFPGLKGMDLAKEVTTAQSYQWLQGSWTLTEGLPEARKEQELPYHIVAYDFGVKRNILRMLVDRGCRVTVVPAQTPADEVLKMAPDGIFLSNGPGDPEPCDYAIEAIKTFLNTEIPVFGICLGHQLLALASGAKTVKMKFGHHGGNHPVKDLDRNVVMITAQNHGFAVDENSLPANLRVTHKSLFDGTLQGIHRTDKPAFSFQGHPEASPGPHEAASLFDHFIALIEQHR

SEQ ID NO: 361 - protein, 273 aa, Xenorhabdus nematophilus
MADTDIRIAIVGASGRMGRNLIQAVQQADGVTLGAALVRSGSSLVGADAGELAGTGTNGITIHDNLHSVIDDFDVLIDFTLPEGTLTYLAICHQHRKAVIIGTTGFDDAGKQAIHDASRDIPIVFAANFSVGVNLVLKLLEKAATVMGEHTDIEIIEAHHRHKVDAPSGTALAMGESIAHTLGRDLKTCAVYAREGYTGERDPKSIGFATIRAGDIVGEHTAIFADIGERVEITHKASSRMTFANGAVKAATWITNKNSGLYDMKDVLNLENL

SEQ ID NO: 362 - protein, 375 aa, Xenorhabdus nematophilus
IKPKKSVALSGVTAGNTALCTVGKNGKELHYRGYDIFDLASQCEFEEVAYLLVHEKLPSRAELTAYKAKLKALRGLPSSVKSALEALPAVAHPMDVMRTGVSVLGCTLPEKEDHNPAGARDIADRLLASLSSILLYWYHYSYNGRRIDVETDDDSIGGHFLHLLHGQKPRASWEKAMHTSLILYAEHEFNASTFTSRVIAGTNSDIYSAIIGGIGALRGSKHGGANEASFDIQQRYDTPDEAETDILRRLERKEVIIGFGHPVYTISDPRHKVIKEVAQTLSEEAGTLQMFNIADRIESVMRDEKKMFPNLDWFAAVSYHMLGVPTAMFTPLFVIARTSGWAAHIIEQRIDNKIIRPTANYTGPENLPFVPIEKR

SEQ ID NO: 363 - protein, 626 aa, Xenorhabdus nematophilus
MSFQDFYRRSIDDPSGFWAEQARRIHWQHPFEQTLDHSDPPFARWFCGGKTNLCYNASDRWLESQPDAKALIAVSTETNTEQVFTYRELYQEVNQAAAIMLSLGVKKGDRVVVYMPMVAEALFILLACARIGAIHSVVFGGFAAHSLATRLDNAEPVLVVSADAGSRGGKIIPYKPLLDEAIELAAHTPRHVLMINRGLSEINWVKNRDLDFATLRQAHLGTEVPVAWLESNEVSCVLYTSGTTGTPKGVQRDVGGYAVALATSMDIIFGGKPGGTFFCTSDIGWIVGHSYIVYAPLIAGMATVMYEGLPIRPDAGIWWRIVEKYHVTRMFSAPTAIRVLKKYPTDNIAQYDISSLETLYLAGEPLDEHTARWITETINVPVIDNYWQTETGWPIMAIARALDDRPGRFGSTSFPMYGFNVKLINELTGQECGDNEKGMVVIKGPLPPGCIQTIYGDNHRFVNTYWKHFDQQVYSTFDWGIRDSEGYYFILGRSDDVINVSGHRLGTREIEECIASHEDVAEVAVIGIKDDVKGQAAVSFVVLKEGKEIQSADHFATLEKSLMDLVDKKIGSVGRPARIYFVTQLPKTRSGKMLHRTMQAICEGRDPSDIALIENPASLDVIRDAV

SEQ ID NO: 364 - protein, 356 aa, Xenorhabdus nematophilus
TFKIAAIPGDGIGHEVLPEGIRVLQAVAEKWDLHLSFEYFEWASCDYYLRHGKMMPDDWFNQLMQFDAIYFGAVGWPETVPDHISLWGSLLKFRRDFQQYVNLRPVRLLPGVPCPLANKKPEDIDFYVVRENTEGEYSAIGGRFNEGTEHEVVIQESVFTRRGVDRILKYAFELAQSRPRKLLTSATKSNGLSISMPYWDERVEKMAKQYPDIKWDKQHIDILCARFVLNPERFDVVVASNLFGDILSDLGPACTGTIGISPSANLNPERNFPSLFEPVHGSAPDIYGKNIANPIAMIWAGAMMLQFLGEGEQRYQDAHDDILAAIEAVIVQGIVTPDMKGKASTQQVGEAIVNHL

SEQ ID NO: 365 - protein, 628 aa, Xenorhabdus nematophilus
LRNSELMTLVLGALQAGAAVKGEFEKRFKGIMAEVIQSPKPIILFIDEAHTLIGAGNQAGGLDISNLLKPALARGELKTIAATTWSEYKKYFEKDAALSRRFQLVKVSEPSAEEATVIMRGLRAIYEQAHGVLIDDEALKASAVLSDRYLSGRQLPDKAIDVLDTACARVAINLTSPPRQISSLTTELHQMQMEIDVLEREQRMGLNEHSERLEELQNQQQETQEQLTALESDWQQQQELVKQVIELRSQLLSDDKEASQDADREKQAADEVSDNSEHDATEQEEVQEETVTEPADVKSLIEKLAELNEQLAELQKKQTLVSPHVDKTQIAGVIAEWTGVPLNRLSQSELSIVTELPVHLGQNIKGQDVAIQCLHKHLLTARADLRRPGRPLGAFLLVGPSGVGKTETVLQISELMFGGRQYLTTINMSEFQEKHTVSRLIGSPPGYVGYGEGGVLTEAIRQKPYSVVLLDEVEKAHPDVLNLFYQAFDKGELADGEGRIIDCKNVVFFLTSNLGYQTIVDYAEQPEQINDQLYPELAAFFKPALLARMEVIPYLPLGHETLKTIIQGKLARLDKLLTQRFNAEVTISDDVSEEILLRATRAENGARMLESIIDGALLPPVSLLLLQK

SEQ ID NO: 366 - protein, 410 aa, Xenorhabdus nematophilus
NNQERKIMTHAFICDGVRTPIGRYGGALASLRSDDLAALPLRALLARYPGLDWQAIDDVILGCANQAGEDNRNVARMATLLAGLPYSVPGTTLNRLCGSGLDALAFAARSIKAGETQLVLAGGVESMTRAPLVMGKAETAFSRQAQIFDTTIGWRFINPLIQKQFGTDSMPETAENVAALFDISRDAQDAFALRSQQRTAKAQQQGILAEEIIPVTLPDRRKKGENTIISQDEHPRPETTLEQLQKLKTPFRTEGTVTAGNASGVNDGAAALIIASEVAALKHGLTPKARIVATATSGVEPRIMGIGPLSATSKVLALTGLSLNQMDVIELNEAFAAQSLAVMRQWGLPDDAEHVNPNGGAIALGHPLGMSGARLALTATLELERRAGRYALCTMCIGVGQGIAMIIERI

SEQ ID NO: 367 - protein, 509 aa, Xenorhabdus nematophilus
IAVIGAGTMGIGIAQVAALAGHSVLLFDANVEAAQRALDTLHTRLHQRVTAGKADADKTQALLQRITLVNSLQALAPCILVIEAIIEQLEAKQKLFHQLESLCSEQTIFASNTSSLSITAIARVLSKPQRMAGLHFFNPAPLMKLVEVVQGLETCPQIIATLKCLMINWQKQPVICRSTPGFIVNRIARPFYAEALRALEEQVASPATLDAVLKDAGGFAMGPLQLTDLIGHDVNYAVTESLFHAFYGDPRFQPSLRQKELVEANHLGRKSGRGFYVYSDTNNAEKNSVDKKPQLFPEIEEKQAAEPITSAQINANGDWSTLPHFAALLQDKLQENGVFCGEKCNIPLPSPALQIDDVLFMLATGKTSSQLADEIQAPVVQFDLSANHHAAPIITISAASQNTQQQTAKVARFLHFLGKQVILLPDYPAMLTMRTVAMLCNEALDALNKGIASAEDIDLAMCRGVNYPIGPLAWGTQLGWQHIFNTLENLQQFYGETRYRPSPLLRQLA

SEQ ID NO: 368 - protein, 687 aa, Xenorhabdus nematophilus
MQQLTSYICGEWVYGNGNARTIHHAVSGAALYQVCSDDLPLADSLKYAREKGGKALSAMTFQQRAQMMKAVAKHLLANKEALYAISAETGATRSDGWVDIEGGIATLFSYAGLAGRELPDDVLWPEDEMIPLSKQSQFVARHVLTSRSGVALHINAFNFPCWGMLEKLAPTWMAGMPAIIKPATASAQLTQAMVKLILDSGLVPEGALQLICGGIGDLFDHLDYQDAVTFTGSAQTGHKLKSHPRLIEKSIPFTMEADSLNCCILGEDVTPDMPEFGVFIKEVVREMTVKAGQKCTAIRRIIVPESQLESVKQALVKRLSGVVVGDPALPDVRMGSLISLEQRDEVQSKVDLLLQSGCELLHGGSLAKLQLADKTNSHGAFYPPTLLYCADPMTNQAVHETEAFGPVSTLMAYQETEQAIELALMGQGSLVGSLVTADEQIAMQVIRATACAHGRMLILDEAASAESTGHGSPLPMLVHGGPGRAGGGEELGGLRAVKHYMQRTAIQASPSMLAAIGREWVRGAKVKEDPVHPFRKYFEQIEIGESLLTARRTVTEADIVNFACLSGDHFYAHMDKIGAAESLFGERVAHGYFVVSAAAGLFVDASVGPVLANYGMENLRFIEPVKIGDTIQVRLTCKKKIKKVQKTPDDKPHGVVMWDVQVLNQEQQPVALYSILTLVERQLRDYV

SEQ ID NO: 369 - protein, 284 aa, Xenorhabdus nematophilus
VLDNIKIRLQYLLPKQCITHLAGWFANKKAGWLTQLVIKAFAKVYKVDMNEAQNPSFQAYSTFNEFFVRPLKEDIRPVVNETHLLALPADGAVSQLGAIREEQIIQAKGHYYTVEALLAGQHQLAEQFRNGHFVTIYLSPKDYHRVHMPCDGVLKEMIYVPGDLFSVNPLTAANVPNLFARNERVICIFDTAFGPMAQILVGATIVGSIETVWSGCVTPPREGIIKRWVYPAEGEEGAVSLKKGEEMGRFKLGSTVINLFAPNQIQFANNLYSGSQTLMGGLLA

SEQ ID NO: 370 - protein, 325 aa, Xenorhabdus nematophilus
KASWLNREPQFSAFTNGLLLDFWNIRDEREFMGVDNIPIRYVSFSSPHHDKTLVISPGRSESYVKYPEVAYDFYHLGYNILIIDHRGQGRSGRMLTDPQKGHVESFDHYVDDLAKLIELEISSLKSHRCYALAHSMGGAILSSLLLRHASVFRAAALCAPMFGINLPMPRWAANFLVNQAEPYPGRRNRYAVLTGQWRPLPYFINLLTHSYARYQRYLRYYVDYPELRLGGPTYRWMRESMRAGDSLVEKAGEIQTPLIVLKASEDKVVSNRELLAFCASRQKAGAGKEEYNPLVIQGARHEILFEKDALRAQALNAICDFFDQN

SEQ ID NO: 371 - protein, 282 aa, Xenorhabdus nematophilus
WKILVITCLLSTLAYGSDKQADAVRGSVISAMLQEYDSPFMLYPYDTNYILYTYSSRVNKQAISSYDWVDHARKDEVHFQVSFGFPIWRGIVGENSLLGASYTQRSWWQLSNKRESSPFRETNYEPQLFLAWLTDYELAGWHLREIEAGINHQSNGRPESTSRSWNRVYARLMAQKGNWQVDLKPWYRLTESNRRDDNPDMNRYMGYYRLKVGYHYGENVFTMQGRYNWNSGYSGGELGWSYPLSKHVRFYAQLFSGYGESMIDYNFRQTRFGIGVMLNDML

SEQ ID NO: 372 - protein, 640 aa, Xenorhabdus nematophilus
LCYVDWPPRLMRHHYMTTETEISFADLGLSAPILSALQDMGYEKPSPIQQQCIPHLLNGRDVLGMAQTGSGKTAAFSLPLLHNIDAELRAPQILVLAPTRELAVQVAEACSDFSKHMRSVNVVALYGGQRYDVQLRALRQGPQVVVGTPGRLLDHLKRGTLDLSNLKGLVLDEADEMLRMGFIEDVENIMSQIPAEHQTALFSATMPEAIRRITRRFMKEPQEVRIQSSVTNRPDISQSYWSVYGGVRKNEALVRFLEAEDFDAAIIFVRTKNATLEVAETLERNGYNSAALNGDMNQALREQTLERLKNGRLDILIATDVAARGLDVDRISLVVNYDIPMDAESYVHRIGRTGRAGRAGRALLFVENRERRLLRNIERTMKLTIPEVELPNAELLSQRRLEKFAGNVQQQLESSDLDQYRALLSKLGTGEELDMETLAAALLKMAQGERPLILPPDPVRRPRREFNDRDDRRRNGNSFGERDRGDRGDRGDRGDRPRRERRDVGDMELYRIEVGRDDGVEVRHIVGAIANEGDISSRYIGNIKLFATHSTIELPKGMPGDLLSHFTRTRILNKPLNMQLLGDAQPFERRERRERRGGGRNGGNGGNGGNGARRDRDGFSNGNGGGRRFNNNERRGGGER

SEQ ID NO: 373 - protein, 777 aa, Xenorhabdus nematophilus
MNPERSERIEIPVLPLRDVVVYPHMVIPLFVGREKSIHCLEAAMDHDKQVMLVAQKEASTDEPGVNDLFSVGTVASVLQMLKLPDGTVKVLVEGLQRARITTLTDNGEYFYAQVEYQDSPIVDEREQEVLVRTAINQFEGYIKLNKKIPPEVLTSLHSIEDAAKLADTIAAHMPLKINDKQAVLEMSDVVERIEYLIAMMESEIDLLQVEKRIRNRVKKQMEKSQREYYLNEQMKAIQKELGEMDDAPDEYETLKRKIENAKMPKEAREKAEAELQKLKMMSPMSAEATVVRSYIDWIVQVPWNARSKVKKDLVKAQEILDTDHYGLERVKDRILEYLAVQSRVSKIKGPILCLVGPPGVGKTSLGRSIARATGRKYVRMALGGVRDEAEIRGHRRTYIGSMPGKLIQKMSKIGVKNPLFLLDEIDKMSSDMRGDPASALLEVLDPEQNVTFNDHYLEVDYDLSDVMFVATSNSMNIPAPLLDRMEVIRLSGYTEDEKLNIAKRHLLPKQIERNALKKGELTIDDGAILGIIRYYTREAGVRSLEREISKLCRKAVKALLMDKALKHIEINAENLKNYLGVQKVDYGRADTENRVGQVTGLAWTEVGGDLLTVETASVPGKGKLTYTGSLGEVMQESIQAALTVVRARADKLGISSDFHEKRDIHVHVPEGATPKDGPSAGIAMCTALVSCLTGNPVNANVAMTGEITLRGLVLPIGGLKEKLLAAHRGGIKTVIIPDENKRDLEEIPQNVIQDLEIHPVKRIEDVLTIALQEPAFG

SEQ ID NO: 374 - protein, 1081 aa, Xenorhabdus nematophilus
RLAVKLRSDFYQRLSRQDPEFYLRHRTGDLIARSTNDVDRVVFAAGEGVLTFVDALVMGCAVLIVMSVEISWQLTLLSLLPMPIMALVIKRYGQQLHHRFKLAQGAFSALNNHAQESLTSIRMIKAFGLEDLQSSQFEEVATEAGRKNMRVARVDARFDPTIFIAIGFSNLLAVGGGSWMVVNGSLTLGELTSFVMYLGLMIWPMLALAWMFNIVERGSAAYTRILSLLQEPLVIEDGSHSLSAERGALTADINTFIYPGYSEPVLQNIYFQLLPGQLLGICGPTGSGKSTLLAVLQRQFDITDGEILFQSQNVSTLRMDEWRSRLAVVNQTPFLFSDTVAGNIALGRPDATQEQIEEVARLANVHDDILRLPQGYQTEVGERGVMLSGGQKQRISIARALLLDAEILILDDALSAVDGQTEHQIMKNLSQWRQQRTVIISAHRLSALVEADNVLVMQNGMISQQGQHKQLIAQSGWYSEMYQYQQLEAALDVNMSNTGMEKPNTRKLWPSLKRLLSYSKNHRKPIVLAVIMLWVAALAEVSGPMLISYFIDNMVSTGHIPLGIASGLAVVFLILQVVAAALHYFQSLLFNQASVGVVQQIRTDVMDSALRQPLSTFDNQPVGQLISRVTNDTEVIKDLFVNVIPTVFRSVALIGAMLMAMFFLDWRMASVALTIFPAVFLVMILYQRFSTPIIRQVREYLADINNVFNEAINGMTVIQQFRQQARFGEKLFATNRAHYQARMQALRLDGVLLRPLLSLFSAAVLCGLLLLFGFQGTDFIGVGVLYAFISYLGRLNEPLIELTAQQSLLQQAVVSGERVFELMDSPQQQYGVDKQILESGRIDVENLSFAYRNDKVVLDNINLHVPSRGFIALVGHTGSGKSTLANLLMGYYPWQSGEIYLDGRSVSSLSHTTLRNGVAMVQQDPVILATSFFDNITLGRDICEEKVWQVLEVVQLAEFVRKLPEGIYSRLGEQGNTLSAGQKQLLAMARVLVQTPQILILDEATANIDSGTEQSVQQALRMIRKQTTLVVIAHRLSTIVEADSIFVLHRGAIVEQGQHQQLLERRGRYYQMYQLQQVGET

SEQ ID NO: 375 - protein, 365 aa, Xenorhabdus nematophilus
MLKVIQSPSKYIQGPDAISYIGHYTKILADHVFVIADNFVLNLIGDTVSKSLKENEVTSHFEVFNGECSRKEIERLSAILLTNQCQAVIGIGGGKTLDTAKAVAHESKLPILVSPTLASTDAPTSALSVLYTELGEFDSYLFYPKNPDIVLVDTKIIAKSPVRLFVAGMGDALATYFEARASSTAHNPTMAGGTTSLTGLALAKLCYDTLLSEGYKAKLAVEAGVTTPAVENIVEANTYLSGIGFESAGLAAAHAIHNGFTILEECHHLYHGEKVAFGTLTQLILENSPSEELETVLDFCVQVGLPITLEQLGLRDSENLHQKIMQVAKVSCAEGETIHNMPFTVTPEQVYAAILAADQMGKDWL

SEQ ID NO: 376 - protein, 425 aa, Xenorhabdus nematophilus
MKFDAVIIGSGLAGLTSGIRLAEAGKSCAIVSSGQSSLYFSSGSMDFLSRLPDGGEVTHPLHALSELTRQAPHHPYSRIGEKNVVSLAYQAEKLIRDSGLVMTGSASQNHYRVTPVGRQRMTWLSPARVPVCELERPFKWESVVVIGIAGFLDFQPGIVASALQRQGVKASAQEIHLPFLDRLRDNPSEFRSVNIAHLLDLPQNLTLIAEEISRLAQGYEAVFLPACIGLETDQVVQALQIQVKKPVYLLPTLPPSLLGIRVDQLLRARFRHFGGVIMTGDTVNGVEMADNHITGLYTRNHGDIPLRASHVILATGSFFSNGLKAKLNRIYEPLLDLDLLAYSSREQWTRQNVFAPQPYLKFGVTTDEYLRPLKSGQVVKNLYAAGAVLGGYDPLFEGCGSGVSLLSALFVAEQIITGQRVTKQR

SEQ ID NO: 377 - protein, 557 aa, Xenorhabdus nematophilus
TDVIIIGGGATGAGIARDCARRRLRCILLERHDIATGATGRNHGLLHSGARYAVTDSESAKECIKENRVLKSIARHCIEKTHGLFITLPEDSLEYQQTFIAACEKAGIDAQSIDPEEAKRFEPAVNPDLIGAVIVPDGTVDPFRLTAANMLDAREHGAQILTYHEVMGLIRQEDKITGVHVYDHRTKRLYDIYAPIVVNAGGIWGQKIAEYADLRVHMLPAKGSLLILGHRINNMVINRCRKPADADILVPGDTISLIGTTSSRIEYDQIDNMSVTKEEVDILIREGAKLSPRLAQTRILRAYAGVRPLVASDDDPSGRNVSRGIVLLDHAQRDGLDGFITITGGKLMTYRLMAEWATDKICEKLNITAHCTTAQEPLPGSENSAEQTRQHTSHSKSPHSKKPHCSTVTLSAPIRGSAIYRHGDRASQLLSTERSDKSLVCECEAVTAGEVRYATESLAVTNLLDLRRRTRVGMGTCQGELCACRAAGLLNRLGVITEQESEQQLKQFLNERWKGIRPVVWGDALRESEFTSWVYQGLCGLDDHDTDADNQPVTETD

SEQ ID NO: 378 - protein, 597 aa, Xenorhabdus nematophilus
VQTFNADLAIIGAGGAGLRAAIAAAEANPQLKIALISKVYPMRSHTVAAEGGSAAVTQSHDSYDFHFNDTVSGGDWLCEQDVVEYFVKHCPTDMTQLEQWGCPWSRKEDGSVNVRRFGGMKIERTWFAADKTGFHMLHTLFQTSLKYPQIQRFDEHFVLDILVDEGRARGLVALNMMEGSKVQIRANAVIMATGGAGRVYRYNTNGGIVTGDGMGMAFRHGVPLRDMEFVQYHPTGLPGSGILMTEGCRGEGGILVNKDGYRYLQDYGLGPETPLGHPENKYMELGPRDKVSQAFWHEWRAGRTIATPRGDVVHLDLRHLGEKKLLERLPFICELAKAYVGVDPVKEPIPVRPTAHYTMGGIETNQQCETRIKGLFAIGECSSVGLHGANRLGSNSLAELVVFGRLAGEEAAKCAQEAPPANENALAAQVHGIEAKLNKLLNQQGGESWAKIRDELGTAMEEGCGIYRTPELMQKTIDKIVELKERFKQIQISDRSSVFNTDLLYTIELGFGLDVAECMAHSAMNRKESRGAHQRLDEGCTERDDENFLKHTLAFYNPEGAPHLEYSDVKITKSQPAKRVYGGEAAAQEKKQKEQAN

SEQ ID NO: 379 - protein, 242 aa, Xenorhabdus nematophilus
EMKNLKMEVMRYNPETDDAPYFTTYDVPYDDQTSLLDALGYIKDNLAPDLSYRWSCRMAICGSCGMMVNRVPKLACKTFLRDYQHGLKVEALGNFPIERDLVVDMTHFIESLEAIKPYIIGNDRKPSDGPNVQTPAQMAKYHQFSGCINCGLCYAACPQFGLNPEFIGPAAVTLAHRYNLDNRDHGKKERMPQINSDNGVWSCTFVGYCSEVCPKHVDPAGAIQQSKAESAKDFIISMLKPQ

SEQ ID NO: 380 - protein, 540 aa, Xenorhabdus nematophilus
KQPAYRILFSLLNRSRWILLIAILASIVNGISNVFLITLVNRIVTTSGNSYHLLAVYFCIIAVLAIVSHVMSGVIFARLSQNTIARMREFISERITRAPFRQIEILGASRAQSIITDDTTNVSLLFFTLPNIVTQSSIILGCLIYLAWLSWSVFFLVLTVIVIGSLGYAIGGTSALASLKAAGKSQDRLFNHFNALFTGAKELKLHFSRAQAFFTHSLGREIGAVRQHRIRAFSVYAFGAGWMYLLFYIFLGLVIFAPAVIVGLKVTTIAGYVIVFLFILMPLDSLLNSIPSLNAARVSLNRIGYVLSELTEQDHLDEQVSASEFGEANLLQLSGITHNYYREKEDDMFQLGPIDMTLKRGEITFLIGGNGSGKTTLAKLLSGLYTPESGTITVDGNLITDSNRANYRQLFSAIFSDFHLFETLIGLTDTDSVLDARANALLAKLHLEHKVKIQDGCFSTRELSQGQRKRLALVVAYLEDRPFYLFDEWAADQDPLFKIVFYQDLLPELAARGKAVLAITHDDRFFHLADHCIKLENGQL

SEQ ID NO: 381 - protein, 819 aa, Xenorhabdus nematophilus
LPIYDVVDSVIAQLETSKQVLLHAPTGAGKSTGLPLAILNKSRFSGRIIMLEPRRIAARSVAERLAEQLNEPVGRTVGYRMRLETKVSAHTRLEVVTEGILNRMLQQDPELSGVSLVILDEFHERSLQADLALALLLDVQEGLRDDLRILVMSATLDNQRLSSLLPEAPVVVSEGRSYPVTRSYHPLPAHLPFEQSVASTVLRLLQQESGSLLLFLPGVREIQRVQAYLEEKVGSDTLLCPLYGALSLTDQRMAIMPAPAGKRKVVLATNIAETSLTIEGIRLVVDSGLERTSRFEPRTGLTRLITQRISQASMVQRTGRAGRLEAGVCWHLFSQEQAERAAEHSEPEILHADLSIVLPSSLKQWGPIGSGLIRWVDNPPQAALAVARTLLVRLGALDDKQQLTARGWQMTESGCEPRLAAMLCLAKEQYDRQDSDRGILATAAKLVAILEEPPRRGQLDLTHCLNTLQPNWQQRSKQLLRELAGNNMANVADSNVKYIPELLVQGFPDRIAKNRDNLGRFQLATGLGAMLAREEPLSGETWLVAPLLQQGNKMPDAHILLACPLDIEQIIRQYSSLFTEQTAIEWDDNKGTLRAWKRLKCERLTVRSQPLAKPSDAELQEALLNWIRQEGLAALNWSQEALQLRVRLQRAQEWLPETQWPAVDDEALLASLEQWLQPVLEGVRNLKGLQQVELSAALVSLLDWQQRQVLDNELPTNYTVPTGSRIGIEYFYDKSPVLSVKMQEMYGEQQNPAVAKGRVPVVVELLSPAQRPLQITQDLAAFWQGAYREVQKEMKGRYPKHLWPDDPANTAPTRRVKKY

SEQ ID NO: 382 - protein, 426 aa, Xenorhabdus nematophilus
MSQSETLYSQAKHVIPGGVNSPVRAFNGVGGTPVFIQRANGAYLYDVDGHAYIDYVGSWGPMVLGHNHPAIRNAVIEAAERGLSFGAPTAAEVEMAKLVTELIPSMDMVRMVNSGTEATMSAIRLARGYTQRDKIIKFEGCYHGHADCLLVKAGSGALTIGQPNSPGVPADFAKHTLTCVYNDLNSVREAFEKFPEEIACIIVEPVAGNMNCIPPQPEFLPGLRKLCDEFGALLIIDEVMTGFRVALGGAQEYYGVKPDLTSLGKIIGGGMPVGAFGGRQEIMEKLAPTGPVYQAGTLSGNPIAMAAGLACLKEVAQIGVHQRLSELTDKLATGLKNAAAKADIPLVINHVGGMFGIFFTDAENVTCYQDVMKCDVERFKKFFHFMLDEGVYLAPSAFEAGFMSIAHSEEDIQRTVDAAARCFAKL

SEQ ID NO: 383 - protein, 321 aa, Xenorhabdus nematophilus
MNLESIIKLTADDMAAVNETILNQLNSDVALINQLGYYIISGGGKRIRPMIAVLVAKALGHEGEKHIKVAALIEFIHTATLLHDDVVDESDMRRGRATANAMYGNAAGVLVGDFIYTRSFQMMTDLNSMRVLKLMSDATNVIAEGEVMQLMNCNDPDISEDDYMRVIYSKTARLFEVASHSSAILSNATPEQEAALRDYGRYLGTAFQLIDDLLDYDSDDNTLGKNTGDDLNEGKPTLPLLHAMNHGTPEQSALIREAIEKGNGRHLLDTVLTTMKQCGSLNYTRQRAEEEADKAISALQVLDESPYKAALVGLAHIAVQR

SEQ ID NO: 384 - protein, 311 aa, Xenorhabdus nematophilus
MKVAVLGAAGGIGQALALLLKTQLPSGSELSLYDIAPVTPGVAADLSHIPTAVKVTGFAGEDATPALAGADVVLISAGVARKPGMDRSDLFNINAGIIRNLVQQIAKTCPKALIGIITNPVNTTVAIAAEVLKKEGVYDKNRLFGITTLDIIRSNTFIAELKGKKPEELEVPVIGGHSGVTILPLLSQIPGVSFTAEEVEALTKRIQNAGTEVVEAKAGGGSATLSMGQAAARFGLSLIRALQGDSNVIECSYVEGDGEHARFFAQPIRLGKNGIEERLDIGQLSEFEQNALNNMLDVLKKDIELGEKFIN

SEQ ID NO: 385 - protein, 333 aa, Xenorhabdus nematophilus
MKTLGEFIVEKQHDFPHATGELTALLSAIKLGAKIIHRDINKAGLVDILGTSGVSNVQGEVQMKLDLYANEKLKAALKARGEVAGIASEEEDDIVIFDGDRAENAKYVVLMDPLDGSSNIDVNVSVGTIFSIYHRITPIGQPVTEEDFLQPGHRQVAAGYVVYGSSTMLVYTTGCGVHTFTYDPSLGVFCLTHEKVQFPAKGNMYSINEGNYIKFPQGVKKYIKYCQEQDEETQRPYTTRYVGSLVADFHRNLLKGGIYIYPSTASHPTGKLRLLYECNPIAFLAEQAGGKASDGTNRILDIVPNQLHQRVPLFVGTKSMVEKAESFMAEFPE

SEQ ID NO: 386 - protein, 378 aa, Xenorhabdus nematophilus
MAKKDYYEVLGVSKTADEKEIKKAYKRLAMKFHPDRNQGDKEAEAKFKEIKEAYEILTDSQKRAAYDQYGHAAFEQGGMGGGAGGFGGGADFSDIFGDVFGDIFGGGRRQQRPSRGSDLRYSMDLTLEEAVRGVTKEIRIPTLESCESCHGSGAKAGTSPETCSTCQGAGQVHMRQGFFTVQQPCPQCHGRGKIIKEPCNKCHGHGRVEKYKTLSVKIPAGVDTGDRIRLSGEGEAGEHGAPAGDLYVQVQVKAHHIFERDGSNLYCEVPINFATAALGGEIEVPTLDGRVSLKIPAETQTGKLFRMKGKGVKSVRGGAQGDLLCRVVVETPVKLNEEQKELMRQLGESFGGKSGETNSPRSKSFLDGVKKFFDDLTK

SEQ ID NO: 387 - protein, 637 aa, Xenorhabdus nematophilus
MGKIIGIDLGTTNSCVAIMDGTTARVLENSEGDRTTPSIIAYTQDGETLVGQPAKRQAVTNPQNTLFAIKRLIGRRFQDEEVQRDVAIMPYKITNADNGDAWLEVKGQKMAPPQISAEVLKKMKKTAEDYLGEPVTEAVITVPAYFNDAQRQATKDAGRIAGLEVKRIINEPTAAALAYGLDKEVGNRTIAVYDLGGGTFDISIIEIDEVDGEKTYEVLATNGDTHLGGEDFDSRMINYLVDEFKKEQGIDLRNDPLAMQRLKEAAEKAKIELSSAQQTDVNLPYITADATGPKHMNVKVTRAKLESLVEDLVKRSIEPLKVALNDAGLSVSDIQDVILVGGQTRMPMVQKAVADFFGKEPRKDVNPDEAVAMGAAVQGGVLAGDVKDVLLLDVTPLSLGIETMGGVMTSLITKNTTIPTKHSQVFSTAEDNQSAVTIHVLQGERKRSGDNKSLGQFNLDGIQPAPRGMPQIEVTFDIDADGILHVSAKDKNSGREQNITIKASSGLNEEEIQQMVRDAEANAEADRKFEELVQTRNQADQLVHGTRKQVEEAGDKLTADEKTAIEKAVAELETAAKGEDKAEIEAKIQALVEASKKLQEIAQQQAQAGAADADAGNAAKKDDDAVDAEFEEVKDKK

SEQ ID NO: 388 - protein, 262 aa, Xenorhabdus nematophilus
  unsure (1)..(262): unsure at all Xaa locations
MGFMTGKRILITGVASKLSIAYGIAKAMHEQGAELAFTYQNDKLKPRVEEFAASLNSNIVLPCDVAQDESIDTLFVELGKVWPKFDGFVHSIGYAPAEQLDGDYVNAVSREGFKIAHDISAYSFVALAKACRSMLNPDSALLTLSYLGAERAIPNYNVMGLAKASLEANVRYMANAMGAEGVRVNAISAGPIRTLAASGIKDFRKMLAHCESVTPIRRTVTTEDVGNAAAFLCSNLSGGITGEILHVDGGFSIAAMNELEXK

SEQ ID NO: 389 - protein, 421 aa, Xenorhabdus nematophilus
MKNTELNQRRLNATPRGVGVLSDYFAQKAENATLWDVEGNEIIDFAAGIAVLNTGHRHPEIVSAIEQQLKAFTHTAYQIVPYESYVTLAERINALAPINGPTKTAFFTTGAEAVENAVKIARAYTRRPGVITFSGGFHGRTFMTMALTGKVAPYKIGFGPFPGSVYHAKYPNGLHSVSVDNALASLEHIFKADIAPDQVAAIIIEPVQGEGGFNMAPTEFMQALRTLCDEHGILLIADEVQTGFARTGKLFAMEHHNVKADLITMAKSLAGGMPLSGVTGRAEVMDAPAPGGLGGTYAGNPLAVAAAHAVLNIIEKEQLCERANQLGQHLVEILAQARTQCPAIAEIRALGSMVAVEFNDPQTGKPSPEFTREVQTRAKREGLLLLSCGTHGNVIRFLYPLTIPEAQFGKALQILSHILKN

SEQ ID NO: 390 - protein, 543 aa, Xenorhabdus nematophilus
VAIHPRAGQLAQQHDLINVALLTSQYYTLQPNPENPAHKVKFGTSGHRGSAGRNSFNEAHILAISQAIVEVRKQYDITGPCYIGKDTHALSEAAFISVLEVLTANGVDVVVQENNGFTPTPAISHAILSYNRQGKNLADGIVITPSHNPPEDGGIKYNPPNGGPADTDLTSVIENRANELLAGNLKGVKRQSYEQALKSEYLHPQDLVDPYVTALGEVVDMAAIQKAGLKIGIDPLGGSGIAYWQRIGEYYNLDLTLVNDNIDQTFRFMTLDRDGVIRMDCSSRWAMAGLLELRDKFDLAFANDPDYDRHGIITPAGLMNPNHYLATAVDYLFRHRPQWSEKVAVGKTLVSSAMIDRVVADLGRELVEVPVGFKWFVDGLYKGELGFGGEESAGASFLRFDGTPWSTDKDGIILCLLAAEMMAVTGENPQQRYDKLAARFGTPSYSRLQAPASHQQKAQLAKLSPEMVKADTLAGDPITARLTTASGNGASIGGLKVMSDNGWFAARPSGTEEAYKIYCESFLGAEHREKIEQEAQELLTKYL

SEQ ID NO: 391 - protein, 478 aa, Xenorhabdus nematophilus
ISMSIATLRHFINGQYIESKGSEYFDLISPVTGESYARSPNANAEDVNNAYASAKAAFKVWGRSTPSERQKALLALADSVEKNAERLVEVQSRNTGQLKHLIASEEVATSADHIRFFAGAARFLESKATTEYLSGMTSSIRREPLGVVGQVTPWNYPLMMAAWKIAPALAAGNTIVLKPSDTTPESTLLLAELAATFFPAGTFNVVLGNASAGALVVSHKTPAMVSITGSVRAGLQVASSAAANLTRSHLELGGKAPVIVFADADMDKVVETIAIAGYFNAGQDCTAASRVLVHESVYDTFVTKLVAAAKATRFGDPEDEKALYGPLNNIRQLEQVKGFIARRPAYARIETGGRQAERPGYYFEPTVITGLEQHDEMIQTEIFGPVITVQKFRTEEEAIEKANDVKYGLASSVWTRDHARTLRLSRELDFGTVWINAHIPLAAEAPHGGFKHSGYGKDLSAYSFDEYTRIKHVMSSND

SEQ ID NO: 392 - protein, 244 aa, Xenorhabdus nematophilus
LSNKVAIVTGGATKIGAAVARVLSEYGVKVAIFDIDREGGKKACDVRPDDIHFWPVDITDDKQLSQGIQEVAAYYGHLNCLVNLAATYLDNGADSGREMWLTALNINVVSAIKAAQFAHPYFMAAGGGAIVNFTSVSSSVAQTGRWLYPASKAALLQATRSMAMDYAADRIRVNSVSPGWTWSRVMDELTQGSRRKTDEVAADYHLLGRAGDPEEIAQVVSFLLSDLSSFVTGADYSVDGGYSV

SEQ ID NO: 393 - protein, 345 aa, Xenorhabdus nematophilus
VTNKTSLSYKDAGVDIDAGNALVNRIKSVVKQTRRPEVMGGLGGFGALCSLPQKYREPVLVSGTDGVGTKLRLAMDLIRHDTIGIDLVAMCVNDLVVQGAEPLFFLDYYATGKLDVDTASSVITGIAEGCKQAGCALVGGETAEMPGMYHGEDYDVAGFCVGVVEKSEIIDGSKVQAGDALIALSSSGPHSNGYSLIRKILEVSQTNPETTELDGKTLADHLLAPTRIYVKPLLELIEQVEIHAICHLTGGGFWENIPRVLPENMQAKIDGTSWQWPAIFKWLQQAGNVSDHEMYRTFNCGVGMIIALPQSQATQAIEWLNKAGENAWQIGSIAESDHSGQQVTI

SEQ ID NO: 394 - protein, 427 aa, Xenorhabdus nematophilus
MADKKATLTINGSAAIELDVLTPTLGSEVIDVRTLGSKGFYTYDPGFTSTASCESKITYIDGNEGILLHRGFPIDQLAMKSTYLEVCYILLNGEPPTPEEYEKFKTTVTRHTMIHEQITRLFHGFRRDSHPMAILCGVTGALAAFYHDALDVNNPRHREITAYRLMSKMPTVAAMCYKYSVGQPFVYPRNDLSYAGNFLYMMFSTPCEEYKVNPVLERAMDRIFILHADHEQNASTSTVRTAGSSGANPFACISAGIASLWGPAHGGANEACLRMLEEIQTVDHIPEFIARAKDKNDAFRLMGFGHRVYKNYDPRATVMRETCHEVLDELGLNDSLLEVAMELERIALNDPYFIEKKLYPNVDFYSGIILKAMGIPSSMFTVIFAIARTIGWIAHWNEMHDEGMRIARPRQLYTGHAERDFNSQLKK

SEQ ID NO: 395 - protein, 588 aa, Xenorhabdus nematophilus
MKLPVREFDAVVIGAGGAGMRAALQISQMGLSCALISKVFPTRSHTVSAQGGITVALGNTHEDNWEWHMYDTVKGSDYIGDQDAIEYMCKTGPEAILELEHMGLPFSRLDNGRIYQRPFGGQSRNFGGEQAARTAAAADRTGHALLHTLYQQNLKNHTTIFSEWYSLDLVKNQDGAIVGCTAICIETGEVVYFKAKATILATGGAGRIFQSTTNAHINTGDGVGMALRAGVPVQDMEMWQFHPTGIAGAGVLVTEGCRGEGGYLLNKDGERFMERYAPNAKDLAGRDVVARSMMIEIREGRGCEGPWGPHVKLKLDHLGKDVLESRLPGILELSRTFAHVDPVKEPIPVIPTCHYMMGGIPTKITGQALTINDKGEDVVIPGLFAVGEIACVSVHGANRLGGNSLLDLVVFGRSAGLHLKECLMEQGTTRDASESDVDVALQRLNRWNNTRSGEDPVEIRKALQACMQHNFSVFREGEAMARGLDELKVIRKRLHNARLDDTSSEFNTQRIECLELDNLMETAYSTAVAANYRTESRGAHSRFDYPERDDANWLCHSLYLPQTESMTRREVNMQPKLREAFPPKVRSY

SEQ ID NO: 396 - protein, 238 aa, Xenorhabdus nematophilus
MKLEFSIYRYNPDVDNAPRMQDYTLEAEEGRDMMLLDALIQLKEQDPTLSFRRSCREGVCGSDGLNMNGKNGLACITSISALRRGNKKIVIRPLPGLPVVRDLVVDMGQFYAQYEKIRPYLINDGKNPPAREHLQSPEQREKLDGLYECILCACCSTSCPSFWWNPDKFIGPAGLLAAYRFLIDSRDTETSSRLDGLNDAFSVFRCHGIMNCVNVCPKGLNPTKAIGHIKSMLLRHSA

SEQ ID NO: 397 - protein, 934 aa, Xenorhabdus nematophilus
MQNGAMKDWLDSSFLAGANQSYIEQIYEDYITDPNSVDAGWREIFQQLPDEGLHGEQLHSQTRDYFRRLAKDATRYHTSVSDPAMDAKQVKVLQLINAFRFRGHQNANLDPLGLWKQEPVPDLDPAFHNLTKADFEETFNVGSFAIGKETMKLADLYDALKRIYCGSIGAEYMHITNTEEKRWLQQRLESVAVGSQFNTEEKRRFLAELTAAEGLERYLGAKFPGAKRFSLEGGDALIPMLKELIRHAGKQDTREVVLGMAHRGRLNVLVNLFGKKPADLFDEFAGKHKEHLGTGDVKYHQGFSSDFETDGGPVHLALAFNPSHLEIVSPVVIGSVRARRDRLDEGRSNMVLPVTIHGDSAVTGQGIVQETLNMSQARGYEVGGTIRIVVNNQIGFTTSNPKDTRSTEYCTDIAKMVQAPIFHVNADDPEAVTFVTRLALDFRNTFKRDVMIDLVCYRRHGHNEADEPSATQPLMYQKIKKHPTPRKIYADKLIAENLLSPNDVTEMANLYRDALDHGDCVVDEWRPMGLHSFTWEPYLNHEWDAEYPHQVDMKRLQDLGKRISSIPAEVAMHSRVAKIYADRAEMANGNKLFDWGAAETLAYATLVDEGVPVRLSGEDAGRGTFFHRHAVIHNQTDASVYVPLANVHNGQGEFNVWDSVLSEEAVLAFEYGYATTEPRTLTIWEAQFGDFANVAQVVIDQFISSGEQKWGRMCGLVMLLPHGYEGQGPEHSSARLERYLQLCAEQNMQVCVPSTPAQVYHMLRRQALRGMRRPLIVMSPKSLLRHPLAVSSLDELADGKFETVIGEVDALDPKGVKRVVLCSGKVYYDLLEQRRKNEQSDVAIVRIEQLYPFPRQDLQNLFEQYAHVHDFVWCQEEPLNQGAWYCSQHNFREAIPFGASLRYAGRPASASPAVGYTSVHQKQQQALVNDALNV

SEQ ID NO: 398 - protein, 403 aa, Xenorhabdus nematophilus
SVEILVPDLPESVADATVATWHKKPGDAVERDDILVEIETDKVILEVPASEAGVLEAVLEEEGATVLSKQLLGRISLSNSAGMPTAVKETTEATPAQRQTASLEDESNDALSPAVRRLIAEHDLDPAAIKGSGVGGRIVREDVEKHIAANKKESAKPAASAPAAQQSELPHRSEKRVPMTRLRKRVAERLLEAKNNTAMLTTFNEVNMKPIQELRKQYGDVFEKRHGVRLGFMSFYVKAVVEALKRYPEVNASIDGTDVVYHNYFDISIAVSTPRGLVTPVLRDADALSMADLEKTIKELAIKGRDGKLTVDELTGGNFTITNGGVFGSLMSTPIINPPQSAILGMHAIKDRPMAVNGQVEILPMMYLALSYDHRLIDGRESVGFLVTIKEMLEDPTRLLLDV

SEQ ID NO: 399 - protein, 388 aa, Xenorhabdus nematophilus
MNLHEYQAKQLFARYGLPAPAGYACTTPREAEEAASKIGSGPWVVKCQVHAGGRGKAGGVKVVNSKEDIRAFAEQWLGKRLVTYQTDVQGQPVHQILVEGATDIAKELYLGAVVDRGTRRVVFMASTEGGVEIEKVAEETPELIHKAIIDPLAGPMPYQGRELAFKLGLTGKQVGQFTKIFMGLANLFLERDLALVEINPLVITTEGDLICLDGKLGADGNAMFRQAELREMHDPLQEDPREAQAAQWELNYVALDGNIGCMVNGAGLAMGTMDIVKLHGGAPANFLDVGGGATKERVTEAFKIILSDENVKAVLVNIFGGIVRCDLIADGIIGAVEEVGVHVPVVVRLEGNNAEQGAKKLADSGLNIIAATSLTDAAKQAVAAAGNK

SEQ ID NO: 400 - protein, 288 aa, Xenorhabdus nematophilus
MSILIDKNTKVICQGFTGSQGTFHSEQAIAYGTQMVGGVTPGKGGTEHLGLPVFNTVREAVEATGATASVIYVPAPFCKDSILEAIEAGIKLIITITEGIPTLDMLTVKVKLDEAGVRMIGPNCPGVITPGECKIGIMPGHIHQAGKVGIVSRSGTLTYEAVKQTTDAGLGQSTCVGIGGDPIPGSNFIDILKLFQQDPQTEAIVMIGEIGGTAEEEAAAYIKEHVTKPVVAYIAGVTAPKGKRMGHAGAIIAGGKGTADEKFAALEAAGVTTVRSLADIGDAVKGLL

SEQ ID NO: 401 - protein, 259 aa, Xenorhabdus nematophilus
  unsure (1)..(259): unsure at all Xaa locations
LTGKVMQKAILITGCSSGIGLTAAKTLHQRGYRVLAACPXPADLAHMRELGLEPIELDLDDPESVKKAAEQVIELTNGRLFGLFNNGGFGVYGPLASISREQMEKQFSTNFFGTHQLTCLLLPAIRANGEGRIIQTSSVLGLIATPGRGAYSASKYALEAWSDALRMELAGSGIKVSLIQPGPIKTRFTENVAQTEIDNPVENSAMARRLTMTPEDVVEKLIHALESPNPKLRYPVTLISHAVTVLRRLLPARLIDKIV

SEQ ID NO: 402 - protein, 849 aa, Xenorhabdus nematophilus
IALQLSGLSCMKCVGKTQKALESVEGVVATEVDKQTARIYGKADENALISAVKQAGYHAESVMSSHLPKNEPLTTPEPEFLPAATDSTSIPITKSDKKTGSGASHNSDDSIQLLLDGMSCASCVSKVQKALQSVEGVKNARVNLAERSALVTGSASPDALVNAVIKAGYGAKSFWMKLNAGNDSNKLAQANMRRFRWQSALALIVGVPVMIWGMIGDNMMLTPENHTIWLSIGLVTLAVMVFAGGHFYRNAWQSLKNGSATMDTLVALGTGAAWLYSISVNLWPDIFPPQARHIYYEASAIIIGLINLGHALEQRARQRSSQALERLLDLTPPTARVITSEGEVSLPLADVEPDMTLRLVTGDRVPVDGEIIQGTVWLDEAMLTGEAIPQQKTLGDTVHAGTVVQDGTVLFKASAVGSQTTLARIINLVRQAQSSKPEIGQLVDKISSIFVPVVVVIALVAGAIWYFAGPAPQIMYALVIITTVLIIACPCALGLATPMSIISGVGRAAELGVLIRDADALQQASQLDTLVFDKTGTLTEGMPQVTEIHTFNGYTEEQVLLWAGALESGSNHPLAKAILLKAEDRKIESKQLTDVTQFRTLAGTGISGNIGNTALLLGNLSLLEQNQVETSTLQQQVVQQAEKGITPVLLAVDGKIAALFSIHDPLRQDTISALQRLHKQGYHLVMLTGDHPATAHAIAKEAGIDQVIAGVLPDGKAATIQTLQSEGRKVAMIGDGINDAPALAQADVGIAMGSGSDIAIETASITLMRHSLHGVADAAELSKGTLRNMKQNLFGAFIYNTLGIPIAAGILYPFTGTLLNPVIASAAMALSSITVVSNANRLLRFKTKD

SEQ ID NO: 403 - protein, 494 aa, Xenorhabdus nematophilus
ITLLASVTAFLQRSHGHYINGQSVRGQGDKTFSVVNPASDEMIATVNQGSEVEANAAMQAASDAFHGSWARTSPMERGNCLIRLADLLQKHSEELAQLETLCSGKTIQLSRMLEVGASAQYLRYFAGWSSKISGETLNVSLPSFKGEEYTAFTRREPVGVVVGIIPWNFSIMIAIWKLGAALACGCTIVLKPSEYTPLTMLRVAELAKEAGIPDGVINIVNGSGASVGTKLLTHPLCSKVSFTGSVPTGKLIGKSVMEQGQFRATLELGGKNAAAFLSDVPVEKIVDGILEAGYLNQGQICAAAERFYIPSVHMDAVLKLLSERLSTMKIGSPLDETTEMGPLANKEHYEKILSLFEKARQEGNEIVYGGRALEGKGFFVMPTVIRAKSADDTLMKEETFGPIGTFLSYDDEEELIAMMNATPFGLSASLWTNDLSKAMRMIPRIQAGVLWVNMHTHLDPALPFGGIKSSGLGREFGKAFIEYYTELKSVMIRY

SEQ ID NO: 404 - protein, 401 aa, Xenorhabdus nematophilus
MTKEIQRNWFEQYMVPCFAPAPFIPVRAKGSRVWDQDEKEYVDFAGGIAVNALGHANNELKETLSNQMENLWHIGNGYTNEPVLNLAKDLVENTFSDKVFFCNSGAEANEAALKIARKYALDKHGSHKSEIISFENSFHGRTLFTVTVGGQPKYSQDFAPLPQQITHLPYNDIEAIKAHISDKTCAVIVEPIIGEGGVIPATPDFLKALRELCDQYQALLIYDEIQTGIGRTGYLYAYEETGIEPDILTSAKGLGGGFPIGAMLVKQHVAEVFQPGSHGTTFGGNPLASAVAHKVLNIVNQKAFLAGVQERHQEFIRHMTDLNQRYQVFSEIRGKGLLLGAELADKYQGKAKTLTNLAAEEGLIALIAGPNVLRFAPALNIEQQDINDGFARLENALKRFV

SEQ ID NO: 405 - protein, 488 aa, Xenorhabdus nematophilus
SDQANYIDGKWVTGQGVQVVKHSPIDQQILWQARSASVKQVEEAGLAARRAFSDWAKLAVEKRIAIVQAFADLLAKEKETIARVISEETSKPLWETRTEVQSMIGKVAISIEAWQQRTGYSETAMPDGKAILQHRPHGVMAVFGPYNFPGHLPNGHIVPALIAGNTLIFKPSELTPITAEKTVELWIKAGLPAGVLNLVQGGRETGGALLDCREIDGILFTGSATTGFHFHRLLAGQPEKMLALEMGGNNALIVDDYDDLDAAVYTIIQSAFISAGQRCTCARRLLVKQGEKGDALIQRLTEAARQIVPSRWDAEPQPFMGGVISLAAAESLLNAQSGLLALGGKALLTLTQPDPHSTFMTPGIIELTGVSQVPDEEYFGPLLTLQRYDTFEEAISIANDTRFGLATGLISPDESLFLRLQEEARAGIVNWNKPLTGASSKAPFGGIGASGNHRPSAYYAADYCAWPMASLVTDKLSLPDTFVPGLDF

SEQ ID NO: 406 - protein, 464 aa, Xenorhabdus nematophilus
MTNTVKTPAEQSAGAQKLHRGLGKRHVQLIAIGGAIGTGLFMGTGKTIAVSGTSIILTYLLIGFFAFMVMRAMGELLLSKLDYRTFADFVADYLGEKASYFLGWTYWMSWVVSCIADVVVCGGYIQYWFPDISLWFTALFILGLMCLCNFFSVRLFGETEFWFAMIKVVAIVALIIVGVGMVAIGWTSPNGVTASVRHLTNPEVFLPNGVFGFLAGFQIAIFSFTGIELVGTVTAETKEPEKILPKSINSIPIRIIIFYVFSMMCIIAVTSWPHISPEVSPFVTLFALAGLPAAAAVINFVALTSAMSSANSGLYACTRMLYGLSTEKLAHGWFGRLSVNSAIPVFSLIFSVVCMASGVLLLFIVPDVMKLFTIVSTVAAIMVVYSWCMILLAYLAYRKKRPDLHEKSIYKMPMGIPMTWCTLIFFAFTVVIMIFDYDTRIALYGTPIWFVILEVLWRMRKKRK

SEQ ID NO: 407 - protein, 344 aa, Xenorhabdus nematophilus
FNQADYPHRRYNPLTGQWIIISPHRLKRPWAGVEKLLQHPVSPGYDKQCALCPNNTRASGDINPDYQDIYVFQNDYSALLPETPAIATADDPLFISKPTRGTCRVICFSPNHSKTFPELSLTNIRRIIDVWNSHIEELGQRYIWVQVFENKGEMMGCSQPHPHGQIWASDFLPNELTRKDELLRQYYDQHGSNLLLDYARAEQKNGVRTIVDTKHWLAVVPYWAVWPFETMLLPKSPVRRMNELTKEQRDDLAVAMKKLTCRYDNLFQCSFPYSMGWHFAPFFTNKQTDIEHWQLHALFYPPLLRSATVRKFLVGYEMLAESQRDLTPEQAAQRLRDVSDVHFR

SEQ ID NO: 408 - protein, 304 aa, Xenorhabdus nematophilus
ISSLGNQIDNSLVSNAFGFLRFPLNFQPYSGDAEWVITGVPFDMATSGRAGSRHGPAAIRQVSTNLAWESSRWPWNFSLRKRLNVVDCGDLVFNFGDAQDMSDKLQAHAEKVLASGKKMLTFGGDHFVTLPLLRAHAKHFGKMALVHFDAHTDTYPNGSKFDHGTMFYHAPNEGLIDPAHSVQIGIRTEHDTDNDFTVLDAGQVNDRSVEDVVDQIKSVVGDLPVYLTFDIDCLDPAFAPGTGTPVIGGLTSDRALKILRALQPLNIVGMDVVEVAPSYDQSEITALAAATIGLELLYLQASKK

SEQ ID NO: 409 - protein, 556 aa, Xenorhabdus nematophilus
VFWTIGLFTVFINLLMLAPSIYMLQVYDRVLPSSNEMTLLMLTLIILGMFAIMGGLEYIRSMVVIRIGNQFDMCLNQRIYTASYESNLKNGSTDAGQMLNDLATIRQFLTGNALFAFFDAPWFPVYLCVIFLFNSYLGLLALVGATILISLAVLNQWLSKAPLAEASQLSLRSTNLASTNLRNAEVIEALGMLPALRHRWFGLHERFLNFQRIASERVASITALTKTVRMALQSLILGLGGWLAIEGHITPGMMIAGSILMGRALSPIEQLIQAWKSWNAARLSWQRLDTLLQAQPERKSGMSLPPPKGALLLENVSAMPPGIIRLEQDQASKNPHYVLQNLNFALNNGEVLGIIGPSASGKSTLARLLVGIWPTQEGIVRLDGADIYQWNKDELGASIGYLPQDIELFAGTIAENIARFHHADPEKIIEAAKKAGVHELVLNLEQGYDTIIGASGVGLSGGQKQRIGLARALYGNPSLVVLDEPNSNLDDLGEKALNRAIIQLRDQGKTVVIITHRPSLLSQTSKILFLVQGKMKMFGASQQVMAALSQSKPSAQ

SEQ ID NO: 410 - protein, 621 aa, Xenorhabdus nematophilus
MSIEINVPDIGADEVEVTEILVKVGDTVEIEQSLITVEGDKASMEVPSPQAGVVKEIKVTVGDKVETGKLIMIFESATGAAEAVPVQQEAAPAAAPVAAESKEVAVPDIGGDEVEVTEIMVKVGDTITEEQSLLTVEGDKASMEVPAPFSGTVKEIKIAVGDKVKTGSLIMVFEVAGSGAAPAPAAAPAPAAAPAASAAKEVNVPDIGGDEVEVTEIMVKVGDTIAEEQSLITVEGDKASMEVPAPFAGTVKEIKIAVGDKVKTGSLIMVFEVAGAAPVAAPAAAPALAAAPAKAAPAPAAAKPAEGKNEFAENDAYVHATPVIRRLAREFGVNLAKVKGTGRKGRILREDVQAYVKDAIKRAEAAPAAAGGGLPGMLPWPKVDFSKFGEIEEVEMSRIQKISGANLSRNWVMIPHVNLFDEADITEVEEFRKQQNKEAEKKQLGVKITPLVFVMKAAAKALEAMPRFNSSISEDGQKLILKKYVNIGIAVDTPNGLVVPVFKDVNKKGIMELSRELAEVSKKARAGKLTASDMQGGCFTISSLGGIGTTGFAPIVNAPEVAIMGLSRSSMKPVWNGKEFVPRLILPMSLSFDHRVIDGADGARFITYINQLMSDIRRLVM

SEQ ID NO: 411 - protein, 475 aa, Xenorhabdus nematophilus
MMSTEIKAQVVVLGAGPAGYSAAFRCADLGLDTVLVERYSTLGGVCLNVGCIPSKALLHVAKVIEEAKALAQHGIVFGEPQTDIDKIRLWKEKVISQLTGGLGGMAKGRKVNVVNGVGKFTGANTLVVEGENGATTINFDNAIIAAGSRPIQLPFIPHDDPRVWDSTDALELKTVPERMLVMGGGIIGLEMGTVYHALGSQIDVVEMFDQVIPAADKDVVKVFTKRISKKFNLMLETKVTAVEAKEDGIYVTMEGKKAPAEPQRYDAVLVAIGRVPNGKLIDAGQAGVAVDERGFINVDKQMRTNVPHIFAIGDIVGQPMLAHKGVHEGHVAAEVISGKKHYFDPKVIPSIAYTEPEVAWVGLTEKEAKEKGISYETATFPWAASGRAIASDCSDGMTKLIFDKESNRIIGGAIVGTNGGELLGEIGLAIEMGCDAEDIALTVHAHPTLYESIGMAAEMYEGSITDLPNPKAKKK

SEQ ID NO: 412 - protein, 554 aa, Xenorhabdus nematophilus
MSEADTRPTNFIRQIIDEDLATGKHTSVHTRFPPEPNGYLHIGHAKSICLNFGIAQDYQGQCNLRFDDTNPVKEDIEYVESIKQDVQWLGFQWSGDIRHSSDYFDQLHQYAIELINKGLAYVDELSPDEIREYRGTLKEPGKNSPYRDRSVEENLALFEKMRAGEFAEGKACLRAKIDMASPFMVMRDPVLYRIKFAEHHQSGNKWCIYPMYDFTHCISDALEGITHSICTLEFQDNRRLYDWVLDNITIDCHPRQYEFSRLNLEYAVMSKRKLNQLVTENIVDGWDDPRMPTISGLRRRGYSAASIREFCRRIGVTKQDNNVEMAALESCIRDDLNEHAPRAMAVLDPVKLVIENMPEGEVILTMPNHPNKPEMGSREVPFSRELYIDRADFREEANRQYKRLVMGKEVRLRNAYVVKAERVEKDAEGNITTIYCHYDEQTLNKDPADGRKVKGVIHWVSAVHAAPAEFYLYDRLFSVPNPGAEEDFLSTLNTESLVVRKGFVEPGLVNAMLEKTYQFEREGYFCADSKLSTAEHLVFNRTVGLRDTWAKISK

SEQ ID NO: 413 - protein, 177 aa, Xenorhabdus nematophilus
NIKAILFDMDGTLVQSLSEVEMIWSKWCEMQNVPIQHVLEICHGVRSRDVILTIAPHLNVEEQVQLLDDLEVQHSGSAQALFGAKEFLLSLNDCPWAVVTSASQRVAYHRMNVCGLKIPELIVGSDDVQDGKPHPAPYLMAAERLGMKAKDCLVFEDSYAGIQSALAAGCEVIQIGG

SEQ ID NO: 414 - protein, 838 aa, Xenorhabdus nematophilus
SLEGATAFCKLRGNPYVELVHWLHQIMQQQNSDLQKLIHHLGLDESALTKDIVAALDSLPRGASAISDLSEHIDNAVERAWVYGSLKFGVAQIRSSHLLIGILKTFNLRNALKAISPLFDHINADTLIDNFNNIFDGSDEAQESIISSTETQGASPQSVTGSALQQYGQELTARARNGEIDPVSGRDEEIRQIIDIVMRRRQNNPLLTGEAGVGKTAVIEGLALRIVAGEVPPPLKNVQLWLLDIGMLQAGAGIKGEFESRLRKVIEEVQSSPTPIILFIDEIHTLIGAGGQQGTGDAANLLKPALARGQLRTLGATTWSEYKKYIEKDPALTRRFQVVQVHEPDETKALIMLRSLVNTLEKHHRILLLDEAVDAAVHLSHRYIPARQLPDKAIALLDTACARVAVSQHAEPPQLENCRHKIDSLNVELGIVERESKVGMGDPLRAENILSQLATLTEQQEQLEARWQQELLLTDKIIQLRLQLHEEQADEEQNNNDKITLHTELAELQQQLEMLQGEEPLIFAAVDSNVVSAVVSDWTGIPLSRMMKDEIEAVLQLADTLNQRVIGQYHALETIANRVRTSRAKLDDPNKPVGVFMLCGPSGVGKTETALALAETLYGGEQNLITINMSEFQEAHTVSTLKGAPPGYVGYGEGGVLTEAVRRRPYSVVLLDEIEKAHPDVHEIFFQVFDKGWMEDGEGRHIDFRNTIIILTSNVGADLVNSMCYQHYQQSNTLPEPEQLSSALRKPLLNTFPAALLGRLLVIPYYPLDDEVMTSIVYLQLGRIQKRLLENHGITATFDEAMIENIVSRCTEVESGGRTVDAILTNTLLPQISQRLLS

SEQ ID NO: 415 - protein, 281 aa, Xenorhabdus nematophilus
LQALPIGYCFNELEIEKVVGKGGFGIVYRAWDHSKQCAVAIKEYLPSMIVVRRNDLKLKLRHPNLQERFRIGLHSFMREAHIMTCFNHPCLPRFIRFWQQNSTAYIATPFYHGITLKVLQVKYAKIVTQSWLCHILSPLLDAINTLHQAGYLHCDISLDNILLQNDRLPVLLDLGSARKIAERLSDEEEITVRPGFTPCEQYTANEEGQQGPWSDIYALGAVLHTLIVGRPPPVSIVRNIEDRYQPLTERCLTGYSLSFLHAIDCMLAIKIAERPSSISKL

SEQ ID NO: 416 - protein, 368 aa, Xenorhabdus nematophilus
WMPFSANRHFQQDPRMIVSADGHWLTDDKGRRIYDSLSGLWTCGAGHSRSEIRQAVSEQLGTLDYSPGFQHAHPLSFRLADKIASLMPGDLNHVFFTNSGSESVDTAVKIARAYWRIKGQPTKTRMIGRMRAYHGVNIGGTSLGGIGGNRKMFGQLMEVDHLSHTLQSNMAFTKGVPATGGIELADELLKLIELHDASNIAAVIVEPVAGSAGAIVPPQGYLQRLREICTQHNILLIFDEVITGLGRLGRWTGAEYFGVTPDILTFAKQVTNGAIPLGGAVVSSEIYDTFMSQPLPEHMIEFSHGYTYSAHPVACAAGLATLTLLEKENLIQQSAELAPHFEKILHELRHCPNVVDIRNCGLIGTIQI

SEQ ID NO: 417 - protein, 168 aa, Xenorhabdus nematophilus
MTQEKSVDIEWVDIVNEENEVIAQATREQMRNQNLRHRATYIVVHDGMGKILVQHRTETKDFYPSKLDATAGGVVTMGEHLLESARREAEEELGIAGIPFAEHGIFYYEEEICRIWGGLFSCVSRGPFALQEEEVSAVYWLSPEEITARCDEFTPDSLKALSLWLSRN

SEQ ID NO: 418 - protein, 199 aa, Xenorhabdus nematophilus
MIDLYYAPTPNGHKIALFLEEVGLPYTIYPIDISANEQFTPEFLAISPNNKIPAIVDHQPADRGEPLSLFESGAILLYLAEKTGKLLSQNERERIRQLQWLFWQVGGFGPMLGQNHHFNRYAPEVVPYAINRYVTETQRLYKVLNTQLEKTPYLGGNEYSIADIATYPWAYCYEYQKINLQDYPAVEKWLEKISQRPAT

SEQ ID NO: 419 - protein, 336 aa, Xenorhabdus nematophilus
MSEGWNIALLGATGAVGEAILALLQERQFPVGELHLLASEQSAGSIKRFNGKNVTVRDVAEFDWSQVQLAFFAVGMEVTAQYIAQATEAGCLVIDSSGLFAAEPDVPLVVPTVNPHVLAEYRNRNIVAVADSATSQVLTAIKPLIDTAGIARLQLTNILPVSVHGKAAIDELAGQSARLLNGIPPDEGRFNKQLAFNLLPLLPDAEGTVREERRIVDQVRRILQDEGLPVSVSCVQSSVFYGIAQMVSVETLRPVGVEEARDEFERLEEIQVSEEGDYPTQVTDASGADGLSIGCLRNDYGMPEMLQFWSVADNIRFGGALMAVEVAEKLMQEQFY

SEQ ID NO: 420 - protein, 184 aa, Xenorhabdus nematophilus
IMTANAQKLQFIKDSIETIPDYPKAGILFRDITTLLDNPVAYQATIDLLVAHFQDKGITKIVGTEARGFLFGAPVALRLGVGFVPVRKKGKLPRETLSETYALEYGTDTLEIHKDSIKAGDKVLVVDDLLATGGTIEATVSLIRRLGGEVSEAAFIIGLPDLGGTERLKNQGIDSYTLVEFPGH

SEQ ID NO: 421 - protein, 630 aa, Xenorhabdus nematophilus
  unsure (1)..(630): unsure at all Xaa locations
LRXXMSMKDQETRGFQSEVKQLLQLMIHSLYSNKEIFLRELISNASDAADKLRFRSLSAPELYENDGELRVRLAFDKENKTITISDNGIGMTRDEVIDNLGTIAKSGTKAFLESIGSDQAKDSQLIGQFGVGFYSSFIVADKVTVRTRAAGAATEQGVFWESTGEGDYTVADIEKAERGTEITLHLREGEDEFLNDWRLRSVIGKYSDHIALPVEIETQTKNEEDDSVTVAWEKINKAQALWTRGKAEISDDEYKEFYKHISHDFADPLSWSHNRVEGKQEYTSLLYIPSQAPWDLWNREHKHGLKLYVQRVFIMDEAEQFMPNYLRFIRGLIDSNDLPLNVSREILQDSSITRNLRSALTKRVLQMLDKLAKDDAEQYQSFWQQFGLVLKEGPAEDGGNKEAIAKLLRFATTHNDSASQTVSLEEYVSRMTEGQEKIYYITADSYAAAKNSPHLELFRKKGIEVLLLSDRIDEWMMSYLTEFDGKSFQSVSKADESLDKLADENKADQEEEDKKLEPFVERVKTLLGERVKEVKLTHRLTDTPAIVTTDANGMTTQMAKLFAAAGQSAPEVSYNFELNPDHNLVKKAAEIQDDSQFADWIELLLEQALFAERGTLDDPNQFIRRMNQLL

SEQ ID NO: 422 - protein, 306 aa, Xenorhabdus nematophilus
MSNRNYGVLLVNLGTPDAPTPAAIRRYLAKFLSDRRVVDIPPLIWKPLLYGFILPFRSFRVARLYQEIWTDEGSPLLVYSKRQKQRLSEKLGNIPVELGMTYGSPSLTQAVDKLLQQGVEYLIVLPLYPQYSSTTSAAVFDSLSKILQGYRTIPHLKFIRSYAQHPAYIAALKETVEQSFEKHGQPDRLILSYHGIPERLAEMGDIYPQNCLATTKLLTELLDYPADRIMMTYQSRFGRLPWLAPYTDKTIALLPEQNVEHIQVLCPGFAADCLETLEEIKQQNKAIFLDAGGKKFEYIPALNDNE

SEQ ID NO: 423 - protein, 326 aa, Xenorhabdus nematophilus
HRHLLRLLDYKPKEIELFLSLSMKLKANKKSGKEIPLLAGKNIALIFEKDSTRTRCAFEVAAHDQGANVTYLGPSGSQIGHKESIRDTARVLGRWYDGIQYRGYGQAIVDTLAEYAGVPVWNGLTDEFHPTQLLADLLTMQEHSRKPLTEIKLAYLGDARNNMGNSLLEAAALTGLDLRLVAPKTCWPDAQLVSECQKQATKTGGKITLTEDIVAGVQAADFLYTDVWVSMGEPKNVWQERIELLAPYQVNMDLVKLTGNPDVKFLHCLPAFHDEETILGKQLAEEFNLSGGLEVTNDVFESEYSIVFDQAENRMHTIKAVMVATL

SEQ ID NO: 424 - protein, 252 aa, Xenorhabdus nematophilus
MDKLFWQTLGEAPRDLVMLHGWGLNAEVWRSVETRLASHFRLHLVDLPGYGRSQPYPAMTLKEMADTVWQQAPENALWLGWSLGGLIASQIALDHPDKVAGLITVASSPKFSEEGDWPGIQPSVLSAFKHQLSEDFQKTVERFLALQTLGTNSARQDARLLKSVVLSLPMPTVEVLNAGLEILRTDDLRSELAQLQLPFLRIYGYLDGLVPRKIAALLDSEWPHTRSVIMRHAAHAPFISHPDEFVDLLIAF

SEQ ID NO: 425 - protein, 253 aa, Xenorhabdus nematophilus
DVAGSKIQVRDLNFYYGKFHALKNVTLDIAQNKVTAFIGPSGCGKSTLLRTFNKMYELYGEQRAEGEILLDGTNILADKQDIALLRAKVGMVFQKPTPFPMSIYDNIAFGIRLFEKLPRAEMDERVRWALTKAALWNETKDKLHQSGYSLSGGQQQRLCIARGIAIRPEVLLLDEPCSALDPISTGRIEELISELKAEYTVVIVTHNMQQAARCSDYTAFMYLGELIEFSDTDILFTTPKMKQTEDYITGRYG

SEQ ID NO: 426 - protein, 424 aa, Xenorhabdus nematophilus
LVADELSANLLAEIPQDKLVGVIVRDGATHSHSAILVRAMGIPAIMGADIHPELLHNRMLILDGYRGEFFIDPEPLVVQEYRQIIEEEQVLSKLAEGGQQQKARLKSGERVRVQLNAGLSLKYEQQIGDSIDGVGLYRTEIPFMLHSGFPSEDEQRNRYQEMLTLFPDKSVVLRTLDIGADKHLPYMPIHEENPCLGWRGIRITLDQPEIFLIQLRAMLKANISTGNLKILLPMVSCIEEIDEAKKLINRAKTEAEQSAGTTIAMPQIGVMVEVPSLILLLPQLKKRVDFISIGTNDLTQYLLAVDRNNTHVASLYDNLHPAMIKALKQIVDESQRIGLPVSVCGEMAGLPMGVLILVGLGYRCLSMSGRSIPRIKYLLHHLDSAELSYFIQEILRAETTQQVKEICSAFMETHGLGGLVRGGI

SEQ ID NO: 427 - protein, 1797 aa, Xenorhabdus nematophilus
GYTLKYWHERIRHDVESVFALLQQHLDSFLPDDNAWIYLATPEQLQAQIGLLLPAYQRNPDAFPLFGIPFAVKDNIDVADWPTTAACPAFEYIADEDATAVARLKAAGAIVVGKTNMDQFATGLVGTRSPYGVVKNSFNDRYISGGSSSGSASVVARGLVPFALGTDTAGSGRVPAGFNNIVGLKPTKGWLSAKGVVPACRLNDTLSVFALTVEDAFSVADIAGGFDENDAYSCINPASTPATLPDHPLFAIPANPVFCHDTIAESAWQEALHELQNMGATLQPIDFLVFNQLGEQLYQGAWVAERTTVVNGMLSFPAMMDPEVRQIIDSGKNYSAVDAFNAEYLRAELARKIQHILAGFDALIVPTTPTIRTIEEIKRTPIHYNSELGIYTNFTNLANLSALALPAPFRTDGLPAGITLLAPAWHDRALASFGLRWQQHLALPLGATGQLLDGEAMVLPPSGQHIRLAVVGAHLRGMPLNDQLTERNAVFVETTQTASCYRLYELANTQPPKPGLVRDDTGASISIELWDIPLAYFGAFVAEIPPPLGIGSLELADGRWVKGFICEPVALKGATDITEFGGWRNWVINQRKTMFKTVLIANRGEIACRAIRTLKRLGIVSVAVYSDADKNSQHVKDADIALPINGEKASESYLCIDKIISAAQQSHAEAIWPGYGFLSECLLFAQACEKAGIVFVGPTSHQIGEFGLKHRARELAAEAGVPMTPGTGLLNSLDEALSAAETIGYPVMLKSTAGGGGIGLSCCYDANALSEAWESVRHLGEQFFSDTGVFLERCIRQARHLEVQIFGDGKGNVVALEERDCSLQRRNQKVVEEAPAPNLPEQTRTALLDSAVQLGQLVKYRSAGTVEYIYDVEQDEFYFLEVNTRLQVEHPVTECVTGLDLVEYMLRVAAGLPIDWEDLKRAPVGAAIEVRLYAENPLKNFQPAPGVLTEVKFSEGIRIDSGVSTGSEVSAFYDPMIAKMIVHAENREKALIKLREALDSCQLHGITTNLEYLRQITASEPFQKGQVWTRMLDSFEPQASVIEVLKAGTWSSVQDYPGRSGYWDIGVPPSGPMDDLAFRLANRIVGNHESAAGLEFTLEGPTLQFHCDALIALTGAESSALLDGTSVPYWQPLNIKAGQILEIGRAQSGCRTYLAVRNGIDVPCYLGSRSTFALGQFGGHAGRILKIADMLPISQPALPACTTPAPISLPKAPEPASIPVYGDIWDIGVLYGPHGAPDFFAQDYIDEFFSAEWQVHYNSNRLGVRLIGPKPVWARPDGGEAGLHPSNIHDCEYAIGSINFTGDFPVILTRDGPSLGGFVCPVTIAKAELWKVGQVKPGDRIRFHPVSMEEAITLEEQQNRIIATLRSTSEAPLKLERTLQIEEEHSGAVLAAVSATHSAPAVVYRQAGDNYILIEYGENILDLALRLRVHLLMEKLHVLAEPGIKEIAPGVRSLQIRYDNRQIEQQKLIALLLSLEKQLGNVSTMKVPSRIIHLPMAFEDSATLGAVDRYQSTVRSSAPWLPNNVDFIQRINGLADREAVRRILFDASYLILGLGDVYLGAPCAVPIDPRHRLLSSKYNPARTFTAEGTVGIGGSYMCIYGMDSPGGYQLVGRTLPIWNKFLKNEQFEEDKPWLLRFFDQIRFYPVTEAELEQLREDFQEGRTAIHIENTQFDFAEHLHFLKENAEDIAYFKLRQAVAFETEVMRWQQEQPEEERSVQDGEEQPQEEADLNEHGLQISADMSGNIWKVLVKSGDDVEEGQPLIIVEAMKMELAIHAPQAGRVTKISCQPGSAISPGD

SEQ ID NO: 428 - protein, 360 aa, Xenorhabdus nematophilus
LNILHTESSCGWGGQEIRILTESQGMMRRGHHVVIVCCLTSTLYREAHHYGVPVVALPIEKKRLSCFTAMRRWLKAEGHRFDVINTHSSTDSWLVAAASATLKRMPPIVRTRHVSTNVSTSIATRWLYLKSCRHIVTTGEKLRQSLHTNNRYPLSHMTSVPTGIDLTRFHPENKQACRQRIGIADKPTIGIVATMRTWKGHRYLLDSWKALHQRYPEWQLLFVGDGPQRKNLEPWVKQEGLTDSVIFLGNRQDVPDCLNSMDIFALPSFGNEGVPQGIMQAMACGLPVISTSVGAISEAVIDGETGYIIEPKCVEQLTNKLELLIRNAELRLQMGDASLKRAIAEFGMDNMLDKMESIFI

SEQ ID NO: 429 - protein, 273 aa, Xenorhabdus nematophilus
MENRKITFIGAGNMAHAIIAGLINKGYPAKQITACSPNTIRRDVLAEKYGINSQSDNIRYAQEADVIVLAVKPQMMEEVCSSLRSQVNFEQKLVLSIAAGIPLSRFYSFLQENLNIIRIMPNTPSLIGQGISGMFAPEQVNQSDRQFAEVLMNSVGKVCWVNDENGINDIIAVAGSAPAYFFLFMESMQQEAERLGFDSQTARELVLQTAMGSAKLAESQAELPFAILREQVTSKGGTTAEALRVFYENHLPEVVSQAMQGAIRRAQEMEKLF

SEQ ID NO: 430 - protein, 420 aa, Xenorhabdus nematophilus
NSGNNFTPENLLALPEVYGTPLWVYDSDIISRQIGKLKQFDVIRFAQKACSNTHILRLMREQGIKVDSVSLGEIERALHAGFQPGRDKSEIVFTADLIDEETLERVIELDIPVNAGSIDMLEQIGQRQPAHPVWLRINPGFGHGHSQKTNTGGENSKHGIWFQDLPLALEKIHQYNLNLVGLHMHIGSGVDYQHLANVCNAMVEQVVSCGVDIQAISAGGGLSIPYKNGEEAVDTCHYYNLWHEARQRIEQHLGHHIKLEIEPGRFLVAEAGILMAEVRAVKSMGSRHYVLADAGFNDLMRPAMYGSYHHISVLSENCDGTHSDIGENSSRSGLKETLVAGPLCESGDVFTQLEGGEVIPRMLPDISVGDYLIFHDTGAYGASMSSNYNSRPLIPEILLVEGQPRLIRRRQTIQELLSLE

SEQ ID NO: 431 - protein, 650 aa, Xenorhabdus nematophilus
MQLYLCEKPSQARDIANVLGVKQRGQGFLFSTRIIVTWAIGHLLEVAAPEQYGEQFGPPWRMEVLPVLPVQWQWTVKKEAADQFAVIRQLLKQVDEVIIATDADREGEVIARELLEYCRFSGAVRRLWLSALDDTSIRQALAAILPGEQTEALYQAGLGRARADWLTGINLTRFYTLKAQALGFGEVLSIGRVQTPTLALVVSRDKDIANFVPKPYWQVMANLEKDTVRFQAKWLPATEEGDEENRCTREAVAQAVQQCCQQATQATVMAVSKKREKTPPPLCFDLGTLQQTASRLWGMGASQVLTIAQSLYETHKATTYPRTDCGYLPVSMQADIPVVLTALTRTDPAMIDTISQLDEQQVSRVWNDKKITAHHAIIPTRHAFDLTRLTTDELQVYQLIRQHYLAQFLPPQETDVTEVTLDIGGQCFRAKGRVNVTTGWKALFMENFAEDQEKSEADSSLPRFHQGERCRIIAARIQPLHTKPPAPFTEGTLIAAMKNAASLVSDPQLKQVLRENAGLGTEATRAGILDTLFKRRLIERKKKAIQSTPLARELIAGLPEVLTSPGMTALWEQSLEDIAQGKTSLAVFMQKQAQWLLHLVERGKAQPFHLTLPKTPDCPNCGGRMRQRQGKTSPFWGCVNYPVCKGMLND

SEQ ID NO: 432 - protein, 280 aa, Xenorhabdus nematophilus
MFPGQGAQFQGMGRNLFDKYEYHMRLAQQVLGYSLVKVCENEPNVLNKTEFTQPALFVTNILHYLDGLEKHGTEAEIFVGHSLGEYCALFAAGAFSFETALSIVQERGRCMALCSEGAMAAVIGLKLERVEFLLADSEFPDLTISNFNSPTQFIISGSQSELSQFRKSVLKAKGIFHPLQVNGAFHSKRMESIASEFKSFLESVEIYSLKAQVLSNVTADYYPCNNRDQLIDLLVKQLSHPVRWQQCMEKLYSDKFISSKPIVGFEYGPKPVVGPLAKKI

SEQ ID NO: 433 - protein, 4746 aa, Xenorhabdus nematophilus
  unsure (1)..(4746): unsure at all Xaa locations
EYSIIGVAAQFCGGLSLSHYWQTLVEGGSLMGVIDEERYQLNNRQTPVKWGIKEKIRGMFLEDIDSFDRHIFPLSGSAIMFADPRQRLFLQTCWQLLEDAGLAASTLAGKKVGVFVAQDGWYLNSYVDRIPDEHKESQEFIVPGNDPCFLANRVSFFFNFHGPSIVVDTTCSSAFVALDMACQALEDGDCDYAIVGGISLFLNPWKAGETTATPFETSGEDIHSFSEKASGYRTSEGCAALLLQRNSDEVNQRHHVYGVVQASGHNSGGKTNSFAQPNKEQQINLFQTVLKRANLLPEQINYIEAHGVASQMGDAIEANALVDVFARPQNAAPCYVSTVKPNIGHNHASSGFYAIIKGLMAFRYNQIPLIRGLDKATLNAGIPSDTQGIQFLTETVDWPQSEGGTPRHIFFSSYGFSNVNAAIVLREPDNSSATKISPLVETVTEKPVLVCLSAKSDEQLYQQVVNLCKTVSEPDFTENFNLHELAWTLSTGREAFTHRWATLVSSTEQLRCVLEAFTESPEKQYSTIYQGILAQNVREEVLTAQRAELAVAANNGFPVTSLETVARCWITGVDIDWMQYWGDAEWRRIPLPTYPFAKTCYWVPKGEIRSLSSQEVSSQKGASQFIHPFVHQNTSDFAEQRFSTTFSGEEFCLKGHVIHGIRVLPGVGHLELARVASHHSFGSTPNSSSEVKEKTGLALKNVVWAQIIGVIDEPQQVHIRFINHGNGEAGYQLYSGAEEETIHNTGVATRKALTPAPVYDIDNLKSRYLQNAYSPKQYYDMYYALGLYMAPDYQGIEELYVGMDHVLAKLSLPESLEPTRDQFVLHPCLMDGALLSSVGLLMRFGDLNRPIPPKCLIPFALDEIEFHDEESQLHWAWISYSSDSSASDPFPKVDVDCCDINGKVCIRFKGFSCRGLGAQSAPPAEEAPYLLQPQWKNQALPADTALRAATKRIVFLCELESLQSELLFRSDTDTCEYIVLPKILHDESPLKRQQNVITLCKKIDDLIQHSPTEPVLIQLVLPEARPEYAIVTALLKTAYQNNANLLSQTIYCDDEDGLIEKLSEETSQIKYDTVLWQSEERWVPHWTAWTPESDSVDNLTPPWKEKSVYLIVDEDGSMGRAIARDITTHTDSAIAIVLSESEKNQYQITIASKTTTINDSVICLDTVTLAALVSRIEQNFGALRGVFFCVGTHFATNSQHTENQALTSILERYQGLSRLEKVTQGVSLDFFTVLTYRDGVLGSSGYPLFSAYCAAVNNFVRHSQQSPESAQYQKQTLSLILPQSNGTNEGEFIRHMALQSLYQALHERFSGELMLMEGGTIERFRAEMLGIRPYYEPAFSSTTENNVNSLASQEQASSDLEPTAVDLIKRVVSKAVSLPLAEIDENAGMEKYGIDSILSIKMTEALEQDFGVLPKTLFFEYLTIRELAAYFVKHHRLVLLEGAQNHSQNKNVQTSSISEDSRLSVQPFPGRTDKTENLFVSQTGEVANTTSESDDIAIVGLAGRFPQARNMRDFWQLLREGQDCITEIPFERWDHSRYFDMDKTKRGKTYGKWGGFIDGVDEFDPLFFNLSPRDARVMSPQERLFLQCAYETIEDAGYSHRTLGSRDWTRLPKKTGVYVGVMYGEYEFYSIEELAKGNVLEQSIVTGSFGSIANRVSHFFNINGPSLAVDTMCSSSLTSIYLACQALRQGDIEMALAGGVNVSIHPNKYLILGQSKFLSDEGRCQSFGEGGTGYVPSEGVGAVLLKPLTKAIADGDHIYGVIKGIAVNHGGKTNGYTVPNPIAQAEVISQAIQSSGVSPRAISYIEAHGTGTSLGDPIEIAGLSRAFQQCLQDNDTQESAFCAIGSVKSNMGHCESAAGIAGVAKVLMQIKHRQLVPSLHSRELNPNIDFDASPFYVQRELADWKRPLLGELGQNKEEQSEHPRTAGISSFGAGGTNAHLVVQEYIPANDLNSINNTDWPKWAVIPLSAKNHDQHRELAQNLSQYLKEQAKWYSEVSKAEYLHSLAYTLQTGREEMEERVTFMVDSLSALIDSLKVFSLSCLPSAHFWMGRVEKSKSAKQLMTPVYAGKDKQEEEYEQLQQIASAWTQGHDIDWQGYYQSLPVRPNRLSLPTYPFARERYWIPEPEAQIADFAVAVEEIDSTKEMTSTVLYTSGWERCDISQSTTYAMKPKHTDLFVIGNANETSLTELALLTSVDNVHYLRTENDLHTDSLHSSSLSDLVLRLTNYCQQRIHSGQGLPTFIAVFAPWKNNGLPYRALLGALRTLSMEFPVVQTKLILDAALDNADSETFIRHAEKELLSLDQLSSAVCYQEKDQRFVWRQKAVEPTDLTNLPSLFTHECRTIWITGGLGGLGYQIAQYIGTKTGAQLVLSGRSVLDADKEAQLDSLRKRGIKAEYVPCDVNNYAALEKTMLLIRQRFGALHGVIHCAGVIHDALTINKTEEEIDHVIATKASAACLLDEVTQHEPLAFFVMFSSLASLGNIGQIDYAAANAFLDTFAEYREDLVQQKQRSGKSLSINWPLWQEGGMNVTPRVAKHMFDTFGIVPLDTKTALEILEIAIRSPFSQFGVMKGNEQKIKDYLRLSDDSLPVTPLSVSDHKDSDITFNDKNMDSVNPSESDKSESGNLSAAIADIAAGKLSELLGMRSEAIDIHRQFGDYGMDSVGLIELAEYINSRFGVTLSQASFLEFNTLNRVAEHLIQLLPEPSIPVPSDILPSDTSSSDIPDAVSTPSFAIVGYDCTFPGAKNAHAYWQNIVQKNISIQGITQEKWQQRHILTPSDKEDAVKRMQLFGFLPDIDQFDAEFWGIDAETAKQIDPQQRLLMQCIWRCVEHAGYDLEDFTQRKVGLFVAADSTDYKSLIKDHSLINNIEGCGGLQAGLSLGMMVNQISYFFNFTGPSEVVDNACASVFVALQKARQAILQGDCDVAVVAGVKVILDFMEFYIRDQGGILSQSGKMAPFDYTADGYIRGEGVGAVMIKPLEQAHLERDPVRAIIRGIGISHNGRSAFSSMAPSVEKQEENIKKAYQTAGIDPLSVDYIEAHGSATQFNDVSEVAAFKKVFSENQTDSHRCVISAVKGNIGHLEAASGMASLIKVILAMQHGVIPPIASFSQLHPSIFIENTPLFFPREPVLWQQASSDKTQPRRAGLNSIGITGVNAHVILETPEQREVPVFSQRKEHVLIPISAKSEKTLKVYLSQWLDYVHQEKLAGHDNPTTLRNLAYSAQTGRADMPFRTAIIVNDLEKLIATLEWMITGENGTPPAGVVVTGVVSSKSRFPKKQVAFSTTLPVLKQLADDWVTGACIDWRAFAQGHGVYVDIPGYPFDEQRYWFPIGNPFLEPETRKFTPLSKRXRHNNILKRKXKDEXSXXKKXFIGLIENHRKRNIAAERXYXYXGTYSGSGFDSKSLVIFTDKISGVLDKEVHPGVLFEFTTLEKFADYLMNYQTSAAKRFLTALSSPTLTEETLTAGKVCLSQGNENSCQKTCSSKNTNDLAYMTGMTRGIEQNIPVIIGGGIAGMLISYQLSQEKIPHIIVGKPEIGDMPKLGESMTEVVSIEFARRFKNLSRHFYPKEFTPFFMGELVAGLRFHFFESLASLFMEEDIPEHFIHIDRLGFDKALYEETVAASECTWIEALVEHVEYSEDSDKVSLLHLSDGQIIQPSYVWDCTNHVRLLGRKIGLSYTELDSRRQVIFTHYYQKAGSKLCDSKELPWMHATSLLSADEEFDQLKGVSWLIPLGDYVSVGISMLPDDVRDRTAEEIIALLTKAYQRRGLDYSAHFTCRREIVSLPTQHFIYERFTGKNWALVGGSGISTWFTSGSNLSIATLMSSIAPKIIQSPELYGEYYTTHVRGFAKTQTIYDAFMESNIGSVDALKFLSGVVEQARSRITSFFLLDEIEGKSSGKVARELWQENTAIDKEYFDFLRQIATHARPEDRQQQTDLIFQKLMQLESMEHQVRLPYLKDSKVRQEKPQLFIXLCNGWHFMTDKMTWLLQHPYAEFVLGLKAAWEDDLSSDAFNNLFAQNCVCHMQSNELNDAQAFQTFIQSVRLNTANLKLIPESVIIQDDILHLFHRWKADRWHDEIISGGEYSNFCQIAIRINDGKIVELWQQVQDFLFLVGMPLSEACLSYPAWQQRVLVNKEKEGLHVASDEQSIRMSEKAKQLVDCVFNQGSLRHIDSLLHPELVFHNGNVTGHGIAEWKSFIYALRTAIGKEGVTLFDELFIRDENTLTLFVRMELTQASPFVLSRLNGMFCVLKLEMDEHRITKIQTYPENYLFFLGIDFPQHETRLKQLFRGNRLPLEIKSQPKHEAEIKMPPFSESVRNEQVAIVGIAGSFPQADSVDQFWRNLLEEKSGFSAFPEDRPWLSAGTIIRSAGFINDIFRFDEQYFQIPPAVAQYMDPQHRLLLEIINQSIEDSGHANQDVSGDRTALFVSALANDYEKLLRDKGVEENFYYWAGNEPAMSSGRIARFLDIQGPTQFINTECTGGTTALLGACDLIRSGQVDQAIVSASSLFLHPYGFIAREDGILSSAAAPELFSKRSKGQLRGEAVVSVIVKSLSKAQQDGDDIYAIIAGGAANNSGRTFSLISANVEQQAKTISKAWQNSGVSADDFSVIECNASGVRAGDFTEITALKKVFLPHQHIHLSTVKGAIGHTEAVSGLVALVKVLLQLRHQTIIGTQGLSEIDDSLGLEGSGLYLNHHHQKWDSTIREGEALPRIAGINSFAGGGYNTHVVVKEFIRQENTSVKQATMPV

SEQ ID NO: 434 - protein, 177 aa, Xenorhabdus nematophilus
MSEFATVARPYAKAAFDFAVEHQSLEHWQNMLAFVAEVTRNEQVGELLSGSLAPETLANTFITLCGDQVDEHARNFIRVMAENGRLLVLPEVFLQFIQLRASLESTIDVEVISASELNEQQQAKISAAMEKRLSRKVKLNCKIDKSVIAGVIIRAGDMVIDGSIRGRLDRLTDVLQS

SEQ ID NO: 435 - protein, 513 aa, Xenorhabdus nematophilus
MQLNSTEISELIKQRIAQFNVVSEAHNEGTIVSVNDGIIRVHGLADVMQGEMIALPGNRYAIALNLERDSVGAVVMGPYADLAEGMKVKCTGRILEVPVGRGLLGRVVNTLGEPIDGKGAVEHDGFSPVEVIAPGVIDRQSVDQPVQTGYKSVDAMIPIGRGQRELVIGDRQTGKTALAIDAIINQRDSGIKCIYVAIGQKASTIANVVRKLEEHDALKNTIVVVASASESAALQYLAPYSGCAMGEYFRDRGEDALIVYDDLSKQAVAYRQISLLLRRPPGREAFPGDVFYLHSRLLERAARVNAEYVEKYTNGEVKGKTGSLTALPIIETQAGDVSAFVPTNVISITDGQIFLESALFNAGIRPAVNPGISVSRVGGAAQTKIIKKLSGGIRTALAQYRELAAFSQFASDLDDATRKQLDHGQKVTELLKQKQYQPMSIAQQALSLFAAERGYLEDVEIAKVVSFESALLAYASHEHADLLKEIDQSGDYNGEIEAKLKALLESFKATQSW

SEQ ID NO: 436 - protein, 287 aa, Xenorhabdus nematophilus
MAGAKEIRTKIASVQNTQKITKAMEMVAASKMRKTQDRMAASRPYADTIRSVIGHLALGNLEYKHPYLEERDVKRVGYVVVSTDRGLCGGLNINLFKKLLIEMKDWSDKKVQVDLALIGSKAVSFFSSVGGNVVAQVTGMGDNPSLSELIGPVSVMMQAYDEGRLDKLYIVTNKFHNTMSQVPTITQLLPLPAGDDETLKKKSWDYLYEPDPKALLDTLLRRYIESQVYQGVVENLASEQAARMVAMKAATDNGGNLIKELQLVYNKARQASITQELTEIVSGAAAV

SEQ ID NO: 437 - protein, 460 aa, Xenorhabdus nematophilus
MATGKIIQVIGAVVDVEFPQDSVPKVYDALEVKNGEEKLVLEVQQQLGGGIVRCIAMGTSDGLRRNLEVTDLGHPIEVPVGEATLGRIMNVLGDPIDMKGDIGEQERWSIHRTAPSYEELSNSQELLETGIKVMDLICPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVARGVQSILQRYQELKDIIAILGMDELSEDDKLVVARARKIQRFLSQPFFVAEVFTGSPGKFVSLKDTIRGFKGILNGDYDHLPEQAFYMVGTIEEAIEKAKKL

SEQ ID NO: 438 - protein, 609 aa, Xenorhabdus nematophilus
MCGIVGAVAQRDIAEILIEGLRRLEYRGYDSAGMAVVDSENQMTRLREVGKVQMLADEADKQPVIGGTGIAHTRWATHGEPNERNAHPHVSEHIAVVHNGIIENHEELREELKARGYGFSSDTDTETIAHLVHWEQQQGGSLLEIVQRVIPQLRGAYGTVIMDSRQPDVLVAARSGSPLVIGLGVGENFLASDQLALLPVTRRFIYLEEGDVAEITRRTVRIFGVQGEAVEREQIESNVQYDAGDKGVYRHYMQKEIYEQPMAIKNTLEGRVSHGEIILSELGANAAELLSQVEHIQIVACGTSFNAGMVSRYWFESLAGIPCDVEIASEFRYRKPACRKGSLLITLSQSGETADTLAALRLSKELGYLTSLTICNVAGSSLVRESDFALMTKAGAEIGVASTKAFTTQLTVLLMLVAYMGRLKGADDSLEQNIVHALHALPSRIESMLSKDKVIEALAEDFSEKHHALFLGRGDQYPIAVEGALKLKEISYIHAEAYAAGELKHGPLALIDADMPVIIVAPNNELLEKLKSNIEEVRARGGQLYVFADQDAGFTDSENMKIISLPHVEELIAPIFYTVPLQLLSYHVALIKGTDVDQPRNLAKSVTVE

SEQ ID NO: 439 - protein, 293 aa, Xenorhabdus nematophilus
QSTSADSTLLDKNKQLSPAITSRSENTKQADSLYQSLITASQNRVMDTPELKANDIAGKHSKFIDYALAQVTRDVYRRNSFGIGDYVRMSDEELIKAGIDPDTLDDRSTGFQAGVYRNKGLYIVSFTGSNEIKDFMASIRQGLGYNEAQYNQAVDLAKSALKAFGENVIFTGHSMGGGLASMAALTTGKPAVTFNSAGVSDWTLKRMGWSPGAGREMAEQGLIRNYIVEHDWLDNLQKALPIPQPMGSQILLEYEYKPENFIDSIVRYSYALHSFKAHFLEAVQELMVIHRPW

SEQ ID NO: 440 - protein, 445 aa, Xenorhabdus nematophilus
MTATNFSDFELDECLLDALNDKGYERPTAIQAAAIPAAMDGRDVLGSAPTGTGKTAAYLLPAIQHLLDFPRKKSGPPRILILTPTRELAMQVAEQAREMAAHTHLDIATITGGVAYMNHAEVFSENQDIVVATTGRLLQYIKEENFDCRAVETLILDEADRMLDMGFANDVETIAGETRWRKQTMLFSATLEGESIRDFAVRLLTDPVEIDAEPSRRERKKIQQFYYRADNLAHKTALLCHLLKQEDVTKSIVFVRKRERVRELVEWLHQAGIQSSFLEGEMVQAKRTDAVKRLNDGRVKVLVATDVASRGLDIENISHVFNFDLPRTADVYLHRIGRTARAGRKGTAIALIESHDHPLLGKISRYLQEPLKVRVVDELRPQTKAPSENKSYKPSKKVLAKRKEKKKTEESKKNRVKVRHRDSKNIGKRRAPSGNPKPELPESTD

SEQ ID NO: 441 - protein, 236 aa, Xenorhabdus nematophilus
  unsure (1)..(236): unsure at all Xaa locations
QKKSMNPIQSVRADLYSCNIGXCAEIIFPSDLTFTHEVSVXVPRLSDWRGGLSLTNSLSNTKNMAEKRNIFLVGPMGAGKSTIGRQLAQQLNMEFYDSDQEIERRTGADVGWVFDVEGEEGFREREEKIINELTEKQGIVLATGGGSVKSKETRNRLSARGVVVYLETTIEKQLARTQRDKKRPLLQVDAPAREVLENLADERNPLYEEIADLTIRTDEQSAKVVANQIIELLEKN

SEQ ID NO: 442 - protein, 362 aa, Xenorhabdus nematophilus
MEQVIVTLGERSYPITIAQGLFSSSEAFRPLQSGQQVMIVTNETLAPLYLEQVKSTLLNMGLRVNEVILPDGEQYKSLFVLNDIFSALLENNHARDTTLIALGGGVIGDMTGFAAASYQRGTRFIQVPTTLLSQVDSSVGGKTGVNHPLGKNMIGAFYQPASVVIDLNCLNTLPAQELYAGLAEVIKYGVILDGEFFDWLESNIEKLLDLDHQAMAYCIRRCCELKALVVAADEHERSGMRALLNLGHTFGHAIEAEMGYGVWLHGQAVAAGMVMAARASELVGSFSGQDTQRIISLLERAKLPVHGPSEMPPENYLPHMMRDKKVTAGKLRLVLPTAIGKAELRSDISTDIILDAIRRCSE

SEQ ID NO: 443 - protein, 231 aa, Xenorhabdus nematophilus
NVVQAIQAIAFDLDGTLVDSAGGLADALDQALLTKGLPAAGKERVAVWVGNGSDIMVERALKWAVGEFSPELFSETRSLFDKFYETTVTTGSKLFPHVKETLAELAKHNLPMAIITNKPTPFIAPLLESLGISQYFSLVLGGDDVKQKKPHPAPLYLTMGMFGLNKDELLFVGDSRNDILAAQAAGCPCVGLTYGYNYGESIALNHPDYVLDNFPDLLPTIGLPTLNLQEA

SEQ ID NO: 444 - protein, 615 aa, Xenorhabdus nematophilus
YQRSLQDPKGFWGEKGKIVDWIKPYTKVKNTSFDPGHISIRWFEDGTLNLSANCLDRHLQERGHQTAIIWEGDNPAESRHVTYQELYHDVCQFANVLKKLGVKKGDVVAIYMPMVPEAAVAMLACARVGAIHSVIFGGFSPDAISGRIIDSNAKLIITANEGLRAGRVVPLKKNVDEALSNPAVTNVTNVVVFKRTDNATNWHTGRDLWWHELTKEISSDCPAEEMNAEDPLFILYTSGSTGKPKGVLHTTGGYLVYASLTFKYTFDYHPGEVYWCTADVGWVTGHSYLLYGPLSCGATTLMFEGVPNYPDVNRLCQVVDKHQVNILYTAPTAIRALMAEGDKAIEGTKRTSLRIMGSVGEPINPEAWEWYYKKIGNSKCPIVDTWWQTETGGFMITPLPGATDLKAGSATLPFFGVSPAIVDNTGETLSGESEGNLVITDSWPGQARTLFGDHDRFEQTYFSTFKGVYFSGDGARRDEDGYYWITGRVDDVLNISGHRLGTAEIESTLVAHPKIAEAAVVGIPHRIKGQAIYAYVTLIHGEEPSPDLYAEVRSWVRKEIGPIATPDILHWTDSLPKTRSGKIMRRILRKIASGDTGNLGDTSTLADPGVVEKLL

SEQ ID NO: 445 - protein, 445 aa, Xenorhabdus nematophilus
MTGHIQQSTLKRGLKNRHIQLIALGGSVGTGLFLGIAQTIKMAGPSVLLGYAISGFIAFLIMRQLGEMVVAEPVAGSFSHFAYKYWGNFAGFLSGWNYWVMFILVGMAELTAVGMYIQYWWPEIPTWVSAAIFFVVINSVNLINVRLYGEAEFWFSMIKVGAIIGMILFGSYLLISGTGGPQASVSNLWQYGGFMPNGAAGLITAMAVIMFSFGGLETVGITAAEAENPEKNIPKATNQVVYRILLFYIGSLFILLSLYPWIKVVEGGSPFVLIFHNLDSFWVANALNIVVLTAALSVYNSGVYCNSRMLYGLAKQGNAPRILTKVNKRGVPVLSIALSALATSIGVLINYVMPGKAFELLMALVVTTLVINWIMICVSHLKFRAAKNAEGVKTSFRAFWYPFGNFLCLIFLACILIIILTIPGIRISVILMPFWIGALWVGYLF

SEQ ID NO: 446 - protein, 152 aa, Xenorhabdus nematophilus
QDHQLQVEAIKCGTVIDHIPAQVGFKLLSLFKLTETDQRITIGLNLPSNHLGKKDLIKLENTFLTAQQANQLAMYAPHATVNNIENYVVVKKMPINLPEQIDGILVCPNGNCISHNEPVESSFHVMETANDVIVRCKYCEKEFDRQAVINND

SEQ ID NO: 447 - protein, 752 aa, Xenorhabdus nematophilus
IKPYHAAAGGWGSLEATTRFVFDSKQVLKNMVNLMRMNKPRGFDCPGCAWGDDNKSLFSFCENGAKAVTWEATRRHVDREFFATHSVSKLYEQSDYFLEYQGRVIEPMRYNHETDHYEPISWEQAFSLIARHINGMENPNQLELYTSGRASNEASWLYQLFGRVLGTNNFPDCSNMCHEASGYGLLKSLGVGKGTIRLNDFDHADAIFVFGQNPGTNHPRMLHSLRHAAEHGARIVTFNTLRERGLERFADPQKPLEVVTPMAGNISHRYYQPKLGGDMAAVRGMVKALLEVHNSRIAAGAAGIFAQDFISAHTEGVEAYLQEVAATEWVFIEEQSGLTQQQLREAADIYQHAERVICTWAMGITQHKHSIDTVREITNLQLLFGQLGKPGAGVCPVRGHSNVQGNRTMGINEQPSQAFLDSLANHFGFEPPRAHGHNVVQALEAMLRDEVKVLIALGGNLAAAAPDSPRTEEALRHCDLTVHISTKLNRSHLVTGKKDALILPALGRTEQDIQLSGAQFVTVEDSFSMVHASEGINKPLSDTQRSETAIVAGMADAVLGNTPTINWLELAGDYNKIRDHISATIPGFADFNKKCEHPGGFYLGNAAAELRFQTPSKKAEFSHAPLPDTLFPQIAGEDVPFALQTLRSHDQYNTTIYGLDDRYRGVYGQREVLFMNPEDIAQSGYQEGDLVDIETIWHDGIERKVCGFKLVPYTIPRGNLAAYYPETNPLVPMDSFGHGTGTPTSKSVPVKL

SEQ ID NO: 448 - protein, 247 aa, Xenorhabdus nematophilus
  unsure (1)..(247): unsure at all Xaa locations
MKVNMLHSFTEQKISTKKLFDWESINKIFINECNEPLEVIYETDKIKLKPVYFLAGINGAVEYCAVRKNVAEKLIQASQLLPAHLGLLVLDGWRSRETQLALQEKTRATIAQQYSYLSIEEQKELLEQFVAPAPTEQNPVSPHLTGGSVDVTLFDIVSGNALFMGTEFDEVDDLSYTAALEQASDTNMPAVLYRRILHHVMLQAGFTNLPTEWWHYDYGNALWAFYKNDQAVYGAVEGIRESGSTIX

SEQ ID NO: 449 - protein, 521 aa, Xenorhabdus nematophilus
SGNYLMALDAGTGSIRAVIFDLEGNQISVGQSEWVHQPVPNVAGSMEFDLQTNWQLTCQCIRQALQKAELPASAIQGVAACSMREGIVLYNRNGDPIWACANVDARSSHEVSELKELYNNTFEYDVYRYSGQTLALGAMPRLLWLAHHRADIYRQASTLTMISDWLAYMLSGELAVDPSNAGTTGMLDLVSRDWRPSLLEMAGLRSDILSPVKETGTLLGYVTNKAAAECGLDSGTPVIMGGGDVQLGCLGIGVVRPAQTAVLGGTFWQQVVNLPEPMTDPNMNIRINPHVIPGMAQAESISFFTGLTMRWFRDAFCAEEKLMAERLGIDAYALLEEMAARVPAGSYGVMPIFSDVMRFKSWYHAAPSFLNLSIDPEKCNKATLFRALEENAAIVSACNLDIVATFSGVQPDSLVFAGGGSKGKLWSQILSDVTGLPVRVPVVKEATALGCAIAAGVGVSLYDSMPETGERLVRWEREYLPNSGQWDVYQKAKKDWQAVYADQLHLVDDGLTTSLWKAPGL

SEQ ID NO: 450 - protein, 257 aa, Xenorhabdus nematophilus
MSILITRPAPAGEELVKRLKAAGKTAFSAPLISIHPGADLPLLSQKLQRLTAGDFVFLLSKNAVHYACEQLGQDSLSWSDRLSYYGIGKSTSLFFHQKTGKSILWPDQGETSEDLLQLPSLQQVENKKVLLLRGNGGREMIASTLRARGAEVDYCECYARRAVKYHSAEFSHYWQRCGIKTIVVTSGEMLRLLYNLVIEGDSAEGNANDSSNSKAWLLNCRLIVVSDRLASIARTLGWHVIKVAKSADNDALMQALE

SEQ ID NO: 451 - protein, 332 aa, Xenorhabdus nematophilus
MTMKTIRIATRQSPLAMWQARYVQKQLKHFHPDLQVELIPMTTRGDIILDTPLAKVGGKGLFVKELELAMLENRADIAVHSMKDVPVEFPDGLGLVTICEREDPRDAFVSVEYASLNDLPTGSIVGTSSLRRQCQLRQLRPDLVIRDLRGNVGTRLSKLDNGDYDAIILAAAGLKRLGLEDRIRMPLAPELLLPAVGQGAVGIECRLDDMQTRELLAPLNHKNTEICVLAERAMNTRLEGGCQVPIGSYAIWQGDNIWLRALVGAPDGSNIIRGERTICSEKTSCSEKTSCSQSTISSDKAISSEEACQAGISLAEELLEKGARQILADVYQ

SEQ ID NO: 452 - protein, 274 aa, Xenorhabdus nematophilus
MQFSKMHGLGNDFMVVDAVTQNVYFSPELICRLSDRHTGVGFDQLLVVEAPYDPDLDFHYRIFNVDGSEVSQCGNGARCFARFVRLRGLTNKRDIKVSTQAGQMVLSINHDDQVCVNMGEPVFEPQSVPFRANKAEKTYIIRVMERTVLCGVVSMGNPHCVIQVDNVDTADVEVLGPVLERHERFPERVNVGFMQVVSRNHIRLRVFERGAGETRACGSGACAAVAIGIQQGLLDKQVRVDLPGGSLQIRWDGPGQPLYKTGPATHVYDGTIHL

SEQ ID NO: 453 - protein, 719 aa, Xenorhabdus nematophilus
MDVSYLLESLNNKQREAVAAPRTNMLVLAGAGSGKTRVLVHRIAWLLSVEHASPFSIMAVTFTNKAAAEMRHRIENLIGTSQGGMWIGTFHSLAHRLLRAHHLDANLPQDFQILDSDDQLRLIKRIIKAMNLDDKQWPARQGMWYINGKKDEGLRPRHIESYGNPVEVTWLKIYQAYQEACDRAGLVDFAELLLRAHELWLNKPQILQHYRDRFTNILVDEFQDTNSIQYAWIRLLAGDSGRVMIVGDDDQSIYGWRGAQVENIQRFLKDFPAAQTIRLEQNYRSTSNILKAANALIAHNSDRLGKNLWTEGSEGEPISLYSAFNELDEARYVVSRLKNWLDNGGALKECAILYRSNAQSRVLEEALLQASMPYRIYGGQRFFERQEIKDALSYLRLVANRNDDAAFERVVNTPTRGIGDRTLDVVRQMARDQQKTLWESSQLLIQEKVLAGRAASALQRFIELINALETETQEMSLHVQTDRVIRDSGLWAMYQQEKGEKAQARIENLEELVTATRQFSYQDEDEDMMPLQAFLSHAALEAGEGQADAYQDSVQLMTLHSAKGLEFRQVFIVGMEEGMFPSQMSIDEGGRLEEERRLAYVGVTRAMEKLTLTYAESRRLYGKEVYHRPSRFVGELPAECVTEVRLRATVSRPVSHKRLGTPLSANDSGYALGQRVRHPKFGEGTIVNIEGSGEHCRLQIAFQGEGIKWLVAAYARLET

SEQ ID NO: 454 - protein, 581 aa, Xenorhabdus nematophilus
IMNDKDLSTWQTFRRLWPIITPFKAGLLVAAVALVINAAGDTLMLSLLKPLLDEGFGKADMSVLKWMPLVVIGLMLMRGISGFVSSYCISWVSGKVVMQMRRRLFNHMMGMPVAFFDQQSTGTLLSRITYDSEQVASSSSGALVTVVREGASIIGLFALMFYYSWELSLILIVIAPIVAGVIRLVSVRFRRISKNMQNSMGMVTTSAEQMLKGHKEVLIFGGQKVETQRFNKVSNHMRQQGMKMVSADSVSDPIIQLIASFALAFILYAASFPEIMGALTAGKITVVFSSMIALMRPLKSLTNVNAQFQRGMAACQTLFTILDMEQEKDDGKREIKKAKGDLEFRDVTFCYPTKESPALKNISMEIPAGKTIALVGRSGSGKSTIANLLTRFYDVSEGSISLDGHDLREYTLSSLRNQIALVSQNVHLFNDTVANNIAYASEGQFSREEIERAAEMAYAMDFIKKLDNGLDTMIGENGVLLSGGQRQRIAIARALLRDSPILILDEATSALDTESERAIQAALDELQKNRTSLVIAHRLSTIESADEIIVIEDGNIIERGNHNVLLEKNGAYAQLHRMQFG

SEQ ID NO: 455 - protein, 750 aa, Xenorhabdus nematophilus
NKSTVPGVHPYHGPAGGWGALKATAIAVRTQMDAFVAPKTLLNTNQPDGFDCPGCAWPDKEHNSTFQFCENGAKAVTWEATKKRVTPEFLAENTVSTLLEKSDYELEGYGRLTHPLAYDAATDTLVPVSWEAACRRIGEILREIPSPSEVEFYTSGRASNEAAYLFQLFAREYGTNNFPDCSNMCHEPTSVGLPQSIGIGKGTVSLDDFDKTQLIISIGHNPGTNHPRMMGTLHEVARRGVPIVVFNPLRERALERFTDPQNMIEMATYSSTNIASSYYQVKAGGDAAALKGIMKVLLEWDEKRGNILDHEFIATHTMGFDAVKEELRGTSWQDIENESGISQADIENVALLYANSDATIVTYGMGITQHNKGTANVRLIADLLLMKGNIGKSGAGICPLRGHSNVQGNRTVGITEKPSPEFLQKLEEVFGFKPPYEHGHDAVKAMQAMVDGRVKALLCLGGNFAVALPDPELSFSAMKKLDLSVHIGTKLNRSHLLVAKETFILPCLGRTELDIRELGRQSITVEDSMSMVHASSGKLTPASPLLKSEPVIVAEMAAATLLNSKTPWLRYTESYDLIRDLIEKTIPGFDNYNQRIRTPGGFRMPLPPTERIWPTPTGKAMFSVFKGVKENADVLGEDVLRLMTIRSHDQYNTTIYALDDRYRGVFGRRDVLFMNDVDLEARDLKHGDKIIIETVSQNRKLFLKDITVISYNIAPGTVAAYYPEANILIPLDYIDEESGTPSYKSVPVRV

SEQ ID NO: 456 - protein, 158 aa, Xenorhabdus nematophilus
ISLIAAMAMDRVIGLDNAMPWTIPGDLAWFKRNTLGKPVVMGRVTYESIGRPLPGRLNIIISRQPGSDDRVTWVSSIEEALAAAGDVEEIMVIGGGKIYEQFIPLASRMYLTHIDAEVIGDTHFPDYEPDEWSSVFTEYHDADERNSHGYCFEILERR

SEQ ID NO: 457 - protein, 168 aa, Xenorhabdus nematophilus
MSVPAFGLGTFRLKDDVVIASVKNAIELGYRAIDTAQIYENEAAVGQAIKESGVVREDIYITTKIWTDNMGAEKVIPSLKESLAKLGTDYVDLTLIHWPSPNNAVSLEETMSALLEAKKMGLTREIGVSNFTVALMQQAIDAVGAENIATNQIEVSPYLQNRYVTGWA

SEQ ID NO: 458 - protein, 560 aa, Xenorhabdus nematophilus
  unsure (1)..(560): unsure at all Xaa locations
LIVIGAGIGVLAPFLLREIIDTALPQQNIQLLVWLALGLIVITALNAVINAAQMILSTQIGQAIMHGLRVRLYGHLQTLSLAFFTRTRTGEIQSSIASDIGGLQSVVSNTVTEIIRSATITVTTAIAMLLLDWRLALFSFAVLPPSLWLSHKVGLMRERLTHQQQDGHANMSAIVQETLSAPGIILSRTLARSFFLIQRFEKASSKTLHLEVRAHTAGEWSWSVIELLLGAMPAMTLLLGGLLIGQGVPVTIGTLVALIALQEQLLWPLENLLENAVKLRTTRALFTRIFKYLDTPPDIVEPAQIRDLSNEGPRGHVRFENVSFSYDGTDMSSLCNVSIDIPAGSHVAIVGPTGAGKSTFGYLLARLVDPSQGRITIDGIDLREMSFEQLASVLGVVTQEPFLMNTSIAENLRFACPEASDEDLVASARTAQIHDLIVSLPEGYQTKVGERGYRFSGGEKQRLALARTILRNPPILLLDEATSALDNTTEKAISLALAQMASERTVISIAHRLSTIRHADQILVLKDGQLKEWGTHQQLVEKDGIYAELLRTAEPTXNSI

SEQ ID NO: 459 - protein, 532 aa, Xenorhabdus nematophilus
DNGKVVIGVDVGTGSARAGIFDMNGNMLSSAKRDITLYRDNTHFVEQSSREIWDAVCYCIREAMSHSGCVPQQVAGIGFDATCSLVVLGKDQEPISVSQSKDPNRNIIVWMDHRATVQAEHINALGHSVLDYVGGKISPEMETPKILWLKENHRESFDNAWQFFDLADFLTWKSTSSLSRSTCTVTCKWTYLAHEKRWDADYFRKIGLSELADENFYRIGQNIIEPGTPCGQGLTESAAKQMGLLAGIPVAAGMIDAHAGGIGTVGINGDATRNMAYVFGTSSCTMTTTLEPVFIPGVWGPYFSAMVPCMWLSEGGQSAAGAAIDQLLSFHPAAIAAKAMAKEKQKSLPVFLADRVLEKTQSASQAVELAKGIHVVPEFLGNRAPFADPHARAVIAGLGMEDSLDNLLSLYIAGICGIGYGLRQIIEAQAKSGATIDNIVISGGAGQHPLVRQLIADTCDVTVIATQACEPVLLGSAILGAVAGGVCKSVGEAMSRFSNIDCTYEPSESYREHHNIRFTSFQSLQQCARELK

SEQ ID NO: 460 - protein, 244 aa, Xenorhabdus nematophilus
SFMAISLENKVAAITGAASGIGLECARILIEAGVKVVLIDRAKERLMQLVSELGENAIPLVIDLMKPEQVDGILDEILKKAGRLDIFHANAGAYIGGPVAEGDPDVWDKVLNLNINAAFRSVRAVLPHFIEQKSGDVLFTSSISGVVPVVWEPIYTASKFAVQAFVHSTRRQMAEHGVRVGAVLPGPVVTALLDDWPKAKMEEALENGSLMQPIEVAEAVLFMLTRPRNVTIRDLVILPNSVDL

SEQ ID NO: 461 - protein, 329 aa, Xenorhabdus nematophilus
QHKKFDVICMGRIAVDLYGQQIGARLEDMTSFSKYLGGSSGNVAYGTARQGLKSSMLARVGDEHMGRFLREELERVGCDTSHLITDKERLTALVLLGIKDKETFPLVFYRDNCADMAITRDDFSEEYIASARCLAITGTHLSHPKTRAAVLTALQYARRNGVKTVIDIDYRPVLWGLTSLGDGETRYIASKQVTAQLQEVLSQFDLIVGTEEEFHIAGGSKNTLDALRSVRKLSSATLVCKRGALGCSVFTGNIPETLDEGITIQGVKVEILNVLGAGDAFMSGLLRGYLNNESWEQSCAYANACGALVVSRHGCAPAMPDKTELDNYI

SEQ ID NO: 462 - protein, 306 aa, Xenorhabdus nematophilus
GVFNVVQGDKEAVDVLLTDPHVQAVSFVGSTPVAEYVYATASSHGKRCQALGGAKNHSILMPDADLDMAVNAIIGAAFGAAGERCMALSVVLAVGDEIADELVTKLRQQIDRMVVGAGISEGRENDMGPVISEQHRSKICDYINSGVEQGAKLLVDGRGYQVTGHEKGYFVGPTLFDYVTPEMKIYKEEIFGPVLSIVRVPDYHTALKLINHHEYGNGAAIFTRDGETARQFSEDVQAGMVGINIPIPVPMAFHSFGGWKRSIFGPLNVHGNDGVRFYTRMKTVTSRWPASVRLEHHSSSFVMPTM

SEQ ID NO: 463 - protein, 445 aa, Xenorhabdus nematophilus
LQRGLEARHIELIALGGTIGVGLFMGSASTLKWAGPSVLLAYIIAGLFVFFIMRSMGEMLFLEPVTGSFAAFGHKYLSPYWGCLTAWGYWFMWVSVGISEITAVGVYAEFWFPDLPQWVAALVAVSLVALANLAAVRLYGELEFWFAMIKVTTIIVMILVGIGLIFFGLGNDWQAIGLDNLTTHGGFFAGGWKGFLFALCIVVASYQGVELVGITAGEAKNPQVTLKKAINNILWRILIFYVGAIFIVVTLFPWTEIGSHGSPFVMTFAKVGIASAAAVINFVVLTAALSGCNSGMYSGGRMLYALAENRQLPASLRKLSKNGVPVRCVAITIGCLIAGSSLNYLIPNPQSVFVYVYSASVLPGMVPWFVILVSQLRFRQHHQEALKQHPFKSILFPYINYLTLIFLSCVLIGMAINPDTRFSLMVGGAFLLIVSLIYWVIKFIR

SEQ ID NO: 464 - protein, 293 aa, Xenorhabdus nematophilus
  unsure (1)..(293): unsure at all Xaa locations
MKGIILAGGSGTRLYPITRGVSKQLLPIYDKPMIYYPLSVLMLAGIRDILIISTQEDLPAFKRLLGNGERFGIHLSYAVQPSPDGLAQAFLIGEEFIGDNPCCLVLGDNIYFGQAFSPKLQSVAARSHGATVFGYQVMDPERFGVVEFDEQYRVLSIEEKPVQPKSNWAVTGLYFYDNNVVDFAKRVKPSIRGELEITSINQMYLERGELNVELLGRGFAWLDTGTHDSLIEASMFVQTVEKRQGFKIACLEEIAWRNGWMSDDQVRASAAELTKTGYGQYLLDLLNVYSRXY

SEQ ID NO: 465 - protein, 357 aa, Xenorhabdus nematophilus
LALKRILITGGAGFIGSAVVRHIINHTEDSVVVVDSLTYAGNLESLAPVADHPRYAFEQADICHRDALERIFQQYQPDAVMHLAAESHVDRSIDGPAAFIETNIIGTYTLLEAARAFWQQLDQEKQATFRFHHISTDEVYGDLHGEEGFFTETTPYAPSSPYSASKASSDHLVRAWRRTYGLPTVITNCSNNYGPYHFPEKLIPLVILNALAGKPLPVYGEGKQIRDWLYVEDHARALHLVVTQAIPGETYNIGGHNERRNIDVVETICELLEEFKPEKPAGVAHYRELITYVTDRPGHDMRYAIDAAKIERELGWKPQETFESGIRKTVQWYLANENWWCRVQDGSYAGERLGLSE

SEQ ID NO: 466 - protein, 417 aa, Xenorhabdus nematophilus
MSFETISVIGLGYIGLPTAAAFASCQKTVIGVDVNQHAVETINRGKIHIVEPDLDQVVKTAVEGGYLRAVTSPQPADAFLIAVPTPFKGDHEPDMAYVYSAAESIAPVLKKGDLIILESTSPVGATEQMAERLAEARPDLTFPQQAGENSDIDIAYCPERVLPGQVMVELVKNDRVVGGMTPKSSSRASELYKIFLEGECVVTNARTAEMCKLTENSFRDVNIAFANELSLICAEQEINVWELIRLANRHPRVNILQPGPGVGGHCIAVDPWFIVSQNPTQSRLIRTARLVNDDKPLWVVDQVKAAVADCLAESDKRASEIKIACFGLAFKANIDDLRESPAVHITKMIAQWHAGSTLVVEPNIHELPHSLEGVVELVSLQQALEEADVVLMLVDHSQFKAINGSQIKQKWVVDSKG

SEQ ID NO: 467 - protein, 415 aa, Xenorhabdus nematophilus
MSKTHLTEKKFSDFALHPKVIETLDKKGFSNCTPIQALTLPFTVEGQDVAGQAQTGTGKTLAFLTSTFHYLLSHPAAADHKTNQPRALIMAPTRELAVQIYSDAEELAEATGLKMGLAYGGDGYDKQLKVLEAGVDIIIGTTGRLIDYAKQGYINLSAIQVVVLDEADRMYDLGFIKDIRWLFRRIPSATQRMTLLFSATLSYRVRELAFEQMNNPEYVEVEPLQKTGHRIKEELFYPSNEEKMSLLQTLLEEEWPDRCIIFANTKHRCEDIWAHLAADGHRVGLLTGDVAQKKRLRILEEFSLGNVDILVATDVAARGLHIPSVTHVFNYDLPDDCEDYVHRIGRTGRAGESGHSISLACEEYALNLPAIEEYIQHQIPVSKYNSDALLKDLPVPRRRNRSRSGGHPRRTNMPR

SEQ ID NO: 468 - protein, 637 aa, Xenorhabdus nematophilus
  unsure (1)..(637): unsure at all Xaa locations
MRLNPSQQQAVEFVTGPCLVLAGAGSGKTRVITNKIAHLIRACGYQARHIAAVTFTNKAAREMKERVAQTLGRKETRGLMISTFHTLGLEIMKREYKALGMKSNFSLFDDQDQMALLKDLTADLLEEDKDLLQKLISSISGWKNDLMSPEQVIRRARSEQEHHFAECYRRYDLHLNSCNVLDFDDLITKPTLLLMRDEEVRERWQNRIRYLLVDEYQDTNTSQYQLVKLLVGNRARFTVVGDDDQSIYSWRGARPQNLILLKEDFPQLKVIKLEQNYRSSGRILKSANILIANNPHVFEKKLFSELGYGDPLRVIEANNEDHEAERVVGELIAHHFINKTDYKDYAILYRGNHQSRIFEKMLMQSRIPYRISGGTSFFSRPEIKDLLSYLRVLTNPDDDSAFLRVVNTPRREIGAVTVQKLGEWAKQRNKSLYHASFDLGLEQNLSGRGLAALQRFTHWMNEISHQAERDPLLAVRDLLHGMDYESWLYETSPSPKAAEMRMKNVNQLFTWMSEMFEGDDLNEPMTLSQVVARFTLRDMLERGEESEESDQVQLMTLHASKGLEFPYVFMVGMEEGLLPHQSSIDEDNIDEERRLAYVGITRAQRELFLTLSKERRQYGELIARNRAGFCXSCLRMI

SEQ ID NO: 469 - protein, 446 aa, Xenorhabdus nematophilus
MGLAKQRKNVAVIERYNNIGGGCTHWGTIPSKALRHAVSRIIEFNQNPLYSDNSRILRSSFSEILRHAEVVINQQTKMRQGFYERNRCKMFAGEATFIDEHHVSVRYADDSVDILSADKIIIATGSRPYCPPDVDFTHSRIYNSDTILELDHEPRHVIIYGAGVIGCEYASIFRGLGVKVDLINTRDHLLSFLDQEMSDALSYHFWNSGIVIRHNEEYEKIEGLEDGVIIHLKSGKKVKADCLLYANGRTGNTDKLGMENVGLETDSRGLLKVNRVYQTSNENIYAVGDVIGYPSLASAAYNQGHIAAKAIMTGSENAEKYLVDDIPTGIYTIPEISSVGKTEQELTAMKVPYEVGRAQFKHLARAQIAGMNVGSIKILFHRETKQILGIHCFGERAAEIIHIGQAIMEQKGEGNNIEYFVNTTFNYPTMAEAYRVAALNGLNRLF

SEQ ID NO: 470 - protein, 456 aa, Xenorhabdus nematophilus
MALWGGRFSQEADQQFKQFNDSLCFDYRLAEQDIVGSVAWSKALVTVGVLTSEEQQKLELALNALLDEVRTNPEAILQSDAEDIHSWVEGQLIAKVGDLGKKLHTGRSRNDQVATDLKLWCKDQIADIRQALTALQQALVITAENNQDAVMPGYTHLQRAQPVTFAHWCLAYAEMLARDESRLQDTLKRLDVSPLGCGALAGTAYNIDREQLASWLGFASATRNSLDSVSDRDHVLELLSNASISMIHLSRFAEDLIFFNSGEADFIELSDRVTSGSSLMPQKKNPDALELIRGKCGRVQGALTGMMMTLKGLPLAYNKDMQEDKEGLFDALDTWRVCLHMAAMVLDGIQIKRERCREAAKQGYANATELADYLVAKGVPFREAHHIVGEVVIAAIKKGRALEELSLSELQRFSETISIDVYDILSLQSCLDKRLAKGGVAQKQVTLAIAEAKQRL

SEQ ID NO: 471 - protein, 412 aa, Xenorhabdus nematophilus
ATSMTTTTTSVKNSIKKIVLAYSGGLDTSAIIPWLKEHYGNCDVIAFVADVGQSREDLEGIEQKALRSGASECHIADLREEFIKEYVYPVLKTGALYEGSYLLGTSMARPIIAKAQVELALKVGADALAHGATGKGNDQVRFESTYTALAPHLKVVAPWREWDLRSREALLDYLKVRDIPTTATLEKIYSRDENAWHISTEGGVLENTWNAANKDCWEWTVEPEDAPDEPEYLSVTVEKGEVVGVNGKILSPYQCLNELNELGAKHGIGRIDIVENRLVGMKSRGCYETPGGTIMMAALRGIEQLVLDRDSFKWRQQLGLEMSYVVYDGRWFVPLRQSIQAAAEMLAENVSGEVILKLYKGQVTATQKTSPHSLYSEEFATFGEDEVYDHSHAEGFIRLHSLSSRIRALKSK

SEQ ID NO: 472 - protein, 258 aa, Xenorhabdus nematophilus
LMEPLVIKLGGVLLDSDEALVRLFSTLQLYRKTHKRPLVIVHGGGCLVDELMQKLQLPIIKKQGLRVTPADQIDIITGTLAGTANKTLLSWAIKYRLPAVGLCLGDGCVVKVSPFNEEFGHTGMASPGNPDLLKILLDIGYIPIISSIGITEDGKLMNVNADQAATAVAQSLNADLVFLSDVSGILNGKGNKIPEVSEKEIQQMIEQGVITDGMVVKVHAALEAAKTLGRPVDIASWRYADQLIALFNGISVGTRILA

SEQ ID NO: 473 - protein, 334 aa, Xenorhabdus nematophilus
MLNTLIVGASGYTGAELAACLQRHPYIHLAGLMVSAQSSDAGKCLSELYPQYKGTLDLPLQPLTDVAEAASGIDIVFLATAHEVSHDIAPEFLQAGCIVFDLSGAYRVQNTLFYSEYYGFEHKNIDWLEQAVYGLAEWQAEKIKTAQLIAVPGCYPTVSQLSLKPLLEAGLLDTGQWPVINAVSGVSGAGRKASINNNFCEVSLQPYGVFNHRHQPEIATHLGIDVIFTPHLGNFARGILATITCKLKAGITEEQVRHAYQQAYHDKPLIRLYENGVPALKGVVGLPFCDIGFAVQGQHLIIVGAEDNLLKGAAAQAVQCMNIRFGFEETQALL

SEQ ID NO: 474 - protein, 878 aa, Xenorhabdus nematophilus
MNQQYSAMRSNVSMLGKILGNTIKEAQGKDILDKVETIRKLSKSSRAGNDADRQQLLSTLQNLSNDELLPVARAFNQFLNLANAAEQYHSISPHGEAASNPVALAALFERLKSKNFNNDDLVQAVNELSIELVLTAHPTEIARRTLIHKLVEVNTCLAQLDHDDLADYEHNNIMRRLRQLIAQSWHTDEIRKIRPTPIDEAKWGFAVVENSLWEGVPAFLREFNEQLEESIGYSLPVESVPIRFTSWMGGDRDGNPNVTAEVTRHVLLLSRWKAADLFLKDIQVLVSELSMSECTPELRQLAGGDEIIEPYREIAKQLRTQLNNTLAYLEKRLKGEQVIPPADLLLHNDQLWQPLYACYQSLKACGMEIIADGQLLDILRRIRCFGLSLVRIDIRQESTRHTDAIAELTRYLEMGDYASWSETEKQAFLLRELNSKRPLIPRHWQPSAETQEVLETCKVIAESPPDAIAAYVISMAKVPSDVLAVKLLLKAADCSLSLPVAPLFETLDDLNNAESVIQQLLHIEWYRELIQDKQMVMIGYSDSAKDAGVMAASWAQYRAQDALIRVCEKEGVKLTLFHGRGGTIGRGGAPAHSALLSQPPGSLKGGLRVTEQGEMIRFKFGLPQVTISSLAMYASAILEANLLPPPEPKPEWKQIMDTLSDISCDMYRDYVREQPEFVPYFRSATPEQELAKLPLGSRPAKRRPTGGVESLRAIPWIFAWTQNRLMLPAWLGAGAALQHVIEAGQQDTLSEMSRDWPFFTTRIAMLEMVFAKADLWLAEYYDQRLVDKKLWPLGTKLRNQLLADIETVLAVSRDGQLMADLPWIAESIALRNVYTDPLNVLQAELLQRSRQQEQPDPRVELALMVTIAGVAAGMRNTG

SEQ ID NO: 475 - protein, 811 aa, Xenorhabdus nematophilus
MVELAIAGAESGRQLHKFGGSSLADVKCYKRVADIMANYSQPGDLMVVSAAGSTTNQLIDWLKLSQNDRISAHQVQQALRRYQQELIRGLLPEAVAETLIADFVADLERLSALLDKPVSDITYAEVVGHGEIWSARLMAAVLESQGISSAWLDARQFLRAERAAQPQVDVILSQPLLSQLLVENSDKRLVVTGFISSNNKGETVLLGRNGSDYSATQVGALAGAKKVTIWSDVAGVYSADPRKVSDACLLPLLRLDEASELARLAAPVLHTRTLQPVSLSDIDLQLRCSYQPEQGSTRIERVLASGMGAKIVTSHDDVCLIELHLFSALDFKQTYKDIDSLLKRAQIRPLATGLHTDCNLIQLCYTSEIVNSALEVLQDASLPGKLSLREGFSLVALVGAGVCKNPLHSHRFYQQLKDQPVEFIWHAEDDISLVAVLRLGQTSHLIQGLHQSLFRAEKQIGLVLFGKGNIGSRWLELFAREQKNISARSDFEFILAGIVDSRRSLLNYQGIDASRALAFFNDEATTHADDELFLWMRAHPYDDLVVLDVTASEELAGNYIDFASYGFHVISANKAAGASDSNTYRMIRDAFTKTGRHWLYNATVGAGLPINYSVRDLRESGDTILSISGIFSGTLSWLFLQFDGTVPFSDLVEQAWQQGLTEPDPRIDLSGQDVMRKLVILAREAGYEIEPDQVRIESLVPPEASVGSIDEFFENSSAINEQMQKRLEAAREMGMVLRYVARFDAKGKAKVGVEAVRSEHPLASLLPGDNVFAIESRWYRDNPLVIRGPGAGRDVTAGAIQSDLNRLSQLL

SEQ ID NO: 476 - protein, 380 aa, Xenorhabdus nematophilus
KQATAAVQSGINVDEQYGCVVPPVYLSSTYNFTGFNEPRAHDYSRRGNPGRDVVQQVLAELEGGAGAVMTSSGMSAIHLLCTVFLQPGDLLVAPHDCYGGSYRLFDSLSRRGAYNVIFVDQSDGAALRQALAQKPKLVLIETPSNPLLRIVDIRYICELAREAGALTVVDNTFLSPVLQKPLDLGADLVVHSCTKYLNGHSDLIAGAVVAKDPAIAEDLAWWANNIGVTGGAFDSYLLLRGIRTLSARVLLQQNNAAAIAEYLQQQPQVKKLYYPGLKDHPGHEIALRQQAGFGAMLSFELAGDEQTMRGFLSALKLFTLAESLGGVESLISHTATMTHAGMSAEARKQAGITDSLLRISVGIEDSQDLIADLDSAFQAA

SEQ ID NO: 477 - protein, 499 aa, Xenorhabdus nematophilus
TDKKYIVALDQGTTSSRAVILDHDANIVSISQREFPQIYPKPGWVEHDPMEIWASQSSTLVEVLAKADIRSDQIASIGITNQRETTIVWEKETGKPVYNAIVWQCRRTADICTRLKKKEGLEEYIRHNTGLVIDPYFSGTKIKWILDNVEGVRQRAENGELLFGTVDTWLVWKMTQGRVHITDYTNASRTMLFNIHDLDWDQKILDELDIPRVMLPKVAASSAIYGQTNIGGKGGTRIPIAGIAGDQQAALYGQLCVHPGMAKNTYGTGCFLLMNTGTDAVRSSHGLLTTIACGPRGEVNYALEGAVFVGGASIQWLRDELKLIADAADSEYFATKVQDSNGVYVVPAFTGLGAPYWDPYARGAIFGLTRGANSNHIIRATLESIAYQTRDVLDAMQADSGARLQALRVDGGAVANNFLMQFQSDILGTRVERPEVRESTALGAAFLAGLAVGFWKDLDEVKSKATIEKEFRPGIETTERNHKYNGWKKAVARAQEWED

SEQ ID NO: 478 - protein, 255 aa, Xenorhabdus nematophilus
MRHPLVMGNWKLNGSTHTVNDLIAGLRKELSNVDGCGVAIAPPTVYVTLANNALAGSRIALGAQDVGINLSGAYTGETSAEMLKDVGAKYIIIGHSERRTYHKESDEFIAKKFAILKEQGLIPVLCIGETEQENEAGQTEAVCARQIDAVLNTLGAEAFKNTVIAYEPVWAIGTGKSATPAQAQAVHKFIRDHIAKQDAAIAEQVIIQYGGSVNASNAAELFTQPDIDGALVGGASLKADAFAVIVKAAAEAKKA

SEQ ID NO: 479 - protein, 321 aa, Xenorhabdus nematophilus
IKRIGVLTSGGDAPGMNAAIRGVVRAALTEGLEVYGIYDGYLGLYENRMKKLDRYSVSDMINRGGTFLGSARFPEFRDDKVREIAIENMRKNEIDALVVIGGDGSYLGAKKLTEAGFPCIGLPGTIDNDVAGTDYTIGYFTALDTVVEAIDRLRDTSTSHKRISIVEVMGRYCGDLTLSAAIAGGCEFIVLPEREIPFDREELLAEIQAGIQKGKRHAIVAITEHVCDVDELAKYIEAETRHETRATVLGHIQRGGAPVAYDRILASRMGAYSVQLLLEGCGGRCVGIQNEKLVHHDIIDAVQNMQRIFKKDWLETAKKLY

SEQ ID NO: 480 - protein, 296 aa, Xenorhabdus nematophilus
FEEQLSNCQQHINEKLMATFSSLPFLGSPLATAMQHGAVLGGKRLRPFLVYAVGKMLGLPKESLDAPALAIECIHAYSLIHDDLPAMDNDDLRRGQPTCHIKFGENHAILAGDALQSLAFEILAKHNMPNIALSDRLEMVAELAISSGIAGMCGGQSLDLQAEGKQIDLAALEKIHQHKTGALIRCAVRLGAYGAGARGREVLPLLDQYAQAIGLAFQVHDDILDVIGNTEIIGKRQGNDQQLGKSTYPALLGLEQAQKKAKDLHEDAIAALTELEKQFYNTVTLKQLAGFIIERN

SEQ ID NO: 481 - protein, 619 aa, Xenorhabdus nematophilus
MSIDIAKYPTLALAETPEELRLLPKDTLPKLCDELRQFLLNSVSRSSGHFASGLGTIELTVALHYVYKTPFDNLVWDVGHQAYPHKILTGRRDRINTIRQKNGLHPFPWRNESEYDTLCVGHSSTSISAGLGMAIAAKHEDKGRKTVCVIGDGAITAGMAFEAMNHAGDIDPDMLVILNDNEMSISENVGALNNHLAQLLSGKLYTTLRESGKKVFSGLPPIKELLKKTEEHLKGMVVPGTLFEELGFNYIGPVDGHDVLALTQTLKNMRELKGPQFLHIMTKKGRGYAPAEKDPISWHAVPKFDPSTGSLPKSSDTRPTFSKIFGEWLCEEAATDKKLMAITPAMREGSGMVRFSREYPEQYFDVAIAEQHAVTFAAGLAIGGYKPVVAIYSTFLQRAYDQLIHDVAIQNLPVLFAIDRGGIVGADGQTHQGAFDLSFLRCIPNMVIMAPSDENECRQMLHTGYQYQEGPVAVRYPRGAGTGAELQPLEILPIGKGVIRRQGEKIAILNFGTLLPNALQAAESLNATVVDMRFVKPLDKELVLEMASRHDLLVTLEENAIMGGAGSGVNELLMQTGNSVSVLNLGLPDYFIPQGTQAELHSDLGLDSAGILNAIEKRL

SEQ ID NO: 482 - protein, 329 aa, Xenorhabdus nematophilus
FPGRRMRRVRRHDFSRRLVAENQLTVNDLIYPVFVMEGTNQRQEVPSMPGVYRLTTDLLLKEAEEIARLGIPVLSLFPVIESDKKSLDAKEAYNPDGLIQRSIRALKDAVPELGLLTDVALDPFTTHGQDGVIDQDGYVINDITKEILVKQALSHAEAGAEIVAPSDMMDGRIGAIREQLENDGYVNTQIMAYSAKYASCYYGPFRDAIGSSANLKGGNKMTYQMDPANSDEALQEIAQDLQEGADSVMVKPGMPYLDVIRRVKDTFGVPTFAYQVSGEYAMHMAAIQNGWLKEQPAIMESLLCFKRAGADGILTYFAKRAAQWLHEQK

SEQ ID NO: 483 - protein, 540 aa, Xenorhabdus nematophilus
MTPSEIKRLYFIIKVFLTYGLDELIPKIRLTWPLRFGRYFLFWLPNRHKDKPLGERLRLALQELGPVWIKLGQMLSTRRDLFPPEIADQLSLLQDRVVSFDGAVARQSIETALGGALETWFEDFEQQPLASASIAQVHTARLKENGRNIVIKVIRPDILPVIKADVRLMYRLANLVPLLPDGRRLRPLEVVREYEKTLLDELNLLREAANAIQLRRNFEKSPMLYVPEVYPDYCRENVLVMERIYGIPVSDVAALEAQNTNMKLLAERGVQIFFTQVFRDSFFHADMHPGNIFVSRERPEDPTYIGIDYGIVGSLNKDDKRYLAENFIAFFNRDYRKVAELHVDSGWVPADTNVEDFEFAIRTVCEPIFEKPLADISFGHVLLNLFNTARRFNMAVQPQLVLLQKTLLYVEGLGRQLYPQLDLWKTAKPFLEDWLHDQVGIPAIMRAFKEKAPYWAEKLPELPELVYGTLQQHKRLQTSIDQISLQLKQQRHNQQKPLYLLGIGATLFICGGLFFISNLVHLASGLIGAGIVSWLLGWFK

SEQ ID NO: 484 - protein, 448 aa, Xenorhabdus nematophilus
QNRPDEKQRLEDLICLRKNFKASLNEMAEAISCDFGHRSRHESIMAEAVIVLNEIDLCLRSLKKWAKPQRYKAGWQLWPAKAEIRHVPLGVVGIMAPWNYPVNLTLIPLIAAIAAGNHVFIKPSEHTLHTNAYLEKLLSKIFPENRVSIAQGGADLAADFSALPFDHLLFTGSKANGKKVMAAAAQNLTPVTLELGGKSPALVAPDADLKKAAARIITGKLFNSGQTCIAPDYILLSENVIEPFIAEIKEQVSKRYPQPNNFPDYTSIINDNQYQRLIKLLEDAITRGHQTIPLMPLTDQEQALKQRVFAPTLVLNPDDSSAIMQEEIFGPLIPVKTYRSYDEAIHYIASHERPLAFYCFSRNNKYIEAALSHIVAGSICINDTLYQFACTGLPFGGVGPSGMGQYHGYEGFKTFSKAMPILRKYNPSLTDLLRPPYGQFINMVIRIL

SEQ ID NO: 485 - protein, 214 aa, Xenorhabdus nematophilus
MLQVYLVRHGETEWNLARRIQGQSDSPLTETGRRQALLVAQKVKSENITHVITSDLGRTRQTAEIIAQACGCEVILEPRLREINMGVLENRDLNSLTQEEETWRKSLVDGTPNGRIPEGESMSELSERVRAALESCRDLPAGSRPLLVSHGMALVSLVCSILGLPANSERRLRLRNCSISRVDYQDSPWLAPGWIVETAGDITHLDMPALDELQ

SEQ ID NO: 486 - protein, 540 aa, Xenorhabdus nematophilus
LAQYVYSMHRVGKIVPPKRHILKNISLSFFPGAKIGVLGLNGAGKSTLLRIMAGIDKDIEGEARPQPGIKIGYLPQEPKLNLEHTVREAVEEAVGEVKHALTRLDEVYAAYADPDADFDKLAKEQGELEAIIQSHDGHNLDNQLERAADALRLPAWDAKIEHLSGGERRRVAICRLLLEKPDMLLLDEPTNHLDAESVAWLERFLHDYEGTVVAITHDRYFLDNVAGWILELDRGEGIPWEGNYSSWLEQKDARLAQEAASEAARRKSIEKELEWVRQNPKGRQAKGKARLARFEELNNVEYQKRNETSELFIPPGPRLGDKVLEVSNLTKSYGDRVLIDDLSFSLPKGAIVGIIGPNGAGKSTLFRMLSGQEQPDSGSIALGETVTLASVDQFRDAMDDKKTVWEEVSGGQDIMRIGNFEIPSRAYVGRFNFKGVDQGKRVGELSGGERGRLHLAKLLQVGGNMLLLDEPTNDLDIETLRALENALLEFPGCAMVISHDRWFLDRIATHIIDYQDEGKVTFFEGNFSEYEDYKKRTLGA

SEQ ID NO: 487 - protein, 234 aa, Xenorhabdus nematophilus
VGYRSIDTAAIYHNETGVGKALRESCIPREEVFITTKLWNDRHQDAKTALQESLDRLQLEYIDLFLIHWPVPQQDKYVETWKQFIELKESGLARSIGVCNFHIEHLQKLFSETGIVPAINQIELHPLMQQRQLHSWNATHHIITESWSPLSRGGKGVFDHPLVESLAIKYDKTPAQIVIRWHLDSGMIAIPKSVTPSRIKENFDVFDFRLEKEDLTIMAGLDIGKRLGPNPDTY

SEQ ID NO: 488 - protein, 395 aa, Xenorhabdus nematophilus
DMSEKKLETRLVEVGRKRKYTQGAVNPIIQRTSSVIFKTVDAMRHAIKNRANGELFYGRRGTLTHFAFQEAMAELEGGVGCALYPSGTAAITNSILAFVETGDHVLLTGSAYEPTQEFCKNILKKMQISTDYFDPRLGEEIALLIQPNTKVIFLESPGSLTMEVQDIPAIVQAARRVNPDIVIMIDNTWAAGVLFRALDFGIDISIQSATKYIIGHSDGMLGTAVANQRCWDQLRESSYLMGQIADPDTVYSANRGLHTLAVRLKQHEESSLIIAKWLSQRPEVAEVYHPALPSCPGHNYFQRDFTGSCGLFSFMLNVSLTPGQLSDYLDNMQYFKMAFSWGGFESLILGISPESLAVLRNYNFPQKTGTLIRVHIGLEDPQDLIDDLNAGFSRI

SEQ ID NO: 489 - protein, 469 aa, Xenorhabdus nematophilus
FPETFLWGAATSAYQVEGAAEKYGKKLSQQDILNNKPGLADSHITSDHYHRYKEDVALMKELGLKAYRFSIAWSRIFPDGIGKPNDEGVQFYHNLIDELLENGITPIPTLYHYDMPMALVEKYHGWIDRQSVNDFAYYAEFVIREYGKKAKYWLTINEQSIIVQFWTKKCFIPEQYLDNEQIKYQINHHMNLAHAIACKLVHQWVPEGQVGAALGYSAIYPLTSKPEDNLAAQNANDLRNYYFTDIYLKGEYNQSALIYLKNQGLAPNIEDGDMALIKEGYSDFLALNYYCSHAATAAPEGAQRRMDGFNPTGIKGQMDGYEIQPDYYQIHKNPQLDTTDWDWTIDPHGLEYLLRDLYTRYQKPLMITENGFGADDVLESDGTIHDSYRIDYLKQHLQAIKRAMDSGVVVLSYNPWSFIDLLSTSNGYKKRYGFVYVNRTDDDLKDLARYKKDSFYWYQNVIQTRGGSL

SEQ ID NO: 490 - protein, 245 aa, Xenorhabdus nematophilus
KVTIITGGSRGIGKATALDLAKKGHHVCISYRSRRERAQEVVDMIQSLGQSALAVQMDVTDEQQVTALFQKAEKELGYITGLVNNAGILKAQTTIEQLTAERLNEMFATNITGYFLCAREAVKRMAFRHGGQGGAIINVSSAAARLGAPYEYIDYAASKGAVDTLTTGLSLEVAAQGIRVNAVRPGLIYTEMHADGGEPDRVDRIKDSLPMKRGGQPEEVAAAIAWLLSDDASYVTGNFMDLAGG

SEQ ID NO: 491 - protein, 369 aa, Xenorhabdus nematophilus
MKSRAAVAFGPNRPLEIVEIDVAPPKAGEVLIKVSHTGVCHTDAFTLSGDDPEGLFPVVLGHEGAGVVIEVGEGVTSVKPGDHVIPLYTAECGQCDFCQSGKTNLCIAVRDTQGKGLMPDGTTRFSYNGQPVYHYMGCSTFSEYTVVAEVSLAKINPEANHEHVCLLGCGVTTGIGAVHNTAKVQPGDSVAVFGLGGIGLAVLQGARQAKAGRIIAIDTNPTKFELARQFGATDCINPNDHDKPIQQVILDMTKWGVDHTFECIGNVNVMRAALESAHRGWGQSVIIGVAGAGQEISTRPFQLVTGRTWKGTAFGGVKGRSQLPGMVEDAMKGEIELEPFVTHKMPLEDINEAFELMHEGKSIRTVIHY

SEQ ID NO: 492 - protein, 323 aa, Xenorhabdus nematophilus
MKALLLEQRDTLSASIQNIDTTQLPPGDVIVDIHWSTLNYKDALAITGKGKIIREFPMIPGIDFSGVVRHSEDPRFHIGQQVLLTGWGVGENRWGGLAEQARVSGEWLTPLPPGLSTRQAMIIGTAGFTAMLCIMALEQGGITPESGEIAVTGATGGVGSTAITLLSLLGYSVVAISSKPESQEYLLSLGAKEILPVSDFSQPARPLEKQRWSGVIDTVGGTILAKLLAQVSHNGTVAACGMASDINLPTTVMPFILRNVRLQGVESAIVSAADRPKIWERLQKLLPESFYQQTANEISLDQVIEHANKLVNNQSTGRTVVKI

SEQ ID NO: 493 - protein, 146 aa, Xenorhabdus nematophilus
MADKFRILLLNGPNLNLLGTREPETYGKLTLDDIVSKLSQEAHQSGIELFHLQSNAESELIERIHTARGNTDFILINPAAFTHTSVALRDALLAVDIPFIEIHLSNVHAREPFRHHSYLSDIAVGVICGLGADGYSFALQAAVNRL

SEQ ID NO: 494 - protein, 449 aa, Xenorhabdus nematophilus
MLEKIVIANRGEIALRILRACKELGIKTVAVHSAADRDLKHVLLADETVCIGPAASVKSYLNIPAIISAAEITCAQAIHPGYGFLSENADFAEQVERSGFTFIGPKAETIRLMGDKVSAISAMKKAGVPCVPGSDGPLGDDTEKNKSIAQRIGYPVIIKASGGGGGRGMRVVRSDKELEQSIAMTRAEAKAAFNNDMVYMEKFLENPRHVEIQVLADGQGNALYLAERDCSMQRRHQKVVEEAPAPGISAELRRSIGERCANACMEIGYRGAGTFEFLYENGEFYFIEMNTRIQVEHPVTEMITGVDLIKEQLRIASGMPLSIKQEDIVIKGHAIECRINAEDAKTFLPSPGKITHFHSPGGFGVRWESHIYAGYTVPPYYDSMIGKLITYGETREVAIARMKNALAELIIDGIKTNIDLQMSIMNDENFQKGGTNIHYLEKKLGLHDK

SEQ ID NO: 495 - protein, 535 aa, Xenorhabdus nematophilus
GVTAQELAVYGIRDISEVIYNPGYELLFSEETKSSLQGYEKGTLTNLGAVAVDTGIFTGRSPKDKYIVRDEVTRDTVWWADQGKGKNDNKPLSQETWSHLKGLVTQQLSGKRLFVVDAFCGANADTRLKVRFITEVAWQAHFVKNMFIRPSDEELIDFTPDFIVMNGAKCTNPQWKEQGLNSENFVAFNLTERMQLIGGTWYGGEMKKGMFSMMNYLLPLKGIASMHCSANVGEQGDVAVFFGLSGTGKTTLSTDPKRKLIGDDEHGWDDDGVFNFEGGCYAKTINLSKEAEPDIYHAIRRDALLENVTVLADGSVDFNDGSKTENTRVSYPIYHIENIVKPVSKAGHATKVIFLTADAFGVLPPVSRLTPEQTQYHFLSGFTAKLAGTERGVTEPTPTFSACFGAAFLSLHPTQYAEVLVKRMQASGAKAYLVNTGWNGTGKRISIKDTRAIIDAILSGDIEDADTVELPIFDLTVPTTLPGVDSGILDPRNTYADKSEWDVKAKDLAERFINNFDKYTDTAAGAALVKAGPKL

SEQ ID NO: 496 - protein, 661 aa, Xenorhabdus nematophilus
TRKTLANAIRFLSMDAVQKAKSGHPGAPMGMADIAEVLWRDYLNHNPVNPHWADRDRFVLSNGHGSMLIYSLLHLTGYDVSIDDLKNFRQLHSKTPGHPEYGYTAGVETTTGPLGQGIANAVGFAIAERTLAAQFNRPGHDIVDHHTYVFMGDGCMMEGISHEVCSLAGTLKLGKLIAFYDDNGISIDGEVEGWFTDDTAARFEAYGWHVIRGVDGHDSDAITAAIEEARKETGKPSLLMCKTVIGFGSPNKAGKEECHGAPLGDAEIEATRKALGWEHPAFEIPQDIYAGWDAKEAGKAKESAWDAKFAAYAEAYPELAAEFSRRTSGELPENWEAESKAFIENLQQNPASIASRKASQNALEAFGKVLPEFMGGSADLAPSNLTMWSGSKPLNEVQDGNYIHYGVREFGMSAIMNGIALHGGFVPYGATFLMFVEYARNAVRMAALMKIRSIFVYTHDSIGLGEDGPTHQPVEQIASLRVTPNMSTWRPCDQVESAVAWKYAIERKDGPTSLIFSRQNLAQQERTAEQLANIEKGAYVLKDCAGQPELILIATGSEVELAVKAADQLSAEGRKIRVVSMPSTDAFDKQDAAYREAVLPAAVSARVVVEAGIADYWFKYVGINGAIVGMNSFGESAPADALFKEFGFTVENVVAKAAALL

SEQ ID NO: 497 - protein, 344 aa, Xenorhabdus nematophilus
MTIRVAINGFGRIGRSVLRALYESGRRAEIEVIAINELADAEGVAHLLKYDSSHGRFAWNVRLNKIGLNNTVLHVGDDSIRLFHQPDISDLPWKELGIDIVLDCTGKYGERIDGEAHLASGAKKVLFAHPGGNDLDATVVYGVNHELLSAEDCIVSNASCTTNCIIPIIKVLDDAFNIESGTVTTIHASMNDQPVIDAYHSDLRRTRAASQSIIPVDTKLAAGITRIFPKFSNRFEAISVRVPTINVTAIDLSVTVSAAVNVSEVNQLLQKSAVSSFRGIVDFTDLPLVSTDFNHDPHSAIVDGTQTRVSGNHLIKTLVWCDNEWGFANRMLDTTLAMASKGFK

SEQ ID NO: 498 - protein, 387 aa, Xenorhabdus nematophilus
MSVIKMTDLDLAGKRVLIRADLNVPVKDGKVTSDARIRASLPTIEAALSQGAKVMVTSHLGRPTEGEYNEEFSLQPVVDYLKAALSSPVRLEKNYLNGVEVAEGELVVLENVRFNKGEKKDDETLSKQYAALCDVYVMDAFGTAHRAQASTHGVAKFAPIACAGPLLSGELEALGKALHNPARPMVAIVGGSKVSTKLTVLDSLSKIADQLIVGGGIANTFVAAEGHNVGRSLYEDDLIPEAKKLLECCDIPVPTDVRVATEFSETAEATLKSTSEIKDEEQILDLGDASAERLAEILQGAKTILWNGPVGVFEFPNFRKGTEIIARAIAESDAFSIAGGGDTLAAIDLFEIADKISYISTGGGAFLEFVEGKKLPAVVMLEERANS

SEQ ID NO: 499 - protein, 358 aa, Xenorhabdus nematophilus
MSKIFDFVKPGVITGDDVQKVFAIAKEHNFALPAVNCVGTDSINAVLETAAKVRAPVIIQFSNGGAAFVAGKGLKAEGQQAAILGAISGAYHVHQMAEHYGVPVILHTDHCARKLLPWIDGLLEAGEKHYAQTGKPLFSSHMIDLSEESLEENIEICSQYLARMAKIDMTLEIELGCTGGEEDGVDNSHLDSSSLYTQPEDVAYAYEKLNAISPRFTIAASFGNVHGVYKPGNVKLTPKILRNSQDYVSEKFNLPHNSLDFVFHGGSGSTAEEIQEAVSYGVVKMNIDTDTQWATWEGILNYYKKNEGYLQGQLGNPEGADKPNKKFYDPRVWLRAGQVSMEVRLEQAFKELNAVDVL

SEQ ID NO: 500 - protein, 448 aa, Xenorhabdus nematophilus
MSSSPEAIQKHDAPDYSHKNLTAQQQSVIKKLFRRLILFLFVLFIFSFLDRINIGFAGLTMGKDLGLTSTMFGLAATLFYVTYVAFGIPSNIMLGIVGARRWIATIMVLWGIASTATMFATGPTSLYILRMLVGIAEAGFLPGILVYLTYWFPAYYRARANALFMIAMPVTMAFGSLASGYILEMDGIWDLRGWQWLFFLEGFPSVLLGIVVWFYLDDSPEKAKWLTNEDKKCLQEMIENDKVSLAHAEPSHAKTSLWREIFTPIVLMYTFAYFCLTNTLSAINIWTPQIMQSFNQGSSHTVIGLLTAIPQFCTILGMIYWSRRSDRLQERKMHTALPFLFAAAGWILTSLTGNSMIQLLGIIMASTGSFTAMAVFWTTPDQSISLRARAIGIAVINATGNVGSAVSPLLIGWLKDQTGNFNSGLYFVAGLLVIGALMVLLIPMKHAR

SEQ ID NO: 501 - protein, 478 aa, Xenorhabdus nematophilus
LHDSLLLRQQGYIDGKWLDADNKATFAVTNPATGDIIANVSDMGAAETHRAIKAAEKALPAWRDLTAKKRSQILRQWFNLVIDNQKTLAELLSIEQGKSHAEAMGEIAYGASFIEWFAEEGKRIYGETIPSPMPGCRTSTIKQPIGVVAAITPWNFPNAMITRKVSPALAAGCTVVLKPAAETPLSALALVVLAEQAGVPAGVFNIVTGMDAKAIGEALTSSPIVRKLSFTGSTRVGKLLMAQSADTVKKLSLELGGNAPFIVFDDADLDAAVKGAMAAKFRNSGQTCVCANRILVQENIYEAFAERLAQAARELHVGPASDSSSQQGPLINQAAIDKVQAHVSDAVSRGARLLTGGKSHKLGGLFFEPTVLADIDETMQVAHEETFGPLAALFKFRDEEEAIRIANSTEYGLAAYFYSRDIGRIYRVAEALESGMVGINEGLISNEAVPFGGIKQSGLGREGSRYGIEDYLEVKYLC

SEQ ID NO: 502 - protein, 488 aa, Xenorhabdus nematophilus
MTTINHWINGKNVGSSTYFETVNPATGEVLAEVASGGKEEIDQAVAAAKDAFPKWANTPMKERARLMRRLGELIDQNVPEIAAMETSDTGLPIHQTKNVLIPRASHNFDFFAETCQQMNGRTYPVDDKMLNYTLIQPVGVCALISPWNVPFMTATWKVAPCLALGNTAVLKMSELSPLTANRLGELALEAGIPAGVLNVVQGYGNTAGDALVKHHDVRAVSFTGGTATGRLIMQNSGLKKYSMELGGKSPVLIFEDADIERALDAALFTIFSLNGERCTAGSRIFIQESIYPEFVKRFAERASRLRVGDPQDLNTQVGSLISHQHWEKVSGYIQLGIEEGATLLTGGPDKPADLPDHLKNGHFLRPTVLADVDNRMRVAQEEIFGPVACLLPFKSEEDGLRMANDVEYGLASYIWTQDVSKVLRLAQGIEAGMVFVNSQNVRDLRQPFGGVKASGVGREGGEYSFEVFAEVKNVCISMGNHPIPRWGL

SEQ ID NO: 503 - protein, 448 aa, Xenorhabdus nematophilus
SQYIVAKFGGTSVANFDAMNNCADIILANRDVRVVVLSASAGITNLLVTLASGCNSDKREKCLKQIRDIQYAIIGRLNESDVIKDEIDRLLDNIATLSEAASLATSDALTDELVSHGEVMSTLLFVELLRQRNADVEWFDIRRIMRTNDQFGQAEPDTTQLNILAEQHLQPRLNNTIVITQGFIGKEEKGRTTTLGRGGSDYTAALLGEALGLKRVDIWTDVPGIYTTDPRVVPTATRIDKIAFDEAAEMATFGAKILHPATLLPAVRCGIPVFVGSSKQPQAGGTLVCDRTATPPRFRALALRRKQTLLTLHSLKMLHARGFLAEIFILLSRHNISVDLITTSEVSVALTLDTTGSTSTNGSLLTNALLTELSTLCRVEVEEDLALVAIIGNKLSQARGLGKEIFGPLESFNIRMISYGASSHNVCLLVPGQDAEEVVQTLHKNLFE

SEQ ID NO: 504 - protein, 548 aa, Xenorhabdus nematophilus
MKNINPSQTEAWKALQQHFEQIKDTHLRDLFEQDKARFATFSATFDDQMLVDYSKNRITAETLEKLQALAKETDLSGAIHSMFSGEKINRTEDRAVLHIALRNRSNSPIKVDEEDVMPQVNAVLAKMKSFSERIISGEWKGYTGKAITDVVNIGIGGSDLGPYMVTEALKAYKNHLNMHFVSNVDGTHIAETLKSLDPETTLFLIASKTFTTQETMTNAHSARDWFLQSAVDEVHVAKHFAALSTNEQEVSKFGIDPQNMFEFWDWVGGRYSLWSAIGLSIVLSIGYDNFEQLLNGAHAMDKHFAQTAPEQNIPVILALIGIWYNNFFGAETEAILPYDQYMHRFAAYFQQGNMESNGKYIDRNGSPVDYQTGPIIWGEPGTNGQHAFYQLIHQGTKLIPCDFIAPAISHNPIGDHHSKLLSNFFAQTEALAFGKTQAQVEAEFVAAGKNVQDVANVVPFKVFEGNRPTNSILLREITPFSMGALIAMYEHKIFAQGAILNIFSFDQWGVELGKQLANRILPELHDSESVNSHDSSTNGLINRFKEWR

SEQ ID NO: 505 - protein, 817 aa, Xenorhabdus nematophilus
MKKPQLDKAEFQAALTRQLQRFGLDLAQGVTTHQWWQTISATLLELLPAYRQNNHHQNNHHQIDNLPPTDGSKGKQRHVNYISMEFLIGRLTGNNLLNLGWYDDVQAYLAEYGVALSDVLEEETDPALGNGGLGRLAACFLDSMATINQPAIGYGLNYQYGLFRQSFEQGLQIETPDDWERNTYPWFYRNIQLNVDVSFGGEMVTTTDGGEIWRPAFTLTGEAWDLPVVGYKNGVIQPLRLWQATYDNPFDLSLFNDGQFLHAEQQGIEATSLTKVLYPNDNHRAGKRLRLMQQYFQCACAVADILRRPQLAGRKIQELPQYEVIQLNDTHPTIAIPEMMRLLIDDLQLDWDTAWSITGQTFAYTNHTLLPEGLERWDEHLIIELLPRHHRIIQEINNRFRKTVEKNWPGNQQIWEKLAVIHDNQVRMANLCVVACFAINGVAALHSSLIVTDLFPEYHQLWPQKFHNVTNGVTPRRWLKQCNPALSSLIDQTLGHEWLSDITELKRLEPYAADAAFREAYRTVKQNNKIRLSNYINKTMGLKLDPHAIFDVQIKRLHEYKRQHLNLLHILSLYRQIQENPALDIYPRVFLFGAKAAPGYYLAKNIISAINHAAEKINHDPIVRDRIKIAFIPDYNVSKAELMIPAADVSEQISTAGKEASGTGNMKLALNGALTIGTLDGANVEIAEQVGNDNIFIFGHTVEETKTLLREGYDPKNILQQNKQLQQIMDSLSSGEFSHGDKQAFDLMLHSLIDGGDPYLVLADFASYCAAHQQIDELYRNTPHWTRSTILNTARMGTFSSDRTIQDYQQRIWQVKQ

SEQ ID NO: 506 - protein, 377 aa, Xenorhabdus nematophilus
YLIIDGEKHIDAASGTFNLPLGYTNHRLAEKLKQQIDRCTHLSSAYTREMSQYILTKLVKYTPKGIDRMWLRDVSGSGAVECAIRIAQKATGRSGIVSFFLAHHGQSLATAQVSGNAFRLKNFHINIEGSIKIPAPVSVMAESQEETPQYIDLEQFIQLGSSDNIACLIIEPIQGNGGNIVFPVEFYRKIREICHQHGIIIIADEVQTGFGRTGTFFASTGYAKELEPDIIVFAKGAGGIGIPTGGVLMRSSLDVLESFEHSSTSGANPLSLVALNEIINIIEDEHILDNVIQNETFLRDGLLDLQHKYSEITGVRGVGYMFGFDTPTPEFAAQAIATASRHKLILRGSRYGKGRALKVRPPLICTQEHLAEILHKL

SEQ ID NO: 507 - protein, 306 aa, Xenorhabdus nematophilus
VVVDIAVCGICGTDVGIITGFYPVAVPGTTLGHETTGIVAQVGSGVTCFQAGDRVVINPTYSCGHCRMCLTGSPNHCEKKLGTEAGVSYDGAFAEQYLAKESSLIKLEPHVSMEAASLTEPLSCTLTGVDKLGITHTNIRAVVAGAGPMGMLYLWALHERGVNAFIIEKNPYRMQFASQNLPVGCRLYADFDEALIQEFGDKSTLIDLCVDTTGQLTEYIFDHLAPGGKLLNVALKDKHASLDILKIADKSLSVIGSIDSLNNSFERAYVMIRDGVIPVDRLVSQVFDFDDYQQAFLTVGCDIAAK

SEQ ID NO: 508 - protein, 205 aa, Xenorhabdus nematophilus
IIFDIDGVIVDSEQLHFDVLRELAPDHTHEIRPQQLIGLSLAQTLSSIGVPLQAQKSITDRIISTYQDKLSPHYLRSGVTDLISALQQNEIVFGFVSTAPREVCLLNLGLLNLREEPALISGDDVKQTKPFPDPYLAMLKLKAMDVRQTLVIEDTDLGILAAKQAGIPWIYAWPHALSGAEKYEQSTGIIRELVDIPQIFGLLNE

SEQ ID NO: 509 - protein, 675 aa, Xenorhabdus nematophilus
NPFFYTSVLPFQAPPFDKIKETDYSPAITAGIKQKLEEVEKIANNPAPPDFENTFIALEKTGTTLDRVTNVFWAMTSANTTDGLQKLSEEMSPKLAAMNDEIMLNSKLFNRIKTIYQQRETLNLDSESLRLVEVIYKQFELAGANLSDADKIKMKALNQEAATLRTQFTNKLLAATKDGALTIKDKTLLAGLSDGEMAAAAQAASERKLDNQWLFVLQNTTQQPVLQDLKDRDTRKALFEASWNRAEKGDDNDTRQTLSRLAKIRAEQAKLLGFKDYASWKLQSQMAKTPEVALKFLRDIVPAATARAEREAKDIQAVIDQQKGGFKVEAWDWPFYAEQVRKARYDLDESQIKPYFELNNVLNNGVFYAANLLYGITFKERKDIPVYHPDVHVYEVFDKDGQQLALFYSDYFKRDNKAGGAWMSNFVDQSRLFGTKPVIYNVANFTKPAPGQPALLSYDDVITIFHEFGHALHGMFADQEYPTLSGTSTARDFVEFPSQINEYWARDPKVFANYARHYQTGEVMPQALMDKINQADKFNKGYQMTELLSAALLDMHWHMLAADKPQQDVNKFEAASLQEDKIHLNYVPPRYRSSYFKHIWGGGYAAGYYAYLWTEMLADDAFAWFTEHGGLTRENGQIFRDKILSRGNSTDLEKLYIDWRGKPPSTESMLKNRGL

SEQ ID NO: 510 - protein, 353 aa, Xenorhabdus nematophilus
MNELKNDRYLRALLRQPVDITPVWMMRQAGRYLPEYKATRQEAGDFISLCKNTELACEVTLQPLRRFPLDAAILFSDILTIPDAMGLGLYFEAGEGPRFQSPILNHADVAKLPVPDPEMELGYVMDAVRAIRKALAGQVPLIGFSGSPWTLATYMVEGGSSKAFTKIKAMMYAEPTTLHLLLDKLADSVILYLNAQIKAGAQSVMIFDTWGGVLSQRDYQEFSLRYMHKIVDGLIREHEGRRVPVTLFTKGGGQWLEAMAATGCDALGLDWTTNIADARRRVGDKVALQGNMDPSMLYAQPARIEQEVSTILQDFGTGNGHVFNLGHGIHQDVPPEHAGAFVEAVHRLSAKYH

SEQ ID NO: 511 - protein, 295 aa, Xenorhabdus nematophilus
QVKTFFLSLQDEICKQLERLDDHSHFIEECWQREEGGGGRSRVLKSGKVFEQAGVNFSHVTGDSLPSSATAHRPELAGRSYQAMGVSLVIHPQNPYVPTSHANVRFFVAEKEGEPPIWWFGGGFDLTPYYGFKEDAVHWHTVASTLCQPFGEDIYPIYKKWCDDYFFIKHRNEPRGIGGLFYDDLNSPDFDTCFNFTQAVGNGFLSAYLPIVERRKDIGWGERERQFQLYRRGRYVEFNLVWDRGTLFGLQSGGRTESILMSMPPLVRWEYNYSPEPNSPEEELYTSFLIKKDWI

SEQ ID NO: 512 - protein, 201 aa, Xenorhabdus nematophilus
VGSIFAVSQVQADGDTNVLRKGREYLCAGYAIYGPSTLFVITFGLGVVGFTLDPSDGQFKLTNARMRVPTETTEFAVNSSRQRFWDEPIRRYVDECLAGSAGPRGQDFNMRWTASMVADVHRILTRGGVFLYPADESNRRAGGKLRLMYEANPMAFLVEAAGGAASTGTEDILRIQPQAHHQRVSVLLGSSNEIQRLVQFH

SEQ ID NO: 513 - protein, 548 aa, Deinococcus radiodurans
MAKQLVFDESARRSLERGVNAVANAVKVTLGPRGRNVVIEKKFGSPTITKDGVTVAKEVELEDKLENIGAQLLKEVASKTNDITGDGTTTATVLGQAIVKEGLRNVAAGANPLALKRGIDKAVAVAIEEIKKLAVSVEDSEAIKKVAGISANDETVGQEIASAMDKVGKEGVITIEESKGFDTEVDVVEGMQFDKGFINPYFITNPEKMEAVLEDAYILINEKKISNLKDMLPVLEKVAQTGRPLLIIAEDVEGEALATLVVNKLRGTLNIAAVKAPGFGDRRKEMLRDIAAVTGGEVVSEDLGHKLENVGMEMLGRAARIRITKDETTIVDGKGEQAQIDARVNAIKGELDSTDSDYAREKLQERLAKLSGGVAVIRVGAATETELKEKKHRYEDALSTARSAVEEGIVAGGGTTLLRVIPAVRKAAESLTGDEATGARILIRALEEPARQIAANAGEEGSVIVNAVVGSDKARYGFNAATGEYVEDMVAAGIVDPAKVTRTALQNAASIGALILTTEAIVSDKPEKAAPAMPQGGGDMGGMGGMDF

SEQ ID NO: 514 - protein, 388 aa, Deinococcus radiodurans
MTSPFRLSARAQSLKPSATVAVTSRALELQRQGLDVISMSVGEPDFDTPPHVKAAGIAAIEEGKTKYTPVSGIPELREAISAKFRRENGLDYAPNAVTVTSGGKQALFNAFFALLNPGDEVLIPAPHWVSYPEMVALTGAVPVTVPTTPQQGFQLDPDALAAAITPRTRMVILNSPGNPTGAVFPPETLRAVADLATQHGLMIVTDEIYEHLVYDAEQVSIGTYAPEHTLTINGASKAYAMTGWRIGYAGGPREVIAAMNALQSQSTSNASSVSQYAALAALEQHEETMRFIDRARTAYRERRDRIVAGLNALGLPTPTPQGAFYVMADTRAIHTDELEAARIILDEAQVAVVPGTDFAAPGQVRLSYATSMDNIEEVLRRLEGVVRR

SEQ ID NO: 515 - protein, 334 aa, Deinococcus radiodurans
MTQPDMAYPNPAGIKRVAVLTSGGDAPGMNAAIRAVVRTGAQQGIEVVGVRRGFSGLHRGEVQLLGPRDVANTIQRGGTILLTARSHTWRSPEGRAKGAAVLREWGVDGLVVIGGDGSFHGGYFLQEEHGIPVIGVPGTIDNDLYGTDHTIGYFTAVETALEAVDKLRDTGASHERIFVIEVMGRHAGHIALDVAVAGGAEEVFIPEDKKPIGDVVNIVKDSIAKGKRGSIIIVAEGYDGGAEAVAQAIHAGTGLETRVSILGHIQRGGTPVSSDRILASRLGEAAVYALMDGKKGVMVGRIGGGIAYTPLHETWEKRKDVSRDLYRCAKMLSI

SEQ ID NO: 516 - protein, 408 aa, Deinococcus radiodurans
MSKFAVRKFYTSESVSEGHPDKLSDFISDSILDEFLRQEPTSRVAVETLVTTGMAVVAGEVRAHTAHVDIQKTVREAVQRVGYTRANYGFDAEYSAVLVAIHEQSPEIASGVDHSEEWREMSEAERQKPENAYSMVGAGDQGLMFGYATDETPELMPLPISLAHGLTRRLAELRKDGTLPYLRPDAKAQVTVVRNGEPHSATETAVDTIVISTQHSDDVTQEQIRADMLEHVIPAVIPAELLNEQTRYFINPSGRFVIGGPHGDTGLTGRKIIVDTYGGAVPHGGGAFSGKDPTKVDRSAAYYARYVAKNIVAAGLARRALVEIAYAIGRAHPVSLRVDTYGTGTVSDEKLDELIAAHFDARPQAIIAQLDLQRPIYAQTAAYGHFGRPEFPWEQTDRAQALKEAAQG

SEQ ID NO: 517 - protein, 460 aa, Deinococcus radiodurans
MQVRRRGKIGHRSVLSHGLCARRAPTLYTPFMSDSVLRALTAALEADPADTGVREHLVRLLLDAGQGEQALALVRVWLAADPTRQVALGLAVRAADLAGDSQAAASYQTMLNALYQLEQGQSAPAPARQPVPTVSENGPPPRNDAPEYWVDPDEAPAQQQPYPTGTDFSSRWQPLAGDVSLKDVVGMTDLKERLERSLLGPLRHPELAQLYGKKSGGGMLLYGPPGCGKTFLARAVAGELGASFLEVTVADVLDMWLGNAERNVRDLFASARAHAPCVVFFDEVDALGRGRQLTRHSSHSVTQTLLRELDGLGGREGVFVLAATNAPWDVDTALKRPGRLGATLLVPPPDLAAREAMFTEFMRGRPAERLDPAWLARQTDNFSGADIRQLCEEASERALAVALKRGGMQPVRMQDFKDALKTAAPSTREWLMQARNHVVYANEGGSYDELAALLKEKRLL

SEQ ID NO: 518 - protein, 301 aa, Deinococcus radiodurans
MNISILGIPMDLGAGRRGVDMGPSALRNAHLAHTLRDLGHDVTDLGDIEVALPETLDKHETGGLVFFEPILDACRTAAERVMALPGGTFPLTLGGDHSVSMGTVTGNGLRGRPQRTGVIWVDAHTDYNTPESSPSGNIHGMPVAHLTGRGDERLTRLGGLVTGEWGIRPEDVVMIGIRSVDARERELLREAGIKAYTMKDVDQLGITRIHEETQERLNDVERLHVSFDADALDPGVCPGVGTPVPGGLSYREGHLLMELLSESGRVTSMDIVEVNPILDTRNQTAEVMVGMAASLLGQRIL

SEQ ID NO: 519 - protein, 431 aa, Deinococcus radiodurans
MKRPSLAVQILIGLVLGVIVGAVFYGNPTVVSWLQPLGDIFIRLIKMIVVPIVLSTLIVGVAGVGDMKKLGKLGGLTLIYFEVVTTGAILFGLLMGNLFQPGAGVNLGDLTKTDITKYTEGAQAATSHSFADTFVNIVPTNVVDAFARGDMLAIIFFAVFFGLGLGALGERGKPLLNIFQLVADTMFWVTNQIMKLAPIGVFALIGVTVSKFGVQSLIPLGKLVLVVYGAMLAFVLVILGGVARLAGTSIFTLIQVLREELTLAYSTASSESVLPRLMQKMEAFGCPRYITSFVIPTGYSFNLDGSTLYQTIAALFIAQLYGIHMPLEKQLLLVVTLMLTSKGIAGVPGVSFVVLLATLGTVGIPVEGLAFIAGIDRILDMARTAVNVVGNSLAAVVMSRFEGEFDDAKSRQYVADMKAGTLPPLSEATGH

SEQ ID NO: 520 - protein, 1024 aa, Deinococcus radiodurans
MPKRTDLQTILILGSGPIQIGQAAEFDYSGTQALKALKNEGYRVILVNSNPATIMTDPELADATYLEPLTPEFVEKIIEKEKPDAILPTLGGQTALNLAMELHERGSLEKYGVELIGAGVEAIKKGEDRELFQAAMKKIGVETARGKMVHSMEEAVEYQKEIGLPIVIRPSFTLGGTGGGIAHTYEEFLAITEGGLRDSPVTSVLLEESILGWKEYELEVMRDTADTVIIITSIENFDPMGVHTGDSITVAPAQTLSDVEYQRLRDQSLAIIREIGVATGGSNIQFAVNPDNGRVIVIEMNPRVSRSSALASKATGFPIAKIAALLAVGYHLDELPNDITRVTPASFEPSIDYVVTKIPRFAFEKFPGTPDGLGTQMRSVGEVMAIGRTFKESLQKALRSTEGDIRGVYAEMDEAGLRALLYPNPRRIEAVIELLRRGESVESLFDATKIDRWFLSQLKEIMDAEKEILDLGPIAEWKYELWREVKRLGFSDARIGEIVGLSELEVRDLRKKAKATPVYKTVDTCAAEFEAHTPYHYSTYEWEDEVAPTDKPKVVILGSGPNRIGQGVEFDYATVHAVWALQEAGYETIMVNSNPETVSTDYDTADRLYFEPLTFEDVMNIVEHEKPVGVIVQLGGQTPLKLAKKLADAGAPIIGTSPETIHEAEDRASFNALCERLGLPQPRGKVAQTPAQARELAAELGFPLMARPSYVLGGRAMRTVRSMDELTTYLDEVYAAVEGQPSILLDQFLEGALELDVDTLCDGERAVVAGIMEHVEAAGVHSGDSACILPPVTLDAGVLERVKADTERLALELGVRGLMNVQWAVKDGTAYILEANPRASRTVPFVSKAVNHPLAKSAARIAAGQTLEQIGLLETPTPRMYSVKEVHLPFLKFKDVLPVLGPEMKSTGESMGIDSDPYLAFYRAQLGAKNYLPLEGTALLIGDGLDEVAGTLEGAGLKVIREQDGDELPDLLIDVTGSPLLRTALERGVPIVSTKEGAEWTARAVAEAKKAGMLGVRSLQEWVK

SEQ ID NO: 521 - protein, 402 aa, Deinococcus radiodurans
MSKEKIVLAYSGGLDTSIILKWLQTERNYDVVCFTADLGQGDEVEEARVKALNTGAVAAYALDLREEFVRDYVFPMMRSSALYEGYYLLGTSIARPLIAKKMVEIAEKEGAVAISHGATGKGNDQVRFEMSAYALKPDIVTVAPWRDWDFQGRADLEAFAREHGIPVPTTKKDPWSMDANMLHISYEGGPLEDPWTEPPTHMFKLTVNPEDAPSEAEYVEIEYVNGDPVSINGEQLSPAALLTKANEIAGRHGVGRIDLVENRFVGMKSRGVYETPGGTLLYHARRAVESLTLDREVLHQRDALGPKYAELVYNGFWFAPEREALQVYFDHVAKSVTGTARLKLYKGNCIVAGRKAERSLYDKDLVSFEAGGDYNQHDAGAFIKLNSLRMRVQKRVEDKGKK

SEQ ID NO: 522 - protein, 488 aa, Deinococcus radiodurans
MFYAFPEPSPELRRGLFMTNQKQETKLWGGRFAEKTAELVELFNASVGFDQRLAEQDIRGSLAHVAMLGGQGILTAEEVSQITDGLNGVLADIRAGNFEWRLDREDVHMNVEAALRDRIGPVAGKLHTARSRNDQVAVDFRLFTKEAALDLAEQTRALRRVMLAEAEKHLQNEVILPGYTHLQVAQPILLAHWFMAYVAMLERDEGRFRDAAERMDESPLGSSALAGTPWPLDRHATAEALGFARPTANSLDGVGSRDFALEFLSACAILSAHLSRLSEELILYSTFEFGFITLPDSHTTGSSIMPQKKNPDVSELARGKAGRVFGNLMALLTVVKGTPLAYNKDLQEDKEGVFDSYDTLSIVLRLYAEMLPKTVWHADVTKAAAARGYSTATDVADYLARQGVPFREAHEVVGGLVGLASRSDRQLWELTDAELKAAHPLLSAEVAQKLTVEESVRSRQSYGGTAPERVREAVEAAKEKLRQETGQP

SEQ ID NO: 523 - protein, 394 aa, Deinococcus radiodurans
MIRKERAILALEDGTVYRGYAFGYRGETVGEVVFNTSMTGYQEIMTDPSYNGQIVTITYPHVGNYGVAIYDMESNKPYVRGFISREFSGEYSNYRAQQSLEAFMQQYGVVSIQGIDTRALVRRLRSGGVVKGVIAHRSFTHPEDPYGEFTPAEEQIYVQRARDHQDIDGFDMTKEVTTALPYAFPTLRQGKRVVLMDFGIKHTIIERLAEVGIEPIVVPAHTTPAQIMALQPHGLFLSNGPGDPAPLEYAHKTAWEMMGLLPTFGICLGHQILGLAAGGQTFKMKFGHRGGNQPVKNLLTGNVEITSQNHGYAVDLDSIPNGAFVATHVNLNDGTLEGMAHSRYPVFSVQYHPEASPGPHDSRYLFDRFIEEIDAFDGGNGTPIIKANPGRLGV

SEQ ID NO: 524 - protein, 247 aa, Deinococcus radiodurans
MTDQPDLFGLAPDAPRPIIPANLPEDWQEALLPEFSAPYFHELTDFLRQERKEYTIYPPAPDVFNALRYTPLGEVKVLILGQDPYHGPNQAHGLSFSVRPGVRVPPSLRNIYKELTEDIPGFVAPKHGYLRSWAEQGVLLLNAVLTVRAGQANSHQGKGWEHFTDAVIKAVNAKEERVVFILWGSYARKKKKLITGKNHVVIESGHPSPLSEQYFFGTRPFSKTNEALEKAGRGPVEWQLPATVTEE

SEQ ID NO: 525 - protein, 582 aa, Deinococcus radiodurans
MTQQKQGVVQSIAGPAVIAKGMYGAKMYDIVRVGQERLVGEIIRLDGDTAFVQVYEDTAGLTVGEPVETTGLPLSVELGPGMLNGIYDGIQRPLDKIREASGNFIARGIEVSSLNREQKWDFTPSVQAGDTVTGSGILGTVPEFSFTHKILVPPEVQGRLRSVAPAGQYTIDDTIAELEDGTKLRLAHYWPVRAPRPVQKKLDPSLPFLTGMRILDVMFPLVMGGAAAIPGPFGSGKTVTQQSVAKYGNADIVVYVGCGERGNEMTDVLVEFPELEDPKTGGPLMHRTILIANTSNMPVAAREASVYTGVTLAEYFRDQGYSVSLMADSTSRWAEALREISSRLEEMPAEEGYPPYLGAKLAAFYERAGAVKTLAGEDGAVSVIGAVSPAGGDMSEPVTQATLRITGAFWRLDAGLARRRHFPAINWNGSYSLFTPILDKWYRENVGPDFPELRQRIGSLLQQEAALQEVVQLVGPDALQDNERLIIETGRMLRQDFLQQNGFDPVDASASMPKNYGLMKMFLKFYDEAEAALRNGLTIDEIIQNPVIEKLARARYTPENEFMAYGEGVMDELDQTFKAVKA

SEQ ID NO: 526 - protein, 471 aa, Deinococcus radiodurans
MTLLQKEYNDVAYISGPLLFVNAASDLPNGAIVNIKDGNGKLRGGRVISVSDQNAVIQVFEETRGLDLATASVSLVEDVARLGVSKEMIGRRFDGLGRPIDGLPAVVAEQRLSVDGQPMNPAARAKPEEFIQTGISTIDVQTSLIRGQKLPIFSGSGLPHNELAAQIARQAKVPGHEGDFAVVFAAMGLTQREVSFFTQEFERTGALARSVLFLNKADDPAVERLLTPRMALTTAEYLAFEHGYHVLVILTDLTNYCEALREIGGAREEIPGRRGFPGYMYTDLASLYERAGVVEGKPGSVTQVPILSMPDDDITHPIPDLTGYITEGQIVVDRTLNSKGVFPPINPLPSLSRLQGNGIGKGKTRADHKNVADQLFAAYANGLDLRKLVAITGEDALTETDKLYLKFSDDFENYFIGQGDQDRSIDDSLTVAWGILSKLPQSQLTRLSKDSIDKYYGTKMDEMWKGGRSSI

SEQ ID NO: 527 - protein, 224 aa, Deinococcus radiodurans
MAGQISPTRSALLASKASLKTANGGADLLKRKRDALIGEFFALVKDALAAREQLSSVSKGAYTSLFGAKAWDSPEAVESLSLAGTGDYAVDMQIESIYGVKVPKINIPERAAQADFSPINVGARTIQASNDFGGVLEAIVKVAATETKLRRIGEEIKKTSRRVNALEQVVIPGIHDDIRFIRSVLDQREREAGYTQKKIKAKIEGKNKEAREAAAATSHGSAAD

SEQ ID NO: 528 - protein, 657 aa, Deinococcus radiodurans
MTALPFSPTLACKSKGNACPLRHDLPARLCAAGRAGASFCPLIQGVLMYPTATLSAQHDHTPGYTERLGALLGGHVRVRLRTTLPVLGVRLKVVQIGEIETLPAREVTGLQGEGRWFEADLPLHEARVRYAWHLDLPGDHLNLTRLGLHHARRGFRSWFQYLAGYQAPEWAWKSVFYQIFPDRFRNGDSTNDVQTGEYLYEGRPVEKVEWTHPVDAWGDIHGHYGGDLAGITQAVPYLQALGVTGLWLTPIFTSPSNHRYDITDYRAIDPHLGGDAAWDALVQATDAAGIRIVLDGVFNHMGNENALFQAALAAEDAPERAMFTWRDTPGKPPYHSFFDVATLPKIDYANERAVEEFFSGERSVVRHWLRRGAAGWRLDVAHMLGKGGTEEDNLALHRVLKAAARQEKADAYVFGERFYDPELALDGQGEDGAMNYHGFGLPVMQWLAGATYFNEPSRLDGTELAEILWDAYHALPPQAALNMFNLLESHDIGRALWRLGGDRTKYRAALTLLLAYAGVPCLYYGSEIGLSQSRDGNMPWCREPMPWDEARWDMELLAHVKALVKVRRETPVLHTGALQFIHAEPDALAFLREVTGPDGAAERVVALASRRAGAHPVTFTLPAGEWQDALSGERLGGGEVTLDAAGGQLLLSLPLSR

SEQ ID NO: 529 - protein, 303 aa, Deinococcus radiodurans
MTSLPLIVSAGEALTDLVTAGGNTWHAHPGGAGWNVARACARLGVPSAFAGAVGQDNFGDDLHRESLEAGLDPRFLQRVPAPTLMAVVYSTRPPQYRFLGENSADLHFDPTRLPGGWLGAARWLHVGGISLARWPLADTLLGVIEAARAAGVRISFDPNARIAHRHPDYPAVFAAVTKRADLLKFSDEDLAFFFPGASEAQALQELRGLNPRCPIVVTRGAAGASLYHSAGRVDLPTVPVEVADTVGAGDSLCAGLLVSATERPDALWTEHLRFGLGAASVTCAHAGAYAPTREEVAALSSGK

SEQ ID NO: 530 - protein, 251 aa, Deinococcus radiodurans
MSSESSSPLVVVTGAARGIGRAIAELYVERGHPVLGVDLSLPPVLRGQRRVKADIATAAGRARILKAAREHGEVSVLVNNAAYQDAHGSVLEVSERGWARTLNVNLTAPLLLTRELIELLPSGSAVVNVASVQGLFAEQGNAAYNASKGGLVNLTRAMCLDLAPRGLRVNAVAPGAIATEAVLQAIAGSGDPEQTRRDYEDLHALRRLGTPREVAQLVYFLGSPEASFLTGAIVPVDGGMTASFMMAGRPV

SEQ ID NO: 531 - protein, 265 aa, Deinococcus radiodurans
MLRGVLAKRIVPCLDVQNGRVVKNVRFFEDHRDAGDPLVLAQAYEAQQADELVFYDITATHEGRSLMLDVAARVAEQVMMPLTVGGGVGALSDFRQLLLAGADKISVNSGAVKRPELIREASDHYGAQCVMLSIDAKRRPGGQGWTVHIGGGRVDTGLDLLAWARRGQELGAGELCLNVMDADGTRAGFDLEATRAVAREVDLPVIASGGAGKVQDFYDVLTAGEADAALAASVFHFGELTVPQVKTSLAAQGVPVRPEWRGATE

SEQ ID NO: 532 - protein, 218 aa, Deinococcus radiodurans
MTDLSELNFDPSGLIPVVTQDARSGAVLMQAYADRAAVERTLDTREATYYSRSRGEQWVKGQTSGHTQRVVSVHVDCDGDSLLYRVEQTGPACHTGEYSCFYRPLLEDDAPDTGLDGTLERVYATITERLATLPEGSYVARLHAGGLDRVLKKISEEAGEVLLAAKNADRAELATETADLLFHTLFALAEVGVSPADVAAVLQGREGKSGLKGPKEVG

SEQ ID NO: 533 - protein, 438 aa, Deinococcus radiodurans
MFVLALLAKKLCHLFVKCSTSYRRLSAKGRRFFDSRGGACLLKPPRRGRQSRYSRPMRYLTAGESHGPQLTAIIEGLPAQLPLGKADIDPWLRKRQGGYGRGRRMVIETDEAELLSGVRAGRTTGAPVTLAIQNKDHRNWTEIMSPEPGGEPRKKALTDARPGHADLTGGIKYRHKDLRDVLERASARETAARVAVGSIALKLLSELGIEGANYVFNLAGIETRQAFSWDALDAIEDSDLRTPDADAAAQMRERIDQAKKDGDTLGGILEVRFRGLPVGLGSFVHYDRKLDGKIAQACLSVQAMKGVEIGRAFENAVKPGSGVHDAIHYREGTYARDTNGAGGLEAGMTNGEELIVRVAMKPIATLMKPLPTVNVVTHEASDAARERSDTTAVPAAGVILQCVIGWVLAEAITEKFGGDTLPELQERLAAARRYAAEY

SEQ ID NO: 534 - protein, 350 aa, Deinococcus radiodurans
MRRVEVGGAAPYAVEVGPGLLTRLAVPETPSALIHPADLPAAWVEQAQASLQPHLTVTVPARDECKTLEVFADVLSQLAQAGLPRSGAVVGLGGGAATDLAGFVAASYLRGVAFYTAPTTLLGMVDAAVGGKTGVNLPEGKNLVGAFWPPRAVWCDTATLTTLPDAVFREGAAEAFKHGLMADPSLLDRVVSPDFRPGGALLEDTLADAIAVKAGVVTRDLTEQGERAFLNFGHTLAHALEAVTHQAIPHGEAVAYGMHYAARLSHALGGADLTAHTRAFLRWQRPRRLPPLTFDALAPFIARDKKADSAGVRFVLLRDLAQPYLARVPDDVLRREFDGWQADLAELFPL

SEQ ID NO: 535 - protein, 143 aa, Deinococcus radiodurans
MLLILNGPNLNRLGLREPGVYGSQTLEDLERQCEAWGAELEMSVTCRQSNYEGQLLEWVQDAEEQGFTGLVINPGALTHYSYALRDAIAGQRLPVVEVHISNVDAREEFRHQSVTAAVCRGKISGLGFSGYRLAMEYLAEVLE

SEQ ID NO: 536 - protein, 465 aa, Deinococcus radiodurans
MGLGLSKSQPECPQASPSKSSAKLDAPTAAAPTLGSMTGNEQNPSKWLAAEKKYDSGVYNKHDVVMVRGQGATVWDENGRSYIDCVVGYGVATLGHSHPDVVKAVQEQAGKLMVMPQTVPNDKRAEFLQELVGVLPQGLDRVFLCNSGTEAMEAAKKFAITATGRSRFVSMKRGFSGRSLGALSFTWEPKYREPFGDAVDNKSVDFVTYGNLDELRAAVTEQTAAVIMEPVQGEGGVRPASAEFIQEARRITREKGALLILDEIQTGFCRTGKMFACEHFGVIPDGMTLAKAIAGGTPTAAFAMMSEVADRMPAGGHGTTFGGNPLSMAAGVASLRAMKREGLAEQAREKGAYMMDKLRAIQSPKIREVRGLGLMIGVELKEKSAPYIHAMEHDEGVLCLAATPLVVRFLPPAVISKEQIDQVVAAFERVLNNVNPREERQAELRAQQSEMGQQQVSQGESVQTE

SEQ ID NO: 537 - protein, 523 aa, Deinococcus radiodurans
MIKVQDYRPQPFTDFTKEENVQAYQAALAKVRKELLGKHYPLIIDGQEVDTEGKIQSINPCDTSEVVGTTAKATIGDAENALQGAWKAFESWKKWDMDARARILLKAAAILKRRRLEACALMSIEVGKNYAEADVEVAEAIDFLEYYARSAMKYAGFGSSETTWFEGEENGLMSIPLGVGVSISPWNFPCAIFVGMAAAPIVAGNCVVVKPAEDAGLIAGFMVDILREAGLPAGVLQFLPGVGKEVGEYLTTHAKTRFITFTGSRAVGLHINEVAAKVQPGQKWIKRVIMELGGKDGLIVDETADIENAITAATQGAFGFNGQKCSAMSRLIVVDSVYDEVVNGFVERAKALKMGTGEENANVTAVVNQMSFNKIKGYLELAPSEGKVLLGGEATGEANGKQGYYIQPTIVGDVDRNSRLAQEEIFGPVVAVLRAKDWQDALDIANSTEYGLTGGVCSNSRERLEQARAEFEVGNLYFNRKITGAIVGVQPFGGYNMSGTDSKAGGPDYLSNFMQLKTVTERW

SEQ ID NO: 538 - protein, 266 aa, Deinococcus radiodurans
MSRRVGGRPRGSTPDRYTCRMTSHSALFRLDGKRALVTGGSKGIGLAAARQLRELGAEVTLAARGEETLRRAAEDIGAAWVVADVSTPEGVKVAADAAGQVDILVSNAGGPPPSLPSEVTEAAWEQGFQTTFLSTARLVDAVLPGMRERRWGRIIAITSLTVGRPSLTLPVSNALRAAVTNHLRTLALEVAADGVTCNTVAPGYTATERLQKLHADPAEADKLRAKIPARRFGEPDEVASAIAFLATNEAAYITGQELLVDGGWSI

SEQ ID NO: 539 - protein, 196 aa, Deinococcus radiodurans
MSTINFAAREINCKIVYYGPGMCGKTTNLKHVFGKVPGHLRGEMVSLATEDERTLFFDFLPLDLGTVQGFKTRFHLYTVPGQVFYNASRKLILRGVDGIIFVADSAPGRLRANAESMRNLRENLAEHGIDINDVPIVIQINKRDLPDALPADMIRAVIDPQRRYPTYEAVASKGTGVFETLKATSRLVLEKLSRNR

SEQ ID NO: 540 - protein, 548 aa, Deinococcus radiodurans
MTSALPRPAPSPYARRKTALVIGAGFGGLALGIRLQSLGFDTTILERLDGPGGRAYQKRTPDGYVFDMGPTVLTVPHFIEELFALERDRAGLDAPDYPPEVLSGERVKEGVSGGPHTSRYVTLVPILPFYRIVFHDGTYFDYDGDPESTRRQIAELAPGDLAGYERFHADAEAIFRRGFLELGYTHFGDVPTMLRVVPDLLKLDAVRTLFSFTSKYFQSDKLRQVFSFETLLVGGNPLSVPAIYAMIHFVEKTWGIHYAMGGTGALVRGLVQKFEELGGAIRYGAGVDEVLVDGNLPGKRTARGVRLESGEELRADLVASNGDWANTYLKRVRPSARLVNSDLRVKAASESMSLLVVYFGFRGGDDLPLKHHNILLGPRYEALLSEIFGTKRLGEDFSQYLHVPTLTDPALAPAGHHAAYTLVPVPHNGSGIDWDVEGPKLAEAALADIERRGLIPGLRERLTHFEFITPDYFAGTLDSYLGNAFGPEPRLVQSAFFRPHNRSEDLHNFYLVGAGAQPGAGTPSVMMSAKMTARLIAEDFGIHADIRR

SEQ ID NO: 541 - protein, 299 aa, Deinococcus radiodurans
MQTSSEPAASETAALLGKPLADRVMRGVRADLKAWAQLDPPFEPQLVSVLASDDEASQVYVQSKAKRAKKLGVAFRVVDLGAAATQEALEQTLRELSADPAVHGIVLELPLAAGLDADAALLHIAARKDIEGLSPANLALIAAGREPEALLPPTPRSVRFLLRHALGDDLRGLRVAVIGPGRTVGRPLLFMLNNKGATVTLCNEHTRDLAAVLAAQDAVVVAVGKAGLLRPEQVQPEHVVIDAGINVQESGDMVGDALPELPVRAQTPVPGGVGPLTSALMYQNLVRGVKLQRGEPVDD

SEQ ID NO: 542 - protein, 573 aa, Deinococcus radiodurans
MAFPCGQAGNKITRPGQCVNGGRARSAPSKFRLDPLPASALLFEELPQQEPPTSERPRDLARRRRGNRTPSRHGAKASPLGVSTMSRRAGPSGKATRMTIFKCPFSIHSRQGECRDWRPRTCFPRGAATMTDTKQPQPLHFETLQVHAGQRPDPVTGAQQTPIYATNSYVFESPEHAADLFGLRQFGNIYSRIMNPTNDVFEQRVAALEGGVGALSVSSGHAGQLVTLLTLAQAGDNIVSSPNLYGGTVNQFRVTLKRLGIEVRFTSKDERPEEFAALIDERTRAVYLETIGNPALNIPDFEGVAKVAHEHGVAVVVDNTFGAGGYYCQPLRHGANIVLHSASKWIGGHGNGIGGVIVDGGNFDWGSGRYPLMTEPSPSYHGLKFWETFGEGNGLGLPNIAFITRARTEGLRDLGTTLAPQQAWQFLQGLETLSLRAERHAENTLALAHWLISHPDVKQVTYPGLSNHPHYDRAQTYLPRGAGAVLTFELRGGRAAGEAFIRSVKLAQHVANVGDTRTLVIHPASTTHSQLDEVTQTNAGVTPGLIRVSVGIEHVDDIREDFAQALASAGERA

SEQ ID NO: 543 - protein, 1546 aa, Deinococcus radiodurans
MKDFNKVRIAIASPEKIREWSFGEVEKPETINYRTLKPEREGLFDERIFGPIKDYECACGKYKRQRYEGKVCERCGVEVTSSKVRRYRMGHIDLATPAAHIWYVKDSPSKIGTLLDLSAGQLEKVLYFSSFIVTKPFNAQKDGRPLKRGELLSDDEYRELRFGRQETYTIPNSVEDVEIRDGEYVTRGQILGGNVVSKMDGLAQYRFPRRAVIAYSEGVEASLPLPADTLVEQETFRAGEILAELEQDVQITAPVAGTVFMHDLGEDSVMIELREGVEANDSDEEEAADPIRGEVLARVYVPHGMNVQVAEGEVIEAGALLADASEGARLRVSRDSNLSGVTFPKKKGDVTVTAHWTRRVEYPIDPTMHVLVGDGSEVTKGQRVIGAIDKEEEVIAEADGVITLHQPASILVSKAKVYAYDDEPLVVNGDRVEPGDELADDGNLRSEISGRIELDLVRKQVRVIESYDFEAKMGAEAVKELLDELNLDELETELNEQMKDNSRHKRAKARKRLEVTRSFKASGNNPSWMILGTVPVMPPDLRPMVQVDGGRFATSDLNDLYRRLINRNNRLKKLMSQGAPDMIIRNEKRMLQEAVDALIDNGRRGSPVTNPGSDRSLRSLTDLLGGKQGRFRQNLLGKRVDYSGRSVIVVGPQLKLHQCGVPKRMALELFKPFLFKVLEEKGEVTNIKQARKMLERYRDTRDSVWDALEEVIEDKVVLLNRAPTLHRLGIQAFEPVLVEGQSIQLHPLVCEAFNADFDGDQMAIHVPLSAQAQAEARIQMLASHNLLSPANGEPNVKPSRDIILGIFTLTQLRRDNLGAGTEYASEADALAAFDEGKLSLNSPVMVNGVETSPGRLRYTFSNPDEALHAVEQGEIDHQDHVRIRLNGQVYETSAGRVQFRRMVQEALGAQGGLIDTLVDLETTYEKDALKDMVMACFKHLGIEATAGLLDGLKEGGFKLSTTSGITIGIDDIVLPPNKGELLAEADQMLAEIEQNFEFGFMTEEERYKQVVQLWNNTTDAVKDAVFENFSKNYPFNPLWIMSQSGARGNPQQIRQLAGMRGLMARPDGSTIEVPIRASFREGLTVLEYFISTHGARKGGADTALRTADSGYLTRKLVDVAHEVVVRDVDCGSTDSTVMPLGATDERTGEWRSRKGSEIETSIYGRTLTADVEFSDGRVIPEGEMLSMEDVKAIAKDAKHIGEVFVRTPLNCRVKAGVCQKCYGYDLSQAKPVSMGEAVGVVAAESIGEPGTQLTMRTFHTGGIAGGGDITMGLPRVIELFEARKPKTQAVVADRDGVIRIEEEEERYLVRIEADDEQYSSKTATKVPRVLRMTVKDGERVEAGQPITRGAVNPHDLLMYKDTDAAQRYLVEEVQRVYRSQGVKVHDKHIEVIVRQMLRWVEVTDGGDTTLLEGQTVEHWEVDQANEALAEGQTPASWKPVLLGITKSSLTTKSWLSAASFQHTTHVLTEASMRGQVDDLIGLKENVILGKLIPAGTGLLTVREMQVADDRTLEKYGEGSTSSDAVTGGQRYDDTRPGSSINPGYGD

SEQ ID NO: 544 - protein, 1179 aa, Deinococcus radiodurans
MRFWTWTRAAAPRFPACEVCMTLSKTPPRIERFGDITEVIPLPNLTEVQVNSFKAFLQDDKAPDQREDVGLQSAFREVFPIDESEKGRSTGMVLDFIEYRLGEPEYSPEECREKDLTYEAPLYVKLELIHKDTGVIKGFKPDSPPESWVFLGNLPLMTFDGSFIINGADRVVISQIHRSPGVYFTSSYKGIKKQYTAAIIPMPKRGPWIELEFAGDVLEMKVNKRKFPVSLLLRVLGMDDASIRALFTEFTPEVEPGEDKSAGMGADEALLRLFTVLRPGDPPKRDKAIQYLFGLLADPRRYDLGEPGRFKMNTKLGVQRQERTLLKFEDGKFSDAGLVDTIRYLMALQQGLETVPMVDEDGVVTDVPVAEDDIDHLGNRRVRTVGELLADQLRVGMGRMARGVRERMLLGNPDAATPTKLVNNRPIVAAMREFFGRSQLSQFKDQTNPLSDLRHKRRISALGPGGLTRERAGFDVRDVHRTHYGRICPIETPEGANIGLISSLSSYAKVNDLGFIMAPYRKVEDGKVTNQVEYMTADIEDRYTIAQANSPLNEDNTFADERVLARRKGDPLLYTPDEVDYMDVSPKQIVSINTSLIPFLEHDDANRALMGSNMQSQAVPLVRADSPAVGTGVERRVVTDSGTSVVSDVNGRVSYVDARAIQVTLSEDHRELNMNAGNVRTFELIRFTRSNQGTNLDQHPIVSVGDEVKVGQVIADGPASERGRLALGQNITIAIMPFDGFNFEDAICINEDLVRQDFYTSVHIEKDEIEARDTKLGPEKITRDIPGLSEAALRDLDEDGIVRVGAEVKPGDILVGKTSFKGESEPTPEERLLRSIFGEKAREVKDTSLRVQSGQGGIVVKTVRFRRGDEGVDLKPGVREMVRVYVAQKRQLQVGDKVANRHGNKGVVSKIVRPEDMPYLEDGTPVDIVFNPLGVPSRMNLGQILETHLGEVARLTGQKFETPVFDSVTEATIKEMLEVAAAERLQARKDDGFELDKREQEVLDRAGKLGVIDAPGDDYEKGQMQLARTGKSILYDGRTGEPISGPVVVGIMYVMKLYHMVEDKLHARSTGPYSLITQQPLGGKAQFGGQRFGEMEVWALEAYGAAHVLQEMLTIKSDDIDGRDAAYQSIVKGEEVSGSTIPESFKVLVKELHSLGLDVEVLDHGDKAVDIFEGMMPKR

SEQ ID NO: 545 - protein, 392 aa, Deinococcus radiodurans
MDNSARFRTRAVHAGHGLDPATGAHAMPIYATSTFGYGDAARGQRLFAGEEQGHFYSRLSNPTVRAFEEKLASLEGTEDALAFASGMGAASAILLTLLRSGDEVAFLAPLYGGTEGLLQDMLPKFGIRVWEAKDPADLRGRLTDRTRLVWLETPSNPTLRLTDLREVADLAHGAGARLVVDNTFSTPYLTRPAEFGADLVMHSATKYLGGHGDVIGGVVAGDAATLLDLRLHGLRHVGASLGPFEAYLLLRGMKTLPLRMEAHCAGAHLIAERLAARGDLKVYYPGLPEHPGHDLARRQMSGRFGGIVSLDLGDFAAAQQFLDALQLFTQAVSLGDVESLSSHPASTTHQLLGEEVLNAHGIVPGLVRLSVGIEDPEDLWADIEQALRQARR

SEQ ID NO: 546 - protein, 381 aa, Deinococcus radiodurans
MDFNLPDDLREVQATIRDFMLTRVEDRAQEIEHTNSVPPELIKEAADLGLFGLSIPEEYGGVGLSSLGRCAVYEAMGQGHMGFGGMISAHASIGTSGLVKLGNEEQKQRFLPRMAAGECIAGFAITEPSSGSDAGNIRTKAVKKGDVYVLNGTKHYISNAPIAGLLTVIAITDPAQGSRGMSAFLVEPQSTPGVSIGKIDEKMGQKGALSAEVIFEDAEIPAANLLGPENRGYREALGILTNGRVGIAARSTGAMQRLLDLSVAHAQTREQFGKPIAEFQAVQFMLAEMEVAIQTSRVLWQKVAWMVDQGQDVKRMASVAKYHATEMLSQVADKAVQVAGGMGYVKDAPFERFYRDQRLLRIYEGTSEIQKVIIAAELLRR

SEQ ID NO: 547 - protein, 320 aa, Deinococcus radiodurans
MPDAAFETRMREVLRSDVEFIAIIGEDLVTAGGKRVRPLVTLLAAQALGAGPDALATSHSWDELLRLSVCVELLHSASLLHDDLIDDSDKRRGQETAFRRFGNVVSVMSGDFMLARLLGELSGMPGSPALTRAFGQAASVICEGEVLQFQVASYADYSFENYFQVIHGKTAALLELAAQAPAMLLGADDSARDALSTFGREYGMAFQMQDDLLDLLGEEAQIGKPVGGDLREGKATYPVLCLLGGPHDAEVRAILERRAGEDGDVARMIALARQERTDDCTREEIRRRARLAIAALDALPPSPARTALAALAERELNRTH

SEQ ID NO: 548 - protein, 264 aa, Deinococcus radiodurans
MTQIQTPVTSSSVVQSGATPLAPADVPMLPLKVKVLRFNPEQDKKGRWVTYDIEAQPGDRLVDVLNEIKWYHEPSLTFRRSCQHGICGSDAMMINGRNRLACKTLVRDLVKGSGGEITVEPIRGLKVERDLLVDMEPFFDAYRAIMPYFINEDPAPAGERLQSEAQAERMAHSSNCILCACCTTSCPIFWVNGSYLGPAAIVQAHRFIFDSRDQATQQRLNIMNQNTGVWRCRTAYNCTEACPREIPITSLIEEVKRAVMFQQA

SEQ ID NO: 549 - protein, 583 aa, Deinococcus radiodurans
MHHRYDVIVVGAGGAGLMSALYAAKGGVSVACISKLYPTRSHTGAAQGGIGAALGNIQEDHWEWHMFDTIKGGDYLTDQDAAEVFSKDIIEVVYELEHMGLPFSRTPEGKIAQRKFGGHTRDFGKAAVERSCYAKDRTGHMILQTLYQQNVKAGTLFFNEFHVTDLIIEDGRCRGVVAYDLATGELHTFHAKAVILAAGGYGRVFKITSNALTLTGDLMSIYYRKGLPLQDMEFYQFHPTGLAKLGILVTEGIRGEGGILRNSNGERFMERYAPTIKDLAPRDIVARSMTTEIREGRGVGKDKDAIHIDLTHLPREVIEGKLAEITDLARTYLGQDPVKDLVMVQPTAHYAMGGIPTDLNGLCLSDGNGGSIEGLYAAGEQACVSLHGANRLGTNSLGDLVVFGRRAGRYAAEYAKQVEYAEMPENAEAESRRVFDDLRAASGKDNAAAIRKELQETMMRNVGIFRNGPDMAKQVEIIKELKTRYKNVGVSDTNARYNSELVEALELGFMLDCAEAMASSAVNRTESRGAHDREDFHQRDDVNWLKHTMAYRDMNNPGNVLIGYKDVALKGFTRSFEPKPRVY

SEQ ID NO: 550 - protein, 416 aa, Deinococcus radiodurans
MHLRNAADQAPSLPFAQCQRQLPLPLWGKGLGDGAKSSSLGFNAIHSSRPRSLDPPPHQPPPPTTLLPMSTEKKTVAIVGGSGYAGGEFLRLALGHPHLEVTQVTSERSAKLPVSMVHPNLRGATNLKFRKAAELEEADIIVLALPHNSAAKRITEFEAKGKVIVDLSADFRLKDPEVYERFYGEPHPAPEQLGQWVYGNPELHREDLRGATRIACAGCFATSVILALYPLLRLGALAPKDIIATGLVGSSAAGASASESSHHPERAGSLRVYKPVGHRHTAEAQQELPGKFPLHLTAISTPRVRGILTTIQAWVPDGWSDKDVWSAYREVYGQEPFIRIVKVAKGIHRYPDPMLLDGTNFCDIGFEMDVDTGRVVLMSAIDNLVKGTAGHAIQSLNVAQGWDERAGLGFLGLHPT

SEQ ID NO: 551 - protein, 529 aa, Deinococcus radiodurans
MSGTEFIVVGAGSGGCAAAARLREAGRRVHLLEAGGPDTHPHIQIPVAFGRLFGSEVDWAYQTEPQAELNGRRLFWPRGKVLGGSSSINAMIYIRGHRADYDGWAAAGNRGWSYDEVLPYFKRSEDFEDGPDAFHGAGGPLHVEHRRYTHPICDALTDGFAELGYPRNDDFNAAQQEGFGRYQVTMKGGERHSTAAAYLRPALALEGPGELQVTTGAHVTRLLLRGGRAVGVAYRDEAGAEHELHAEGGVILTAGAVTSPHLLLLSGIGPADELRAAGVEVQCDLPGVGQNLQDHLIVPVVFETDTPGLRSPLREPHLSEYEQERRGLLVSNVAETGGFLRTSPDLAAPDLQFHHGAALFLEFGKPLARGHHFTLLPTLLQPHSRGQIRLASADPLARPLIEPNYLSDSRDLDVLLRGIELAREVADTAALTSYRRAEFLPGAGATDRAALTEHVREHAMTIYHPVGTCRMGHDDFAVVGDDLRVRGVDGLWIADASVMPTVPRGNTNAPTIMVAEKAADLILGRAAPV

SEQ ID NO: 552 - protein, 490 aa, Deinococcus radiodurans
MLEAVPAALSRSLTTAVTSLFGGLMTTAQPDAQPGAQPIADLGLKPGQLHLNPGVDDLYAHAIRLGEGVQAATGPLTVRTNKTGRSPKDRFIVEDDQTRETVWWEGFNQPISAEVFDRLLDKMVKYAEGRELFVQQVFAGTDAEHRIPVRMITEMAYHSLFIRNMFVRPTAEELQNFQAEWTVLNIPSFKADPAVDGTRTDTFILVNFSKKMIIAGGTQYAGENKKGIFGVLNYLLPAKGIMPMHCSANVGEDGDVALFFGLSGTGKTTLSADPGRKLIGDDEHGWTDTGVFNFEGGCYAKVINLSAEAEPAIYQTTRNYGTVLENVVLDESGTPDLDDGSLTENTRSAYPIEQIANIQPGSVGGIPKNVVFLTADAFGVLPPLSRLTPEQMMYQFISGFTAKIPGTEEGVTDPTPTFSTCFGAPFMPRHPGEYARLLAQKVEESGAKVWLVNTGWTGGKYGEGHRMSLNLTRLKSRDSHFADHCPPKQV

SEQ ID NO: 553 - protein, 392 aa, Deinococcus radiodurans
MTEVTSVRPSSIKNAAVNLPYGGGKGGIRIDPRKYSQGELERVTRRYTTEIGLIIGPEKDIPAPDVNTGPQTMAWMMDTYSMNVGRTATGVVTGKPVSLGGSLGRADATGRGVFVTGAEAMKKLGMPLEGARIAVQGFGNVGEAAARIFHQHGAKIVAIQDVTGTIHSAAGIDPGKALAHLRQTGKITGLEGSEEMQKDDFWSVDCDVLIPAALEKQITLQNADKIRARLVVEGANGPTIPAADDLLAQKGVTVVPDVLANAGGVSVSYFEWVQDFSSFFWTEDEINERLDRIMREAFQSLWDVKEQHGVTLRTAVYIVACTRVLEARACAGCIRKSTREKGRFLDGAALFVGCWGAFRTFDRKRHPPPLFARPSPIKVKGQRQNRSFCQML

SEQ ID NO: 554 - protein, 376 aa, Deinococcus radiodurans
MSGGFPTLLPMTQQRSIDDLRAEVDQINRDLLALISRRGEVVAQIGHAKSAEGRPNHYDPAREEQQLKELEKINPGPFPTATVKGIFKEIFRASLALEESNDKKQLLVSRKVKREDTVLDIDGVRIGGGEAPIVIAGPCSIESEEQMEQTAAFLQGKGVKILRGGAYKPRTSPYGFQGMGVDGLILGSRVAKEHGQLFVTEVMDTRDVDVVSEYADILQIGARNMHNFALLREVGRARRPVLLKRGLSATIEEWLYAAEYILSEGNNEVILCERGIRTYEKWTRNTLDLSAVALAKQETHLPVIVDVTHAAGRRDLLIPLAKAAIAVGADGIHVEVHPNPATALSDNEQQLDFAGYEKFLEGVGSLLQAPAVPATA

SEQ ID NO: 555 - protein, 522 aa, Deinococcus radiodurans
MTQGSVVDPRPAQVRAALAPQEWDVIVVGGGASGLGSAVEAATRGHSVLLLEGHDYAKGTSSRSTKLVHGGVRYLAQGNVSLVREALHERGLLRKNAPHLVRDLGFVVPAYDWWAAPFYGIGLKMYDVLAGKLNLGSSTYLDRDKVLSRVSTYKEKGLRGGILYFDGQFDDARLAVTLLRTLEDFGGVALNYAPVIGLIKDGEQVRGVRFRDEESGQEHEARAKIVVNATGVWVDDIRRMEDPTVKPMLSPSQGVHVVVEKKFLPGDSAIMIPRTDDGRVLFAVPWHDHVVIGTTDTPVPQADFEPHALEEEVEFILRTAGRYMDPAPGRADVLSVYAGLRPLVKNEKSDGAGSTAALSRDHVIRISKGNLITLTGGKWTTYRRMGEDTINRAEKLGGLPERLTITPGLHLHGWSEDERPDHWKVYGNDAERVQQLPGADAQLHPDLPYSEAELRWAVRHESARTVEDVLARRTRSILLGARASMEAAPRAAAILAEELGKDAAWQAQQVEAYRQVASGYVL

SEQ ID NO: 556 - protein, 655 aa, Deinococcus radiodurans
MTRRAPVRRFSGRWSSRSGSWKAGLLTLHLLTLPVLVQGTAAATTAHVTASANAPTTPAPQPPTWTPNKGNPRLMPENYTVNRFFADLQAGKVERVKLDGAGNTQVFFKEPAGGPNPRWLLLPPDAATLARLRGSGVTMQVTPGGSRFAWLGQALPLVLTALILAVLWRSLRGNGGGGASSFAKSKAAIISEGQIKLTFADVAGCDEAKQDLQEVVDFLRQPEKYHQLGARIPHGVLLVGPPGSGKTLLAKAVAGEAKVPYFSISGSDFVEMFVGVGAARVRDLFEQARKSSPCIVFIDEIDAVGRKRGMNIQGGNDEREQTLNQLLVEMDGFGSGQDVIILAATNRPDVLDAALLRPGRFDRQVVVDAPDVRGREQILRIHSRKKPLDVSVDLGVIARRTAGMVGADLENLLNEAALLAAREGRNRITGRDVDEARDRVLMGPERRSMVVREADRKVTAYHEVGHALAAQLLPNAHRVAKLTVVPRGRAAGYMLPDADDRLHVTRAALEDMIAVALAGRAAEEVVYGEVTTGAQNDFQQATGLARRMVTEWGMSGRIGKVALASDEGNYLGGGPQPLPTSEHTSQVVDEEVRALIDAAYARVLALLREYLPQVHQIVTVLMQRETLSGEEFATLLAGGSLEPLPPVGQVALAPA

SEQ ID NO: 557 - protein, 454 aa, Deinococcus radiodurans
MDPAALAALQTRFGEQLSTAHAVREAHARDESRMDYHLPDAVLHVQSEQDVVDALRIAGEYLFPIVPFSVGSSLEGQVIPVRGGLTLNLLGMNRVLAIEPGGFQATVQPGVTYPELNRQARRHGLFFPVDPGAEASLGGMASTNASGTGAVKYGTTRDNVLEMRVALPGGRVVRVGSKARKTSAGYDLKNLFIGAEGTLGVITELTVRLWPLPAEVVVLRCNFGTVAEAAACAVTVMGAALQPERLELIDEHEIHAVNVQLERDYPERPTLWIELASPSRAALEESLSVCSDLCRDAGGQDLAVATSAEERAAVWEARHKAYSSMVAMYPGHVNLSTDVCVPLHRLPAVVAATRAKCDERGLNASFVGHVGDGNFHVLFHAAPDDRATWDAIHATYDEMMTLTLAAGGTCSGEHGIGLHKQKYLAQERADTLELMREVKALFDPQGLLNPGKIF

SEQ ID NO: 558 - protein, 875 aa, Deinococcus radiodurans
MTIGHSSFRMRAVKPCPHSGGFPLNPERFTEASAVAINAAQQLAQENHNQNLTHFHVLRTLLDNDTASRALTLAGGDLNTARAALDAEIAKLPKVQGSDGQLYLDPALNRAFQKADTLAAQLGDSFVAADTLLLALRGEYRGRGLPDEVSLNRAVTEQRKGKTVTNKTSEQQFDALNKYGTDLTQRARDGKFDPVIGRDEEIRRVMQILLRRSKNNPVLIGEPGVGKTAIAEGLAMRIVKGDVPEGLRDKKIVSLEMGSLLAGAKFRGEFEERLKGVIDEVVKSAGEIILFVDEIHTIVGAGKTEGSPDAGNMLKPALARGELHLIGATTLDEYREIEKDAALERRFQPVFVDEPSVEDTISILRGIKERYQVHHNVEITDPALVAAATLSNRYITDRQLPDKAIDLIDESAARLRMALESSPERIDQLSRRKLQLEIEREALKREKDVDSQNRLLDIENQLKTLTDELNEVRSRWEAERGEVAALREKREKLDAVRTQIEKARRDYDLEEAARLEYGELPALEKDVQDLEKKLKSAEFAHMEVTEEDIAAVVSRWTGIPVSKLMEGEREKLLHLEEQLHGRVIGQDRAIVSVSDAIRRARAGLNDPNRPLGSFMFLGPSGVGKTELAKALAEFLFDSSDAMVRIDMSEYMEKHTVARLIGAPPGYVGFEEGGQLTEAVRRRPYAVILFDEIEKAHPDVFNVLLQVLDDGRLTDGQGRTVDFRNTLIIMTSNIGSPLILEMQQRGEDAETIKSAVMDELRGEFRPEFLNRVDDIIVFDALTAKDLQSIVDIQLGGLRRRLAERRITLHLTEDAKDKLAELGYDPAYGARPLRRTISQYIETPLAREILGGQIQDGSVLNVDYGDGGFTFNSGSLN

SEQ ID NO: 559 - protein, 278 aa, Deinococcus radiodurans
MKFGVIGAGQMGGGIAQVAAQSGFDVVVHDQKQEFLDRGKGVIEKSLGKLHEKGKLTDAPETVLGRIHFTTDLQDFADCDLVVEAIVENQQIKNDLFKQLGQIVKPEGILASNTSSIPITALATASGRPAQFIGMHFMNPVPLMQLVEVIRGYQTSDETARIVTETAEKLGKTPLSCNDFPGFVSNRILMPMLNEAIQCVMEGVAEPEAIDGIMKLGMNHPMGPLTLADFIGLDTCLAIMEVLHQGLGDDKYRPSPLLRKMVQAGLLGRKSGEGFYKY

SEQ ID NO: 560 - protein, 393 aa, Deinococcus radiodurans
MSKAVIVAASRTPTGKFLGALTDVPAVELGAITLRETLRRSGMPAELVEEVIMGQVVQAGCGQNPARQAALRAGVSHEAGALTINKVCGSGLKAVMLAAQSIRAGDQQAVLAGGMESMSNAPHLLPGARKGYRLGHATVLDANTHDGLWCSINDEGMGLTGERVAEKYSIGREEQDAYATGSHRKAVAAAQGGLFKDEIVPVTIKGRKGDVIVDTDEGPRADTSEETLGKLKPAFKKDGSVTAGNAPGLNDGAASLLVVSEELAQAHELTPLAEIVDYASGGLAPEWVMMTPVPATQKLLKKMNIQAGDVDLWELNEAFSVQSLAVARELGLDAERVNVNGGAVALGHPIGASGARILVTLLSALKQQDKELGVATLCMGGGNGLALAVRRLG

SEQ ID NO: 561 - protein, 251 aa, Deinococcus radiodurans
MVQTLRMPPMRWLPSVLLLLTGLLLAALALGVFAVLGGSGPLWLRSLGSVTLGGPGPNGFARGLALMLLASTRPRAGDAAPSGTQIFRTRARTGARAAAGLRSGLTMSLMTPLLIRDVLKALPHRYPFVLVDRVFSTENGEVHALKNVTINEPFFMGHFPTEPVMPGVLITEALAQASMFCLHGQMEPGQIGYLAGIEGARFKRKVIPGDQLHLHAKLEFLRRGLGKTTCRAEVDGEVAAEMQILFAVAKG

SEQ ID NO: 562 - protein, 411 aa, Deinococcus radiodurans
MARQHRLRAGRPVAAEACMSGGETGRTLRALFMSVSLGAGHDQAQQAVKQAFAERGVELLGAEHDSVEYLSTFERSFTVDLYEFELRYAPWLYRGFYWLTDQDQPWNIISRMFTWLGMGAFKDELRELRPEVVINSFWAPAAVCDTLRAQTGQRFLNCLIVTDYRAHLHWARRETDLLMVASEETRRQMLERGVRPEQVEVTGIPISPAFREVLAADRWALRAELFSEMSLRPGVPLLLLSGGGRGHYAAAADVLTELGNLGRAVQVLVPASRQGEGTETIGGATVHHLGFRRDLPRLLAASDLVVGKAGGLTVAEATALGVPLVIYAPIPGQEEHNADFLERHGAGLWARARHDVRPLVLRALDPAEHARLSAGARAVGIPDAADRVAGAILRRLGDGLGDELGDSRGPA

SEQ ID NO: 563 - protein, 462 aa, Deinococcus radiodurans
MTPSTDITDSPAALPGGALYPVRMSDALPATFDVIVHPARELRGELRAQPSKNYTTRYLLAAALAEGETRVVGVATSEDAEAMLRCLRDWGAGVELVGDDAVIRGFGARPQAGVTLNPGNAGAVARFLMGVAALTSGTTFVTDYPDSLGKRPQGDLLEALERLGAWVSSNDGRLPISVSGPVRGGTVEVSAERSSQYASALMFLGPLLPDGLELRLTGDIKSHAPLRQTLDTLSDFGVRATASDDLRRISIPGGQKYRPGRVLVPGDYPGSAAILTAAALLPGEVRLSNLREHDLQGEKEAVNVLREMGADIVREGDTLTVRGGRPLHAVTRDGDSFTDAVQALTAAAAFAEGDTTWENVATLRLKECDRISDTRAELERLGLRARETADSLSVTGSAHLAGGITADGHGDHRMIMLLTLLGLRADAPLRITGAHHIRKSYPQFFAHLEALGARFEYAEATA

SEQ ID NO: 564 - protein, 314 aa, Deinococcus radiodurans
MTAASSAGPRPRHLLDFQDWTPERLEAVLDNADTMLQVLDRPVKKVPALQGLTVCTAFFENSTRTRTSFELAARRMSADVVSFAAGNSSVSKGESLRDTIEVLTAYKVDAYVVRHHAAGAAHLVAKYSGKPVINAGDGRRAHPTQALLDAYTIRQEYGSLEGKKVAIIGDIRHSRVARSNAELLPKLGAEVVLCGPATLLPPDLAGQPGVRLTTDPREAVRGAHAVMALRLQQERMNGGYLASLQEYADTYQVNETLMREAESGAIVLHPGPMNRDLEISTEAADGPRSRIIRQVENGQAVRMSVLYHLLVGRA

SEQ ID NO: 565 - protein, 183 aa, Deinococcus radiodurans
MTAPKATILSSDEIRRALTRIAHEIIERNKGAENLAIIGVHTRGIPLAERLASKLSELEGVEVPRGMLDITLYRDDLSEVARQPIIRETQVPFDLADRRVILVDDVLYTGRTVRAALDALIDLGRPEGIQLAVLVDRGHRELPIRADYVGKNLPTAKHEVVKVKLQETDGTDIVELFDPEDLQ

SEQ ID NO: 566 - protein, 747 aa, Deinococcus radiodurans
MTNRFDDRARLVFHYAREEGNRLGHAMVGPEHLLLGLMREGGSAAQILGEFGATLDSLRRKVEDIIGRGEGSRLNDAPSITPRARRVMELSGAEARALGSQTTSTQHILLGIIREGDGVAFRILQDLTKDVETIRWRILAEDSGEGGKAAKPVPTPFLDEYGRDLTKWAREGKLDPVIGRSEEIRRVTQILTRRTKNNPVLIGDPGVGKTAIVEGLALAIHEQRTPPSLHGVRLISLDLSGVVAGTKYRGEFEERLRQIIEELRTAKVMAFIDELHTLVGAGGAEGTLDAANILKPALSRGEIQVIGATTTGEYHRYIEKDAALERRFQPVIVLEPSPAETLQILRGLKPKYEEHHGVQIPDSALELAVRIGERSLPGRNFPDKAIDLIDEAASRVRLNMSVGLPVAENESGEPMVTREDMESVINSMGGIYSEETGAALIDLEEQLNDQVYGQPDAVKALTSAMRRARVGLGGRTRVSASFLFVGPSGVGKTHLAKALARTLFGSERALIRVDMSEFQEGHSISKLIGSPPGYVGFEQGGRLTEAVRRQPFSVILLDEIEKAHPDIYNTFLQVLDDGRLTDGQGRTVDFRRTVIIMTSNTGFNVNPTVGFSPVTPDSNAPLRNIFTPEFLDRLDDVIRFKSLGEDELVRVAQQLLGEMREELASRELNVTFDPAIAAWVVGKLKARSPKHAVGSSRQLRTLLREELEDPLALYLIGSDARDLRVVLGENSIDFEQVERSAPPQILA

SEQ ID NO: 567 - protein, 426 aa, Deinococcus radiodurans
MQLTPLHVTGGRQLGGEIAVQHSKNAALPIIVATLLSSEPITLHGIPRLSDVYTILELMHHLGTRHAWVGPNSLTLHTPEIENTDAPYALVSKMRASFIVLGAILARAGTATVSMPGGCAWGPRPVDQHVKALRALGAEVIEDGGNFFAHREGSLNGSFVFELLTVGGTHNAILAAALGEGTVTLENASIDTDVVDVIEFLNALGARIEGAGTNTITIHGVKELHGGEYTVIPDRIEAGTFMMLAAATRSRLTLTNVRPDHLRAVTSKLAEMGVDIQEDGNRMVVDARGRDLKPVNVTTQSYPGFPTDLQPQMSALLATVPGTSVIQDPVYPDRLTHVAELHRMGATITVSGYTQVIQGGTLHAAPVKAADLRAGAALFIAGLTCEGETVIDGVQYLNRGYERLAERLRGIGGEVMQPEPMLAADD

SEQ ID NO: 568 - protein, 462 aa, Deinococcus radiodurans
MSVRRLRWREGGPMTNPNAHTLPIIVVGAGMTGLAAAWELQQRGVPYVLLEAGDSFGGKVQSERTEDEFLVEKAADAFILGKPWALQLAQEVGLQDELIHPRAETKKLYFLRGGELLDFPQNLKMFVPLDDESFLQSGVLSPEGLRRMLDEQNVPPKENTDEDESLADFIIRRFGAEAMNFIVPLAAGIYVANPFELSMKAAFPQFLALEQKYGSVIKGSRATPRAQGPIFGSFKDGMSTLANAVAAKLTGDVRLNTPVLAVHPDGVTLTGGEKIAASGVVLTAPAWVAAPTLGQSFPAASALVGELQTNGSVAVILAYREGQFPRDMHLHGLQVAADEGIEMKAITVHSAKLHGRAPEGHVLLRVFFKDLDPQKALAEAVHEVARLFGAQGDPLWHAYADWRGKNPAYQVGHLDHIARIRAALPPNIQVAGSSYTGVGIPDCVNAGRTAARDVVAALGVDG

SEQ ID NO: 569 - protein, 316 aa, Deinococcus radiodurans
MTTLTNQKPLGVLFMAYGGPENLGEMPGYLADIRAGRVTSQAILDEITNNYRLIGGKSPLPEFTRAQVEATMEQLASTGRPLKAYIGMRHWSPWIEDAVREMLDDGIEQAIAIVLAPQYSSLSVAKYQKKIKAALEMNHGHIDFAYIDNYHTEPGYITALADRVRIGIQEFPEDERDDVHVILSAHSLPVRIIKEGDPYADQLHETARLVAAQAGLTDEQWSWSYQSAGRSPEPWLGPQLDEHLRDLNEQGIKKVVSIAIGFVSDHVEILFDIDIAAQEVAHELGMTLVRPPALNTDPLFIGTLASVIERKAAEVA

SEQ ID NO: 570 - protein, 392 aa, Deinococcus radiodurans
MTRPQSEQAPEKQPATAPPPADQPTALDPSVGRVPGRPGVSRPELDPRVRDSAFLKTARGEQAPYTPVWFMRQAGRYMPEYRALRAGKTMLECIRTPDLAAEITLQPIKAMPLDAAILFNDILTPLPTMGLSLDFVGGVGPVIHNPINTPKDVDVLGVPATAETMPYTAESIRLLMPELNSRGIPLIGFVGAPFTLASYAIEGKGSRNYEKTKRFMYAEPAAWARLMGKFESVLADYLTEQVKAGASAVQIFDSWVGALSVYDYQTFVKPATAGLIERVKKLGVPVIYFGTGATHLMPDMASLGSDVMGADWRTPLDKAWDLIQPGQSIQGNLDPLLLQAPWRELKHQTDRILHEANGRPGHIFNVGHGLLPETPQDMVHRLTDYVHEQTQR

SEQ ID NO: 571 - protein, 498 aa, Deinococcus radiodurans
MSRPPAILRPAMSEPVSAVPLSAPVTPEWVADAVFYQIFPDRFARSGRVTGLHLQPWGSAPTIHGYMGGDLWGVAERLGDLAGLGVNALYFCPVFQSASNHRYHTHDYFQVDPMLGGNAALRHLLDEAHARGIRVVLDGVFNHASRGFFQFNDLLEHGEASAYRDWFHVTGWPLSAYDEDRPANYAAWWGIRALPKFNTDHPEVREFLLSVAEYWMHFGIDGWRLDVPNEIDDDAFWQEFRRRVKAINPDAYIVGEIWGDAGRWLAGDQFDAVMNYHFTRPCLGFFGARTLDHPMNERSGTGRVEPLDAAAFAVRVEEVTRMYHPAVVRAQLNLLDSHDTARFLTAVGGDASAQRLALVFQFSYVGAPCLYYGDEIGLPGGVDPDCRRAFPWDEPQTWDHDTLTLVRELTAARHRSAALRRGDFTVLHAQGEQVSFARKHDGEAAYVAFNCALDAAPVPVPATSGRYRDMLTGAVHDLNESSVLTLPARTAALLLCEG

SEQ ID NO: 572 - protein, 302 aa, Deinococcus radiodurans
MGGVFQDSPSLDSLFFPQPLPSAAKSCHHAGMTYSDDDLRLDEMEFENITIDQHGPIAVLTVNRPKALNALNGTTLSELAMAADLIANDPEVGALIVTGAGDKAFVAGADISELAGLEGPFAGRDMSLLGQDAMTQLSNLPIPVIAAIGGYALGGGLELALCCDIRIASPRARMGLPEVTLGLLPGFAGTQRLPRLIGAGRALDLMLTARQIGAEEALSMGLVNYVADDPLQKAREVAEQIVKNGPLAISLVKEAVRRGLATDLEAGMEIEADLFGLAFATSDFKEGTKAFLEKRPAEFKGE

SEQ ID NO: 573 - protein, 330 aa, Deinococcus radiodurans
MGSRRFVRGPLRAPGPYTVTVNVSAPDPSASVPARSGSGPRRAFLFADPAAHSLSPRMHRAAFAWAGLNGTYDAERVPAPELPTAMARLRAPDVLGANLSLPHKEAALPLLDGLSDAARAIGAVNTVIHRAGQLYGDNTDAPGLLQALAGSGLTGRLGAADRVVVLGAGGAARAAVYAGAVILGREVWVVNRTPARARALAAGWQGGGEVRAAGPGEVPWGQVGLVINSSSAGLDNPEETPLPGFDFGQLPAHAGVYDMVYKPRRTRLMRDAEAAGLPAENGLGMLAQQARLAFTAWTGVDVPVSVFLAALEAPATGRGAGDAARTEATR

SEQ ID NO: 574 - protein, 402 aa, Deinococcus radiodurans
MNPLRIGLFTDTFLPDQNGIVTSVCLLSDELRALGHQVDVVAPRFPEHLDRRPDVRRVASVRYPLLPTYRLAWPGRRSFEQRYDLIHTHTPLTLGLAGARLARKWGVPHVATYHTHLEAYTHYVPGMTQLNRAVHFMPKVVGRLYGEADAVITPTAGTLDTLRQAGITDAVVIPTSIDPAVLEAAPPIASPWPPGTRRLLTVGRLAREKRFDLVLDTLADLPGAHLVILGEGPERTHLEDHAQRLGVAEHVTFVGVRPWTEIGAYYRLAELFVFASDTETQGLVLQEAQLMGVPVVAVGARGTLTGVQSGYSGYLTAPGDVPELVRRARELLESPEQYARFSRQAREFGGRTTPAGVARQVLAVYARTLGLPPESPDDPRADGLSAPAEAAGRPRNNPVYGR

SEQ ID NO: 575 - protein, 386 aa, Deinococcus radiodurans
MKLHEYQGKEVLRDFGVNVQDGKVATTPEEVQAIYKEYGQPVVVKAQVHVGGRGKAGGVKYSANEDKALENAKNILGMDIKGLTVNKVLVTKAVDIDAGTEYYVGMIVDRNVQSYTLMASAEGGMEIEEVAATNPEKIIRHRVDPVTGLRPYEAREVAIKAGFRGNLNKIADMMVKMSKAALERDAVLVEINPLFVDADGTPIALDTKFEIDDNAMYRHKDLAHYRELSAEHPLEVEASDYGFAYVKLDDGNVGVLGNGAGIVMTTLDVVNRAGAKPANFLDIGGGAKADVVYNAVKLVSKDPDVKAIFINIFGGITRADEVAKGVIRALDEGILTKPVRMRIAGTAEDEAKALLNEKNSDLIKMYPTMFEAANEAAKEANALGGK

SEQ ID NO: 576 - protein, 301 aa, Deinococcus radiodurans
MGILVDKNSKVIVQGMTGSEGAKHSRAMKEFGTQVVAGVTPGKGGQDFEGWPIYNSVAEAKEKHGANVSIIFVPPAGAADAVLEAAHAGIPLIVLITEGVPTVDMMRAVQEVKELDAHSKANGGQGVRLIGGNCPGLVTNGEAKVGIMPNRIYTNPGRIGLISRSGTLTYEAAKLLNDAGMGTSTTVGIGGDPVIGTTFADVLPMFEADEGTDAVVVIGEIGGADEEAAAEYIKNNMKKPVVAFISGRSAPAGKRMGHAGAIIMGDVGTPESKLAAFKAANVPVADTMPEIIDLVKQALNK

SEQ ID NO: 577 - protein, 387 aa, Deinococcus radiodurans
MTDNGMSFAPSSEQRMILQHVRDFCRAEIAPRAAEYDRSGEYPREQLRGLAELGLLGATVPEEWGGAGLDSVTYALCLEEIAAADSSVAVIVSVQNGLPEQMILNYGTDAQREKYLRPLASGEHIGAFCLTEAHAGSDAASLRLKAERDGDDWVLNGAKAWITSGNHADTFLVMARTGGPGARGVSCFIVERGTPGLSSGKPEHKMGQHAAQTTTVSFDNVRVPHANLVGEEGQGLIIALSSLDSGRIGIGMLGLGIARSALEHAAAYANEREQFGKKIREFEGVSFKIARMAARIESARLVGLKAAWLKDQGQPFSKEASIAKLLGSEAAVDVTRDAVQIFGGNGYSAEYPVEKLYRDAKITEIYEGTSEIQQLVISRAVFAELEK

SEQ ID NO: 578 - protein, 325 aa, Deinococcus radiodurans
  unsure (1)..(325): unsure at all Xaa locations
MRTVTVGVLGSGTVGQNVLQLIERRRPVFGDLGVQIELAGVLVRDVNKARELPAGVRVTDNCDFLQECGVVIEAMGGIERPLELLRPYLKSGRPVITANKALLAEKWDELRSYALDGDLYYEASVMAGTPVIGPMSTVLRASTFTRLQAVLNGTCNYILTQMEGGKDYAAALAEAQALGYAEDPPTLDVGGFDTAHKLAVLARFCADGNFPYEQIEVQGIEHVTLDDIEQARQRGERLKLVAELRREGHDTQRGGWRAVVAPQSLPADHPLCXAGGGRNAMVYEGEECGPLIFAGGGAGGMVTASAMVGDLLDYLLGFPGHVPLH

SEQ ID NO: 579 - protein, 829 aa, Deinococcus radiodurans
MALNNDVNRLGRILGQVLKEQEGEAFFNLVEQTRTLVREVRAGGDPAQLNALLGSLSENDASNLARAFTWYFQLVNIAEEYERVRVLQSRSGVRSQSLAQALADLREQGLSAEDVENLLARVNLELTFTAHPTEMRRRTVRSHLEHIARELPDLGRESAQERVAAHVEALWRTPELRRLKPTVLDEVKGGLNYISTIAQALPKLERDLSDAFQATYGRETAAHVPLRFSSWMGGDRDGNPFVTPEATREALQLHRERARELLLAALRQAYTDLSQEEEEDAAEGTYRTELRALHNAVRDGEPVELLPRLEALNARLHADGQERTAWQLLMPLLSVARVFGQHLVSLDIREHSGQTGAAVAELLKAAGVEADYLGLSEDAKLELLTRELRSHRPLWPAGATFTETLEAVIGPIREVQAAARRVGPLAFGHYVISMSESVSDILEPLILAREVGFRVLPVPLFETLDDLQHAPRIVTDLLALPEYRAVLGDDMQEIMIGYSDSNKDAGFLAANWALHEAQRTISDVCRRAGVRWRFFHGRGTSIGRGGGPASRAILGQPAGTIDAGVRITEQGEALADKYSHPVLARRNLEQALYGVLLAAARPVGDPPADFMAAMTRAAEASATAYRDFVHDPDFLPFFERVTPIHEISRLNIASRPVRRPGAPTLGNLRAIPWVMSWTQNRANLPGWYGLAEGLAEIGPELAAKMYAEWPFFHSMLDNAQMSLAKSDPLVFAEYLTLLEGASTRLADHLRESYARTVAAVESVIGGELMLGEQRLKESIALRNPYIDPIHRLQVELLRRSRSHEGGLDEYERPLLLTLQGIAAGVRNTG

SEQ ID NO: 580 - protein, 398 aa, Deinococcus radiodurans
MTQFKNFPAAPAVEWPTGADMDFTLTDEQRQLQQLARDFTRKEIIPIAAEYDQKEELPWQVVEKAFEVGLLNASIPEHAGGLGLGMVDETLIGEEIGYGCMGIYTILMASELGITPILVGGTEEQQKRFLGPLTEKPGLAAFALSEPNNGSDAAGMHTTAYLDGDEWVINGTKMWISNGGIAEVTVVFATTDKQGGHRATVALVVPKDAPGFSYNKIKHKMGQRASLTSELVFENVRVPKENQLGGLGDGFKIAMKTLDKTRIPVAAGSVGLARRALEESVKYAKQRERFGTPISQFQAIQFKLADMAIGVETGRLMYQKAAWLVDQGHTHGAESAIAKAYCSEMAFNAANEAIQIHGGYGYVGEYPVEKLLRDVKLNMIYEGTSEIQRVVISRGLLK

SEQ ID NO: 581 - protein, 244 aa, Deinococcus radiodurans
  unsure (1)..(244): unsure at all Xaa locations
MQTLLALNWKMNKTPTEARSWAEELTTKYAPAEGVDLAVLAPALDLSALAANLPAGIAFGGQDVSAHESGAYTGEISAAMLKDAGASCVVVGHSERREYHDESDAXVAAKARQAQANGLLPIVCVGENLDVRERGEHVPQTLAQLRGSLEGVGADVVVAYEPVWAIGTGKTATADDAEELAAAIRGALREQYGARAEGIRVLYGGSVKPENIAEICGKPNVNGALVGGASLKVPDVLGMLDALR

SEQ ID NO: 582 - protein, 411 aa, Deinococcus radiodurans
MTGLCPLHQPSPLDHPHSGGTPMQNLSQLDVKGKRVLVRVDYNVPVGDGVVQDDTRITASVPTIKKLLDGGASVVLMSHFGRPKNGPEDKYSLKPVAEAVSRALGQDVKFIPSLPGSDETLQAVQALRPGEVALLENVRFEAGEEKNDAALNDKLAKLGDAFVLDAFGSAHRAHSSVSGVAGKLPHAAGGLLQSEVDALGKLLHAPEHPYVVIIGGAKVSDKIKVIENLLPKVDRMLIGGGMMFTFIKARGGQIGNSLVEDDQLDLAKGLLEKYGDKLLLPTDAVAADKFAADAQSKVVPADQIPDGWMGLDIGPDTQRAYADALQGAKTVFWNGPMGVFEFDQFAAGTNAVAAAVGSLKDQAYTVVGGGDSVSAINKSGKADQIDHISTGGGASLELLEGKELPGVVAMA

SEQ ID NO: 583 - protein, 330 aa, Deinococcus radiodurans
MKVGINGFGRIGRLVFRILEARGVEVVAINDLTDNHTLAHLLKYDSTAGRFDGTVEYDESSLTVNGKKIQAIAERDPANIKWGEYGADIVIESTGIFTSREGASKHMQGGAKKVIITAPAKGEDFSIVLGVNDEQYDPANHHIISNASCTTNSLGVPMKVIDEAFGIEKAIMTTVHSYTNDQRVLDLPHSDLRRARAAAINIIPTSTGAAKAVSQVYPALKGKFDGTSLRVPTPTGSISDVSVILGRDVTVEEVNNVFREAANGKYKGIMAYTEDPIVLTDIQGDPHSAIIDGGLTMAMGNLVKFFSWYDNEWGYSNRIADLVQLVQNKG

SEQ ID NO: 584 - protein, 473 aa, Deinococcus radiodurans
MSQPQPPSRLLVMKFGGTNMQSAHAIRHSASLAGRSVREGVKVVVVVSAMAGVTNGLLHLADAAQSGDIARANDEIAALRTRHFTAAQELGAAPDSETVRELRELHETLRQAVYGVYLLRELTPRSRDLIVAFGERLSAPLMSLALEQSGLRARHLTGGEAGILTDTNFGNARPLPGTYERVGDRLSGFLSAGVTPVIAGFMGETEQGAITTLGRGGTDFSATIVGKALGADEVWAWKDVDGVMSADPRVVGDASNIGVLSYGEVMELAYFGAKVLHPLAVTPLQDSGIPLRVKSAADPDFAGTLVRSQAEEIPGRPVKAVTAIKNVSLLTVTGAGVLGVPEVIASVFTAIARENITLLMVSQSSSMSNVSLAVPSADAARALQALRAGLSSELNVEETNGVAVLAIVGSGMRGQQGVSARLFTALASEDINILMISQGSSELNISVALSGEEVDRATAAVHAAFTLSQPVGA

SEQ ID NO: 585 - protein, 564 aa, Deinococcus radiodurans
MNPVSSISYKKYFPASQFSSETIQSTLNLSMTSLQGELKWWQSGIIYQIYPRSYQDSNGDGVGDLPGITARLPYVASLGVQAVWLSPIFKSPMRDFGYDVADYCDIDPVFGTLEQFDALVAEAHRLGLKVMLDYVPNHTSSDHAWFQEALTGKASAKRDWYVWRDPAPDGGLPNNWKSFFGGPAWTLDEASGQYYLHQFLPSQPDLNWRNPDVRAAMFDVLRFWMRRGVDGFRVDVIWLLAEDERFLDEPENPDADREVVGGQIEHSTLLHIYTQDQPETHDYVREMRRVIDEFDDRMMVGEIYLPLDKLLPYSGTPEAPMVHLPFNFHLILLPWDAQTIRQFADEYDAASNAAGAWPNWVLGNHDQHRFKTRVGAAQYRVAQTLLLTLRGTPTVYYGDEIGMENVPVPPEKMVDPSGLQQPDSPDAGRDPERTPMQWEAAPGAGFTAAGTEPWLPLTDNFAQVNVQVQEQDSQSDLNYFRALTRLRQEQPALVGGSYRSLDSGHADVFAFERELNGERLTVWLNFRGEERAVAATGQTLLSSRGDQPAAQSPLRGHEARVVLG

SEQ ID NO: 586 - protein, 176 aa, Deinococcus radiodurans
MSLPPGNGPVQISAEQIKARIQELAAQIRSDYAGQRPHLICVLNGAFMFHTDLVRALDMPATIDFMQASSYGTAKQSSGEVRLVKDLAFPISDRHVIMVDDIVDTGITMSYLLHYLQGRGPASLKVAALLSKPSRRKVEVPVDYLGFTIPDAFVYGYGLDRAQLDRNLPFITSQEE

SEQ ID NO: 587 - protein, 354 aa, Deinococcus radiodurans
MMDKDLGASPASAYERAGVSIDAGHRAVDLMKGAVARTHTANVLGGLGGFGGLFRAAFGDMADPVLVASTDGVGTKTKVAVKVGQFGGLGHDIVNHCVNDILVQGARPLFFLDYVAMGKLRPEAVAEVVSGAAQACEALGVALLGGETAEMPGVYVDGELDIVGTIVGVVDRPNLIDGGRIEVGDAVIALPSSGLHTNGFSLARMALDALDWNEARSDLGGQTLAAVLPVPHRSYLPAYDALEKAGVDVRGMAHITGGGLVDNPPRVFPQGIGMQVDTASWAVPPLFELIVREAGVERQEAFRALNMGVGFLFIVPAAQREQAMQTLRAAGEQPWVIGEMVAGQGVTFSGGGAS

SEQ ID NO: 588 - protein, 329 aa, Deinococcus radiodurans
MRPELLARVLSLLPETSATPELARFYALLRDYPQRGGKGIRSELLLASARAHGLSESDTGWESALWLAAALELFQNWVLVHDDIEDDSEERRGRPALHHLCGMPVALNVGDALHAYMWAAVGKANVPGAFEEFLQMVYRTAEGQHLDLAWVEGREWGLRPADYLQMVGLKTAHYTVIVPLRLGALAAGMAPQDAFTPAGLALGTAFQIRDDVLNLAGDPVKYGKEIGGDLLEGKRTLIVLDWLTTAPDDRKAIFLDQMRRHRADKDPAVIDEIHRWLLESGSVEAAQDYAQAQAAEGLDLLEKALADAPDAQAAAALLASVRELATREK

SEQ ID NO: 589 - protein, 510 aa, Deinococcus radiodurans
MQFRSRGAPVCRVPARLWRMSLQSPPELPSGFIRTSDVLHERLTPARARHLDLQYGNEELLYGLDVLGLAGPFYRTSPWELEDEQGVRRINACGYAALPFGEMPPAITSFMQEFLEHNRAMTLPQQSSSPWRAALQTNLVKLLSRELPSHSDSQVFFCSSGTEAIEGAMKFAKAWRPEARHFISFGSGYHGKTYGSLSLTPNPEYQDVFRPLVPGALTSPYGDLDALKALVRRAGPDKIIAVVVEPIQGEGGVNIPPPGFLRGLGEFCRSHGIVVIADEIQTGLGRTGHWFESAAQGLDADIITLAKPLGGGLVPVGATIVRQPIYKKMLGGLSSKRHSNTFGGGALSMAVGLKSLEYLLENDLPARSRALGEQGLARLQDLQRRFPKLLQAVRGQGLLLAMQFQPVVGLALPGAIRELVYEGTAILALRELHHARVMANLSLSSKRVVRLSPALDMPQDVFTELMDRVERFAQLNPNARSLVTHTPAPTLLRLATFAASKPKKRTPSDG

SEQ ID NO: 590 - protein, 292 aa, Deinococcus radiodurans
MLSRDQHCFTFAKRFSFLVCIRIVNMIVVKVGGSDGIDYDAVCADLAERWQAGEKLILVHGGSGETNRVAEALGHPPKFVTSPSGYTSRFTDRQTLEIFEMVYCGKMNKGLVERLQRLGVNAVGLSGLDGRIFEGKHKDSVRSVENGKVKVLRGDHTGTVEKVNTGLIELLLGAGYLPVLTPPAASYEGVAINVDGDRAAAQLAAALRAEALLLLSNVPGLLRDYPDEASLIREIPANDVESYLEFAQDRMKKKVLGAAEAVAGGVGRVVFGDARAGKPISAALAGEGTVVS

SEQ ID NO: 591 - protein, 420 aa, Deinococcus radiodurans
  unsure (1)..(420): unsure at all Xaa locations
MEQDTAWRQEANQTFHTRATFLECARVNLGSGGRADLSRRKRRPMDYYELLGVSRTASADEIKSAYRKLALKLHPDRNKEEGAAEKFAQVSEAYSVLSDTEKRAHYDRFGSAPGAGMPGGDXFGGMGGMGGVGFDPMDIFEQLFGGAAGMGGRGRRGPARGDDLETEVRITLEQARAGEEVEVTVDRLTECEHCHGTRTEPGGKPPVTCSTCNGSGAVRGQARTIFGVVETQQVCPTCKGDGKMVVDPCTVCHGRGRTLKSEPVKVKLPKGIDEGYRIRVAGQGNEGPGGNGDLYVHIEMEPHPELHRQDENLIFPARIGFATAALGGRIQVPTLDGPQEVEVKPGTQHGELHRLRGQGMPRLQGAGTGDLIVDYEIVVPKHLNAEAKDALQAYARAVGDEVPEEHEGLFGKIGKLFGRD

SEQ ID NO: 592 - protein, 269 aa, Deinococcus radiodurans
MGYPLPCMTRLDTPAKPAPSTLQKLWKELLEPILFAVVITQFVATLVGVDGNSMLPGLRNRERVFVPKYETWLHKAGVGNFKRGDILIFKPPAQAAQKIENLNRSFLGLWNYRPFLIKRLIGLPGDKIRISGGEVYLNGAKLDASWTTGYWQQQECWDTQSDLATQATSGRAGVMPDQPEFTVPAGTYFVMGDNRTVNGSEDSRMFGPVPLRDIAGRAAAVVWPVMRKSNLKYDCAAETAGELSGENELNWRVLNRPPGFSAVPAPTTP

SEQ ID NO: 593 - protein, 402 aa, Deinococcus radiodurans
MRLGTGGLVMPEAVIVSTARTPIGKAYRGFLNDTHGSDLGAHAVKHAIERAGVNPADIEDVIMGAGNPEGATGSNIARQIALRAGLPVTVSGVTVNRFCSSGLNTIALAANHVMAGQGDVFVAGGLESISLTQNEHANTFHLRGEWLLEHKPDIYMSMLQTAEVVAERYGISRERQDEYGYQSQMRTAAAQQAGKFDHEIVPMTATMKVQDKATGEISTQEVTRKLDEGNRPDTTLEGLAKLKPVFEGGVITAGNASQLSDGAAAVVVMNSDVARERGLQPLGVFKGFAVAGCEPDEMGIGPVLAVPKLLKRHGLSVDDIDLWELNEAFAVQTLYCRDKLGIDPEKFNVNGGAISIGHPYGMSGARLTGHILLEGQRRGAKHVVVTMCVGGGMGAAGLFEVL

SEQ ID NO: 594 - protein, 218 aa, Deinococcus radiodurans
MTAQTTPERRPDHLTLALPKGRIMDDAIALLSQAGLPLTRPEASRALRHEFPGVTVLELRNQDVPVYVDLGVADAGIVGKDVLLEAGRPVYEPVDLHFAECRLSLIREIGASGPIARVGTKYPRAARAYLQERGIPAEVVKLSGNIELAALTGLADAVIDLVQTGSTLRANHLEEVDVLFHSSARLIVNRTALKLRRERLRPLIARLRELTAPAGEES

SEQ ID NO: 595 - protein, 332 aa, Deinococcus radiodurans
MSLPTSTTPESFMNSRRSPLLVFSGQSNRPLAQAICDNLGVPLGRSRTEKFTNDNLIVHYEESLREGDVFIVQTFSTPVSDAIMELMLMIDAAKSASAGRVTAVIPYYSYARSDKKDSPRISIAGRLVADLLQEAGADRVLTMTLHSPQVHGFFKVPVDHLSADVVLSQHFKKCVPDAHNGVVLAPDAGSIKRASQIARRLDSGLAMIDKERLSDTEVRPRALIGDVDGKTVFIVDDEISTAGSLVETVSIARSMGAKDVYVAVTHGVYSGPAIERIAALDVTQVASCNTVLVPQDKLDRAGGKLAVLDVAPLFASAIANIHTGASVSTLFT

SEQ ID NO: 596 - protein, 255 aa, Deinococcus radiodurans
MTQEAKQFEKQSGGADSNQFGAGKSAFVTGASKGIGYAVAQALAAEGYRVTITSRKQGEIDEAAQQLGENVRGVVCDVKDAAAVQSAVDAHVEAFGSLDVLFVNAGVGHFANIEQLSIEQWQDVIDTNLSGAFYTIKAAIPALKKQGGYILTLSSLAGKNPFEGGAAYNASKFGLNGLSEVVNLDLRQYDIKTTQIMPGTVATHFNDHTPNEDDFWKIQPEDIAQLTVDLLKMPARTLPSRVEVRPSRPDRKPKK

SEQ ID NO: 597 - protein, 483 aa, Deinococcus radiodurans
MHHLILPALLLASAASAQAAPTSTGPSFEGQIIYQVMPDRFFDGDPSNNAGVDRANLRAWHGGDLAGLTQKLPYIQKLGATAIWMTPIYRQQTAKSFDTAAYHGYWPADFRQVDPHFGSMATFDTFMKAAKGAGMKVVLDQVINHYGYEAPAVKANPGWFNGKAQCDATKNKDVDCPLAGLPDLRQSVPAVRQQLFGNGDFWRARGVDGFRYDAIKHVERPFLLDLLKKDRAAGTWTLGEWYDADAGTVAEWQKQGFDSLFLFSLQAAMRGSVMGASSLVNVREVLRRSDELARPGEVALFLDNHDVPRFSQGSFFEDEGQARTKYGLRALLTLRGVPVLYQGTEIAMRGGADPDNRRDMRFESQWTPAEKAVYNVARDAIAVRKASPPLSRGTQTLLPVPDRQADDLLLLTREQGGQRVLVAWHNGLKRQSYSLKLSTLGIKANAQDVTKTLFAGQDAKVSVKGGYLHLSLPPKDAAAFVLR

SEQ ID NO: 598 - protein, 629 aa, Deinococcus radiodurans
MNELPGTSDTPLLDQIHGPKDLKRLSREQLPALTEELRGEIVRVCSRGGLHLASSLGAVDIITALHYVLDSPRDRILFDVGHQAYAHKILTGRRDQMADIKKEGGISGFTKVSESEHDAITVGHASTSLANALGMALARDAQGKDFHVAAVIGDGSLTGGMALAALNTIGDMGRKMLIVLNDNEMSISENVGAMNKFMRGLQVQKWFQEGEGAGKKAVEAVSKPLADFMSRAKNSTRHFFDPASVNPFAAMGVRYVGPVDGHNVQELVWLLERLVDLDGPTILHIVTTKGKGLSYAEADPIYWHGPAKFDPATGEYVPSSAYSWSAAFGEAVTEWAKTDPRTFVVTPAMREGSGLVEFSRVHPHRYLDVGIAEEVAVTTAAGMALQGMRPVVAIYSTFLQRAYDQVLHDVAIEHLNVTFCIDRAGIVGADGATHNGVFDLSFLRSIPGVRIGLPKDAAELRGMLKYAQTHDGPFAIRYPRGNTAQVPAGTWPDLKWGEWERLKGGDDVVILAGGKALDYALKAAEDLPGVGVVNARFVKPLDEEMLREVGGRARALITVEDNTVVGGFGGAVLEALNSMNLHPTVRVLGIPDEFQEHATAESVHARAGIDAPAIRTVLAELGVDVPIEV

SEQ ID NO: 599 - protein, 730 aa, Deinococcus radiodurans
MKVTVDGVPLDLPAGTSGIDAVFAAGRDVPYFCAHSYLSPVGACRMCLVESGSPRKGKDGNFELDEQGEVKIFWFPKPMAACTMQATEGMHIKTAATSEVVAKSQAGMMEFTLLNHPLDCPTCDKGGACELQDRAFEYGYGASRFGFDRRHADKHYPLSDFVILDQERCIHCKRCVRYFEEVPGQEVLDFIERGGHTFIDTQEGGLPTGFSGNITDICPVGALLDNVARFRGRNWEYDHTPTTCTLCPVGCAITVDARNGRLERIVGRENRDVNEIWLCDAGRFGHTFASEGRLTRPLIRENGRLREADWDEAIAAMRRGLSGIHPSQLGLFIAADSTLEEGMALERFAAQLGAGNVDHWPRHPVQLTAPAATLTDVAQADALVVIGADLGEEAPVLELRILEALRGGILPTEFDHGTAIADLRLVERPARKPEKLAVIGRESSIWRHAGIQAASNGHNAVARLLRPDTDELRAALKLLEEAEKPVVILGADVLGADVLGSGTDGLAAQVSELANRTGAKVLAVAAAANSTGLAALNLLPRSGAAGYAGLTDAPAAFLSRLDPVGQGLLSLPRGFTVVHDTHLTETAQQADVVLPAVTNYEKRGTTVNLEGRFLALEQAALSAGEGADLIRTLTALAEALGVRPQVRGLKSAQAALQERLGLRVDTLPPQGALNLNVNRAAAPVGVPYTPQLWKPRMRPAPQASEQPDLGRGQASWAAPLSAAAPTGGDD

SEQ ID NO: 600 - protein, 592 aa, Deinococcus radiodurans
MEQTGKQGQNRGEMTGAKALWATLAGHGITTVFGYPGGAIMPVYDALTFYPEVRHILARHEQGAIHAAEGWAKATGEIGVCMATSGPGATNLVTGLADAMLDSVPLLAITGNVAQHLMGTDAFQEADITGITMPITKHNYVVRDVDELPRVIAEAIRIARSGRPGPVLVDIPKDVQLAAFAGDIPTPHTRPQAPEASAESIASARELLRNAKKPVLVMGGGSLDASAELTALAHAWGLPVITTLMGLGAYPASDPLWLGMPGMHGSVAANRAISECDVLLAVGMRFDDRVTGRVSGFAPHAQIIHVELDAAEIGKIVRTHLPIRSDAKTAARQLAEGAEKLELGEWLSQIEEWKGRAVPPQQWGAAYAVGQVTARLRPDDILSSDVGQHQMLAAQLARFEKPRRWLNSGGLGTMGFGFPAAIGAALAEPGVVSMVVAGDGGFQMTAQELATLKMYDIRNVKICIINNSYLGMVRQWQELFHGKRYSEVWLGDSNPDFVKLAGAYDVPAYRASSAEELPAAIDAWLSDPKSSLLEVVVPHEHGVFPMVPAGAALHEMMETEPVRTDISAEATEVNEATWQEMTEQEAEEMNQG

SEQ ID NO: 601 - protein, 264 aa, Deinococcus radiodurans
MQLAIVGVGKLGLSLLTGVIARGVIAPQDIGIIEANAARAQDIAAQTGVQVITPPQLAQVGRIVVSVQPRVFPEVAPWLAQENAGYISTMAGVSAGTIGRRLGTRRVVRVMPNLAATIGRSQTAITGPREAHEAGDIAFAEQLFGAVGQVYELPEHLFNAFTGMSASGPAYVAVVAEALADGGVRMGLPRPLANELAARLLASTGELLLERAHPGLLKDEVASPGGTTIAGLEELEAAGVRGGVMRAVVAATRRGTELGKDQED

SEQ ID NO: 602 - protein, 282 aa, Deinococcus radiodurans
MLYTARMQEQPWSIPGTPVTGYVWAAESPRAAVLLTHGLGEYARRYVDHFGALIPHLVQAGYTVYAYDQRGHGNSPGERGLVDTAPLLEDHFRAREALRSQPLPVYTFGHSLGGLITAASAARDPRGLSGVILSSPALLIGEGQPQLTKALAPLLARVAPRLPVSELGTDALSRRSDEVRAYQDDENIYHGKVTAQTAWTMLRLSGELWPDYVRWQLPTLVVHGDQDQLADVKGSQRFIETIPAADKTLRVFEGGYHELLNDEPSDEVRQIILDWLAAHTAG

SEQ ID NO: 603 - protein, 430 aa, Deinococcus radiodurans
MVGRPAGVGVEWASMSKHIKVPEQGEKITMQNGKLTVPNRPIIPFVEGDGTGPDIWAASVRVFDAAVEKAYGSERKLEWMEVYAGEKSLEVYGANEWLPQETLTAFRDYLFGIKGPLTTPVGTGIRSINVALRQELDLYACVRPVQYFNGVPSPVKRPEDIDMVIFRENTEDIYAGIEWKAGTDEAEKVRGFLMREMNVTKIRFPDTSSFGVKPVSKEGTERLVRAAIEYAIENGRKSVSLVHKGNIMKFTEGGFRDWGYELAKREFGAVEIDGGPWCQLPNGIVIKDVIADNFLQQILLRPTEYDVIATLNLNGDYISDALAAQVGGIGIAPGANINYVTGHAIFEATHGTAPKYAGKNVINPSSVILSGEMMLRYMGWTEAADLILKGLDATIQQRVVTYDFARGMDDATEVKTSEFADKIIENMRNA

SEQ ID NO: 604 - protein, 422 aa, Deinococcus radiodurans
MHSNLTPSSLDPQTETGGFPMTSTLSRPAQNPNLTPQNDDQRTVLSSLKAFLKNKVEPGAAERDQTGEFPFEIVKELGAMGIMGAQTPEEYGGAGLDSATFAMIIEEIAAVDGSLCLTVASHNSLCQGHILIGGSEEQKRKFLPDLASAQKLGAWGLTEPGSGSDSGGMFSNAKEQPDGSWILNGSKNFITQGSVAGTYVVLARTDPAREGKGKNDGISAFVFNRDEVQGFSIGRKEDKLGLRSSDTAQLIFEDIHLPADALLGERGNAFKDVMRVLDGGRVGIAAMGLGLGRGAYEYAARYALGRHQFGKPIAYNQNIAFRLADIDTKLEAARLLIRKAADLKDAGQNFTVPVARAKLYATVVGVEACDEAIQMLGGYGYIKEYPVERMWRDNRLTRIGEGTDEVQRLVISRDVLKRFAQD

SEQ ID NO: 605 - protein, 411 aa, Deinococcus radiodurans
MGSAAVGGPRPHLYFPAMSFFSPPSASVASTLGPKIAVLCHTGAGGSGVVATELGLKVADAGHEVHFVGTAMPFRLTGHQGLRGPYFHQVGGFAYALFEQPFPELSAANTLSEVILEHGVDLTHAHYAIPHASAALHARSITGKTRVLTTLHGTDVTLVGTEPAFQHTTRHAIERSDHVTAVSHSLAAETREVFGVDRDIEVIHNFVDSDRFRRIPDPGVRARFAHPEEALIVHVSNFRPIKRVEDVVQVFARIASEIPARLLMIGDGPERARAFELARELGVIGRTQFLGSFPDVQTVLGISDLFLLTSSHESFGLAALEAMSCEVPVVASNAGGIPEVVQHGVNGFLSDVGDVDDMAHHALKILRDQETYQQMGQAARRTAVEQFHPRLIVPQYLAAYRRLAEQSASTF

SEQ ID NO: 606 - protein, 386 aa, Deinococcus radiodurans
MTRSTLAAAASRYDAFYAQQGRAMTQQHTGEVLLAVNNLKTYFNTDDGVVKSVDGVTFHIKKGETLAVVGESGSGKSVTSLTVMRLIPMPPGQIAGGEILFTGKDGVQRNLVNVSEAEMRRIRGNDISMIFQEPMTSLNPVYTVGDQIAEAVVLHQGKTRKEAMDVATDMLRFVGIPAPEKRVNEYPHQMSGGMRQRVMIAMALSCKPALLIADEPTTALDVTIQAQILDLMRNLQREVGMSILFITHNLGVVAEMADRVVVMYGGRVVEEGDVIEIFKAPRHPYTMGLLNSIPRPSEDEHAHVPGQPKKRLEAIPGNVPNPLNLPPGCTFEPRCKFAVPQCSQAVPALEDTGGGHMARCIRWREFEQVQGGQPHTGTGLSSEVNA

SEQ ID NO: 607 - protein, 305 aa, Deinococcus radiodurans
MLVTGKDILVPARAGKYAVGAFNTNNMEITQAIIHTAEKLRSPVIVQMSEGAIKYGGQDLANIVIDLATRATVPVALHLDHGSSYESALNAIKMGFTSVMIDASHHPFEENVHETKRVVEAAHAMGISVEAELGRLGGIEEHVVVDEKDAFLTDPDEAVKFVEETGTDYLAIAIGTSHGAYKGKGRPFIDQARIKKIGELLSIPLVAHGSSGVPAEIVQRLRAAGGEIGDAAGIADEDLTEAAQYGIAKVNVDTDLRLASTVGIREVLKATPKEFDPRKIFGPARDVMSQIVEHKMGVLGSVGKA

SEQ ID NO: 608 - protein, 368 aa, Deinococcus radiodurans
MVMKIGMIGLGKMGGNMVIRLKNGGQDVVGFDRSQEAIDHLVSQGVAADALTSDMDRFIELLGEPGQRAVWVMVPAGQITQSVIDDLAGRLSAGDVIIDGGNSNFHDTQRRGEALAAKGLHFVDVGTSGGVWGITEGYGMMVGGPDEGVERIRPALEALAPAPDRGWGHMGPTGSGHYVKMVHNGIEYGMMQAYAEGFELMKAHQTFNLDMAQIAEVWRHGTVIRSWLLDLTAEALKNSADFDQLSDYVADSGEGRWTIIDSIELGVPTPVITLATQMRFRSQQDVSYQGQMLSAMRRAFGGHAVKTLEATKQESVVPAVKPGESPKAAAPENIPTAAAQPSISGRSEAQELGETGQQRTTGDQKAGE

SEQ ID NO: 609 - protein, 590 aa, Deinococcus radiodurans
MTDRPRPKKSSPKKSGPEKALAKESAAQGEAAKATRQATQQTEAAKKVGVAQPGAPAQSRKAARKSRQRVPKHAGDNAPKSDAPGADGQNPFRTAMRRSRAPEPATLVIFGATGDLARRKLLPAVFGLWQDGLLGSAFNIVGVGRQEMDDEQFKDYAIDALKTSKETDEIKEGSLEKFRELLYYEYGEFGEDEVYDKVRSELDRAETARGGGKNALFYLSTPPSLFEPISSGLGRQGLQDETEGWRRIVIEKPFGRDLQSARELNDAIHRVWDESQVYRIDHYLGKETVQNLMAIRFGNAIFEPLWNRGFVDHVQITASEDLGLEGRAGYYEEAGIVRDMLQNHLMQLFTLTAMEAPSAFEADAIRDEKVKVLRAVKRIPADRVPEVAVRGQYGPGALDGQTVPGYKQEPDVKRGSRTPTYVAVKLEVDNWRWQGVPFFLRTGKRLPKKVTEIAVVFKRPPLGLFPGGLERNVLAFRIQPDEGVSLKFSSKSPGQEMVLREVVMDFRYDAFGAQLESPYSRLLLDAMLGDATLFPREDEVDHAWQIVSGILQAWEGADAAAPKFPNYAAGTWGPDAADELLGPGRRWRRL

SEQ ID NO: 610 - protein, 193 aa, Deinococcus radiodurans
MQSLVEAIKREGRVLPGGFLKVDGLVNHQLHPALTREMGETFARHFAPLAPTKVLTIEVSGIAPAIMTAAELGVPMVYARKKKPLTMSEQVYTAQSVSRTKGGTVDLFVSSEYLGPQDRVVVIDDFLASGGTLRSLSQIIADSGATLLGLGCVIEKEFEGGRQHLADLNVPIHTLANIVRMSEEEGIVVQAGR

SEQ ID NO: 611 - protein, 685 aa, Deinococcus radiodurans
MTQSTAQSSNPLLNIGFKIPFDQIRPEHAEPAVDELLAAARERVENLARSGERNFENFMADLDTLTEQLGTVNTIVHHLDSVVSSDEWKAATEAIIPKTTQFYTELSLHPGLWGALKAFGETDTAKGLDPVRARHLKLTTDEFRRGGADLPDDQKARLLEVNTKLAQTTNQFAKNVLDATAAYELYVPTERLGGVPQRVQDATRQDAQSKGQEDHRLTLHAPTLQPILTYADDRELRRELWEASGMLGQQEGRDNRPLIREILKLRREQAEILGFANFADYVLEDRMAKSGQGALNFERDLDAKTRPAYERENAELEAYYREKAGADAPALAPWDIAYWAEKQRQEKYDFDEEALRPYFALDNVLSGLFEICRRVFGITVKEAQAPGWHPEVKFYDIFDEAGTHIASFYTDWFPRDTKRGGAWMNAFITGGPKEGGVDPHLGLMCGNMTPPSSGGQGADAPALLSIREVETVFHEFGHLLHHAMSRVPVKSLSGTNVAWDFVELPSQIMENWVMEREALDLFARHYQTGEKLPDDLFQKLVKAQNYRAANFAMRQYSFGLTDLTLHVEYDPSGEEDPVAVARDVMARFYPTELPGNYAQVASFNHLFSSPVGYGAGYYSYKWAEVLDADAFSRFAKEGIFNRETGRAYVDSILSRGGSADPAALYREFMGRDPDADALLRRSGLL

SEQ ID NO: 612 - protein, 333 aa, Deinococcus radiodurans
  unsure (1)..(333): unsure at all Xaa locations
MAKYRICLIEGDGIGHEVIPAAKRVLEAAGFDAEYVHAEAGYEYFLDHGTSVPEATYDAVENTDATLFGAATSPSGEKPAGFFGAIRHLRQKYNLYANVRPTKTRPVPHSYENVDLVIVRENTQGLYVEQERRYGDTAIADTVITREASDRIGKFAADLAMKRSKRLTVVHKSNVLPVTQGLFMNTILDHTKTVEGLSTSTMIVDNAAMQLVRNPQQFDVMVMTNMFGDILSDLAAGLVGGLGIAASGNVGDQFGIFESVHGSAPDIAGQGISNPTATILAAVIMLDHLGDHETARRLDNAINKVLAEXPRTRDLGGTAGTQEFTEAVIKALA

SEQ ID NO: 613 - protein, 435 aa, Deinococcus radiodurans
MHFGGRVPLFLSCCRLHLSGVPMKPRVLGMILAGGQGSRLAPLTQKRSKPAVPFGSKYRIIDFAINNFINSGMFSVYVLTQYKAQSLTEHIQRGWRFGTFLSDYFITLVPAQMYRFEELGDAWYRGTADAVYQNMHLIDNFEADYVAIFSGDHIYKMNVEHMLEKHIETRADVTIAAYPMPQSQAHQFGVMQVDERWRVTEFHEKVPDPPTIPGQADLSLTSMGNYIFSRRALEELLEASISGQETGYDFGHNVIPRALSDGYHVQAYDFHKNPIPGQERPNTYWRDVGTLDAYFEANMDLVSVNPEFDIYNPEWPLRTSSEFSPPAKFVHESEGRKGQAFNSIMAGGAIISGGTVRDSVLGRNVRTHSYSLVESCVLFDDVQVGRHSHLRRVIVDKDVVIPPGTTIGLNREHDEQRGFTVTEHGVVVVPKGYVF

SEQ ID NO: 614 - protein, 584 aa, Deinococcus radiodurans
MTSIPAVPAAPSGSLPRPWLTSYEPGVPQDLAPSSRTLYRLLEDAATRYPNREALQFLGQGTTFRELLKRVRRFAKALQRSGVQQGDRVAIMLPNCPQFVVAFYGTLLAGAVVVNTSPLYTAAELEHQLSDSGSETLVILDSLYPRYAEVADKVPVKRVLVSRIQDELPFPKNLLFPIKALKEGTLASDSFKRNPRAVPMRFVTKLQDPDPVSVPITADDVALLQYTGGTTGVPKGAMLTHRNLVANAEQCRSWMVGLQEGREITMAAIPFFHVYGMTVAMNLSMLIGATLVLVPNARDIKMVLDEISRTRATIFPGVPTLYNAINNHPDTAAHDLTTIRACISGSAPLMQDTARTFREITQGANLVEGYGLTETSPVTHVNPITGEQKEGSIGLPLPGVDALIMDDAGQPVPTGEVGELWVAGPMVMKGYWNMPDETAKVLREYAGKTWLLTGDMATMDEQGFFRIVDRKKELIIAGGHNIYPREVEEVLTSHPAVLEAAAVGLPDPYRGETVHAVVALKPGMQATEKEIIAYCRTLLSAYKAPRSVEFRDELPKTAVGKTLRRQLAAEARERLKKEKAEKSA

SEQ ID NO: 615 - protein, 547 aa, Deinococcus radiodurans
MPTPIHVLPPHVARLIAAGEVVSRPLDVVRELVENALDAGASRIEIEVDGGGLERVQVRDNGSGIAAQSVPLAPARHATSKLTAGPETGSLSVTTLGFRGEALWAAAQAGELELTTRPAAQVGAARLRAQGDAVEVSRTSAPAGTTVTVSQLFARLPARLRTQASAAAEVRDITALLGRYVLHHSALHWRLTVDGDPRLTHAPADHRGAVATVYGPLSANRVLTLDTPGVRGVVSRPELTRARRDRMHFAVNGRPIVAPPELERAVIDAYAELLPAGTAPLCVLDLTVAPEDYDPNIHPAKQVVALADLPAVALRVRDAVAGALAGHPLVRAAPALIAPPEPHPAPTAGNFPDLTLLGVYQELYLLAQGEGDLWVVDAHAAHERALYERLGRELGTAAPLELPTPELLHLTPEQTARLHERGAELRGWGLTIEDFGAGLARLRTLPAALAALPVPRLHEVVVETALSGGPDPRREVLARLACLPALKAGMLDAERGALVLAALRECEQPWACPHGRPTVLRLSERDLAHAFGRRGVRDVARGRDSVV

SEQ ID NO: 616 - protein, 389 aa, Deinococcus radiodurans
MTEPLPDVTFPQGFRAAAMAAGIKPSGKPDLSCVVSERDCAWAFAGTRSTTAAACVTRNRELYASGAPLRALVVNAGVANAATGQQGARDNADMADALASVLAVGEAEVITASTGVIGHLLPMDKVLSGVEHLPEELEGAALPFATAIMTTDTRSKLAHVTLSNGARIVGTAKGSGMIHPDMATMFAFAFTDAQVDQGALRGAFPAIVARTFNAVTVDGDTSTNDMTAVLANGAAGETDLTEFLTALEGVMRDLARQIAADGEGATRLLTVRVTGAASEAEALGAARTCCVSPLLKSAVHGADPNWGRVIMAVGRSGAGVKVEAMKVSVQGVPVFAGGPLNYDAAAVSQSMKTDEVIFDVDLGVGSARGEAWGCDLSAEYVSINADYTT

SEQ ID NO: 617 - protein, 424 aa, Deinococcus radiodurans
MQAVTEVMTSIWPFVQAHPEYAEHALLERLIEPERVISFRVTWVDDAGQVQVNRGYRVQHSSSIGPYKGGMRFHPSVNLSILKFLAFEQTFKNALTTLPLGGGKGGSDFDPKGKSDGEVMRFCQALMTELWRHLGPDTDVPAGDIGVGGREVGYLAGMMKKLANHAGGVFTGKGLSYGGSLLRPEATGYGTVYFVEHMLRDQRMEMEGLRVSVSGSGNVAQYAIEKALHLGAHVLTASNSGGTVVDEDGFTYDKLAVLMDIKNERRGRVEDYAREVGAEFRPGVRPWDVPVDVALPCATQNELGADDARTLIAGGVRVVAEGANMPCDLAAIQAFEEAGVLYAPGKATNAGGVATSGLEMSQNAQRLSWTREEVDQRLRSIMSAIHDSCLEYGRRPDRHVSYLDGANIAGFVKVATAMREQGVL

SEQ ID NO: 618 - protein, 906 aa, Deinococcus radiodurans
MSDKAMNLFGARDTLQVPGSDKKLYFYNLNKLQGHDVSRLPVSIKVLLESVLREANDYDVRREDVETVAGWSATNPEVEIPFKPARVILQDFTGVPAVVDLAAMRSAMVKLGGDPSKINPLIPVDLVIDHSVQVDEFGTEFALANNMALEFERNRERYEFLRWGQQAFDNFGVVPPASGIVHQVNLEYLAKGVQSRAEDDGEVVYPDSLVGTDSHTTMINGLGIVGWGVGGIEAEAVMLGQPIYMLMPEVIGFKITGAMPEGATATDLALRVTQMLREKGVVGKFVEFYGAGLSNMTLPDRATIANMAPEYGATMGFFPVDDEALRYLRRTGRLEDEIGLVEAYYKAQGMFRTDETPDPVFTDTIELDLATIVPSLAGPKRPQDRVNLSDMHSVFNEALTAPVKNRGFELGSDKLDAQGTIGGTDIKIGHGAVTLASITSCTNTSNPSVLIAAGLVAKKAVEKGLKTKPWVKTSLAPGSRVVTEYLETAGLQQYLDQIGFNTVGYGCMTCIGNSGPLPEPVVEAIQEGDLVVASVLSGNRNFEGRVNPHIKANYLASPPLVVAYALAGTVVNDIVNDAIGQDSNGQDVFLKDIWPTNAEIQEAMDRSINAEMFKKVYDGIEKSNADWNAIPVAEGALFDWKEDSTYIQNPPFFDTLAGGAHEIESIKGARALVKVGDSVTTDHISPAGSFKADTPAGRYLTERGIAPKDFNSYGSRRGNDRIMTRGTFANIRLKNQLAPGTEGGFTTNFLNGEVTSIFDASTAYKEAGVPLVVLAGKDYGMGSSRDWAAKGTFLLGVKAVIAESFERIHRSNLVGMGVLPLQYKNGETADSLGINGDETFEFVLPGDLKPRQDVTVKVTGKDGNTRDITVMCRIDTPVEIDYYKNGGILQTVLRGILSKSQGEVKA

SEQ ID NO: 619 - protein, 445 aa, Deinococcus radiodurans
MVPAPPFLGHAAEMGTIKLRPFLTRCYQAYGPVFQLTVPGQKITVLAGPEANLFAMKEGHRVLRSLEAWRDNDHEMGSDRSMISLDGAEHRAYRRVEGRAFARSFFAAGLRPALAVLAEDLAPFQPGDVLPVATWCKKTITEQLARMAVGGTVRPYLPDLLHFIQTALQVTVNRQLPPAVLRLPKYRRAKARIFQMVDDLIEDHRQNPPEKSGRAPDLIDDVLADQQVNPERWEHPDVRLAALGAFIAGMDTAANSLAFVLYRMHLHSEFLPALRAEADALFRDGPPTAEALGRSPLLHRFVMETLRVHPIAPALSRTLTEDVEFAGHRIPAGTPVIIGTTVPHGLPELFPDPEHFDPGRFAPGRAEHRQPGAYAPFGVGSHTCAGSGMAEGLIMLGAAAALRTLDLSLEPDYVLRQTAKPTPSLDNKLQLRVNAVRHNPVFLVH

SEQ ID NO: 620 - protein, 478 aa, Deinococcus radiodurans
MTPEKLALTTNSRARKPRSDGTPDNPLAAELTRTLGHKKVLHHLSERLNYRYDAIQFGVTPLAVVLPESTADVVAAVKAAKAAGVPIVGRGAASGLSGGVTPLQESLVISFTRMTGLHIFPERREAVAQPGVVTLKVTEAAKPHGLMYPPDPASFRTSTIGGNLGENAGGPMCFKYGVTGDYVRALEFVDVDGDVHRLTRDCYDLAGLLIGSEGTLGLITEATLRLIPPPKFTRTLMSHFAEVGQAAEAVSSAIAAGAVPSKLEFMDRACVGAVEDYLHLGLPRDADAVLLVDTDGDDAEIVAAELELVAQACAAAGGTVRRAANDAEADALWRARRSISPSLGRIRPQRMNEDIVVPRSALPDVVREIRALGDASPFHLVQFGHIGDGNLHPNIMFDPRTEDTHAVHDLAHKIALVAIRHGGVLSGEHGIGTMKRDFMRDAVDPVTLNVLRDVKRALDPANGLNPGKILPDLLMDER

SEQ ID NO: 621 - protein, 234 aa, Deinococcus radiodurans
MKRPAGVRRFWREWAGPVCWALLVTQFGASAVRVDGASMLPALRHGEWLALPKAEGWVHRLGLGEYQRGDVVVFKPPRSAAYEWTNVYRGVNLPWAYRPYLVKRVVGLPGDTVQVRAGTLYVNGQPVPEPRTLNYWAAFCHDTGSDLANTPPLKVPAAHYFVMGDNRSPGGSLDSRVFGPVPAWDVDSRAVASLWPLARQEEARPACDEQPQPEKRVQLSGPVQWNPRWGFGGR

SEQ ID NO: 622 - protein, 541 aa, Deinococcus radiodurans
MSRLTDLPAWQALEDHYYELQGTHLRELFAADPERGEKMNAEGAGLYLDYSKHRVTDETLRLLRELAQATGVEARRDAMFRGEKINVTEGRAVLHTALRAPRDAVIEVDGKNVVPEVHEVLDRMATFADAVRSGEWLGYTGKPIKNIVNIGIGGSDLGPVMAYEALKHYAQRDLTVRFVSNVDGTDLTEKTRDLDPEVTLFIVSSKTFTTQETMTNARSARKWLLGSLKDDAAVTRHFVAVSTNAEEVQKFGIDTANMFGFWDWVGGRYSMDSAIGLSLMVAVGPEHFREMLAGFHDMDEHFRTAPAEQNLPMLMGLLGVWYGDFFGAESLAVLPYDQYLASFPAYLQQLDMESNGKHVTLGGEPVDYQTGPIVWGQAGTNGQHAFYQLIHQGTKLIPCDFIGFCQTLNPLPPHHDLLMANVFAQTEALAFGKTLEQVLADGVAPEVAPHRVFEGNRPTSTILADRLTPRTLGALIALYEHKVFVQGAVWDINSFDQWGVELGKVLAKKIDGELQSEGEPELQHDSSTNALIRRYRARRQG

SEQ ID NO: 623 - protein, 379 aa, Deinococcus radiodurans
MSLSRHALQDAAQRFGTPLYLYDAEELDAALWRVQRAFGDARIFYAMKANPNLNLLRRYAAAGVGFECVSLGELLRAEAAGAGGERMILNGPAKSDAEYAAAARLGATIVVDREEEVVLLPPGSRVLVRVNPAMTVSTHEHLATGTARSKFGLTPEQVPGTLAELRDAGHEVLGLHMHIGSAIEQAEDFTAAFARVTELRAHIGGLSVLNVGGGWSLNADLEGIAYEAHEAARVFGAELWVEPGRYLVASAGWLLTRVVGTKRTGRNFCLVDAGMTEFLRPMLYGASHPLYPMWDALATEVWDVAGPACESGDLIARGVPLPTPQRGHLLLIGEAGAYGASMSSTYLSRPRPAEVLWTGHDWQLLRRRETPQDIWAAEV

SEQ ID NO: 624 - protein, 745 aa, Deinococcus radiodurans
MTSSAGPDLLQALNPTQAQAADHFTGPALVIAGAGSGKTRTLIYRIAHLIGHYGVHPGEILAVTFTNKAAAEMRERAGHLVPGAGDLWMSTFHSAGVRILRTYGEHIGLRRGFVIYDDDDQLDIIKEVMGSIPGIGAETQPRVIRGIIDRAKSNLWTPDDLDRSREPFISGLPRDAAAEAYRRYEVRKKGQNAIDFGDLITETVRLFKEVPGVLDKVQNKAKFIHVDEYQDTNRAQYELTRLLASRDRNLLVVGDPDQSIYKFRGADIQNILDFQKDYPDAKVYMLEHNYRSSARVLEAANKLIENNTERLDKTLKPVKEAGQPVTFHRATDHRAEGDYVADWLTRLHGEGRAWSEMAILYRTNAQSRVIEESLRRVQIPARIVGGVGFYDRREIRDILAYARLALNPADDVALRRIIGRPRRGIGDTALQKLMEWARTHHTSVLTACANAAEQNILDRGAHKATEFAGLMEAMSEAADNYEPAAFLRFVMETSGYLDLLRQEGQEGQVRLENLEELVSAAEEWSQDEANVGGSIADFLDDAALLSSVDDMRTKAENKGAPEDAVTLMTLHNAKGLEFPVVFIVGVEQGLLPSKGAIAEGPSGIEEERRLFYVGITRAMERLLMTAAQNRMQFGKTNAAEDSAFLEDIEGLFDTVDPYGQPIEYRAKTWKQYRPTVPAATTAVKNTSPLTAELAYRGGEQVKHPKFGEGQVLAVAGVGERQEVTVHFASAGTKKLMVKFANLTKL

SEQ ID NO: 625 - protein, 431 aa, Deinococcus radiodurans
MGMTIAEKMLAAHSGHDTVVPGQLIECATDWVLCHEITTPAALRMLEERGMDRVFDPQKIVAVPDHSVPAMNIKAAKMYQKLKSWVQEKGIEHFYDVGRGGIAHVVLENTGLMKPGQTLVSGDSHTCNAGALGAFATGVGSTDLAGAIYAGKVWFKVPETMLIRVTGKTNPGVTPKDIVLEVIKQIGADGANYMVMEWVGDYIDQLDMEGRFTLTNMAIEAGGKTGIVAVDDTTRAYMQQRGVSPEQYTEYQSDPDAKYKVVVEIDAAQVEPTVAYPHIPSNGRVAGSDRIRVTHAYVGSCTNGRITDLRDVARILKGRKVAQDVQMIVVPATQAIWKQAAQEGLLEIFVDAGASVSYPSCGACLGMHSGVLGPDDICISSSNRNFVGRMGDPSAQIYLASPATVAASAVEGFIADPRRYDAEGNDLNAAD

SEQ ID NO: 626 - protein, 352 aa, Deinococcus radiodurans
MPKVITLPGDGIGPEVTAAAVQVLREVAPDVTVEEHAIGGGAYDAHGEPFPTSTRDALKEADAVLLGTVGGAHDSAWNQLPRHLRPESGLLALRKALGCYANLRPVRVQPGLEHLSPLKAELARGVDILIVRELLGGIYFDQDRKIEGDTAYNTMRYTTSEVERVAKVAFWAAEQRKGRVTSVDKANVLEVSELWRRDVQALRDRDYRSIHLNHEYVDSVAMLIVADPSRYDVILTENLFGDILSDLAAVIPGSLGLMPSASLGDGAGLFEPIHGSAPDIAGQGVANPAAAIMSVGMLLRHGLERSEAANQVDRAVALALREQPTRDLGGSADTQTFTRAVLKALGSSPSVG

SEQ ID NO: 627 - protein, 597 aa, Deinococcus radiodurans
MSKVRIYTLAKDLGVDNHKMLEILDGLGVSYKSVSSTIDEENVEIIKQILADEAAEGGDAAPAAASAPAAATAEPEEADETPAAAAQADAEPASDLPHRAPVVTIMGHVDHGKTSLLDYIRKTRVAAKEAGGITQHVGAFEAKTSKGKIVFIDTPGHEAFTTIRARGANVADIAIIVIAADDSLMPQTREAIAHAQAAKVPMLIAINKVDLPQADPEKVKTDLTQLNLVPEEYGGDVIVVPVSAKTGEGVEDLLEYISLTAELEDLRADPKGQFSGVIIEGRVDKQAGVLATVMVQEGTLHVGDFLVVGENYGKIKAMTDSNGGRIKEAGPSTPVQILGFSEVPSSGETVVSAKNEHAAREIVAQRASDRRDEEDARERRKAQRSLADLLGPLGEVHTVNLILRADTQGSLEAIQGILARKETEDVKLNVMLAGIGAPTEGDVLLASTAEAQILCFNVTPSAAVTKVAETKEIPIKAYRIIYEMIDEVDRLIKGNLDPVFEEQYLGRAEVRMVIHHPKSGNIAGSYVTDGMFKRNAKAKVTRGKEVVYEGTVVGLKRFKDDVREVQQGYECGINIDWNDVQEGDIIEASEMVEVEPR

SEQ ID NO: 628 - protein, 120 aa, Deinococcus radiodurans
MTTTPTDRKYAASHEWLTQDGTVGISDHAQEQLGDVVYVELPEVGREVKAGEAVAVVESVKTASDIYAPASGTITAVNDELSGSPEKVNESPYEGGWLFKLDVTEEGDLLDAAAYEAQAN

SEQ ID NO: 629 - protein, 361 aa, Deinococcus radiodurans
MTQPPAPSTTENLNVTGFTPLMTPRELKAEVPLTDAAERTVLAGRRAAQAILSGEDDRLLVVVGPCSIHDQAQALEYAGRLAALRERVKDRLEVQMRVYVDKPRTTVGWRGYLLDPDMDGSNDMGKGVRRTRELMVAVSELGLPVATELLDPFAPQYLFDAVAWACLGARTAESQTHRVMASAVSAPMGFKNGTGGGIKLAVDAVVAASHPHAFFTIDEDGRAAIVHTKGNAHGHVILRGGRAGPNYAPQFVQEAADLLRAAGREEAVMVDCSHANSGSDWTRQRLVWRDVLGQRLAGQRAIRGAMLESNLQAGKQSLPADLTQLKPGVSVTDACVGWDETEALLLEAHEQLSGRAALATC

SEQ ID NO: 630 - protein, 444 aa, Deinococcus radiodurans
MPNPNALPGAAHLSGAGAAQTGSPMKTRIAGKTILAIVLAGGRGSRLSPLTDERAKPAVPFLGTYRLIDFTLSNLVHSGINDVWVIEQYLPHGLNDHLSGGRPWDLDRTRGGLVVMPPFASAENEEGEFAQGNAHALAQHAHLIREFGADLVLVLSADHVYRLDYSDVIRQHVERGASVTMVTTELADEQQATRFGNVRAAKNGKVSEFAYKPDEPLGKTVTAEVFVYDAHIMLSTLEALSKEGELGDYGEELLPALVARGDAHAFPMHGYWMDVGTLDAYLQTHRDFLDGKGFALDDPQWPFITSSISRPPTRIEKTARLDEALVCGGAVIAGEVVRSLIAPNAVVEAGAVVRDSVVQPGAVIRAGAQVSRAVVDQDAEVGPGSRVGGQTGNSRPTVVGAHAHLGPGVQVGPGQVVAPRTRVKAGEEGQKVQELDADDKAGKK

SEQ ID NO: 631 - protein, 152 aa, Deinococcus radiodurans
MTAASYAGQLTFSTSHLSTCDPHDLHGCFTEFLASGRARYSRRMTQDLQVEKYQEGSGQPAEKGKMVSVHYTGTLENGQKFDSSRDRGQPIEFPLGVGYVIPGWDQGIAQMRVGDKARLTIPGHLAYGEAGVPGVIPPNATLIFDVELMDVR

SEQ ID NO: 632 - protein, 705 aa, Deinococcus radiodurans
MTFPLPLDHEHLQKLVTADLVRPDHLLGAHPTTEHGVQGVRFAVWAPNAQHVSVVGDFNDWNGFDHPLQRLDFGFWGAFVPAAQPGQRYKFRVTGAGGQTVDKTDPYGTFFEVRPNNASIIWQQDFEWTDAGWLEQRARRGQALEDPISIYECHVGSWARRDDGWFLNYRDLAHRLGEYVTYMGYTHVELLGVMEHPFDGSWGYQVTGYYAPTSRLGSPEDFKYLVNHLHSLGIGVLLDWVPGHFPTDEFALAHFDGSPLYEYADPRKGYHYDWNTYIFDYGRNEVVMFLIGSALKWVQDYHVDGLRVDAVASMLYLDFSRTEWVPNIYGGRENLEAIAFLKRLNEVAHHMAPGCLMIAEESTSFPGVTTPTPEGLGFDYKWAMGWMNDSLAYFEQDPIYRKYDHHKLTFFNVYRTSENYVLAISHDEVVHLKKPMVLKHPGDWYAQRADYRAFLAMMWTTPGKKLLFMGQDFAQGSEWNHDAPLPWFHADQPDHRGVMNLVRRLNELYRERPDWHTGDAREEGMAWISADDTDNSVYAYARRDTYSGAWSLVIANLTPVYREDYVIGVPQGGEYRVLLSTDDGEFGGFGTQQPDLSARDEAAHGQAHALHLNLPPSSVLVLEPVAAAPVKGLVSRQELTPELREVARQSAQAVQVERAADPRPNEQQRLVAETPAHEGGRSAPADAAESAEQKPDDEQKGGKKA

SEQ ID NO: 633 - protein, 206 aa, Deinococcus radiodurans
MGWHPLGEHGAPHNSSMTQQTNSQGTQPGAAQEQAIFAGGCFWCTEAVMQDLRGVQKVESGYIGGTVPNPDYRSVCGGQTGHAEAVRVTFDPNQISYRDLLGLFFATHDPTSLNRQGADVGTQYRSALFPLTQEQEQTAREMIEQLGTEDVFGRPIVTSIEPASTFYVAEDYHQNYYKNNPGQGYCMAVISPKVAKLRQYYGDKLR

SEQ ID NO: 634 - protein, 327 aa, Deinococcus radiodurans
MCPSCAATFLSPILLGMTHGTPAQAPNTQTSNAQSPNAAASGTFLIGGELEVNRLGYGAMRVTGDGVWGDPADREGSLATLRALPGLGVNLIDTADSYGPAVSEELIREALHPYPGLVVATKGGLTRTGPNVWPPCGRPEYLIQQAQISRRRLGVERIDLWQLHRIDPQVPRDEQFGAIRQLLDDGVIRFVGLSEVNVEEIEAARQVFPVATVQNLYNLTNRKSEAVLDYCGREGIGFLPWYPLASGKLAAEGSVLTETAARLGAAPAQVALAWVLRRSPVMLPIPGTSKVKHLEENVAAASLTLTDEDFRALDEAGRAEWEAGQQK

SEQ ID NO: 635 - protein, 172 aa, Deinococcus radiodurans
MGVSGSGKSTVARALAERLGWAFAEADKFHPPENVAKMQGGTPLTDEDRWPWLRAIRDWLTQEAQAGHSTVVTCSALRRSYRDVLREAAGEVRFVHLTGTRDLLAERMGHRQGHFMPASLLDSQLATLEVPGPDEHALTLNIGAAPDELVREVLAGLQLGSTASLSSRPGRD

SEQ ID NO: 636 - protein, 501 aa, Deinococcus radiodurans
MSEHQYILALDQGTTSSRAIVFDHQGNMKGVGQQEFRQHFPKPGWVEHDANEIWSTQIGVAQQALSNAGIRASDLAAIGITNQRETTLIWDRATGKPIHHAIVWQDRRTAPYCDSIRAQHEKTLQDKTGLVLDAYFSGTKVKWLLDNVPGARERAEKGELAFGTIDSWLVYNLTGGELHITDATNASRTLLYNIHTGEWDDELLRILDVPRSVLPEVRNSSEVYGKTAAGLLGAQVPIAGIGGDQQAATFGQACLERGMAKNTYGTGCFMLMNTEGEAVPSQNKLLTTVAWQLDGERTYALEGSVFIGGAVVQWLRDGLNIIRSSTEIEALARTVDSSEGVMLVPAFVGLGAPYWDAYARGTMVGITRGTTKAHIARAALEAVAYQSAELLEAMQKDSGVELKELRVDGGASTNDLMMQFQADILGVPVIRPKVTETTALGAAYLAGLAVGYWKSTDDIAHQWQEDKRFEPQMSEEERSKLMRRWKKAVARARDWEDDSEA

SEQ ID NO: 637 - protein, 428 aa, Deinococcus radiodurans
MWAFNVQFGTSKGDDMISGLKRVVITGLGPVTPIGVGAKAYAEAQRAGKNGIGPITRFDAKDTASKIAGEVHDSLDDFVDPREARKLDRYTLLALSAAELAVRDSGLSAEDLRGERTGTLVGSGIGGMKTFEDQARVYVERGAGRISPMFIPMQIANMATGHIAMRYGAMGPSSTVVTACATGTGAIGEAARYIQLGLADVMLAGGAEASITAMAVGGFSNMKALSTRNDDPEHASRPFSATRDGFVLSEGAGVVVLEEYEHAKARGATIYAEVAGFGVSADAYHITMPAPQGAGAQLAMKMALHTAGVNPEQVGYINAHGTSTHFNDLHETQAIQHVFGDHAAQLAVSSTKSMTGHLLGAAGAIEAIAVAQALADGLLPPTINLTDPDPELPLDFIPEGARERQVDYALSNSFAFGGQNAALLLGRV

SEQ ID NO: 638 - protein, 110 aa, Deinococcus radiodurans
MTEAGGSLHPVQPCAPASARRVHCGHFSFRRNLVMATFDDVKDVIVDKLGVDEGKVTPEARFVEDLGADSLETVELIMGLEDKFGVTIPDEAAETIRTVQAAVDYIDNNQ

SEQ ID NO: 639 - protein, 254 aa, Deinococcus radiodurans
MTHNEISPAPARVALVTGSSRGLGRAMALRLAQDGFTVAVHYGRGEAEAQQVAADIRAAGGAAQVFGADLSQPANAGTLVEDVIAALGRLDVLVNNAGITRDGLAIRMKDEDWDAVLQTNLSSAFAACRAALKHMMKNRSGRIVNVSSVVALAGNPGQANYVASKAGLIGLTRALAKEYGGRGITVNAIAPGFIESDMTAKLPEDTKKQYQANIPLARFGQPEEVAALVAFLASEGAGYITGQTIGVDGGMNPN

SEQ ID NO: 640 - protein, 305 aa, Deinococcus radiodurans
MSASKIAALFPGQGSHAVGMGADLAGEFPQAGETYAALDATLPGLRSLIEGGPLDDLTRTANQQPALVAASVAAYRAWQAHTGLTPMVAAGHSLGEYSALVAAGVLTLEDALRLTRKRGELMQQAVPEGVGAMSAVMGDPAVVAEVCAAQAGVVQPANFNAPTQTVISGEKAAVDAASAELKTRGLKAIPLKVSAPFHCALMRPAAEGLSAELHAAAYGPYLFPVVANVSAELVDSPTHTADLLERQITGSVRWVETVQTLAELGTEVFIEFGPGSVLSGLVKRIVPGARTLNVGSTEQVRAFAL

SEQ ID NO: 641 - protein, 341 aa, Deinococcus radiodurans
MKSIGITAIGMYVPERVVHNHEFESRMGIEDGWIESRSGIRERRFSAPGEFASHIGAKAVQDMLARDPDALKDVDLVIYATCTPDAMFPSTAALVAGQVGLTGVGAYDLSTACSGFVYALSMARGMILGGSAKNVLVLGGEVLSKALDQDDRDTAILFGDGCGCAVVGEVPAGYGFQDFVLGADSAGGPALYISNLADQFPDGQIMRGVPTMNGREVFKFAVRVLGDSGTQALQKSGLSNADVDWLIPHQANIRIIEAATQRFGIPMEKTVINLDRYGNTSAGTVPLALYEAVNDGRIQGGQQLLMVVFGGGLSWAACTMKWWGGRPSLHAQVAQPAEVPA

SEQ ID NO: 642 - protein, 379 aa, Deinococcus radiodurans
MGRGVSCGMRLFLLRVGSALEPGSDSPIFLSGGPGRCYGHVMTASLSAPAIGILAVGAYAPAAVITNAHYATRLDTSDDWITSRTGIRERRHAAPDESSSVLGIRATQDLAGRFPGALDGVNLVICATSSPDAMFPSTAALIAGGTGLRGAAAFDVSVACSGFLYALSVGYGMIRAGLAKKALIVGSEVMSGAVDQNDRNTAILFGDGAGCVVIGEVPQGYGFQSFVLGADSAGGPHLYLRGAALRLPEGTEMGPHLTQNGREVFKFAVRTLGDSAEQAMRQAGKTTADIDWLVPHQANIRIIEAACERFGLPIERAVTNLDRYGNTSAASIPLALAEAQAQGRFKDGDQLLLAGFGGGLSWGAAALKWWSGPTGKQSS

SEQ ID NO: 643 - protein, 399 aa, Deinococcus radiodurans
MSEKIVIVAAKRTPIGSFMGSLKDVSAVDLGVTAAGAVLSGVSDEVKADIADVIVGCVLQAGQGMNVARQVGRGAGLPDAVPGQTINRMCGSGLQSVVSAIQGLKSGDGQIYLAGGTESMSRAPYLLPKAREGYRLGHGEILDTILTDGLTDVFHNYHMGTTAENLAEKYGISREDQDAFALESQKRAAAAIEGGYFGDEVVPVEVPTRKGPVTFDKDEHPRATSLEALAKLRPAFKKDGGTVTAGNASGINDGAAMVLVTTESYAQERGLPILAEVKGYSNVGVDPAIMGIGPAYAVPLAVKRAGLSMSDVDLFELNEAFAAQSLAVLRDLGQQGAEVDPAHVNLTGGAIALGHPIGASGARVLTTLIHQLRRTGKETGVASLCIGGGMGIALVLQAR

SEQ ID NO: 644 - protein, 264 aa, Deinococcus radiodurans
MSVTIDLSGKTALVMGVANARSLGWAIAEQLLQAGCRVGFSYQGERLKGELEKLTKDWPNTWIQQADATSEEDMDALFARVKDEFSELHLLVHSIGFAPRTAMDGRFIDTTADDWNTALNVSAYTLVAAARRAEPLMPDGGSIISLTYHASQQVVPRYNVMGVAKAALEAATRYLAADLGEREIRVNTISAGPMRTIAARSIPHFGKLYNKGAMNAAFGRNATSEEVGKLALFLLSDLSSGITGQTIYVDAGLSIMTVKETAED

SEQ ID NO: 645 - protein, 813 aa, Deinococcus radiodurans
MIWELPVVALRNIVILPGVTMNVDVGRPKSKRAVDEAQAADRRVLLLTQRDPRTDDPTRAELFDMGVLAVVKQVVRMPDNTYQVLVEAQERARVMDEVPSAYMRVRADTQSATEPQGEQARVIGVLASEVKSAFEDYQRQNKNLRLDNYQLEGLKALTDAGALADQVTHHATWTPEEKQEVLEAGDLQPRLEAVLKLLTRDTERFNMDKKIAGRVKEQMDANQREYYLREQMKAIGKELGGGEDSPAEVDALREKIEEAGMPESVKDKALKELQRLERTPGGSPESTVVRNYIDWLVDVPWSKRDEEILDIGRTRDILDSDHYALGDVKDRILEFLAVRQLTHKDGETEEQRRERSAEERTDDAELRAPILCLVGPPGVGKTSLGKSIARSLNRKFVRMALGGVRDESEIRGHRRTYIGAMPGRIIQGMKTAGVVNPVVLLDEIDKMSSDWRGDPSSAMLEVLDPEQNHTFQDHYLEVPYDLSQVMFITTANSLQTIPRPLLDRMEVIQIPGYTQQEKVEIAKRYRVPRQIKSHGLTGKLEITDAALNRIVEEYTAESGVRNLDRQISKLARKAARELLETPWEGLKVIDAPQIPDFLGVPLHRPEKMEKEPQVGVAQGLAWTSVGGTMLLVEALATPGTGKVVMTGSLGDVMKESVGAAIAYLRAHAAEYGADPDFHKTMDIHVHFPDGATPKDGPSAGITIATAVISAVTGRPVRLDVAMTGEISLRGRVLPIGGLKEKLLAAHQGGIREVIFPKDNEPSLQEVPESIRGDLKVHAVEHVSEVLELLLLPKPEQAEQTPPPALGKSVQPGA

SEQ ID NO: 646 - protein, 536 aa, Deinococcus radiodurans
MSDENNKGVGTAVQGVGGPRDGRTAPGEQGTTLTTRQGHPVHDNQNSRTVGSRGPMTLENYQFIEKLSHFDRERIPERVVHARGVGAHGVFRATGKVGDEPVSKYTRAKLFQEDGKETPVFVRFSTVGHGTHSPETLRDPRGFAVKFYTEDGNWDLVGNNLKIFFIRDALKFPDLIHSQKPSPTTNIQSQERIFDFFAGSPEATHMITLLYSPWGIPASYRFMQGSGVNTYKWVNDQGEGVLVKYHWEPVQGVRNLTQMQADEVQATNFNHATQDLHDAIERGDFPQWDLFVQIMEDGEHPELDFDPLDDTKIWPREQFPWRHVGQMTLNRNPENVFAETEQAAFGTGVLVDGLDFSDDKMLQGRTFSYSDTQRYRVGPNYLQLPINAPKKHVATNQRDGQMAYRVDTFEGQDQRVNYEPSLLSGPKEAPRRAPEHTPRVEGNLVRAAIERPNPFGQAGMQYRNFADWERDELVSNLSGALAGVDKRIQDKMLEYFTAADADYGQRVREGIQAKEAEMKGQKQEAPVYGTEASSLY

SEQ ID NO: 647 - protein, 338 aa, Deinococcus radiodurans
MRVAIVGATGAVGHELLKVLETSSLDFSELQLYASPRSAGSTLEFRGQPLTVQATPDGALPADLVLASAGGSISKEKAPRWVEGGAVVIDNSSAFRYDDDVPLVVPEVNGEAALGHKGIIANPNCTTAIAVVAVAPIHRKYGVKRMIVSTYQATSGAGQKGMDELLTETHKVLHGQDAGHHEFVHPIPFNVIPHIDVFQDNGYTKEEMKVVWETRKIMGDESLQISCTAVRIPTLRTHSEAITLELERPATPEAIRELLATAAGVEVRDDPSAKLYPMPLTASGKYDVEVGRIRQSLVFDGGIELFVAGDQLLKGAALNAVQIAEDLQRRGGLKVQRG

SEQ ID NO: 648 - protein, 552 aa, Deinococcus radiodurans
MTQAHPEWYKSAVFYELSVRTFQDGNGDGKGDFPGLTSRLDYLKNLGVDCLWLLPWFPSPLRDDGYDVADYRGIHPDLGTLDDFKVFLREAHARGLRVIGDLVTNHTSSDHPWFQAARRGPTLPDGSPNEYHDYYVWSDEGKEYADTRIIFTDTEVSNWTLDEQAGKYYWHRFFASQPDLNYDNPKVVEELHGAARFWLDLGLDGFRVDAVPYLIEREGTSCENLPETHEILKGFRAMVDREYPGRLLLAEANQWPEEVVEYFGTEAEPEFHMCFNFPVMPRLYMSLKREDTSSIREIMGRLPKIPSFGQWCTFLRNHDELTLEMVTDDERAFMYAAYAPDARMKINVGIRRRLAPLLDNDRRRIELLNTVLLALPGSPILYYGDEIGMGDDLGLPDRNGVRTPMQWNAGTSGGFSTAQPSDCFFPPIQDPVYGFGRVNVQSQLQDPSSLLKWTARQLELRRAHPAFAHGDLTFIETGNPAILAFTRQYDGETLLIVSNFAGNAQAGLLDLAPFVGRAPVTLSGASPLPVVTGNGQYPVVMGKYDYYWLRLN

SEQ ID NO: 649 - protein, 677 aa, Deinococcus radiodurans
MRHFAHSPLGHQAYAGLLPRQGNASAPHFPAVCFFRRLSLLSFSFPCVRFSLDSFRTLWPYLKMHQRQYLIGIVAVMISNAVVLLPAYFIRLTIDGLTRTLDNNPATPGITVTQAGYYALAMVASSLVSGSFMLLMRRMIVVASRQTEYEIRRDLFAHLQTLDKNYYDRARTGDLMNRLTGDLSAVREMLGFGAWQIVNIISGFVTSFAVMFGLSWQLTLIVVAVIPIIVGLLAYMARLINARHKAAQEQNSLIAAKAQENFSGARVVKGYAIEDREIEEYRAMNLELLRRNIALIKVDGPLRSFSNLLLGIAFGLILLVAGRLILRPDATFTVGMLTQFLLYIERLAWPMLMVGWITGVTQRGLASWNRLQELFDARPLVRDEPGRTEPQLWPTQGDLSFENVSLRYGHTQVLDHINLHIPAGTFLGITGPTGSGKTVLGQLITRSMDPTEGVIRIDGHDLRTVPLEHLRSAIAVVPQEPFLFSDTIANNIGFGLNNDELPPVPTRVSVVGLPLPPNIPQHPDPERVREAARLAGLADDVESFPEGYDTVLGERGVTLSGGQRQRTAIARAIVREPMILILDDSLSAVDTETERRIIQGLRQVAQGRTVILIAHRISTLRHADQIVVLEEGRITEQGTHDELLALGGHYAELDHLQRLASDLDEHGQQPAAQEVSA

SEQ ID NO: 650 - protein, 619 aa, Deinococcus radiodurans
MTQKASEYDKGFDVGLTRRIIGYLGPYKTLAAAGVLLALLTAALQPLPTLLQRYAIDHYLVPYTNGSNTDAAALYQGLTMVVLGYVALRVLEFVLTYLSTITVGYLGQNVLRDIRADVFGKLQRLHLRYFDQNPVGRLITRVTSDVDAINQFITGGLISMMTSTFLIIVFMTVMLTINWRLALIAFTVLPVLFYATNFFRGKLREAFRETRTQQAIVNSKLNENITGMLTVQLFGRERRSALDFDHSNRALLTSLENSVKWFSLFMPTVAVLGQVAIALVLYFAARQILGVDVVGTGTAAAISVGTLFAFVQWTQQLFQPIQDLADVFNNLQAATASSERIFGVLDTEEEITDKPDAKTLVNFRGQVDFDRVWFAYSEDVTAQTPDEDDRWILRDFDLHIQPGESVALVGATGAGKTSVTALVSRFYDVQRGAVRVDGTDVRDLQQHDLRRHVGVVLQDVFLFAGTIESNLTLDNPAIPHDRVVEACQYVGVHDYILSLENGYQTEVRERGATLSTGQKQLLAFARALIQNPDILLVLDEATANVDTETELRIQDALKKVMQGRTSIIIAHRLSTIEHCDRIIVMRRGRIVEQGTHAQLIAQGGYYAKLNALQYAGAAD

SEQ ID NO: 651 - protein, 444 aa, Deinococcus radiodurans
MTERKYFGTDGVRAVAGEFPLTPAWVMALGAAAGEVFKRRNPRASVVIGKDTRQSGDMLEAALAAGLTSRGVNVVHLGVLPTPGVSYLTRHLGAEAGVVISASHNPYEDNGIKFFGPGGGKLSDATELEIEAAIDEAATLAPVTGVNLGSVTNYTEAERLYTAFLSSHAPDLSGMRIALDCANGAAYRVAPKVFQQAGADVFAVYTTPDGRNINRGCGSTHMDHLRLIVREGDYDLGIAFDGDADRALFVDSRGNMIHGDHMLLLSARARGEKAVVATIMTNMALEVKLQEAGLTLERTAVGDRYVHERLHAKGLNLGGEQSGHVLFLDVSPTGDGVLTALLTLSSMKKLGTTLDALYDELVMFPQTLVNVRVKDKKAIASDPAVQHAVADAEKQLAGKGRINLRPSGTENLIRVMVEGQDEGEIHDIAAAVAKVVEERGAAGA

SEQ ID NO: 652 - protein, 190 aa, Deinococcus radiodurans
MRLARELLGGTLVRVTPDGHRLSGRVVEVEAYDCPRDPACTAGRFHAARSAEMAIAPGHWLFWFAHGHPLLQVACRQEGVSASVLIRALEPLEGAGKMLDYRPVTRQRDLTSGPAKLVYALGLDPMQISHRPVNSPELHLLAPETPLADDEVTVTARVGIREGRNLPWRFLIRGNGWVSPAQPSMELAAP

SEQ ID NO: 653 - protein, 360 aa, Deinococcus radiodurans
MRAMNAAPAPLLRSLVTGTPPYSALQSEVQAAARTLFPRMSERRHMLDVFTNAQIERRALSRPLAWYLEPHGFAEKNGVFLEEARALIVRLAREALDKAELAPADVDAVVVVNTSGLSTPSLDAYLIGALGLNPHAARLPVWGLGCAGGASGLARAADLVRAGFKRVLYVAVELCSLTLVKGDESKSNFVGTALFADGGAALVVTAPDVPGPRPLLALHGGFSTLIEDSEDIMGWDVVDDGLKVRFSRDIPTLVNSMMQENVAQALAAQGWARDDVQTFVVHPGGVKVVAAYEQALGLPDGTLDSSRAVLREYGNMSSATVLFVLEEVLRSRPQGRGLLSAMGPGFSAEHVLLDFGGGEA

SEQ ID NO: 654 - protein, 436 aa, Deinococcus radiodurans
MQVLQGAEARAALTRTFSQIPVPDAVLSRIEQTFGERLTPEQVVERILLDVRARGDDALRDWTERLDGPRPAELEVPAAELEAAQVAPELHAAIRLAAERVRAFYRQQPAHGFLEHGPDGALGQLVRPLGRVGVYVPGGLAPLISTLMHTAVPAQVAGVPDIVVTTPPGKDGQVHPAILVAARELGLSRVFKVGGAQAIAALAYGTASVPAVDKIAGPGNLFVVIAKRLVYGQTGIESLPGPTETLVVADDSASPRYVAADLLAQAEHNGAEPVLVSVSRELLLAVQAELNEQLENLPEPNRSWARDSVGARMKVVLADSLDEALDLANLYAPEHLCLLTRDPWSLLGQVRRAGGVFVGEASMEALGDYVAGPSHVMPTGGTARFMSPVNVRDFQNIISVVGVNEETLRRIGPAAATLARAEGLEAHARAVESRLK

SEQ ID NO: 655 - protein, 334 aa, Deinococcus radiodurans
MLSPMTPLPTQRPRRLRRTPGLRALTRETRLSPEQFIFPMFVHEGQSDSEISTMPGVLRHSIPSAVEKARETQGLDIPAVILFGIPDVKDEVGTQAYADEGVVQRATRAIKEALPDLVVIADTCLCEYTSHGHCGHLHEVSGQWTVDNDPTLELLAQTAVSQARAGADIIAPSAMMDGQVAAIRAALDGAGFAHIPVMSYAVKYASAYYGPFREAAGSAPSKGDRASYQMDPAGGYREALREARLDVEQGADYLMVKPTLAYLDVMRTVRDAFDLPMIAYNVSGEYSLIKAAAQLGYIDERRTVLETLTGMVRAGADAIITYHALDAARWLRES

SEQ ID NO: 656 - protein, 184 aa, Deinococcus radiodurans
MIPMKLVVSGPVGAGKTTFVQTLSETPVVSTEADASEDIGKATTTVAFDFGTLILDGTELHLYGTPGQDRFDFMWDVLCEGALGLVLLVAGNRPQDFLHARHILEFITSRNPVPFVVGVTRQDLEDVWSPQDIASYFDLPTEQVIGLQATEPDSARQVLIHLLESQLTPETQSESGTQTEKETA

SEQ ID NO: 657 - protein, 418 aa, Deinococcus radiodurans
MTNTPSSPNDASWSYDTAAVQSGIPRGLGETIGFPIHAAAAFQFDTLEQAQDEFQYNGGLSYARIQNPTVRALEERLTVLEGGAATVALASGQAASLTAILSVCRAGDHVVSSASLFGGSTGMLTNILPLMGITATLVEGHPEQIRAAMQDNTRLVWAEMISNPSGAVADVEALAGVAHERGALLAIDNTCGGVGYLCRPLDHGADIVSQSLTKWAGGHGSVMGGSVTVGTQHDLSRNPIYAGGENSLLEQRGADALAWRQRWFGAHQLGMTLAPHSAFLIAQGLETLGLRLQRESDSALALARWLGQHPRVGGVSYAGLPGHPSFPLVQKYLPRGAGAVLTFEVDDPSRFLSRLRVLRMAPNLGDVRTLVVHPWTTTHGRVPEAARHAAGVTPGTIRMSVGVEDVMDLQADIEQALN

SEQ ID NO: 658 - protein, 431 aa, Deinococcus radiodurans
MGERKCGGWPPKVFLHSLSPGGAGGSTKAVVWHGIGDIRLDDVPEPKIEAPTDAIVRLTASAICGTDLHFIRGTMSDMVPGTILGHEGVGIVEAVGPEVRNFVPGDRVVIPSSASCGYCPPCREGNTSQCDNANPNGPSAGTAFYGGPKSSGPLNGMQAEKVRVVYANSSLVKLPDNVSDDQAIMISDIFPTAYFGAEIAGVKTGSVVVVLGCGPVGQFSIISAKLLGATRVIAVDRLDDRLDMARKNGAEVINFEKEDPVEAVKKLTGGLLADCVIDAVGVDAQHAHAGPAKPDAEKEQKFEQEVQEVAPDAKPEKDGQWTPGDAPSQASEWAIEMTKKAGQIGIIGVYSPQMTTYPIGKAMNKNLTIRMGNCNHRAIIPGLVDLVAAGVVDPARVLTEHEHLGSAIEAFEAFDKRQPGWIKVELEPQAG

SEQ ID NO: 659 - protein, 424 aa, Deinococcus radiodurans
MESGRFITPTQGKETSRLPGMTTTTDVPASGVSLSERLRQDLAGLRESGLLISPRVLDAPQRARTRVDGREVVNLASNNYLGFADHPRLKERAAQYLQQWGVGAGAVRTIAGTLRIHEDFERQLADFKHTGSALVLHSGFSTNQGVLGGLLREGDLVVSDELNHASIIDGLRLTKATKKIYKHADPADLDRVLRENPSEGLKLVVTDGVFSMDGDVAPLDKLVEVARRYGAVTYVDDAHGSGVMGEAGRGTVHHFGFEYADDVIQVGTLSKAWGGVGGYAAGHPDLRELLINRARPYLFSTAQPPAVVGALAAALDEVQRDPSLMERLWDNTRFFKAELGRLGFDTLGSVTPITPVVFGEASAAFEASRRLFDLGIFAVGLGFPTVPRDLARIRNIVTAEHTRDDLEQALSAYQQVGRDLGVIA

SEQ ID NO: 660 - protein, 309 aa, Deinococcus radiodurans
MRTVTVGTRGSTLALAQTRWVVARLKEEWPETDFRIQTISTKGDRNRESLEQLAQKGDKGFWVKEIEEALLAKKIDIAVHSLKDLPTEQPEGLEISSIPKRVDGRDALIGREGMKKLAELPEGARIGTSSVRRKAFLRAYRPDLIVKDLRGNIDTRLAALGSGEYDAIILAAAGLIRTEQRHRIDEFVDPDILLPAPGQGALALETRTEDDLTIEVAYAIHDHATDDRITAEREFLAGLGAGCMAPVGAHAVIKNGLLTLEGWVGALDGTQVIRATSQGDVAECADIGAELAADMLERGAAELIEAVRE

SEQ ID NO: 661 - protein, 339 aa, Deinococcus radiodurans
MQDTAIQEIQGAETLEALQAVKTKYVGKSGLVTKELGSLGKLPPEERKACGAEINVVRAAIQAALDEKESALKRAALDAKLASEAIDVTLPGLPLPAGGLHPISRVLDDLIGIYRQMGYAVIEGPEVEEEHYNFEALNVPWYHPARDLQDTFWLEDGRLLRTHTSPMQIRYMVDHEPPFKIVVRGKVYRYEATDATHEAMFHQLEGLVVGDGISMSDLKGTIAEMARGLYGASAKARFQPSYYPFVEPGADFAVYWENPRGESKWLELGGCGMVHPNVFKAVDDLREAAGKDRVYEGKTGFAFGLGLERIAMLKYGIPDIRYFYANDPRVIGQFRGELG

SEQ ID NO: 662 - protein, 612 aa, Deinococcus radiodurans
MPSYKAPTRDMKFVMQELLGAGDQLAAMPFYRDNETADFDLLSQVLDEAARFVETEIQPLNQVGDQEGCKRDEQGNVTTPAGFKAAYKKFCDAGWTALDADPEYGGQGMPHTVSIAMNEMICSANVAWGMYPGLSHGAYAALHAVGSDELKKLYLPHIVDGSWTGTMGLTEPHAGTDLGIIRTKASDNGDGTYSVTGTKIFISAGEHDMSENIVHLVLARLEGSPKGTKGISLFLVPKFIPNADGSLGERNGVVCGSLEHKMGIHGNATAVLNFDGAKGWLVGEVNKGMNHMFIMMNAARLGTGMQGLGLGEVAYQNALAYAKDRIQMRHEPRVSSEEADPILVHPDVRRMLLTGKAYSEAGRALALWLALNLDIESHHADEAQRKEAGDMVALLTPIAKAFMTDNGFNVAVQSQQVFGGHGYIQEWGMEQFVRDARIGQIYEGTNGIQALDLLGRKVLMDGGKKLQKLAGTLQAFAEENEGDENIGDYVNQLGKAAQQLGSITMVIGQKAMTGPEGADEVNAAAVDYLRFFGHVVYGYLWARMAKIAHDQIDAGNDKDGFYLAKTQTAKFYFTKLFPETKALAATIKAGNEALAVDDKAVFGWEHAELVNA

SEQ ID NO: 663 - protein, 304 aa, Deinococcus radiodurans
MKVGVVGTGFVGSTAAFALVLRGSCSELVLVDRDEDRAQAEAEDIAHAAPVSHGTRVWHGGHSELADAQVVILTAGANQKPGESRLDLLEKNADIFRELVPQITRAAPDAVLLVTSNPVDLLTDLATQLAPGQPVIGSGTVLDSARFRHLMAQHAGVDGTHAHGYVLGEHGDSEVLAWSSAMVAGMPVADFMQAQNLPWNEQVRAKIDEGTRNAAASIIEGKRATYYGIGAALARITEAVLRDRRAVLTVSAPTPEYGVSLSLPRVVGRQGVLSTLHPKLTGDEQQKLEQSAGVLRGFKQQLGL

SEQ ID NO: 664 - protein, 467 aa, Deinococcus radiodurans
MTNNFDYDVLVIGAGPGGYHAAIRASQLGLKTACVERGAVGGVCLNIGCIPTKALLHAAETMQASKHAAEFGLTFSGQALDIARLNGWKDSIVKKLTGGVSGLFKANKVTLLTGQASFVDDHTVQVGDKTYTAANIIIATGSDPAKLPGLEVDQQQIVDSTGALVMPDPVPARMLCVGGGVIGFEFAQVYNNLGSQVKIIEFLPSVIPGADADAVKEFSKIMSRQGIEIVTQMKANRAEKKSDGVHVELENVKTGEKTTEVFDRVLVAVGRRPRTDGLNPEQAGVTVTERGFIPADKQQRTNVPHIFSIGDVAGNPMLAHKAMKEGLVAAEVIAGKPAEQDAVAIPGVVYTNPELAWVGLTEAEAQEKGYEVKTGVFPMSASGRAMTLQATEGFVKMVVEKDTDLLLGVHIVAPHASDMLAEAGLALEMAATATDISLTIHAHPTLGESILEAAEASHKQAIHIVNR

SEQ ID NO: 665 - protein, 1418 aa, Deinococcus radiodurans
MPVSQHGGKVGHRSTSSCLTRDHQRTPCCPFRRRDGFPCCAGALAASPSSPSPPPSARSSMTTAPDRSAPARTDKTTQHFDENAQHIAKRQYLQGNDGDISGMFWRIADWVAGAEAPEARQGWAQQYYDLMAEKKFCPGGRVLAGAGTQHGNVLNCFVQGATEHDPSSFEGVMEVAKKLALVTKVGGGNGVNLDVYRPRAQSSRSDNGVRGWVYMSAEHADVQDFIEGLMRPPTQPDGEKQPVSVRNWTRVVYGQAISPELVASARANGVQIVRTLPEGVTAVADDMGGIIDAARQVAEIAKLNIEPRIDLSAMRPEGAPIKGSGGTSSGPVSFLMEIFDNFIEWANRGAEDSGPINTLRYVYAPVLRVVRQGGTRRGAGMATISIGHPDVLDFLTAKDLDREAAEGDISTFNISILVDTKFWDTLQADGVWTIDAQDVPGKYFPVPQEGEYAGTFPELPTRAEDGAKGVPVYGSGIPARWLWDQIAQHAWSTGEPGLIFNDRVNEYSALKNLGERYEIRSTNPCVTADTWVSTAFGARQVQDLIGKDFCATVNGESFSARGGFWLTGVKSVLKVTTRRGYELRLTGNHQLLKVTHQTRKVQQTAWVETATLAAGDRIMLNDHRTVKPWAGAGNFSEGWLLGSLIGDGTFLTDKARPMAALGFWGEERQAQADSAQARLSKLGAVKKLWRSNDEQRQRVRLSSEALAELGAKYGVVHGHKTLTDKVEQGGYEFYRGVLQGLFDADGSVQGTQSKGVSVRLAQSDLSLLKRAQRMLSRLGIMSSLYAERRLAGTSTLPDGKGGSAEYPTQAQHELIISGSNLAVFAERVGFSEAGKAARLAEKLAGYARNLNRERFSDEIVSIVPDGEEAVYDVTVEQVHAFDANGVLAHNCGEIPLTVGEPCDLGAINLAAYVRGSDFDFAAFRADVRTCVRFLDDVLDVNVFALEDNRVASQDLRRLGLGVMGLADALIKMGLRYDNESGRQAIYDIMSALREEAVAESERLGQERGFYPVYERNREQVPHDPRRNVAVLTVAPTGTTSMLMGVSSGIEPVFSPFIWRKIGSEYRALLAPLFVELLESYPAPKGMEKDGGWDWDKVTEAVSENHGSVVGLSFIPDALQQVFVCAHDISPVDHVRMQGTVQRAFDDGGQLAANSLSKTINLPNSASVDDVKSAYEEAYRTGCKGITVYRDGSRQFQVLSTSKKKAKTEERGSAEPLADSKPAEAPAVTAPVSAPAAAAQPQPHYERPGRLHGITDMVKLTDPTSGHRRSFLVTVNHLNGNPVEVMVISGRAGDEANADSEALGRVVSIALQHGVPASALIHTLRGINGGLYGSYNGRLVGSKADLIAVALDTFQKDMAAAPLPPLAGGSGEVAPSAPASTGVSVDGLGQERCPVCEEKAVIREEGCLKCQACGYSKCG

SEQ ID NO: 666 - protein, 588 aa, Deinococcus radiodurans
METSTLQPKSEFFAALRHFAGYYRPYRLTLYADLLCALLVAGITLVYPLCAGYITRTVLTLTPQQAWPELLRVGGLMVGLLAVQVAANSFLDYQGHMMGTFIERDMRRDLFAHLQKLPFGFYDTHRTGQLMSRVTGDLYDIGELAHHGPEDLFIALVSFVGVFVILAGLNLPLTLILLAFLPFMAAYALYFNVQLNRALLQSRQRIGEVNAQVEDSLAGIRVVQSFTGEGTEARRFGAANDLFVEGRRGEYRAELYFYQGMTAFTGLMTIAVLMFGGWAILQGGLRIDGLVTYLMCVGILLEPIRRLVNLARVLQEGVTGFQRFREMMAVTPDIVDAPGAAELQNVRGEVEFQGVSFGYSPDAPPVLRDLNLKIRAGEFVALVGASGVGKSTLCALIPRFYDVSAGQVLVDGHDVCGVTLASLRRSVGVVQQDVYLFSGTVMENIRYGRPGATEAEAMDAARQAGAHDFITRLPQGYHTDIGQRGVKLSGGQKQRLSIARVFLKDPPILIFDEATSSLDNESERLVQESLERLARRRTTLVIAHRLSTVRNAHRIVVLTENGVAEEGSHAELLALGGEYARLQALGRL

SEQ ID NO: 667 - protein, 249 aa, Deinococcus radiodurans
MIVKYGGNAMKSLDLRRAVARELGTLRGAMPLVVVHGGGPVIERELAARGVASEFIGGLRVTTPEAMDVVEMALCQLNKQLSQDIGQAVGLMGRDDELLRAEVLDPQLGRVGRVTGVNAGLLRTLLGAGLTPVVGCVAVGEDGEALNVNADTVAGAVAGALGEGAVFLTDVDGVYRAYPDPDSRAAQLTRAEVEDGLAAGWIAGGMIPKVRAALDALGRGAPFAIIASGMTAGVLAQAARGEAGTRIVP

SEQ ID NO: 668 - protein, 847 aa, Deinococcus radiodurans
MKTLDLDISGMTCAACVGRVERGLRKVEGVQEAHVNLATERASVTYDPALTNAAALVQKVVDTGYDAPTAELSFPVAGMTCAACVGRVERALNKTDGVLDASVNLATERASVRYLPASVSPAELKSAVVNAGYDVPEEQTQAASRLELERARKAEELAGLRRSLTFSAVFSVPLLLLSMVPMLYPLLHHWLLGTLGERAMNVLMLLLAAPVQFGPGLRFYRTGWAALRHRSPDMNTLVMLGTSAAFFYSLAVTLWPQLFPAGSRHVYFEASAVVITLILLGKYFEALAKGRSSEAMRTLLQLQPQSARVQRGTEVVEVPVDGVRVGDTVLVRSGERLPVDGEVLSGESYVDESMLTGESVPVHKAAGAKVTGGTVNGTGSLTFRATGVGADTALARIIRLVEDAQASRPPIQGLADRVVAQFVPLVLAIALVTFLAWLYVGGPSALSNALIHTVAVLIIACPCAMGLATPVSIMVGSGRAAQLGVLFRSGAALEGLGEAQTVALDKTGTVTRGVMEVTDVVVDGRWVMGDGELLRLAAIAEGPSEHPLARAIERAATLSPSPLAGEGLAQPGVRGRVTNEPAPSPTLPQPSSFQALPGYGLRAEVDGRRVEIGAARFMAQLGLPLGELGAKADELAARARTPVFAAVDGQLAGLLGVADPIREGSAEAIRTLTAQGLDVAMVTGDARATAEAVAREAGVNRVLAEVLPEGKAQAVAELQQCGQRVAFVGDGINDAPALAGADVGVAIGTGTDVAVETADVILLGGDLRSVPNAVALSRAVIRNIKLNLFWAFAYNVLLIPVAAGVLAPWGLGLSPVLAAAAMGLSSVFVMSNALRLRGFTPPLSVKG

SEQ ID NO: 669 - protein, 361 aa, Deinococcus radiodurans
MTQTPPPAPGPSGVRQAVRDIPAYPFTPIDVPYKLDQNENPYDFPPELKQKAAERMLAHPWNRYPDLHADTLRAAIAGYEGWDAAGVVITPGSNVLIKILTELGGIGQTVLTTDPTFSVYTLEAAMLGAELVLTPLNPDFSLPVEATLQALAAHAPGVFYVTQPHAPTGHSDRPEDVRRVVEVADRLGWVTVIDEAYSQYAGTDYRELVRAGKHVLSLRTFSKAWGLAGVRAGYLLTNPELAGHLQKLVSAFTINFLTQAVIETALEHPEYMRERVAEAIAERGRIYAAVQGHPTCTIFPSNTNFFLLKTPDADAAYRHLLEHGIVCRRQDKLRGLDGCLRIAVGTPAENDALIAAILALR

SEQ ID NO: 670 - protein, 649 aa, Deinococcus radiodurans [sequence omitted]

SEQ ID NO: 671 - protein, 399 aa, Deinococcus radiodurans
MRDAVIVSAVRTPVGRGVKGTLANTRPDDLAALVMNEAIKRAGVDAGVVEDVYLGCAIPEAEQGLNVARLAALRAGLPDSVGGVTVNRFCSSGLQTIAMAAAAIQTGQADVMLAGGVESMSMLPMSGHNPSPNPDLVDDRPGAYIGMGMTAENVAAKYGVSREDQDKFAYASHQKAAAAQDAGKFDAEIVPVPVRKDSVKGTKLKSDTVMFDKDELIRRDANLEDMAKVRPAFKLGGSVSAANSSPFSDGAAAVLLMSGEKAQELGVKPLAKFIGFAVAGVAPEVMGIGPVAAVPKVLKQTGLTLDDIDLIELNEAFAAQSLAVVRELGIDESKLNVNGGAIALGHPLGCSGAKLTTTAIYELGRRGGGKALITMCIGGGMGAAGIIEVYPAETAQAAD

SEQ ID NO: 672 - protein, 191 aa, Deinococcus radiodurans
MAHLGHGTAGRFAEREHERRLACTPGCGGYWVGGYRAGGQRFVSQSTAILTSGMERTFAMIKPDGVRRGLTPEILARIHNKGYRVVGLKQMMMPRETAEQHYGEHRERPFFGELVDFITGGPVVAIALEGENAIAGWRAMMGATNPANAAPGTIRADFATSTGENVTHGSDSPESAERELALFFGDGELLS

SEQ ID NO: 673 - protein, 585 aa, Deinococcus radiodurans
MALTAASISESLCSRCLHVSGPGGFPMRSNMMPVPLTIPFILERARTGFAEREIVSLLPAGKDAQGQPIAQTHRTTYGEVADRALRLGAGLQALGLQPGDRVATLAVNSFRHLEAYLGVPSAGFVLHTVNIRLHPEQVAWILNHAEDRVLLIENVFAAMIPAIRAACPKLEHVFVLGGLPQPIPGVADYDQWVMSQEPLTHYPQLDENDAAAMCYTSGTTGNPKGVLYSHRSTVLHSLASAPKDALNVGEADSVLPIVPMFHVNAWGLPYTCAMYGAKQVFSGVFTDGKSIAQLMQDEGVTSTAGVPTIWMGLLSELDRAKQAGEPYDLSGLERLIVGGSAAPESLIRAFEERHNLRLLHAWGMTETHPLGTASTLPLNMDPRSDEGYALRAKQGRPVPLVELEIVDDDSNVLPHDGAAMGRLLCRGPWIADSYFKGEGASSFLTLDGNLWFDTGDIATLDERGYMHIQDRSKDLIKSGGEWIGSVELENAIMAHPAVAQCAVIAMDDPKWDERPLAVVVLRPGQAATHEELTEFIAPKFAKWWLPDATVFTDALPIGATGKFLKRELREEYRGYRQQNFPQRQD

SEQ ID NO: 674 - protein, 308 aa, Deinococcus radiodurans
MTQPNSWTIPHLPVAGYAWEVADPAGAVLLTHALAEYAQRYQDRYHCLIPALNAAGYSVYSYDLRGHGASPGEVSMVDAFVQVDDHLAARAALRERCPDLPLYLFAHSAGALFTAGSVMADPQGISGVILSSPMLQAGQDQIALVRHLLPLASKLAPGLAIVPINKAGLSRLPEEVAAYQADERIYQGQVTLLTASTMMQLSQQLWPTYSNWALPTLVFYGTGDQVSYMDGLPDFVAQLHTPDKALKVFKGGYHELLNDCDREEVLALILDWLWERRPVKDPGNEQMQHNLGRLARLRQRRQGIRGSA

SEQ ID NO: 675 - protein, 463 aa, Deinococcus radiodurans
MVHMNGRVGLGPPATRRGEVMPKIFRSLYVQVIIAIVLGILVGALFPKFGEALKPLGDIFVKLIKMVIAPIIFATVVSGVAHMRDTRKVGRVGGKALIYFEVVSTLALIIGMVVMNVLRPGAGMNVDPATLDTAGLTKYTEAAGEMTVWDHILKIIPDTLVSAFTGGELLPVLLVALLFGFALMRLGKLGDQILYGIDALNQVVFVILGFIMRLAPIGAFGAMAFTVGKYGLKSLTSLGYLMGSFYLTCLLFIFVVLGLIARAAGFSIFKLIRYIREELLIVLGTSSSESALPRLMMKLEHAGAEKSVVGLVVPTGYSFNLDGTSIYLTMAALFIAQATNTPLGLGEQLSLLAVLLLTSKGAAGVTGSGFITLAATLGAVGHVPVAGMALILGIDRFMSEARALTNFIGNAVATLVVARSENAVDMNRLTRALNGEDLPTTEPDVASEERGEGREIDSSRPVT

SEQ ID NO: 676 - protein, 480 aa, Deinococcus radiodurans
MPLWRGGTLRSDMDTFDVLVIGGGPAGYVAAIRAAQLGFKTACVDAFERGGKPSLGGTCLNVGCIPSKALLDSSERFEMISHDTAEHGIQVAQPQIDVSKMLARKDGVVDKLTGGVAFLFRKNKVTSFHGYGKLVRQDGQEWVVDAAGTEVKAKNVIVATGSNPRALPGVPFGGHIVENSGALQIDQVPGKLGVIGAGVIGLELGSVWRRLGAQVTILEAMPGFLMAADDAIAKEALKQFQKQGLDFHFGVKIGEIKQDDSGVTVTYEENGSQVTAQFDKLIVSIGRVPNTGGLNADGVGLALDERGFVKVDQHYRTNLPGVYAIGDVIGGAMLAHKAEEEGVALAEMIAGQAGHVNYDVIPWIIYTSPEIAWAGLTEKQAKERGLNVKTGQFPFSANGRALGHGDPRGFVKVVADAQTDKLLGVHMIGGGVSELIGEIVAIMEFGGSAEDLARTIHAHPTLSEVVKEAALAVDKRAIHM

SEQ ID NO: 677 - protein, 283 aa, Deinococcus radiodurans
MTPPSPLKSAAWLLAQRPGAVRVLDCRYALSDPLLGRLAYLEGHIPGAVYADLETDLSGPVQPGGEGGRHPLPDPPVLADWLGAAGIGNGDVVVCYDDPGGGQGFYAARAWWLLRWLGHREVYVLDGGWPAYLAAGGEASTEEPHPVPTTFTPDVQPELVATAQDVQNREDGVLLIDSRAPERYRGDSEPLDKKAGHIPGAVNRPFSAALDEQGQFRAGAEQAGRLAAGDAPTIIYCGSGVSATPNLLARELAGVPLGPNNRLYAGSWSDWVSDEGRPVATGE

SEQ ID NO: 678 - protein, 350 aa, Deinococcus radiodurans
MPQPAPLDFVVVGLNHQTAPVEVRERVAVRPEEEGALLGHLARHADEVLLLATCNRTEVYLAGVHGDPLAAFEGAWGHALLDHLYVYRGEAAVRHLYRVTAGLDSLVIGETQIQGQVKRAWQSARERGLSGTLMNKVVQGALAAGKRVRSHTGLSDKVVSVSSAAVELAQAALGELSQRRALILGAGETAELTLTHLRAAGVQDVLVVNRTAERARALAEKLGGRACPAEELSAALPEVDVVIASSAAPHYVVTAQNVREALAGRPGRAMFLIDISVPRILDPEIASVPGAHLYNLDDLTAVVQRNMQSRRAALPQAEAIIRELGSDLSRWYLTRETQLARQAELALACD

SEQ ID NO: 679 - protein, 578 aa, Deinococcus radiodurans
MPKSPPVSRYYDVKRDEQGQRYIEVKVTGLALLQNPLLNKTTGFTPEERRELGLEGLIPPHISSFEEQKHRTYLRYLEAPTDLARHEYLRALQDRNEVLYYAILEDHLEEMLPIIYTPTVGEAVKLYSNNYRYPRGFTVSTNDIERVEEMLDNVTVNDVRMIVATDSSAILGIGDQGFGGMAISIGKLSLYTAAGGVGPDKTLPVELDVGTNRQDLIDDPLYLGVHHRRWQGQQYDEFVDAFVEAVSARYPKAIIQWEDFSRGTAFRVLERYRKVVPSFNDDIQGTGAMALAGLLRASRMKGEFLTEQVFVVVGAGAAGIGVASAIRQGLEAEGLAPEEAGRRVYVVDRYGLLMEGQPDLEPQQMPFVRRRGDLEGWTFGGEYPTLHEVLVHARATALLGFTGVPGLFRQEDIEAMLAHTPRPIVFPLSNPSSHVEARPSDIVAWTRGGAIVATGSPFPDVPYDNERIPVGQGNNAFIFPGLGFGAVVSRAREITDNMVMAAALTLAEYTTQHHPHLVYPPISELRELSIHVAVRVAEQAIQDGVCAERRVRNMDREQLAALIRERAWLPRPLPLRRE

SEQ ID NO: 680 - protein, 336 aa, Deinococcus radiodurans
MARRRLPSMTHGNSSQSDRPRIISPLAPRADAAEVVRGVDLKGKTAVVTGGASGLGTETARALLLAGAHVILPVRDRAKGERVAAELRQSTGGTVELVDLDLGSLASVRRGAAEIRQLAPRIHILINNAGVMATPQSRTVDGFETQFGTNHLGHFLLTRELLPALMAAAPARVVALTSSGHRRSDIVWDDLNFERRPYDPWDAYGQSKTANALFAVGLTQRYADQGLTANAVHPGGIMTGLQKFVPLEDQRRMGWQDEHGTLNPVFKTPAEGASTSVWAATSPQLYGVGGLFLEDLQHSTPLDESAPNPLFGYKPYALDHESARRLWALSEALVGE

SEQ ID NO: 681 - protein, 238 aa, Deinococcus radiodurans
MTPPAAPLTRSPYTAAMTPAATIPEGLRAVVFDFDGTILDTETREFHHWQELYREHGRELALSDWQRGVGTWDAFDPWAGLPEQVQADRENVRARLHDTIVSDIAGQDLRPGVRAVLEGVKAAGLRLALATSSDREWVTRWMRQHNLLDLFEAVATRDDVRRVKPDPELYLLAAARLGLRPEECLAVEDSFNGATAAVAAGMRLVVVPNDVTRTQPFPAEWRRLEDGYAGGLAGLLGE

SEQ ID NO: 682 - protein, 328 aa, Deinococcus radiodurans
MTQGSALPVLGAGGWGTALAVAAARAGQPARLWARRPDFAARLAEVRENREYLPGVLLPPEVAVTSDLPGAVAGADFALLVVPSVGVPELLAGLPRELGVVLCAKGLAPDGSRLSEYAAGLGFDRVAVLSGPNHAEEIGRGLPAATVVASRDPALAAAVQTALMSPSLRVYTSRDVPGVELGGVLKNVIAVAAGMGDGLHLGDNAKATLLTRGLREMNRYLRSLGAEEETVYGLSGLGDLIATATSPHSRNRAAGEAIARGESPQQGGKVVEGLRTAGLLDAWAAAHGHDLPIVRAVAQVTRGEWSPAEGVRHLMGREAKGETEAGEP

SEQ ID NO: 683 - protein, 464 aa, Deinococcus radiodurans
MTKTRQETDTMGKMDVDASRYWGAQTERSIHNFPIGRDTFVWGRPVIRALGILKKGAAQANAELGELPADVADLIVKAADEVIAGKLDEHFPLVVFQTGSGTQSNMNANEVISNRAIELAGGEMGSKKPVHPNDHVNRGQSSNDTFPTAMHIAVVLELNERLYGAVGKLRDTLHAKAEQYKDLVKVGRTHLQDATPITLGQEIGGWVAQLDYALSEVKHAGEGLLDLAIGGTAVGTGLNAHPKFGDLAAKKYEEETGYHFRSAENKFAALSAHDALVQTSAALRTLAGALMKMANDVRWLASGPRNGIGEITIPENEPGSSIMPGKVNPTQSEAMTMVATRVFGNDATVAFAGSQGNFQLNVFKPVMVHAVLESIRLISDACLAFNDHCAVGIQPNEAKIKENLDKNLMQVTALNRHIGYDKAAAIAKKAHKEGTSLKDAALALGYVTEDEFAQWVVPLGMTHN

SEQ ID NO: 684 - protein, 180 aa, Deinococcus radiodurans
MSSQAALCGTVPSRQDIVAIAAQTENRVIGRDGGMPWHLPADFAHFRALSVGKPNIMGRKVFDTLRRKPLPERVNIVLTRNENLKFDGCLIAHSPEEALQLAGDAPEIAIIGGEEIYRLYWDRLTRLEMTLIHAELDGDTFFPEIGPEWELAQETFRPADEKNRYDLTFQTWRRRGSGQP

SEQ ID NO: 685 - protein, 482 aa, Deinococcus radiodurans
MKHFDRATKIVATVGPASRSTEVLGRMIDVGLNVVRLNFSHGDLEDHRQTVQMVRDLAVSKGVTIGILQDLQGPKIRVGRFAEGSVTLNPGQKFVITMDEVEGNAERVGSTYKGLAGDVTPGMTLLLDDGNMSLRVDHVRGNDIQTTVLIGGTLKNNKGINVPEADLTVPALSEKDVQDMEFGASLGVDWVALSFVRSRDDLLLARHYLARFGSRAKLMAKIEKPQAVDRFADILKEVDGVMVARGDLGVEMRPEQVPTIQKRIIRMCREAGKPVITATQMLESMINLPRPTRAEASDVANAIYDGTDAVMLSAESAAGQYPVESVAMMDRIAREAEASELYQLMQRQVVMDTEQAQDAIALAACNIGAKLEAPAIVTFTSTGGAATRISKNRPPLAIVALTPNEITRNQLALSWGVYPMLSEDPEDTDDMVRIANDELKKSGLADVGDRYVITAGVPFGVRGTTNMLRVEKLKAEDLSDRV

SEQ ID NO: 686 - protein, 820 aa, Escherichia coli
MRVLKFGGTSVANAERFLRVADILESNARQGQVATVLSAPAKITNHLVAMIEKTISGQDALPNISDAERIFAELLTGLAAAQPGFPLAQLKTFVDQEFAQIKHVLHGISLLGQCPDSINAALICRGEKMSIAIMAGVLEARGHNVTVIDPVEKLLAVGHYLESTVDIAESTRRIAASRIPADHMVLMAGFTAGNEKGELVVLGRNGSDYSAAVLAACLRADCCEIWTDVDGVYTCDPRQVPDARLLKSMSYQEAMELSYFGAKVLHPRTITPIAQFQIPCLIKNTGNPQAPGTLIGASRDEDELPVKGISNLNNMAMFSVSGPGMKGMVGMAARVFAAMSRARISVVLITQSSSEYSISFCVPQSDCVRAERAMQEEFYLELKEGLLEPLAVTERLAIISVVGDGMRTLRGISAKFFAALARANINIVAIAQGSSERSISVVVNNDDATTGVRVTHQMLFNTDQVIEVFVIGVGGVGGALLEQLKRQQSWLKNKHIDLRVCGVANSKALLTNVHGLNLENWQEELAQAKEPFNLGRLIRLVKEYHLLNPVIVDCTSSQAVADQYADFLREGFHVVTPNKKANTSSMDYYHQLRYAAEKSRRKFLYDTNVGAGLPVIENLQNLLNAGDELMKFSGILSGSLSYIFGKLDEGMSFSEATTLAREMGYTEPDPRDDLSGMDVARKLLILARETGRELELADIEIEPVLPAEFNAEGDVAAFMANLSQLDDLFAARVAKARDEGKVLRYVGNIDEDGVCRVKIAEVDGNDPLFKVKNGENALAFYSHYYQPLPLVLRGYGAGNDVTAAGVFADLLRTLSWKLGV

SEQ ID NO: 687 - protein, 317 aa, Escherichia coli
MTDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 688 - protein, 638 aa, Escherichia coli
MGKIIGIDLGTTNSCVAIMDGTTPRVLENAEGDRTTPSIIAYTQDGETLVGQPAKRQAVTNPQNTLFAIKRLIGRRFQDEEVQRDVSIMPFKIIAADNGDAWVEVKGQKMAPPQISAEVLKKMKKTAEDYLGEPVTEAVITVPAYFNDAQRQATKDAGRIAGLEVKRIINEPTAAALAYGLDKGTGNRTIAVYDLGGGTFDISIIEIDEVDGEKTFEVLATNGDTHLGGEDFDSRLINYLVEEFKKDQGIDLRNDPLAMQRLKEAAEKAKIELSSAQQTDVNLPYITADATGPKHMNIKVTRAKLESLVEDLVNRSIEPLKVALQDAGLSVSDIDDVILVGGQTRMPMVQKKVAEFFGKEPRKDVNPDEAVAIGAAVQGGVLTGDVKDVLLLDVTPLSLGIETMGGVMTTLIAKNTTIPTKHSQVFSTAEDNQSAVTIHVLQGERKRAADNKSLGQFNLDGINPAPRGMPQIEVTFDIDADGILHVSAKDKNSGKEQKITIKASSGLNEDEIQKMVRDAEANAEADRKFEELVQTRNQGDHLLHSTRKQVEEAGDKLPADDKTAIESALTALETALKGEDKAAIEAKMQELAQVSQKLMEIAQQQHAQQQTAGADASANNAKDDDVVDAEFEEVKDKK

SEQ ID NO: 689 - protein, 376 aa, Escherichia coli
MAKQDYYEILGVSKTAEEREIRKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETPVGLNERQKQLLQELQESFGGPTGEHNSPRSKSFFDGVKKFFDDLTR

SEQ ID NO: 690 - protein, 273 aa, Escherichia coli
MHDANIRVAIAGAGGRMGRQLIQAALALEGVQLGAALEREGSSLLGSDAGELAGAGKTGVTVQSSLDAVKDDFDVFIDFTRPEGTLNHLAFCRQHGKGMVIGTTGFDEAGKQAIRDAAADIAIVFAANFSVGVNVMLKLLEKAAKVMGDYTDIEIIEAHHRHKVDAPSGTALAMGEAIAHALDKDLKDCAVYSREGHTGERVPGTIGFATVRAGDIVGEHTAMFADIGERLEITHKASSRMTFANGAVRSALWLSGKESGLFDMRDVLDLNNL

SEQ ID NO: 691 - protein, 382 aa, Escherichia coli
MIKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEAYSWTQGSWTLTGGLPEAKKEDELPFHVVAYDFGAKRNILRMLVDRGCRLTIVPAQTSAEDVLKMNPDGIFLSNGPGDPAPCDYAITAIQKFLETDIPVFGICLGHQLLALASGAKTVKMKFGHHGGNHPVKDVEKNVVMITAQNHGFAVDEATLPANLRVTHKSLFDGTLQGIHRTDKPAFSFQGHPEASPGPHDAAPLFDHFIELIEQYRKTAK

SEQ ID NO: 692 - protein, 1073 aa, Escherichia coli [sequence omitted]

SEQ ID NO: 693 - protein, 522 aa, Escherichia coli
MDRGAMDIIGGQHLRQMWDDLADVYGHKTALICESSGGVVNRYSYLELNQEINRTANLFYTLGIRKGDKVALHLDNCPEFIFCWFGLAKIGAIMVPINARLLCEESAWILQNSQACLLVTSAQFYPMYQQIQQEDATQLRHICLTDVALPADDGVSSFTQLKNQQPATLCYAPPLSTDDTAEILFTSGTTSRPKGVVITHYNLRFAGYYSAWQCALRDDDVYLTVMPAFHIDCQCTAAMAAFSAGATFVLVEKYSARAFWGQVQKYRATVTECIPMMIRTLMVQPPSANDQQHRLREVMFYLNLSEQEKDAFCERFGVRLLTSYGMTETIVGIIGDRPGDKRRWPSIGRVGFCYEAEIRDDHNRPLPAGEIGEICIKGIPGKTIFKEYFLNPQATAKVLEADGWLHTGDTGYRDEEDFFYFVDRRCNMIKRGGENVSCVELENIIAAHPKIQDIVVVGIKDSIRDEAIKAFVVLNEGETLSEEEFFRFCEQNMAKFKVPSYLEIRKDLPRNCSGKIIRKNLK

SEQ ID NO: 694 - protein, 380 aa, Escherichia coli [sequence omitted]

SEQ ID NO: 695 - protein, 443 aa, Escherichia coli
MQPSRNFDDLKFSSIHRRILLWGSGGPFLDGYVLVMIGVALEQLTPALKLDADWIGLLGAGTLAGLFVGTSLFGYISDKVGRRKMFLIDIIAIGVISVATMFVSSPVELLVMRVLIGIVIGADYPIATSMITEFSSTRQRAFSISFIAAMWYVGATCADLVGYWLYDVEGGWRWMLGSAAIPCLLILIGRFELPESPRWLLRKGRVKECEEMMIKLFGEPVAFDEEQPQQTRFRDLFNRRHFPFVLFVAAIWTCQVIPMFAIYTFGPQIVGLLGLGVGKNAALGNVVISLFFMLGCIPPMLWLNTAGRRPLLIGSFAMMTLALAVLGLIPDMGIWLVVMAFAVYAFFSGGPGNLQWLYPNELFPTDIRASAVGVIMSLSRIGTIVSTWALPIFINNYGISNTMLMGAGISLFGLLISVAFAPETRGMSLAQTSNMTIRGQRMG

SEQ ID NO: 696 - protein, 159 aa, Escherichia coli [sequence omitted]

SEQ ID NO: 697 - protein, 783 aa, Escherichia coli
MAQAGFILTRHWRDTPQGTEVSFWLATDNGPLQVTLAPQESVAFIPADQVPRAQHILQGEQGFRLTPLALKDFHRQPVYGLYCRAHRQLMNYEKRLREGGVTVYEADVRPPERYLMERFITSPVWVEGDMHNGTIVNARLKPHPDYRPPLKWVSIDIETTRHGELYCIGLEGCGQRIVYMLGPENGDASSLDFELEYVASRPQLLEKLNAWFANYDPDVIIGWNVVQFDLRMLQKHAERYRLPLRLGRDNSELEWREHGFKNGVFFAQAKGRLIIDGIEALKSAFWNFSSFSLETVAQELLGEGKSIDNPWDRMDEIDRRFAEDKPALATYNLKDCELVTQIFHKTEIMPFLLERATVNGLPVDRHGGSVAAFGHLYFPRMHRAGYVAPNLGEVPPHASPGGYVMDSRPGLYDSVLVLDYKSLYPSIIRTFLIDPVGLVEGMAQPDPEHSTEGFLDAWFSREKHCLPEIVTNIWHGRDEAKRQGNKPLSQALKIIMNAFYGVLGTTACRFFDPRLASSITMRGHQIMRQTKALIEAQGYDVIYGDTDSTFVWLKGAHSEEEAAKIGRALVQHVNAWWAETLQKQRLTSALELEYETHFCRFLMPTIRGADTGSKKRYAGLIQEGDKQRMVFKGLETVRTDWTPLAQQFQQELYLRIFRNEPYQEYVRETIDKLMAGELDARLVYRKRLRRPLSEYQRNVPPHVRAARLADEENQKRGRPLQYQNRGTIKYVWTTNGPEPLDYQRSPLDYEHYLTRQLQPVAEGILPFIEDNFATLMTGQLGLF

SEQ ID NO: 698 - protein, 500 aa, Escherichia coli
MTIFDNYEVWFVIGSQHLYGPETLRQVTQHAEHVVNALNTEAKLPCKLVLKPLGTTPDEITAICRDANYDDRCAGLVVWLHTFSPAKMWINGLTMLNKPLLQFHTQFNAALPWDSIDMDFMNLNQTAHGGREFGFIGARMRQQHAVVTGHWQDKQAHERIGSWMRQAVSKQDTRHLKVCRFGDNMREVAVTDGDKVAAQIKFGFSVNTWAVGDLVQVVNSISDGDVNALVDEYESCYTMTPATQIHGKKRQNVLEAARIELGMKRFLEQGGFHAFTTTFEDLHGLKQLPGLAVQRLMQQGYGFAGEGDWKTAALLRIMKVMSTGLQGGTSFMEDYTYHFEKGNDLVLGSHMLEVCPSIAAEEKPILDVQHLGIGGKDDPARLIFNTQTGPAIVASLIDLGDRYRLLVNCIDTVKTPHSLPKLPVANALWKAQPDLPTASEAWILAGGAHHTVFSHALNLNDMRQFAEMHDIEITVIDNDTRLPAFKDALRWNEVYYGFRR

SEQ ID NO: 699 - protein, 364 aa, Escherichia coli
MMSKNYHIAVLPGDGIGPEVMTQALKVLDAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDILCVRELTGGIYFGQPKGREGSGQYEKAFDTEVYHRFEIERIARIAFESARKRRHKVTSIDKANVLQSSILWREIVNEIATEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADDAACAIERAINRALEEGIRTGDLARGAAAVSTDEMGDIIARYVAEGV

SEQ ID NO: 700 - protein, 457 aa, Escherichia coli
MMEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 701 - protein, 630 aa, Escherichia coli
MAIEIKVPDIGADEVEITEILVKVGDKVEAEQSLITVEGDKASMEVPSPQAGIVKEIKVSVGDKTQTGALIMIFDSADGAADAAPAQAEEKKEAAPAAAPAAAAAKDVNVPDIGSDEVEVTEILVKVGDKVEAEQSLITVEGDKASMEVPAPFAGTVKEIKVNVGDKVSTGSLIMVFEVAGEAGAAAPAAKQEAAPAAAPAPAAGVKEVNVPDIGGDEVEVTEVMVKVGDKVAAEQSLITVEGDKASMEVPAPFAGVVKELKVNVGDKVKTGSLIMIFEVEGAAPAAAPAKQEAAAPAPAAKAEAPAAAPAAKAEGKSEFAENDAYVHATPLIRRLAREFGVNLAKVKGTGRKGRILREDVQAYVKEAIKRAEAAPAATGGGIPGMLPWPKVDFSKFGEIEEVELGRIQKISGANLSRNWVMIPHVTHFDKTDITELEAFRKQQNEEAAKRKLDVKITPVVFIMKAVAAALEQMPRFNSSLSEDGQRLTLKKYINIGVAVDTPNGLVVPVFKDVNKKGIIELSRELMTISKKARDGKLTAGEMQGGCFTISSIGGLGTTHFAPIVNAPEVAILGVSKSAMEPVWNGKEFVPRLMLPISLSFDHRVIDGADGARFITIINNTLSDIRRLVM

SEQ ID NO: 702 - protein, 474 aa, Escherichia coli [sequence omitted]

SEQ ID NO: 703 - protein, 796 aa, Escherichia coli
MAINNTGSRRLLVTLTALFAALCGLYLLIGGGWLVAIGGSWYYPIAGLVMLGVAWMLWRSKRAALWLYAALLLGTMIWGVWEVGFDFWALTPRSDILVFFGIWLILPFVWRRLVIPASGAVAALVVALLISGGILTWAGFNDPQEINGTLSADATPAEAISPVADQDWPAYGRNQEGQRFSPLKQINADNVHNLKEAWVFRTGDVKQPNDPGEITNEVTPIKVGDTLYLCTAHQRLFALDAASGKEKWHYDPELKTNESFQHVTCRGVSYHEAKAETASPEVMADCPRRIILPVNDGRLIAINAENGKLCETFANKGVLNLQSNMPDTKPGLYEPTSPPIITDKTIVMAGSVTDNFSTRETSGVIRGFDVNTGELLWAFDPGAKDPNAIPSDEHTFTFNSPNSWAPAAYDAKLDLVYLPMGVTTPDIWGGNRTPEQERYASSILALNATTGKLAWSYQTVHHDLWDMDLPAQPTLADITVNGQKVPVIYAPAKTGNIFVLDRRNGELVVPAPEKPVPQGAAKGDYVTPTQPFSELSFRPTKDLSGADMWGATMFDQLVCRVMFHQMRYEGIFTPPSEQGTLVFPGNLGMFEWGGISVDPNREVAIANPMALPFVSKLIPRGPGNPMEQPKDAKGTGTESGIQPQYGVPYGVTLNPFLSPFGLPCKQPAWGYISALDLKTNEVVWKKRIGTPQDSMPFPMPVPVPFNMGMPMLGGPISTAGNVLFIAATADNYLRAYNMSNGEKLWQGRLPAGGQATPMTYEVNGKQYVVISAGGHGSFGTKMGDYIVAYALPDDVK

SEQ ID NO: 704 - protein, 182 aa, Escherichia coli
MVRDMKHTVEVMIPEAEIKARIAELGRQITERYKDSGSDMVLVGLLRGSFMFMADLCREVQVSHEVDFMTASSYGSGMSTTRDVKILKDLDEDIRGKDVLIVEDIIDSGNTLSKVREILSLREPKSLAICTLLDKPSRREVNVPVEFIGFSIPDEFVVGYGIDYAQRYRHLPYIGKVILLDE

SEQ ID NO: 705 - protein, 308 aa, Escherichia coli [sequence omitted]

SEQ ID NO: 706 - protein, 426 aa, Escherichia coli
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAQLVTELVPTMDMVRMVNSGTEATMSAIRLARGFTGRDKIIKFEGCYHGHADCLLVKAGSGALTLGQPNSPGVPADFAKYTLTCTYNDLASVRAAFEQYPQEIACIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGVHETLDELTTRLAEGLLEAAEEAGIPLVVNHVGGMFGIFFTDAESVTCYQDVMACDVERFKRFFHMMLDEGVYLAPSAFEAGFMSVAHSMEDINNTIDAARRVFAKL

SEQ ID NO: 707 - protein, 151 aa, Escherichia coli
MTTNTHTLQIEEILELLPHRFPFLLVDRVLDFEEGRFLRAVKNVSVNEPFFQGHFPGKPIFPGVLILEAMAQATGILAFKSVGKLEPGELYYFAGIDEARFKRPVVPGDQMIMEVTFEKTRRGLTRFKGVALVDGKVVCEATMMCARSREA

SEQ ID NO: 708 - protein, 713 aa, Escherichia coli
MNIIAIMGPHGVFYKDEPIKELESALVAQGFQIIWPQNSVDLLKFIEHNPRICGVIFDWDEYSLDLCSDINQLNEYLPLYAFINTHSTMDVSVQDMRMALWFFEYALGQAEDIAIRMRQYTDEYLDNITPPFTKALFTYVKERKYTFCTPGHMGGTAYQKSPVGCLFYDFFGGNTLKADVSISVTELGSLLDHTGPHLEAEEYIARTFGAEQSYIVTNGTSTSNKIVGMYAAPSGSTLLIDRNCHKSLAHLLMMNDVVPVWLKPTRNALGILGGIPRREFTRDSIEEKVAATTQAQWPVHAVITNSTYDGLLYNTDWIKQTLDVPSIHFDSAWVPYTHFHPIYQGKSGMSGERVAGKVIFETQSTHKMLAALSQASLIHIKGEYDEEAFNEAFMMHTTTSPSYPIVASVETAAAMLRGNPGKRLINRSVERALHFRKEVQRLREESDGWFFDIWQPPQVDEAECWPVAPGEQWHGFNDADADHMFLDPVKVTILTPGMDEQGNMSEEGIPAALVAKFLDERGIVVEKTGPYNLLFLFSIGIDKTKAMGLLRGLTEFKRSYDLNLRIKNMLPDLYAEDPDFYRNMRIQDLAQGIHKLIRKHDLPGLMLRAFDTLPEMIMTPHQAWQRQIKGEVETIALEQLVGRVSANMILPYPPGVPLLMPGEMLTKESRTVLDFLLMLCSVGQHYPGFETDIHGAKQDEDGVYRVRVLKMAG

SEQ ID NO: 709 - protein, 267 aa, Escherichia coli
MAIPAFGLGTFRLKDDVVISSVITALELGYRAIDTAQIYDNEAAVGQAIAESGVPRHELYITTKIWIENLSKDKLIPSLKESLQKLRTDYVDLTLIHWPSPNDEVSVEEFMQALLEAKKQGLTREIGISNFTIPLMEKAIAAVGAENIATNQIELSPYLQNRKVVAWAKQHGIHITSYMTLAYGKALKDEVIARIAAKHNATPAQVILAWAMGEGYSVIPSSTKRKNLESNLKAQNLQLDAEDKKAIAALDCNDRLVSPEGLAPEWD

SEQ ID NO: 710 - protein, 251 aa, Escherichia coli
MNLNSIPAFDDNYIWVLNDEAGRCLIVDPGDAEPVLNAIAANNWQPEAIFLTHHHHDHVGGVKELVEKFPQIVVYGPQETQDKGTTQVVKDGETAFVLGHEFSVIATPGHTLGHICYFSKPYLFCGDTLFSGGCGRLFEGTASQMYQSLKKLSALPDDTLVCCAHEYTLSNMKFALSILPHDLSINDYYRKVKELRAKNQITLPVILKNERQINVFLRTEDIDLINVINEETLLQQPEERFAWLRSKKDRF

SEQ ID NO: 711 - protein, 152 aa, Escherichia coli
MSEKYIVTWDMLQIHARKLASRLMPSEQWKGIIAVSRGGLVPGALLARELGIRHVDTVCISSYDHDNQRELKVLKRAEGDGEGFIVIDDLVDTGGTAVAIREMYPKAHFVTIFAKPAGRPLVDDYVVDIPQDTWIEQPWDMGVVFVPPISGR

SEQ ID NO: 712 - protein, 417 aa, Escherichia coli
MLEQMGIAAKQASYKLAQLSSREKNRVLEKIADELEAQSEIILNANAQDVADARANGLSEAMLDRLALTPARLKGIADDVRQVCNLADPVGQVIDGGVLDSGLRLERRRVPLGVIGVIYEARPNVTVDVASLCLKTGNAVILRGGKETCRTNAATVAVIQDALKSCGLPAGAVQAIDNPDRALVSEMLRMDKYIDMLIPRGGAGLHKLCREQSTIPVITGGIGVCHIYVDESVEIAEALKVIVNAKTQRPSTCNTVETLLVNKNIADSFLPALSKQMAESGVTLHADAAALAQLQAGPAKVVAVKAEEYDDEFLSLDLNVKIVSDLDDAIAHIREHGTQHSDAILTRDMRNAQRFVNEVDSSAVYVNASTRFTDGGQFGLGAEVAVSTQKLHARGPMGLEALTTYKWIGIGDYTIRA

SEQ ID NO: 713 - protein, 155 aa, Escherichia coli
MTILSLSRFMLAGVLLASFNASAIPGFWQQGYGQGNTEYSVTEASGKTFTINCTGNPDQNGFYQHSVFLTLADDKMVSSHDDDTTITVVMDHQQYIIPSSLGWRNGDNAWFDFISNISEAGQFDVYVNDHKAGTFTADRKNAEKVLSTLGDCSND

SEQ ID NO: 714 - protein, 475 aa, Escherichia coli
MSIRLEGYMQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 715 - protein, 310 aa, Escherichia coli
MSQNNPLRALLDKQDILLLDGAMATELEARGCNLADSLWSAKVLVENPELIREVHLDYYRAGAQCAITASYQATPAGFAARGLDEAQSKALIGKSVELARKAREAYLAENPQAGTLLVAGSVGPYGAYLADGSEYRGDYHCSVEAFQAFHRPRVEALLDAGADLLACETLPNFSEIEALAELLTAYPRARAWFSFTLRDSEHLSDGTPLRDVVALLAGYPQVVALGINCIALENTTAALQHLHGLTVLPLVVYPNSGEHYDAVSKTWHHHGEHCAQLADYLPQWQAAGARLIGGCCRTTPADIAALKARS

SEQ ID NO: 716 - protein, 309 aa, Escherichia coli
MIQQGDLMPQSALFTGIIPPVSTIFTADGQLDKPGTAALIDDLIKAGVDGLFFLGSGGEFSQLGAEERKAIARFAIDHVDRRVPVLIGTGGTNARETIELSQHAQQAGADGIVVINPYYWKVSEANLIRYFEQVADSVTLPVMLYNFPALTGQDLTPALVKTLADSRSNIIGIKDTIDSVAHLRSMIHTVKGAHPHFTVLCGYDDHLFNTLLLGGDGAISASGNFAPQVSVNLLKAWRDGDVAKAAGYHQTLLQIPQMYQLDTPFVNVIKEAIVLCGRPVSTHVLPPASPLDEPRKAQLKTLLQQLKLC

SEQ ID NO: 717 - protein, 334 aa, Escherichia coli
MSDLYKKHFLKLLDFTPAQFTSLLTLAAQLKADKKNGKEVQKLTGKNIALIFEKDSTRTRCSFEVAAFDQGARVTYLGPSGSQIGHKESIKDTARVLGRMYDGIQYRGHGQEVVETLAQYAGVPVWNGLTNEFHPTQLLADLMTMQEHLPGKAFNEMTLVYAGDARNNMGNSMLEAAALTGLDLRLLAPKACWPEESLVAECSALAEKHGGKITLTEDVAAGVKGADFIYTDVWVSMGEAKEKWAERIALLRGYQVNAQMMALTDNPNVKFLHCLPAFHDDQTTLGKQMAKEFDLHGGMEVTDEVFESAASIVFDQAENRMHTIKAVMMATLGE

SEQ ID NO: 718 - protein, 450 aa, Escherichia coli
MNAFRQEIIMNKYQAVIIGFGKAGKTLAVTLAKAGWRVALIEQSNAMYGGTCINIGCIPTKTLVHDAQQHTDFVRAIQRKNEVVNFLRNKNFHNLADMPNIDVIDGQAEFINNHSLRVHRPEGNLEIHGEKIFINTGAQTVVPPIPGITTTPGVYDSTGLLNLKELPGHLGILGGGYIGVEFASMFANFGSKVTILEAASLFLPREDRDIADNIATILRDQGVDIILNAHVERISHHENQVQVHSEHAQLAVDALLIASGRQPATASLHPENAGIAVNERGAIVVDKRLHTTADNIWAMGDVTGGLQFTYISLDDYRIVRDELLGEGKRSTDDRKNVPYSVFMTPPLSRVGMTEEQARESGADIQVVTLPVAAIPRARVMNDTRGVLKAIVDNKTQRMLGASLLCVDSHEMINIVKMVMDAGLPYSILRDQIFTHPSMSESLNDLFSLVK

SEQ ID NO: 719 - protein, 556 aa, Escherichia coli
MQFDYIIIGAGSAGNVLATRLTEDPNTSVLLLEAGGPDYRFDFRTQMPAALAFPLQGKRYNWAYETEPEPFMNNRRMECGRGKGLGGSSLINGMCYIRGNALDLDNWAQEPGLENWSYLDCLPYYRKAETRDMGENDYHGGDGPVSVTTSKPGVNPLFEAMIEAGVQAGYPRTDDLNGYQQEGFGPMDRTVTPQGRRASTARGYLDQAKSRPNLTIRTHAMTDHIIFDGKRAVGVEWLEGDSTIPTRATANKEVLLCAGAIASPQILQRSGVGNAELLAEFDIPLVHELPGVGENLQDHLEMYLQYECKEPVSLYPALQWWNQPKIGAEWLFGGTGVGASNHFEAGGFIRSREEFAWPNIQYHFLPVAINYNGSNAVKEHGFQCHVGSMRSPSRGHVRIKSRDPHQHPAILFNYMSHEQDWQEFRDAIRITREIMHQPALDQYRGREISPGVECQTDEQLDEFVRNHAETAFHPCGTCKMGYDEMSVVDGEGRVHGLEGLRVVDASIMPQIITGNLNATTIMIGEKIADMIRGQEALPRSTAGYFVANGMPVRAKK

SEQ ID NO: 720 - protein, 490 aa, Escherichia coli
MSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 721 - protein, 349 aa, Escherichia coli
MKIKAVGAYSAKQPLEPMDITRREPGPNDVKIEIAYCGVCHSDLHQVRSEWAGTVYPCVPGHEIVGRVVAVGDQVEKYAPGDLVGVGCIVDSCKHCEECEDGLENYCDHMTGTYNSPTPDEPGHTLGGYSQQIVVHERYVLRIRHPQEQLAAVAPLLCAGITTYSPLRHWQAGPGKKVGVVGIGGLGHMGIKLAHAMGAHVVAFTTSEAKREAAKALGADEVVNSRNADEMAAHLKSFDFILNTVAAPHNLDDFTTLLKRDGTMTLVGAPATPHKSPEVFNLIMKRRAIAGSMIGGIPETQEMLDFCAEHGIVADIEMIRADQINEAYERMLRGDVKYRFVIDNRTLTD

SEQ ID NO: 722 - protein, 389 aa, Escherichia coli
MSDTTILQNSTHVIKPKKSVALSGVPAGNTALCTVGKSGNDLHYRGYDILDLAKHCEFEEVAHLLIHGKLPTRDELAAYKTKLKALRGLPANVRTVLEALPAASHPMDVMRTGVSALGCTLPEKEGHTVSGARDIADKLLASLSSILLYWYHYSHNGERIQPETDDDSIGGHFLHLLHGEKPSQSWEKAMHISLVLYAEHEFNASTFTSRVIAGTGSDMYSAIIGAIGALRGPKHGGANEVSLEIQQRYETPDEAEADIRKRVENKEVVIGFGHPVYTIADPRHQVIKRVAKQLSQEGGSLKMYNIADRLETVMWESKKMFPNLDWFSAVSYNMMGVPTEMFTPLFVIARVTGWAAHIIEQRQDNKIIRPSANYVGPEDRPFVALDKRQ

SEQ ID NO: 723 - protein, 628 aa, Escherichia coli [sequence omitted]

SEQ ID NO: 724 - protein, 1024 aa, Escherichia coli
MTMITDSLAVVLQRRDWENPGVTQLNRLAAHPPFASWRNSEEARTDRPSQQLRSLNGEWRFAWFPAPEAVPESWLECDLPEADTVVVPSNWQMHGYDAPIYTNVTYPITVNPPFVPTENPTGCYSLTFNVDESWLQEGQTRIIFDGVNSAFHLWCNGRWVGYGQDSRLPSEFDLSAFLRAGENRLAVMVLRWSDGSYLEDQDMWRMSGIFRDVSLLHKPTTQISDFHVATRFNDDFSRAVLEAEVQMCGELRDYLRVTVSLWQGETQVASGTAPFGGEIIDERGGYADRVTLRLNVENPKLWSAEIPNLYRAVVELHTADGTLIEAEACDVGFREVRIENGLLLLNGKPLLIRGVNRHEHHPLHGQVMDEQTMVQDILLMKQNNFNAVRCSHYPNHPLWYTLCDRYGLYVVDEANIETHGMVPMNRLTDDPRWLPAMSERVTRMVQRDRNHPSVIIWSLGNESGHGANHDALYRWIKSVDPSRPVQYEGGGADTTATDIICPMYARVDEDQPFPAVPKWSIKKWLSLPGETRPLILCEYAHAMGNSLGGFAKYWQAFRQYPRLQGGFVWDWVDQSLIKYDENGNPWSAYGGDFGDTPNDRQFCMNGLVFADRTPHPALTEAKHQQQFFQFRLSGQTIEVTSEYLFRHSDNELLHWMVALDGKPLASGEVPLDVAPQGKQLIELPELPQPESAGQLWLTVRVVQPNATAWSEAGHISAWQQWRLAENLSVTLPAASHAIPHLTTSEMDFCIELGNKRWQFNRQSGFLSQMWIGDKKQLLTPLRDQFTRAPLDNDIGVSEATRIDPNAWVERWKAAGHYQAEAALLQCTADTLADAVLITTAHAWQHQGKTLFISRKTYRIDGSGQMAITVDVEVASDTPHPARIGLNCQLAQVAERVNWLGLGPQENYPDRLTAACFDRWDLPLSDMYTPYVFPSENGLRCGTRELNYGPHQWRGDFQFNISRYSQQQLMETSHRHLLHAEEGTWLNIDGFHMGIGGDDSWSPSVSAEFQLSAGRYHYQLVWCQK

SEQ ID NO: 725 - protein, 369 aa, Escherichia coli
MKSRAAVAFAPGKPLEIVEIDVAPPKKGEVLIKVTHTGVCHTDAFTLSGDDPEGVFPVVLGHEGAGVVVEVGEGVTSVKPGDHVIPLYTAECGECEFCRSGKTNLCVAVRETQGKGLMPDGTTRFSYNGQPLYHYMGCSTFSEYTVVAEVSLAKINPEANHEHVCLLGCGVTTGIGAVHNTAKVQPGDSVAVFGLGAIGLAVVQGARQAKAGRIIAIDTNPKKFDLARRFGATDCINPNDYDKPIKDVLLDINKWGIDHTFECIGNVNVMRAALESAHRGWGQSVIIGVAVAGQEISTRPFQLVTGRVWKGSAFGGVKGRSQLPGMVEDAMKGDIDLEPFVTHTMSLDEINDAFDLMHEGKSIRTVIRY

SEQ ID NO: 726 - protein, 335 aa, Escherichia coli
MPLDSTNIRQTMTDLIQRPRRLRKSPALRAMFEETTLSLNDLVLPIFVEEEIDDYKAVEAMPGVMRIPEKHLAREIERIANAGIRSVMTFGISHHTDETGSDAWREDGLVARMSRICKQTVPEMIVMSDTCFCEYTSHGHCGVLCEHGVDNDATLENLGKQAVVAAAAGADFIAPSAAMDGQVQAIRQALDAAGFKDTAIMSYSTKFASSFYGPFREAAGSALKGDRKSYQMNPMNRREAIRESLLDEAQGADCLMVKPAGAYLDIVRELRERTELPIGAYQVSGEYAMIKFAALAGAIDEEKVVLESLGSIKRAGADLIFSYFALDLAEKKILR

SEQ ID NO: 727 - protein, 269 aa, Escherichia coli
MEKKIGFIGCGNMGKAILGGLIASGQVLPGQIWVYTPSPDKVAALHDQFGINAAESAQEVAQIADIIFAAVKPGIMIKVLSEITSSLNKDSLVVSIAAGVTLDQLARALGHDRKIIRAMPNTPALVNAGMTSVTPNALVTPEDTADVLNIFRCFGEAEVIAEPMIHPVVGVSGSSPAYVFMFIEAMADAAVLGGMPRAQAYKFAAQAVMGSAKMVLETGEHPGALKDMVCSPGGTTIEAVRVLEEKGFRAAVIEAMTKCMEKSEKLSKS

SEQ ID NO: 728 - protein, 174 aa, Escherichia coli
MTQPLFLIGPRGCGKTTVGMALADSLNRRFVDTDQWLQSQLNMTVAEIVEREEWAGFRARETAALEAVTAPSTVIATGGGIILTEFNRHFMQNNGIVVYLCAPVSVLVNRLQAAPEEDLRPTLTGKPLSEEVQEVLEERDALYREVAHIIIDATNEPSQVISEIRSALAQTINC

SEQ ID NO: 729 - protein, 457 aa, Escherichia coli
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVWFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 730 - protein, 605 aa, Escherichia coli
MMLNAWHLPVPPFVKQSKDQLLITLWLTGEDPPQRIMLRTEHDNEEMSVPMHKQRSQPQPGVTAWRAAIDLSSGQPRRRYSFKLLWHDRQRWFTPQGFSRMPPARLEQFAVDVPDIGPQWAADQIFYQIFPDRFARSLPREAEQDHVYYHHAAGQEIILRDWDEPVTAQAGGSTFYGGDLDGISEKLPYLKKLGVTALYLNPVFKAPSVHKYDTEDYRHVDPQFGGDGALLRLRHNTQQLGMRLVLDGVFNHSGDSHAWFDRHNRGTGGACHNPESPWRDWYSFSDDGTALDWLGYASLPKLDYQSESLVNEIYRGEDSIVRHWLKAPWNMDGWRLDVVHMLGEAGGARNNMQHVAGITEAAKETQPEAYIVGEHFGDARQWLQADVEDAAMNYRGFTFPLWGFLANTDISYDPQQIDAQTCMAWMDNYRAGLSHQQQLRMFNQLDSHDTARFKTLLGRDIARLPLAVVWLFTWPGVPCIYYGDEVGLDGKNDPFCRKPFPWQVEKQDTALFALYQRMIALRKKSQALRHGGCQVLYAEDNVVVFVRVLNQQRVLVAINRGEACEVVLPASPFLNAVQWQCKEGHGQLTDGILALPAISATVWMN

SEQ ID NO: 731 - protein, 620 aa, Escherichia coli
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVILNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLAILNFGTLMPEAAKVAESLNATLVDMRFVKPLDEALILEMAASHEALVTVEENAIMGGAGSGVNEVLMAHRKPVPVLNIGLPDFFIPQGTQEEMRAELGLDAAGMEAKIKAWLA

SEQ ID NO: 732 - protein, 299 aa, Escherichia coli
MDFPQQLEACVKQANQALSRFIAPLPFQNTPVVETMQYGALLGGKRLRPFLVYATGHMFGVSTNTLDAPAAAVECIHAYSLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 733 - protein, 424 aa, Escherichia coli
MTDKRKDGSGKLLYCSFCGKSQHEVRKLIAGPSVYICDECVDLCNDIIREEIKEVAPHRERSALPTPHEIRNHLDDYVIGQEQAKKVLAVAVYNHYKRLRNGDTSNGVELGKSNILLIGPTGSGKTLLAETLARLLDVPFTMADATTLTEAGYVGEDVENIIQKLLQKCDYDVQKAQRGIVYIDEIDKISRKSDNPSITRDVSGEGVQQALLKLIEGTVAAVPPQGGRKHPQQEFLQVDTSKILFICGGAFAGLDKVISHRVETGSGIGFGATVKAKSDKASEGELLAQVEPEDLIKFGLIPEFIGRLPVVATLNELSEEALIQILKEPKNALTKQYQALFNLEGVDLEFRDEALDAIAKKAMARKTGARGLRSIVEAALLDTMYDLPSMEDVEKVVIDESVIDGQSKPLLIYGKPEAQQASGE

SEQ ID NO: 734 - protein, 784 aa, Escherichia coli
MNPERSERIEIPVLPLRDVVVYPHMVIPLFVGREKSIRCLEAAMDHDKKIMLVAQKEASTDEPGVNDLFTVGTVASILQMLKLPDGTVKVLVEGLQRARISALSDNGEHFSAKAEYLESPTIDEREQEVLVRTAISQFEGYIKLNKKIPPEVLTSLNSIDDPARLADTIAAHMPLKLADKQSVLEMSDVNERLEYLMAMMESEIDLLQVEKRIRNRVKKQMEKSQREYYLNEQMKAIQKELGEMDDAPDENEALKRKIDAAKMPKEAKEKAEAELQKLKMMSPMSAEATVVRGYIDWMVQVPWNARSKVKKDLRQAQEILDTDHYGLERVKDRILEYLAVQSRVNKIKGPILCLVGPPGVGKTSLGQSIAKATGRKYVRMALGGVRDEAEIRGHRRTYIGSMPGKLIQKMAKVGVKNPLFLLDEIDKMSSDMRGDPASALLEVLDPEQNVAFSDHYLEVDYDLSDVMFVATSNSMNIPAPLLDRMEVIRLSGYTEDEKLNIAKRHLLPKQIERNALKKGELTVDDSAIIGIIRYYTREAGVRGLEREISKLCRKAVKQLLLDKSLKHIEINGDNLHDYLGVQRFDYGRADNENRVGQVTGLAWTEVGGDLLTIETACVPGKGKLTYTGSLGEVMQESIQAALTVVRARAEKLGINPDFYEKRDIHVHVPEGATPKDGPSAGIAMCTALVSCLTGNPVRADVAMTGEITLRGQVLPIGGLKEKLLAAHRGGIKTVLIPFENKRDLEEIPDNVIADLDIHPVKRIEEVLTLALQNEPSGMQVVTAK

SEQ ID NO: 735 - protein, 590 aa, Escherichia coli
MRLFAQLSWYFRREWRRYLGAVALLVIIAMLQLVPPKVVGIVVDGVTEQHFTTGQILMWIATMVLIAVVVYLLRYVWRVLLFGASYQLAVELREDYYRQLSRQHPEFYLRHRTGDLMARATNDVDRVVFAAGEGVLTLVDSLVMGCAVLIMMSTQISWQLTLFSLLPMPVMAIMIKRNGDALHERFKLAQAAFSSLNDRTQESLTSIRMIKAFGLEDRQSALFAADAEDTGKKNMRVARIDARFDPTIYIAIGMANLLAIGGGSWMVVQGSLTLGQLTSFMMYLGLMIWPMLALAWMFNIVERGSAAYSRIRAMLAEAPVVNDGSEPVPEGRGELDVNIHQFTYPQTDHPALENVNFALKPGQMLGICGPTGSGKSTLLSLIQRHFDVSEGDIRFHDIPLTKLQLDSWRSRLAVVSQTPFLFSDTVANNIALGCPNATQQEIEHVARLASVHDDILRLPQGYDTEVGERGVMLSGGQKQRISIARALLVNAEILILDDALSAVDGRTEHQILHNLRQWGQGRTVIISAHRLSALTEASEIIVMQHGHIAQRGNHDVLAQQSGWYRDMYRYQQLEAALDDAPENREEAVDA

SEQ ID NO: 736 - protein, 593 aa, Escherichia coli
MRSFSQLWPTLKRLLAYGSPWRKPLGIAVLMMWVAAAAEVSGPLLISYFIDNMVAKNNLPLKVVAGLAAAYVGLQLFAAGLHYAQSLLFNRAAVGVVQQLRTDVMDAALRQPLSEFDTQPVGQVISRVTNDTEVIRDLYVTVVATVLRSAALVGAMLVAMFSLDWRMALVAIMIFPVVLVVMVIYQRYSTPIVRRVRAYLADINDGFNEIINGMSVIQQFRQQARFGERMGEASRSHYMARMQTLRLDGFLLRPLLSLFSSLILCGLLMLFGFSASGTIEVGVLYAFISYLGRLNEPLIELTTQQAMLQQAVVAGERVFELMDGPRQQYGNDDRPLQSGTIEVDNVSFAYRDDNLVLKNINLSVPSRNFVALVGHTGSGKSTLASLLMGYYPLTEGEIRLDGRPLSSLSHSALRQGVAMVQQDPVVLADTFLANVTLGRDISEERVWQALETVQLAELARSMSDGIYTPLGEQGNNLSVGQKQLLALARVLVETPQILILDEATASIDSGTEQAIQHALAAVREHTTLVVIAHRLSTIVDADTILVLHRGQAVEQGTHQQLLAAQGRYWQMYQLQLAGEELAASVREEESLSA

SEQ ID NO: 737 - protein, 183 aa, Escherichia coli
MTATAQQLEYLKNSIKSIQDYPKPGILFRDVTSLLEDPKAYALSIDLLVERYKNAGITKVVGTEARGFLFGAPVALGLGVGFVPVRKPGKLPRETISETYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 738 - protein, 624 aa, Escherichia coli
MKGQETRGFQSEVKQLLHLMIHSLYSNKEIFLRELISNASDAADKLRFRALSNPDLYEGDGELRVRVSFDKDKRTLTISDNGVGMTRDEVIDHLGTIAKSGTKSFLESLGSDQAKDSQLIGQFGVGFYSAFIVADKVTVRTRAAGEKPENGVFWESAGEGEYTVADITKEDRGTEITLHLREGEDEFLDDWRVRSIISKYSDHIALPVEIEKREEKDGETVISWEKINKAQALWTRNKSEITDEEYKEFYKHIAHDFNDPLTWSHNRVEGKQEYTSLLYIPSQAPWDMWNRDHKHGLKLYVQRVFIMDDAEQFMPNYLRFVRGLIDSSDLPLNVSREILQDSTVTRNLRNALTKRVLQMLEKLAKDDAEKYQTFWQQFGLVLKEGPAEDFANQEAIAKLLRFASTHTDSSAQTVSLEDYVSRMKEGQEKIYYITADSYAAAKSSPHLELLRKKGIEVLLLSDRIDEWMMNYLTEFDGKPFQSVSKVDESLEKLADEVDESAKEAEKALTPFIDRVKALLGERVKDVRLTHRLTDTPAIVSTDADEMSTQMAKLFAAAGQKVPEVKYIFELNPDHVLVKRAADTEDEAKFSEWVELLLDQALLAERGTLEDPNLFIRRMNQLLVS

SEQ ID NO: 739 - protein, 320 aa, Escherichia coli
MRQTKTGILLANLGTPDAPTPEAVKRYLKQFLSDRRVVDTSRLLWWPLLRGVILPLRSPRVAKLYASVWMEGGSPLMVYSRQQQQALAQRLPEMPVALGMSYGSPSLESAVDELLAEHVDHIVVLPLYPQFSCSTVGAVWDELARILARKRSIPGISFIRDYADNHDYINALANSVRASFAKHGEPDLLLLSYHGIPQRYADEGDDYPQRCRTTTRELASALGMAPEKVMMTFQSRFGREPWLMPYTDETLKMLGEKGVGHIQVMCPGFAADCLETLEEIAEQNREVFLGAGGKKYEYIPALNATPEHIEMMANLVAAYR

SEQ ID NO: 740 - protein, 550 aa, Escherichia coli
MKLLQRGVALALLTTFTLASETALAYEQDKTYKITVLHTNDHHGHFWRNEYGEYGLAAQKTLVDGIRKEVAAEGGSVLLLSGGDINTGVPESDLQDAEPDFRGMNLVGYDAMAIGNHEFDNPLTVLRQQEKWAKFPLLSANIYQKSTGERLFKPWALFKRQDLKIAVIGLTTDDTAKIGNPEYFTDIEFRKPADEAKLVIQELQQTEKPDIIIAATHMGHYDNGEHGSNAPGDVEMARALPAGSLAMIVGGHSQDPVCMAAENKKQVDYVPGTPCKPDQQNGIWIVQAHEWGKYVGRADFEFRNGEMKMVNYQLIPVNLKKKVTWEDGKSERVLYTPEIAENQQMISLLSPFQNKGKAQLEVKIGETNGRLEGDRDKVRFVQTNMGRLILAAQMDRTGADFAVMSGGGIRDSIEAGDISYKNVLKVQPFGNVVVYADMTGKEVIDYLTAVAQMKPDSGAYPQFANVSFVAKDGKLNDLKIKGEPVDPAKTYRMATLNFNATGGDGYPRLDNKPGYVNTGFIDAEVLKAYIQKSSPLDVSVYEPKGEVSWQ

SEQ ID NO: 741 - protein, 834 aa, Escherichia coli
MSQTIDLTLDGLSCGHCVKRVKESLEQRPDVEQADVSITEAHVTGTASAEQLIETIKQAGYDASVSHPKAKPLAESSIPSEALTAVSEALPAATADDDDSQQLLLSGMSCASCVTRVQNALQSVPGVTQARVNLAERTALVMGSASPQDLVQAVEKAGYGAEAIEDDAKRRERQQETAVATMKRFRWQAIVALAVGIPVMVWGMIGDNMMVTADNRSLWLVIGLITLAVMVFAGGHFYRSAWKSLLNGAATMDTLVALGTGVAWLYSMSVNLWPQWFPMEARHLYYEASAMIIGLINLGHMLEARARQRSSKALEKLLDLTPPTARLVTDEGEKSVPLAEVQPGMLLRLTTGDRVPVDGEITQGEAWLDEAMLTGEPIPQQKGEGDSVHAGTVVQDGSVLFRASAVGSHTTLSRIIRMVRQAQSSKPEIGQLADKISAVFVPVVVVIALVSAAIWYFFGPAPQIVYTLVIATTVLIIACPCALGLATPMSIISGVGRAAEFGVLVRDADALQRASTLDTVVFDKTGTLTEGKPQVVAVKTFADVDEAQALRLAAALEQGSSHPLARAILDKAGDMQLPQVNGFRTLRGLGVSGEAEGHALLLGNQALLNEQQVGTKAIEAEITAQASQGATPVLLAVDGKAVALLAVRDPLRSDSVAALQRLHKAGYRLVMLTGDNPTTANAIAKEAGIDEVIAGVLPDGKAEAIKHLQSEGRQVAMVGDGINDAPALAQADVGIAMGGGSDVAIETAAITLMRHSLMGVADALAISRATLHNMKQNLLGAFIYNSIGIPVAAGILWPFTGTLLNPVVAGAAMALSSITVVSNANRLLRFKPKE

SEQ ID NO: 742 - protein, 430 aa, Escherichia coli
MMNTEGNNGNKPLGLWNVVSIGIGAMVGAGIFALLGQAALLMEASTWVAFAFGGIVAMFSGYAYARLGASYPSNGGIIDFFRRGLGNGVFSLALSLLYLLTLAVSIAMVARAFGAYAVQFLHEGSQEEHLILLYALGIIAVMTLFNSLSNHAVGRLEVILVGIKMMILLLLIIAGVWSLQPAHISVSAPPSSGAFFSCIGITFLAYAGFGMMANAADKVKDPQVIMPRAFLVAIGVTTLLYISLALVLLSDVSALELEKYADTAVAQAASPLLGHVGYVIVVIGALLATASAINANLFAVFNIMDNMGSERELPKLMNKSLWRQSTWGNIIVVVLIMLMTAALNLGSLASVASATFLICYLAVFVVAIRLRHDIHASLPILIVGTLVMLLVIVGFIYSLWSQGSRALIWIIGSLLLSLIVAMVMKRNKTV

SEQ ID NO: 743 - protein, 349 aa, Escherichia coli
MKISRETLHQLIENKLCQAGLKREHAATVAEVLVYADARGIHSHGAVRVEYYAERISKGGTNREPEFRLEETGPCSAILHADNAAGQVAAKMGMEHAIKTAQQNGVAVVGISRMGHSGAISYFVQQAARAGFIGISMCQSDPMVVPFGGAEIYYGTNPLAFAAPGEGDEILTFDMATTVQAWGKVLDARSRNMSIPDTWAVDKNGVPTTDPFAVHALLPAAGPKGYGLMMMIDVLSGVLLGLPFGRQVSSMYDDLHAGRNLGQLHIVINPNFFSSSELFRQHLSQTMRELNAITPAPGFNQVYYPGQDQDIKQRKAAVEGIEIVDDIYQYLISDALYNTSYETKNPFAQ

SEQ ID NO: 744 - protein, 288 aa, Escherichia coli
MAAKIIDGKTIAQQVRSEVAQKVQARIAAGLRAPGLAVVLVGSNPASQIYVASKRKACEEVGFVSRSYDLPETTSEAELLELIDTLNADNTIDGILVQLPLPAGIDNVKVLERIHPDKDVDGFHPYNVGRLCQRAPRLRPCTPRGIVTLLERYNIDTFGLNAVVIGASNIVGRPMSMELLLAGCTTTVTHRFTKNLRHHVENADLLIVAVGKPGFIPGDWIKEGAIVIDVGINRLENGKVVGDVVFEDAAKRASYITPVPGGVGPMTVATLIENTLQACVEYHDPQDE

SEQ ID NO: 745 - protein, 458 aa, Escherichia coli
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 746 - protein, 536 aa, Escherichia coli
MSIPFTRWPEEFARRYREKGYWQDLPLTDILTRHAASDSIAVIDGERQLSYRELNQAADNLACSLRRQGIKPGETALVQLGNVAELYITFFALLKLGVAPVLALFSHQRSELNAYASQIEPALLIADRQHALFSGDDFLNTFVTEHSSIRVVQLLNDSGEHNLQDAINHPAEDFTATPSPADEVAYFQLSGGTTGTPKLIPRTHNDYYYSVRRSVEICQFTQQTRYLCAIPAAHNYAMSSPGSLGVFLAGGTVVLAADPSATLCFPLIEKHQVNVTALVPPAVSLWLQALIEGESRAQLASLKLLQVGGARLSATLAARIPAEIGCQLQQVFGMAEGLVNYTRLDDSAEKIIHTQGYPMCPDDEVWVADAEGNPLPQGEVGRLMTRGPYTFRGYYKSPQHNASAFDANGFYCSGDLISIDPEGYITVQGREKDQINRGGEKIAAEEIENLLLRHPAVIYAALVSMEDELMGEKSCAYLVVKEPLRAVQVRRFLREQGIAEFKLPDRVECVDSLPLTAVGKVDKKQLRQWLASRASA

SEQ ID NO: 747 - protein, 248 aa, Escherichia coli
MDFSGKNVWVTGAGKGIGYATALAFVEAGAKVTGFDQAFTQEQYPFATEVMDVADAAQVAQVCQRLLAETERLDALVNAAGILRMGATDQLSKEDWQQTFAVNVGGAFNLFQQTMNQFRRQRGGAIVTVASDAAHTPRIGMSAYGASKAALKSLALSVGLELAGSGVRCNVVSPGSTDTDMQRTLWVSDDAEEQRIRGFGEQFKLGIPLGKIARPQEIANTILFLASDLASHITLQDIVVDGGSTLGA

SEQ ID NO: 748 - protein, 362 aa, Escherichia coli
MPHNPIRVVVGPANYFSHPGSFNHLHDFFTDEQLSRAVWIYGKRAIAAAQTKLPPAFGLPGAKHILFRGHCSESDVQQLAAESGDDRSVVIGVGGGALLDTAKALARRLGLPFVAVPTIAATCAAWTPLSVWYNDAGQALHYEIFDDANFMVLVEPEIILNAPQQYLLAGIGDTLAKWYEAVVLAPQPETLPLTVRLGINNAQAIRDVLLNSSEQALSDQQNQQLTQSFCDVVDAIIAGGGMVGGLGDRFTRVAAAHAVHNGLTVLPQTEKFLHGTKVAYGILVQSALLGQDDVLAQLTGAYQRFHLPTTLAELEVDINNQAEIDKVIAHTLRPVESIHYLPVTLTPDTLRAAFKKVESFKA

SEQ ID NO: 749 - protein, 487 aa, Escherichia coli
MSLAKDNIWKLLAPLVVMGVMFLIPVPDGMPPQAWHYFAVFVAMIVGMILEPIPATAISFIAVTICVIGSNYLLFDAKELADPAFNAQKQALKWGLAGFSSTTVWLVFGAFIFALGYEVSGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGIQISWLQWFLCFLPVGVILLIIAPWLSYVLYKPEITHSEEVATWAGDELKTMGALTRREWTLIGLVLLSLGLWVFGSEVINATAVGLLAVSLMLALHVVPWKDITRYNSAWNTLVNLATLVVMANGLTRSGFIDWFAGTMSTHLEGFSPNATVIVLVLVFYFAHYLFASLSAHTATMLPVILAVGKGIPGVPMEQLCILLVLSIGIMGCLTPYATGPGVIIYGCGYVKSKDYWRLGAIFGVIYISMLLLVGWPILAMWN

SEQ ID NO: 750 - protein, 556 aa, Escherichia coli
MDNAELAIGIDLGTTNSLIAVWKDGAAQLIPNKFGEYLTPSIISMDENNHILVGKPAVSRRTSHPDKTAALFKRAMGSNTNWRLGSDTFNAPELSSLVLRSLKEDAEEFLQRPIKDVVISVPAYFSDEQRKHTRLAAELAGLNAVRLINEPTAAAMAYGLHTQQNTRSLVFDLGGGTFDVTVLEYATPVIEVHASAGDNFLGGEDFTHMLVDEVLKRADVARTTLNESELAALYACVEAAKCSNQSPLHIRWQYQEETRECEFYENELEDLWLPLLNRLRVPIEQALRDARLKPSQIDSLVLVGGASQMPLVQRIAVRLFGKLPYQSYDPSTIVALGAAIQAACRLRSEDIEEVILTDICPYSLGVEVNRQGVSGIFSPIIERNTTVPVSRVETYSTMHPEQDSITVNVYQGENHKVKNNILVESFDVPLKKTGAYQSIDIRFSYDINGLLEVDVLLEDGSVKSRVINHSPVTLSAQQIEESRTRLSALKIYPRDMLINRTFKAKLEELWARALGDEREEIGRVITDFDAALQSNDMARVDEVRRRASDYLAIEIP

SEQ ID NO: 751 - protein, 554 aa, Escherichia coli
MSEAEARPTNFIRQIIDEDLASGKHTTVHTRFPPEPNGYLHIGHAKSICLNFGIAQDYKGQCNLRFDDTNPVKEDIEYVESIKNDVEWLGFHWSGNVRYSSDYFDQLHAYAIELINKGLAYVDELTPEQIREYRGTLTQPGKNSPYRDRSVEENLALFEKMRAGGFEEGKACLRAKIDMASPFIVMRDPVLYRIKFAEHHQTGNKWCIYPMYDFTHCISDALEGITHSLCTLEFQDNRRLYDWVLDNITIPVHPRQYEFSRLNLEYTVMSKRKLNLLVTDKHVEGWDDPRMPTISGLRRRGYTAASIREFCKRIGVTKQDNTIEMASLESCIREDLNENAPRAMAVIDPVKLVIENYQGEGEMVTMPNHPNKPEMGSRQVPFSGEIWIDRADFREEANKQYKRLVLGKEVRLRNAYVIKAERVEKDAEGNITTIFCTYDADTLSKDPADGRKVKGVIHWVSAAHALPVEIRLYDRLFSVPNPGAADDFLSVINPESLVIKQGFAEPSLKDAVAGKAFQFEREGYFCLDSRHSTAEKPVFNRTVGLRDTWAKVGE

SEQ ID NO: 752 - protein, 546 aa, Escherichia coli
MAIHNRAGQPAQQSDLINVAQLTAQYYVLKPEAGNAEHAVKFGTSGHRGSAARHSFNEPHILAIAQAIAEERAKNGITGPCYVGKDTHALSEPAFISVLEVLAANGVDVIVQENNGFTPTPAVSNAILVHNKKGGPLADGIVITPSHNPPEDGGIKYNPPNGGPADTNVTKVVEDRANALLADGLKGVKRISLDEAMASGHVKEQDLVQPFVEGLADIVDMAAIQKAGLTLGVDPLGGSGIEYWKRIGEYYNLNLTIVNDQVDQTFRFMHLDKDGAIRMDCSSECAMAGLLALRDKFDLAFANDPDYDRHGIVTPAGLMNPNHYLAVAINYLFQHRPQWGKDVAVGKTLVSSAMIDRVVNDLGRKLVEVPVGFKWFVDGLFDGSFGFGGEESAGASFLRFDGTPWSTDKDGIIMCLLAAEITAVTGKNPQEHYNELAKRFGAPSYNRLQAAATSAQKAALSKLSPEMVSASTLAGDPITARLTAAPGNGASIGGLKVMTDNGWFAARPSGTEDAYKIYCESFLGEEHRKQIEKEAVEIVSEVLKNA

SEQ ID NO: 753 - protein, 439 aa, Escherichia coli
MSQAKSNKMGVVQLTILTMVNMMGSGIIMLPTKLAEVGTISIISWLVTAVGSMALAWAFAKCGMFSRKSGGMGGYAEYAFGKSGNFMANYTYGVSLLIANVAIAISAVGYGTELLGASLSPVQIGLATIGVLWICTVANFGGARITGQISSITVWGVIIPVVGLCIIGWFWFSPTLYVDSWNPHHAPFFSAVGSSIAMTLWAFLGLESACANTDVVENPERNVPIAVLGGTLGAAVIYIVSTNVIAGIVPNMELANSTAPFGLAFAQMFTPEVGKVIMALMVMSCCGSLLGWQFTIAQVFKSSSDEGYFPKIFSRVTKVDAPVQGMLTIVIIQSGLALMTISPSLNSQFNVLVNLAVVTNIIPYILSMAALVIIQKVANVPPSKAKVANFVAFVGAMYSFYALYSSGEEAMLYGSIVTFLGWTLYGLVSPRFELKNKHG

SEQ ID NO: 754 - protein, 732 aa, Escherichia coli
MSKLKIAVSDSCPDCFTTQRECIYINESRNIDVAAIVLSLNDVTCGKLDEIDATGYGIPVFIATENQERVPAEYLPRISGVFENCESRREFYGRQLETAASHYETQLRPPFFRALVDYVNQGNSAFDCPGHQGGEFFRRHPAGNQFVEYFGEALFRADLCNADVAMGDLLIHEGAPCIAQQHAAKVFNADKTYFVLNGTSSSNKVVLNALLTPGDLVLFDRNNHKSNHHGALLQAGATPVYLETARNPYGFIGGIDAHCFEESYLRELIAEVAPQRAKEARPFRLAVIQLGTYDGTIYNARQVVDKIGHLCDYILFDSAWVGYEQFIPMMADCSPLLLDLNENDPGILVTQSVHKQQAGFSQTSQIHKKDSHIKGQQRYVPHKRMNNAFMMHASTSPFYPLFAALNINAKMHEGVSGRNMWMDCVVNGINARKLILDNCQHIRPFVPELVDGKPWQSYETAQIAVDLRFFQFVPGEHWHSFEGYAENQYFVDPCKLLLTTPGIDARNGEYEAFGVPATILANFLRENGVVPEKCDLNSILFLLTPAEDMAKLQQLVALLVRFEKLLESDAPLAEVLPSIYKQHEERYAGYTLRQLCQEMHDLYARHNVKQLQKEMFRKEHFPRVSMNPQEANYAYLRGEVELVRLPDAEGRIAAEGALPYPPGVLCVVPGEIWGGAVLRYFSALEEGINLLPGFAPELQGVYIEEHDGRKQVWCYVIKPRDAQSTLLKGEKL

SEQ ID NO: 755 - protein, 427 aa, Escherichia coli
MADTKAKLTLNGDTAVELDVLKGTLGQDVIDIRTLGSKGVFTFDPGFTSTASCESKITFIDGDEGILLHRGFPIDQLATDSNYLEVCYILLNGEKPTQEQYDEFKTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFVRRAKDKNDSFRLMGFGHRVYKNYDPRATVMRETCHEVLKELGTKDDLLEVAMELENIALNDPYFIEKKLYPNVDFYSGIILKAMGIPSSMFTVIFAMARTVGWIAHWSEMHSDGMKIARPRQLYTGYEKRDFKSDIKR

SEQ ID NO: 756 - protein, 588 aa, Escherichia coli
MKLPVREFDAVVIGAGGAGMRAALQISQSGQTCALLSKVFPTRSHTVSAQGGITVALGNTHEDNWEWHMYDTVKGSDYIGDQDAIEYMCKTGPEAILELEHMGLPFSRLDDGRIYQRPFGGQSKNFGGEQAARTAAAADRTGHALLHTLYQQNLKNHTTIFSEWYALDLVKNQDGAVVGCTALCIETGEVVYFKARATVLATGGAGRIYQSTTNAHINTGDGVGMAIRAGVPVQDMEMWQFHPTGIAGAGVLVTEGCRGEGGYLLNKHGERFMERYAPNAKDLAGRDVVARSIMIEIREGRGCDGPWGPHAKLKLDHLGKEVLESRLPGILELSRTFAHVDPVKEPIPVIPTCHYMMGGIPTKVTGQALTVNEKGEDVVVPGLFAVGEIACVSVHGANRLGGNSLLDLVVFGRAAGLHLQESIAEQGALRDASESDVEASLDRLNRWNNNRNGEDPVAIRKALQECMQHNFSVFREGDAMAKGLEQLKVIRERLKNARLDDTSSEFNTQRVECLELDNLMETAYATAVSANFRTESRGAHSRFDFPDRDDENWLCHSLYLPESESMTRRSVNMEPKLRPAFPPKIRTY

SEQ ID NO: 757 - protein, 238 aa, Escherichia coli
MRLEFSIYRYNPDVDDAPRMQDYTLEADEGRDMMLLDALIQLKEKDPSLSFRRSCREGVCGSDGLNMNGKNGLACITPISALNQPGKKIVIRPLPGLPVIRDLVVDMGQFYAQYEKIKPYLLNNGQNPPAREHLQMPEQREKLDGLYECILCACCSTSCPSFWWNPDKFIGPAGLLAAYRFLIDSRDTETDSRLDGLSDAFSVFRCHSIMNCVSVCPKGLNPTRAIGHIKSMLLQRNA

SEQ ID NO: 758 - protein, 933 aa, Escherichia coli
MQNSALKAWLDSSYLSGANQSWIEQLYEDFLTDPDSVDANWRSTFQQLPGTGVKPDQFHSQTREYFRRLAKDASRYSSTISDPDTNVKQVKVLQLINAYRFRGHQHANLDPLGLWQQDKVADLDPSFHDLTEADFQETFNVGSFASGKETMKLGELLEALKQTYCGPIGAEYMHITSTEEKRWIQQRIESGRATFNSEEKKRFLSELTAAEGLERYLGAKFPGAKRFSLEGGDALIPMLKEMIRHAGNSGTREVVLGMAHRGRLNVLVNVLGKKPQDLFDEFAGKHKEHLGTGDVKYHMGFSSDFQTDGGLVHLALAFNPSHLEIVSPVVIGSVRARLDRLDEPSSNKVLPITIHGDAAVTGQGVVQETLNMSKARGYEVGGTVRIVINNQVGFTTSNPLDARSTPYCTDIGKMVQAPIFHVNADDPEAVAFVTRLALDFRNTFKRDVFIDLVCYRRHGHNEADEPSATQPLMYQKIKKHPTPRKIYADKLEQEKVATLEDATEMVNLYRDALDAGDCVVAEWRPMNMHSFTWSPYLNHEWDEEYPNKVEMKRLQELAKRISTVPEAVEMQSRVAKIYGDRQAMAAGEKLFDWGGAENLAYATLVDEGIPVRLSGEDSGRGTFFHRHAVIHNQSNGSTYTPLQHIHNGQGAFRVWDSVLSEEAVLAFEYGYATAEPRTLTIWEAQFGDFANGAQVVIDQFISSGEQKWGRMCGLVMLLPHGYEGQGPEHSSARLERYLQLCAEQNMQVCVPSTPAQVYHMLRRQALRGMRRPLVVMSPKSLLRHPLAVSSLEELANGTFLPAIGEIDELDPKGVKRVVMCSGKVYYDLLEQRRKNNQHDVAIVRIEQLYPFPHKAMQEVLQQFAHVKDFVWCQEEPLNQGAWYCSQHHFREVIPFGASLRYAGRPASASPAVGYMSVHQKQQQDLVNDALNVE

SEQ ID NO: 759 - protein, 405 aa, Escherichia coli
MSSVDILVPDLPESVADATVATWHKKPGDAVVRDEVLVEIETDKVVLEVPASADGILDAVLEDEGTTVTSRQILGRLREGNSAGKETSAKSEEKASTPAQRQQASLEEQNNDALSPAIRRLLAEHNLDASAIKGTGVGGRLTREDVEKHLAKAPAKESAPAAAAPAAQPALAARSEKRVPMTRLRKRVAERLLEAKNSTAMLTTFNEVNMKPIMDLRKQYGEAFEKRHGIRLGFMSFYVKAVVEALKRYPEVNASIDGDDVVYHNYFDVSMAVSTPRGLVTPVLRDVDTLGMADIEKKIKELAVKGRDGKLTVEDLTGGNFTITNGGVFGSLMSTPIINPPQSAILGMHAIKDRPMAVNGQVEILPMMYLALSYDHRLIDGRESVGFLVTIKELLEDPTRLLLDV

SEQ ID NO: 760 - protein, 388 aa, Escherichia coli
MNLHEYQAKQLFARYGLPAPVGYACTTPREAEEAASKIGAGPWVVKCQVHAGGRGKAGGVKVVNSKEDIRAFAENWLGKRLVTYQTDANGQPVNQILVEAATDIAKELYLGAVVDRSSRRVVFMASTEGGVEIEKVAEETPHLIHKVALDPLTGPMPYQGRELAFKLGLEGKLVQQFTKIFMGLATIFLERDLALIEINPLVITKQGDLICLDGKLGADGNALFRQPDLREMRDQSQEDPREAQAAQWELNYVALDGNIGCMVNGAGLAMGTMDIVKLHGGEPANFLDVGGGATKERVTEAFKIILSDDKVKAVLVNIFGGIVRCDLIADGIIGAVAEVGVNVPVVVRLEGNNAELGAKKLADSGLNIIAAKGLTDAAQQVVAAVEGK

SEQ ID NO: 761 - protein, 289 aa, Escherichia coli
MSILIDKNTKVICQGFTGSQGTFHSEQAIAYGTKMVGGVTPGKGGTTHLGLPVFNTVREAVAATGATASVIYVPAPFCKDSILEAIDAGIKLIITITEGIPTLDMLTVKVKLDEAGVRMIGPNCPGVITPGECKIGIQPGHIHKPGKVGIVSRSGTLTYEAVKQTTDYGFGQSTCVGIGGDPIPGSNFIDILEMFEKDPQTEAIVMIGEIGGSAEEEAAAYIKEHVTKPVVGYIAGVTAPKGKRMGHAGAIIAGGKGTADEKFAALEAAGVKTVRSLADIGEALKTVLK

SEQ ID NO: 762 - protein, 350 aa, Escherichia coli
MNYQNDDLRIKEIKELLPPVALLEKFPATENAANTVAHARKAIHKILKGNDDRLLVVIGPCSIHDPVAAKEYATRLLALREELKDELEIVMRVYFEKPRTTVGWKGLINDPHMDNSFQINDGLRIARKLLLDINDSGLPAAGEFLDMITPQYLADLMSWGAIGARTTESQVHRELASGLSCPVGFKNGTDGTIKVAIDAINAAGAPHCFLSVTKWGHSAIVNTSGNGDCHIILRGGKEPNYSAKHVAEVKEGLNKAGLPAQVMIDFSHANSSKQFKKQMDVCADVCQQIAGGEKAIIGVMVESHLVEGNQSLESGEPLAYGKSITDACIGWEDTDALLRQLANAVKARRG

SEQ ID NO: 763 - protein, 250 aa, Escherichia coli
MAVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 764 - protein, 382 aa, Escherichia coli
MSLKEKTQSLFANAFGYPATHTIQAPGRVNLIGEHTDYNDGFVLPCAIDYQTVISCAPRDDRKVRVMAADYENQLDEFSLDAPIVAHENYQWANYVRGVVKHLQLRNNSFGGVDMVISGNVPQGAGLSSSASLEVAVGTVLQQLYHLPLDGAQIALNGQEAENQFVGCNCGIMDQLISALGKKDHALLIDCRSLGTKAVSMPKGVAVVIINSNFKRTLVGSEYNTRREQCETGARFFQQPALRDVTIEEFNAVAHELDPIVAKRVRHILTENARTVEAASALEQGDLKRMGELMAESHASMRDDFEITVPQIDTLVEIVKAVIGDKGGVRMTGGGFGGCIVALIPEELVPAVQQAVAEQYEAKTGIKETFYVCKPSQGAGQC

SEQ ID NO: 765 - protein, 348 aa, Escherichia coli
MTQFNPVDHPHRRYNPLTGQWILVSPHRAKRPWQGAQETPAKQVLPAHDPDCFLCAGNVRVTGDKNPDYTGTYVFTNDFAALMSDTPDAPESHDPLMRCQSARGTSRVICFSPDHSKTLPELSVAALTEIVKTWQEQTAELGKTYPWVQVFENKGAAMGCSNPHPHGQIWANSFLPNEAEREDRLQKEYFAEQKSPMLVDYVQRELADGSRTVVETEHWLAVVPYWAAWPFETLLLPKAHVLRITDLTDAQRSDLALALKKLTSRYDNLFQCSFPYSMGWHGAPFNGEENQHWQLHAHFYPPLLRSATVRKFMVGYEMLAETQRDLTAEQAAERLRAVSDIHFRESGV

SEQ ID NO: 766 - protein, 490 aa, Escherichia coli
MSSLQILQGTFRLSDTKTLQLPQLTLNAGDSWAFVGSNGSGKSALARALAGELPLLKGERQSQFSHITRLSFEQLQKLVSDEWQRNNTDMLGPGEDDTGRTTAEIIQDEVKDAPRCMQLAQQFGITALLDRRFKYLSTGETRKTLLCQALMSEPDLLILDEPFDGLDVASRQQLAERLASLHQSGITLVLVLNRFDEIPEFVQFAGVLADCTLAETGAKEELLQQALVAQLAHSEQLEGVQLPEPDEPSARHALPANEPRIVLNNGVVSYNDRPILNNLSWQVNPGEHWQIVGPNGAGKSTLLSLVTGDHPQGYSNDLTLFGRRRGSGETIWDIKKHIGYVSSSLHLDYRVSTTVRNVILSGYFDSIGIYQAVSDRQQKLVQQWLDILGIDKRTADAPFHSLSWGQQRLALIVRALVKHPTLLILDEPLQGLDPLNRQLIRRFVDVLISEGETQLLFVSHHAEDAPACITHRLEFVPDGGLYRYVLTKIY

SEQ ID NO: 767 - protein, 477 aa, Escherichia coli
MNKKSLWKLILILAIPCIIGFMPAPAGLSELAWVLFGIYLAAIVGLVIKPFPEPVVLLIAVAASMVVVGNLSDGAFKTTAVLSGYSSGTTWLVFSAFTLSAAFVTTGLGKRIAYLLIGKIGNTTLGLGYVTVFLDLVLAPATPSNTARAGGIVLPIINSVAVALGSEPEKSPRRVGHYLMMSIYMVTKTTSYMFFTAMAGNILALKMINDILHLQISWGGWALAAGLPGIIMLLVTPLVIYTMYPPEIKKVDNKTIAKAGLAELGPMKIREKMLLGVFVLALLGWIFSKSLGVDESTVAIVVMATMLLLGIVTWEDVVKNKGGWNTLIWYGGIIGLSSLLSKVKFFEWLAEVFKNNLAFDGHGNVAFFVIIFLSIIVRYFFASGSAYIVAMLPVFAMLANVSGAPLMLTALALLFSNSYGGMVTHYGGAAGPVIFGVGYNDIKSWWLVGAVLTILTFLVHITLGVWWWNMLIGWNML

SEQ ID NO: 768 - protein, 761 aa, Escherichia coli
MRRYLEHLMIKLSEKGVFLASNNEIIAEEHFTGEIKKEEAKKGTIAWSILSSHNTSGNMDKLKIKFDSLASHDITFVGIVQTAKASGMERFPLPYVLTNCHNSLCAVGGTINGDDHVFGLSAAQRYGGIFVPPHIAVIHQYMREMMAGGGKMILGSDSHTRYGALGTMAVGEGGGELVKQLLNDTWDIDYPGVVAVHLTGKPAPYVGPQDVALAIIGAVFKNGYVKNKVMEFVGPGVSALSTDFRNSVDVMTTETTCLSSVWQTDEEVHNWLALHGRGQDYCQLNPQPMAYYDGCISVDLSAIKPMIALPFHPSNVYEIDTLNQNLTDILREIEIESERVAHGKAKLSLLDKVENGRLKVQQGIIAGCSGGNYENVIAAANALRGQSCGNDTFSLAVYPSSQPVFMDLAKKGVVADLIGAGAIIRTAFCGPCFGAGDTPINNGLSIRHTTRNFPNREGSKPANGQMSAVALMDARSIAATAANGGYLTSASELDCWDNVPEYAFDVTPYKNRVYQGFVKGATQQPLIYGPNIKDWPELGALTDNIVLKVCSKILDEVTTTDELIPSGETSSYRSNPIGLAEFTLSRRDPGYVSRSKATAELENQRLAGNVSELTEVFARIKQIAGQEHIDPLQTEIGSMVYAVKPGDGSAREQAASCQRVIGGLANIAEEYATKRYRSNVINWGMLPLQMAEVPTFEVGDYIYIPGIKAALDNPGTTFKGYVIHEDAPVTEITLYMESLTAEEREIIKAGSLINFNKNRQM

SEQ ID NO: 769 - protein, 427 aa, Escherichia coli
MNTFSVSRLALALAFGVTLTACSSTPPDQRPSDQTAPGTSSRPILSAKEAQNFDAQHYFASLTPGAAAWNPSPITLPAQPDFVVGPAGTQGVTHTTIQAAVDAAIIKRTNKRQYIAVMPGEYQGTVYVPAAPGGITLYGTGEKPIDVKIGLSLDGGMSPADWRHDVNPRGKYMPGKPAWYMYDSCQSKRSDSIGVLCSAVFWSQNNGLQLQNLTIENTLGDSVDAGNHPAVALRTDGDQVQINNVNILGRQNTFFVTNSGVQNRLETNRQPRTLVTNSYIEGDVDIVSGRGAVVFDNTEFRVVNSRTQQEAYVFAPATLSNIYYGFLAVNSRFNAFGDGVAQLGRSLDVDANTNGQVVIRDSAINEGFNTAKPWADAVISNRPFAGNTGSVDDNDEIQRNLNDTNYNRMWEYNNRGVGSKVVAEAKK

SEQ ID NO: 770 - protein, 429 aa, Escherichia coli
MTTDDLAFDQRHIWHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 771 - protein, 384 aa, Escherichia coli [sequence omitted]

SEQ ID NO: 772 - protein, 583 aa, Escherichia coli
MTRQDMNDAVITLNGLEKRFPGMDKPAVAPLDCTIHAGYVTGLVGPDGAGKTTLMRMLAGLLKPDSGSATVIGFDPIKNDGALHAVLGYMPQKFGLYEDLTVMENLNLYADLRSVTGEARKQTFARLLEFTSLGPFTGRLAGKLSGGMKQKLGLACTLVGEPKVLLLDEPGVGVDPISRRELWQMVHELAGEGMLILWSTSYLDEAEQCRDVLLMNEGELLYQGEPKALTQTMAGRSFLMTSPHEGNRKLLQRALKLPQVSDGMIQGKSVRLILKKEATPDDIRHADGMPEININETTPRFEDAFIDLLGGAGTSESPLGAILHTVEGTPGETVIEAKELTKKFGDFAATDHVNFAVKRGEIFGLLGPNGAGKSTTFKMMCGLLVPTSGQALVLGMDLKESSGKARQHLGYMAQKFSLYGNLTVEQNLRFFSGVYGLRGRAQNEKISRMSEAFGLKSIASHATDELPLGFKQRLALACSLMHEPDILFLDEPTSGVDPLTRREFWLHINSMVEKGVTVMVTTHFMDEAEYCDRIGLVYRGKLIASGTPDDLKAQSANDEQPDPTMEQAFIQLIHDWDKEHSNE

SEQ ID NO: 773 - protein, 454 aa, Escherichia coli
MSFDSLGLSPDILRAVAEQGYREPTPIQQQAIPAVLEGRDLMASAQTGTGKTAGFTLPLLQHLITRQPHAKGRRPVRALILTPTRELAAQIGENVRDYSKYLNIRSLVVFGGVSINPQMMKLRGGVDVLVATPGRLLDLEHQNAVKLDQVEILVLDEADRMLDMGFIHDIRRVLTKLPAKRQNLLFSATFSDDIKALAEKLLHNPLEIEVARRNTASDQVTQHVHFVDKKRKRELLSHMIGKGNWQQVLVFTRTKHGANHLAEQLNKDGIRSAAIHGNKSQGARTRALADFKSGDIRVLVATDIAARGLDIEELPHVVNYELPNVPEDYVHRIGRTGRAAATGEALSLVCVDEHKLLRDIEKLLKKEIPRIAIPGYEPDPSIKAEPIQNGRQQRGGGGRGQGGGRGQQQPRRGEGGAKSASAKPAEKPSRRLGDAKPAGEQQRRRRPRKPAAAQ

SEQ ID NO: 774 - protein, 716 aa, Escherichia coli
MALTAALKAQIAAWYKALQEQIPDFIPRAPQRQMIADVAKTLAGEEGRHLAIEAPTGVGKTLSYLIPGIAIAREEQKTLVVSTANVALQDQIYSKDLPLLKKIIPDLKFTAAFGRGRYVCPRNLTALASTEPTQQDLLAFLDDELTPNNQEEQKRCAKLKGDLDTYKWDGLRDHTDIAIDDDLWRRLSTDKASCLNRNCYYYRECPFFVARREIQEAEVVVANHALVMAAMESEAVLPDPKNLLLVLDEGHHLPDVARDALEMSAEITAPWYRLQLDLFTKLVATCMEQFRPKTIPPLAIPERLNAHCEELYELIASLNNILNLYMPAGQEAEHRFAMGELPDEVLEICQRLAKLTEMLRGLAELFLNDLSEKTGSHDIVRLHRLILQMNRALGMFEAQSKLWRLASLAQSSGAPVTKWATREEREGQLHLWFHCVGIRVSDQLERLLWRSIPHIIVTSATLRSLNSFSRLQEMSGLKEKAGDRFVALDSPFNHCEQGKIVIPRMRVEPSIDNEEQHIAEMAAFFRKQVESKKHLGMLVLFASGRAMQRFLDYVTDLRLMLLVQGDQPRYRLVELHRKRVANGERSVLVGLQSFAEGLDLKGDLLSQVHIHKIAFPPIDSPVVITEGEWLKSLNRYPFEVQSLPSASFNLIQQVGRLIRSHGCWGEVVIYDKRLLTKNYGKRLLDALPVFPIEQPEVPEGIVKKKEKTKSPRRRRR

SEQ ID NO: 775 - protein, 361 aa, Escherichia coli
MESGHRFDAQTLHSFIQAVFRQMGSEEQEAKLVADHLIAANLAGHDSHGIGMIPSYVRSWSQGHLQINHHAKTVKEAGAAVTLDGDRAFGQVAAHEAMALGIEKAHQHGIAAVALHNSHHIGRIGYWAEQCAAAGFVSIHFVSVVGIPMVAPFHGRDSRFGTNPFCVVFPRKDNFPLLLDYATSAIAFGKTRVAWHKGVPVPPGCLIDVNGVPTTNPAVMQESPLGSLLTFAEHKGYALAAMCEILGGALSGGKTTHQETLQTSPDAILNCMTTIIINPELFGAPDCNAQTEAFAEWVKASPHDDDKPILLPGEWEVNTRRERQKQGIPLDAGSWQAICDAARQIGMPEETLQAFCQQLAS

SEQ ID NO: 776 - protein, 349 aa, Escherichia coli
MRTLFSQQQWIDMKVLVTGATSGLGRNAVEFLCQKGISVRATGRNEAMGKLLEKMGAEFVPADLTELVSSQAKVMLAGIDTLWHCSSFTSPWGTQQAFDLANVRATRRLGEWAVAWGVRNFIHISSPSLYFDYHHHRDIKEDFRPHRFANEFARSKAASEEVINMLSQANPQTRFTILRPQSLFGPHDKVFIPRLAHMMHHYGSILLPHGGSALVDMTYYENAVHAMWLASQEACDKLPSGRVYNITNGEHRTLRSIVQKLIDELNIDCRIRSVPYPMLDMIARSMERLGRKSAKEPPLTHYGVSKLNFDFTLDITRAQEELGYQPVITLDEGIEKTAAWLRDHGKLPR

SEQ ID NO: 777 - protein, 758 aa, Escherichia coli
MLNQELELSLNMAFARAREHRHEFMTVEHLLLALLSNPSAREALEACSVDLVALRQELEAFIEQTTPVLPASEEERDTQPTLSFQRVLQRAVFHVQSSGRNEVTGANVLVAIFSEQESQAAYLLRKHEVSRLDVVNFISHGTRKDEPTQSSDPGSQPNSEEQAGGEERMENFTTNLNQLARVGGIDPLIGREKELERAIQVLCRRRKNNPLLVGESGVGKTAIAEGLAWRIVQGDVPEVMADCTIYSLDIGSLLAGTKYRGDFEKRFKALLKQLEQDTNSILFIDEIHTIIGAGAASGGQVDAANLIKPLLSSGKIRVIGSTTYQEFSNIFEKDRALARRFQKIDITEPSIEETVQIINGLKPKYEAHHDVRYTAKAVRAAVELAVKYINDRHLPDKAIDVIDEAGARARLMPVSKRKKTVNVADIESVVARIARIPEKSVSQSDRDTLKNLGDRLKMLVFGQDKAIEALTEAIKMARAGLGHEHKPVGSFLFAGPTGVGKTEVTVQLSKALGIELLRFDMSEYMERHTVSRLIGAPPGYVGFDQGGLLTDAVIKHPHAVLLLDEIEKAHPDVFNILLQVMDNGTLTDNNGRKADFRNVVLVMTTNAGVRETERKSIGLIHQDNSTDAMEEIKKIFTPEFRNRLDNIIWFDHLSTDVIHQVVDKFIVELQVQLDQKGVSLEVSQEARNWLAEKGYDRAMGARPMARVIQDNLKKPLANELLFGSLVDGGQVTVALDKEKNELTYGFQSAQKHKAEAAH

SEQ ID NO: 778 - protein, 573 aa, Escherichia coli
MRALLPYLALYKRHKWMLSLGIVLAIVTLLASIGLLTLSGWFLSASAVAGVAGLYSFNYMLPAAGVRGAAITRTAGRYFERLVSHDATFRVLQHLRIYTFSKLLPLSPAGLARYRQGELLNRVVADVDTLDHLYLRVISPLVGAFVVIMVVTIGLSFLDFTLAFTLGGIMLLTLFLMPPLFYRAGKSTGQNLTHLRGQYRQQLTAWLQGQAELTIFGASDRYRTQLENTEIQWLEAQRRQSELTALSQAIMLLIGALAVILMLWMASGGVGGNAQPGALIALFVFCALAAFEALAPVTGAFQHLGQVIASAVRISDLTDQKPEVTFPDTQTRVADRVSLTLRDVQFTYPEQSQQALKGISLQVNAGEHIAILGRTGCGKSTLLQQLTRAWDPQQGEILLNDSPIASLNEAALRQTISVVPQRVHLFSATLRDNLLLASPGSSDEALSEILRRVGLEKLLEDAGLNSWLGEGGRQLSGGELRRLAIARALLHDAPLVLLDEPTEGLDATTESQILELLAEMMREKTVLMVTHRLRGLSRFQQIIVMDNGQIIEQGTHAELLARQGRYYQFKQGL

SEQ ID NO: 779 - protein, 588 aa, Escherichia coli
MNKSRQKELTRWLKQQSVISQRWLNISRLLGFVSGILIIAQAWFMARILQHMIMENIPREALLLPFTLLVLTFVLRAWVVWLRERVGYHAGQHIRFAIRRQVLDRLQQAGPAWIQGKPAGSWATLVLEQIDDMHDYYARYLPQMALAVSVPLLIVVAIFPSNWAAALILLGTAPLIPLFMALVGMGAADANRRNFLALARLSGHFLDRLRGMETLRIFGRGEAEIESIRSASEDFRQRTMEVLRLAFLSSGILEFFTSLSIALVAVYFGFSYLGELDFGHYDTGVTLAAGFLALILAPEFFQPLRDLGTFYHAKAQAVGAADSLKTFMETPLAHPQRGEAELASTDPVTIEAEELFITSPEGKTLAGPLNFTLPAGQRAVLVGRSGSGKSSLLNALSGFLSYQGSLRINGIELRDLSPESWRKHLSWVGQNPQLPAATLRDNVLLARPDASEQELQAALDNAWVSEFLPLLPQGVDTPVGDQAARLSVGQAQRVAVARALLNPCSLLLLDEPAASLDAHSEQRVMEALNAASLRQTTLMVTHQLEDLADWDVIWVMQDGRIIEQGRYAELSVAGGPFATLLAHRQEEI

SEQ ID NO: 780 - protein, 785 aa, Escherichia coli
MASSALTLPFSRIAHAVDSAIPTKSDEKVIWSACTVNCGSRCPLRMHVVDGEIKYVETDNTGDDNYDGLHQVRACLRGRSMRRRVYNPDRLKYPMKRVGARGEGKFERISWEEAYDIIATNMQRLIKEYGNESIYLNYGTGTLGGTMTRSWPPGNTLVARLMNCCGGYLNHYGDYSSAQIAEGLNYTYGGWADGNSPSDIENSKLVVLFGNNPGETRMSGGGVTYYLEQARQKSNARMIIIDPRYTDTGAGREDEWIPIRPGTDAALVNGLAYVMITENLVDQAFLDKYCVGYDEKTLPASAPKNGHYKAYILGEGPDGVAKTPEWASQITGVPADKIIKLAREIGSTKPAFISQGWGPQRHANGEIATRAISMLAILTGNVGINGGNSGAREGSYSLPFVRMPTLENPIQTSISMFMWTDAIERGPEMTALRDGVRGKDKLDVPIKMIWNYAGNCLINQHSEINRTHEILQDDKKCELIVVIDCHMTSSAKYADILLPDCTASEQMDFALDASCGNMSYVIFNDQVIKPRFECKTIYEMTSELAKRLGVEQQFTEGRTQEEWMRHLYAQSREAIPELPTFEEFRKQGIFKKRDPQGHHVAYKAFREDPQANPLTTPSGKIEIYSQALADIAATWELPEGDVIDPLPIYTPGFESYQDPLNKQYPLQLTGFHYKSRVHSTYGNVDVLKAACRQEMWINPLDAQKRGIHNGDKVRIFNDRGEVHIEAKVTPRMMPGVVALGEGAWYDPDAKRVDKGGCINVLTTQRPSPLAKGNPSHTNLVQVEKV

SEQ ID NO: 781 - protein, 540 aa, Escherichia coli
MNLLFHTLLFCFFYLTCFIPNFIRLKIKCAAGYNFAFRYFRTSYLPRIIPRFTDAPLILAKDLSMAGNVQEKQLRWYNIALMSFITVWGFGNVVNNYANQGLVVVFSWVFIFALYFTPYALIVGQLGSTFKDGKGGVSTWIKHTMGPGLAYLAAWTYWVVHIPYLAQKPQAILIALGWAMKGDGSLIKEYSVVALQGLTLVLFIFFMWVASRGMKSLKIVGSVAGIAMFVMSLLYVAMAVTAPAITEVHIATTNITWETFIPHIDFTYITTISMLVFAVGGAEKISPYVNQTRNPGKEFPKGMLCLAVMVAVCAILGSLAMGMMFDSRNIPDDLMTNGQYYAFQKLGEYYNMGNTLMVIYAIANTLGQVAALVFSIDAPLKVLLGDADSKYIPASLCRTNASGTPVNGYFLTLVLVAILIMLPTLGIGDMNNLYKWLLNLNSVVMPLRYLWVFVAFIAVVRLAQKYKPEYVFIRNKPLAMTVGIWCFAFTAFACLTGIFPKMEAFTAEWTFQLALNVATPFVLVGLGLIFPLLARKANSK

SEQ ID NO: 782 - protein, 362 aa, Escherichia coli
MAQIFNFSSGPAMLPAEVLKQAQQELRDWNGLGTSVMEVSHRGKEFIQVAEEAEKDFRDLLNVPSNYKVLFCHGGGRGQFAAVPLNILGDKTTADYVDAGYWAASAIKEAKKYCTPNVFDAKVTVDGLRAVKPMREWQLSDNAAYMHYCPNETIDGIAIDETPDFGADVVVAADFSSTILSRPIDVSRYGVIYAGAQKNIGPAGLTIVIVREDLLGKANIACPSILDYSILNDNGSMFNTPPTFAWYLSGLVFKWLKANGGVAEMDKINQQKAELLYGVIDNSDFYRNDVAKANRSRMNVPFQLADSALDKLFLEESFAAGLHALKGHRVVGGMRASIYNAMPLEGVKALTDFMVEFERRHG

SEQ ID NO: 783 - protein, 427 aa, Escherichia coli
MESLTLQPIARVDGTINLPGSKSVSNRALLLAALAHGKTVLTNLLDSDDVRHMLNALTALGVSYTLSADRTRCEIIGNGGPLHAEGALELFLGNAGTAMRPLAAALCLGSNDIVLTGEPRMKERPIGHLVDALRLGGAKITYLEQENYPPLRLQGGFTGGNVDVDGSVSSQFLTALLMTAPLAPEDTVIRIKGDLVSKPYIDITLNLMKTFGVEIENQHYQQFVVKGGQSYQSPGTYLVEGDASSASYFLAAAAIKGGTVKVTGIGRNSMQGDIRFADVLEKMGATICWGDDYISCTRGELNAIDMDMNHIPDAAMTIATAALFAKGTTTLRNIYNWRVKETDRLFAMATELRKVGAEVEEGHDYIRITPPEKLNFAEIATYNDHRMAMCFSLVALSDTPVTILDPKCTAKTFPDYFEQLARISQAA

SEQ ID NO: 784 - protein, 582 aa, Escherichia coli
MHNDKDLSTWQTFRRLWPTIAPFKAGLIVAGVALILNAASDTFMLSLLKPLLDDGFGKTDRSVLVWMPLVVIGLMILRGITSYVSSYCISWVSGKVVMTMRRRLFGHMMGMPVSFFDKQSTGTLLSRITYDSEQVASSSSGALITVVREGASIIGLFIMMFYYSWQLSIILIVLAPIVSIAIRVVSKRFRNISKNMQNTMGQVTTSAEQMLKGHKEVLIFGGQEVETKRFDKVSNRMRLQGMKMVSASSISDPIIQLIASLALAFVLYAASFPSVMDSLTAGTITVVFSSMIALMRPLKSLTNVNAQFQRGMAACQTLFTILDSEQEKDEGKRVIERATGDVEFRNVTFTYPGRDVPALRNINLKIPAGKTVALVGRSGSGKSTIASLITRFYDIDEGEILMDGHDLREYTLASLRNQVALVSQNVHLFNDTVANNIAYARTEQYSREQIEEAARMAYAMDFINKMDNGLDTVIGENGVLLSGGQRQRIAIARALLRDSPILILDEATSALDTESERAIQAALDELQKNRTSLVIAHRLSTIEKADEIVVVEDGVIVERGTHNDLLEHRGVYAQLHKMQFGQ

SEQ ID NO: 785 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 786 - protein, 362 aa, Escherichia coli
MMKRNILAVIVPALLVAGTANAAEIYNKDGNKVDLYGKAVGLHYFSKGNGENSYGGNGDMTYARLGFKGETQINSDLTGYGQWEYNFQGNNSEGADAQTGNKTRLAFAGLKYADVGSFDYGRNYGVVYDALGYTDMLPEFGGDTAYSDDFFVGRVGGVATYRNSNFFGLVDGLNFAVQYLGKNERDTARRSNGDGVGGSISYEYEGFGIVGAYGAADRTNLQEAQPLGNGKKAEQWATGLKYDANNIYLAANYGETRNATPITNKFTNTSGFANKTQDVLLVAQYQFDFGLRPSIAYTKSKAKDVEGIGDVDLVNYFEVGATYYFNKNMSTYVDYIINQIDSDNKLGVGSDDTVAVGIVYQF

SEQ ID NO: 787 - protein, 336 aa, Escherichia coli
MYYPFVRKALFQLDPERAHEFTFQQLRRITGTPFEALVRQKVPAKPVNCMGLTFKNPLGLAAGLDKDGECIDALGAMGFGSIEIGTVTPRPQPGNDKPRLFRLVDAEGLINRMGFNNLGVDNLVENVKKAHYDGVLGINIGKNKDTPVEQGKDDYLICMEKIYAYAGYIAINISSPNTPGLRTLQYGEALDDLLTAIKNKQNDLQAMHHKYVPIAVKIAPDLSEEELIQVADSLVRHNIDGVIATNTTLDRSLVQGMKNCDQTGGLSGRPLQLKSTEIIRRLSLELNGRLPIIGVGGIDSVIAAREKIAAGASLVQIYSGFIFKGPPLIKEIVTHI

SEQ ID NO: 788 - protein, 92 aa, Escherichia coli
MSKVCIIAWVYGRVQGVGFRYTTQYEAKRLGLTGYAKNLDDGSVEVVACGEEGQVEKLMQWLKSGGPRSARVERVLSEPHHPSGELTDFRIR

SEQ ID NO: 789 - protein, 848 aa, Escherichia coli
MNNNDLFQASRRRFLAQLGGLTVAGMLGPSLLTPRRATAAQAATDAVISKEGILTGSHWGAIRATVKDGRFVAAKPFELDKYPSKMIAGLPDHVHNAARIRYPMVRVDWLRKRHLSDTSQRGDNRFVRVSWDEALDMFYEELERVQKTHGPSALLTASGWQSTGMFHNASGMLAKAIALHGNSVGTGGDYSTGAAQVILPRVVGSMEVYEQQTSWPLVLQNSKTIVLWGSDLLKNQQANWWCPDHDVYEYYAQLKAKVAAGEIEVISIDPVVTSTHEYLGREHVKHIAVNPQTDVPLQLALAHTLYSENLYDKNFLANYCVGFEQFLPYLLGEKDGQPKDAAWAEKLTGIDAETIRGLARQMAANRTQIIAGWCVQRMQHGEQWAWMIVVLAAMLGQIGLPGGGFGFGWHYNGAGTPGRKGVILSGFSGSTSIPPVHDNSDYKGYSSTIPIARFIDAILEPGKVINWNGKSVKLPPLKMCIFAGTNPFHRHQQINRIIEGLRKLETVIAIDNQWTSTCRFADIVLPATTQFERNDLDQYGNHSNRGIIAMKQVVPPQFEARNDFDIFRELCRRFNREEAFTEGLDEMGWLKRIWQEGVQQGKGRGVHLPAFDDFWNNKEYVEFDHPQMFVRHQAFREDPDLEPLGTPSGLIEIYSKTIADMNYDDCQGHPMWFEKIERSHGGPGSQKYPLHLQSVHPDFRLHSQLCESETLRQQYTVAGKEPVFINPQDASARGIRNGDVVRVFNARGQVLAGAVVSDRYAPGVARIHEGAWYDPDKGGEPGALCKYGNPNVLTIDIGTSQLAQATSAHTTLVEIEKYNGTVEQVTAFNGPVEMVAQCEYVPASQVKS

SEQ ID NO: 790 - protein, 306 aa, Escherichia coli
MELKDYYAIMGVKPTDDLKTIKTAYRRLARKYHPDVSKEPDAEARFKEVAEAWEVLSDEQRRAEYDQMWQHRNDPQFNRQFHHGDGQSFNAEDFDDIFSSIFGQHARQSRQRPATRGHDIEIEVAVFLEETLTEHKRTISYNLPVYNAFGMIEQEIPKTLNVKIPAGVGNGQRIRLKGQGTPGENGGPNGDLWLVIHIAPHPLFDIVGQDLEIVVPVSPWEAALGAKVTVPTLKESILLTIPPGSQAGQRLRVKGKGLVSKKQTGDLYAVLKIVMPPKPDENTAALWQQLADAQSSFDPRKDWGKA

SEQ ID NO: 791 - protein, 1320 aa, Escherichia coli
MGTTTMGVKLDDATRERIKSAATRIDRTPHWLIKQAIFSYLEQLENSDTLPELPALLSGAANESDEAPTPAEEPHQPFLDFAEQILPQSVSRAAITAAYRRPETEAVSMLLEQARLPQPVAEQAHKLAYQLADKLRNQKNASGRAGMVQGLLQEFSLSSQEGVALMCLAEALLRIPDKATRDALIRDKISNGNWQSHIGRSPSLFVNAATWGLLFTGKLVSTHNEASLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEESDRLEISLDLLEKLCFEPELAGWNGIGFVIQAYQKRCPLVIDYLIDLATRSRRRLMIRLVKGAYWDSEIKRAQMDGLEGYPVYTRKVYTDVSYLACAKKLLAVPNLIYPQFATHNAHTLAAIYQLAGQNYYPGQYEFQCLHGMGEPLYEQVTGKVADGKLNRPCRIYAPVGTHETLLAYLVRRLLENGANTSFVNRIADTSLPLDELVADPVTAVEKLAQQEGQTGLPHPKIPLPRDLYGHGRDNSAGLDLANEHRLASLSSALLNSALQKWQALPMLEQPVAAGEMSPVINPAEPKDIVGYVREATPREVEQALESAVNNAPIWFATPPAERAAILHRAAVLMESQMQQLIGILVREAGKTFSNAIAEVREAVDFLHYYAGQVRDDFANETHRPLGPVVCISPWNFPLAIFTGQIAAALAAGNSVLAKPAEQTPLIAAQGIAILLEAGVPPGVVQLLPGRGETVGAQLTGDDRVRGVMFTGSTEVATLLQRNIASRLDAQGRPIPLIAETGGMNAMIVDSSALTEQVVVDVLASAFDSAGQRCSALRVLCLQDEIADHTLKMLRGAMAECRMGNPGRLTTDIGPVIDSEAKANIERHIQTMRSKGRPVFQAVRENSEDAREWQSGTFVAPTLIELDDFAELQKEVFGPVLHVVRYNRNQLPELIEQINASGYGLTLGVHTRIDETIAQVTGSAHVGNLYVNRNMVGAVVGVQPFGGEGLSGTGPKAGGPLYLYRLLANRPESALAVTLARQDAKYPVDAQLKAALTQPLNALREWAANRPELQALCTQYGELAQAGTQRLLPGPTGERNTWTLLPRERVLCIADDEQDALTQLAAVLAVGSQVLWPDDALHRQLVKALPSAVSERIQLAKAENITAQPFDAVIFHGDSDQLRALCEAVAARDGTIVSVQGFARGESNILLERLYIERSLSVNTAAAGGNASLMTIG

SEQ ID NO: 792 - protein, 317 aa, Escherichia coli
MYTKIIGTGSYLPEQVRTNADLEKMVDTSDEWIVTRTGIRERHIAAPNETVSTMGFEAATRAIEMAGIEKDQIGLIVVATTSATHAFPSAACQIQSMLGIKGCPAFDVAAACAGFTYALSVADQYVKSGAVKYALVVGSDVLARTCDPTDRGTIIIFGDGAGAAVLAASEEPGIISTHLHADGSYGELLTLPNADRVNPENSIHLTMAGNEVFKVAVTELAHIVDETLAANNLDRSQLDWLVPHQANLRIISATAKKLGMSMDNVVVTLDRHGNTSAASVPCALDEAVRDGRIKPGQLVLLEAFGGGFTWGSALVRF

SEQ ID NO: 793 - protein, 309 aa, Escherichia coli [sequence omitted]

SEQ ID NO: 794 - protein, 244 aa, Escherichia coli
MNFEGKIALVTGASRGIGRAIAETLAARGAKVIGTATSENGAQAISDYLGANGKGLMLNVTDPASIESVLEKIRAEFGEVDILVNNAGITRDNLLMRMKDEEWNDIIETNLSSVFRLSKAVMRAMMKKRHGRIITIGSVVGTMGNGGQANYAAAKAGLIGFSKSLAREVASRGITVNVVAPGFIETDMTRALSDDQRAGILAQVPAGRLGGAQEIANAVAFLASDEAAYITGETLHVNGGMYMV

SEQ ID NO: 795 - protein, 78 aa, Escherichia coli
MSTIEERVKKIIGEQLGVKQEEVTNNASFVEDLGADSLDTVELVMALEEEFDTEIPDEEAEKITTVQAAIDYINGHQA

SEQ ID NO: 796 - protein, 413 aa, Escherichia coli
MSKRRVVVTGLGMLSPVGNTVESTWKALLAGQSGISLIDHFDTSAYATKFAGLVKDFNCEDIISRKEQRKMDAFIQYGIVAGVQAMQDSGLEITEENATRIGAAIGSGIGGLGLIEENHTSLMNGGPRKISPFFVPSTIVNMVAGHLTIMYGLRGPSISIATACTSGVHNIGHAARIIAYGDADVMVAGGAEKASTPLGVGGFGAARALSTRNDNPQAASRPWDKERDGFVLGDGAGMLVLEEYEHAKKRGAKIYAELVGFGMSSDAYHMTSPPENGAGAALAMANALRDAGIEASQIGYVNAHGTSTPAGDKAEAQAVKTIFGEAASRVLVSSTKSMTGHLLGAAGAVESIYSILALRDQAVPPTINLDNPDEGCDLDFVPHEARQVSGMEYTLCNSFGFGGTNGSLIFKKI

SEQ ID NO: 797 - protein, 213 aa, Escherichia coli
MRSKYIVIEGLEGAGKTTARNVVVETLEQLGIRDMVFTREPGGTQLAEKLRSLVLDIKSVGDEVITDKAEVLMFYAARVQLVETVIKPALANGTWVIGDRHDLSTQAYQGGGRGIDQHMLATLRDAVLGDFRPDLTLYLDVTPEVGLKRARARGELDRIEQESFDFFNRTRARYLELAAQDKSIHTIDATQPLEAVMDAIRTTVTHWVKELDA

SEQ ID NO: 798 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 799 - protein, 565 aa, Escherichia coli
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 800 - protein, 366 aa, Escherichia coli
MPYRNCWSKIMKKLINDVQDVLDEQLAGLAKAHPSLTLHQDPVYVTRADAPVAGKVALLSGGGSGHEPMHCGYIGQGMLSGACPGEIFTSPTPDKIFECAMQVDGGEGVLLIIKNYTGDILNFETATELLHDSGVKVTTVVIDDDVAVKDSLYTAGRRGVANTVLIEKLVGAAAERGDSLDACAELGRKLNNQGHSIGIALGACTVPAAGKPSFTLADNEMEFGVGIHGEPGIDRRPFSSLDQTVDEMFDTLLVNGSYHRTLRFWDYQQGSWQEEQQTKQPLQSGDRVIALVNNLGATPLSELYGVYNRLTTRCQQAGLTIERNLIGAYCTSLDMTGFSITLLKVDDETLALWDAPVHTPALNWGK

SEQ ID NO: 801 - protein, 315 aa, Escherichia coli
MPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDEIKSLPNVRTLTLSGMLAEAIRRISNEESISAMFEH

SEQ ID NO: 802 - protein, 283 aa, Escherichia coli
MRTQWPSPAKLNLFLYITGQRADGYHTLQTLFQFLDYGDTISIELRDDGDIRLLTPVEGVEHEDNLIVRAARLLMKTAADSGRLPTGSGANISIDKRLPMGGGLGGGSSNAATVLVALNHLWQCGLSMDELAEMGLTLGADVPVFVRGHAAFAEGVGEILTPVDPPEKWYLVAHPGVSIPTPVIFKDPELPRNTPKRSIETLLKCEFSNDCEVIARKRFREVDAVLSWLLEYAPSRLTGTGACVFAEFDTESEARQVLEQAPEWLNGFVAKGANLSPLHRAML

SEQ ID NO: 803 - protein, 207 aa, Escherichia coli
MPLPDFRLIRLLPLAALVLTACSVTTPKGPGKSPDSPQWRQHQQDVRNLNQYQTRGAFAYISDQQKVYARFFWQQTGQDRYRLLLTNPLGSTELELNAQPGNVQLVDNKGQRYTADDAEEMIGKLTGMPIPLNSLRQWILGLPGDATDYKLDDQYRLSEITYSQNGKNWKVVYGGYDTKTQPAMPANMELTDGGQRIKLKMDNWIVK

SEQ ID NO: 804 - protein, 418 aa, Escherichia coli
MTLLALGINHKTAPVSLRERVSFSPDKLDQALDSLLAQPMVQGGVVLSTCNRTELYLSVEEQDNLQEALIRWLCDYHNLNEEDLRKSLYWHQDNDAVSHLMRVASGLDSLVLGEPQILGQVKKAFADSQKGHMKASELERMFQKSFSVAKRVRTETDIGASAVSVAFAACTLARQIFESLSTVTVLLVGAGETIELVARHLREHKVQKMIIANRTRERAQILADEVGAEVIALSDIDERLREADIIISSTASPLPIIGKGMVERALKSRRNQPMLLVDIAVPRDVEPEVGKLANAYLYSVDDLQSIISHNLAQRKAAAVEAETIVAQETSEFMAWLRAQSASETIREYRSQAEQVRDELTAKALAALEQGGDAQAIMQDLAWKLTNRLIHAPTKSLQQAARDGDNERLNILRDSLGLE

SEQ ID NO: 805 - protein, 1247 aa, Escherichia coli
MSKFLDRFRYFKQKGETFADGHGQLLNTNRDWEDGYRQRWQHDKIVRSTHGVNCTGSCSWKIYVKNGLVTWETQQTDYPRTRPDLPNHEPRGCPRGASYSWYLYSANRLKYPMMRKRLMKMWREAKALHSDPVEAWASIIEDADKAKSFKQARGRGGFVRSSWQEVNELIAASNVYTIKNYGPDRVAGFSPIPAMSMVSYASGARYLSLIGGTCLSFYDWYCDLPPASPQTWGEQTDVPESADWYNSSYIIAWGSNVPQTRTPDAHFFTEVRYKGTKTVAVTPDYAEIAKLCDLWLAPKQGTDAAMALAMGHVMLREFHLDNPSQYFTDYVRRYTDMPMLVMLEERDGYYAAGRMLRAADLVDALGQENNPEWKTVAFNTNGEMVAPNGSIGFRWGEKGKWNLEQRDGKTGEETELQLSLLGSQDEIAEVGFPYFGGDGTEHFNKVELENVLLHKLPVKRLQLADGSTALVTTVYDLTLANYGLERGLNDVNCATSYDDVKAYTPAWAEQITGVSRSQIIRIAREFADNADKTHGRSMIIVGAGLNHWYHLDMNYRGLINMLIFCGCVGQSGGGWAHYVGQEKLRPQTGWQPLAFALDWQRPARHMNSTSYFYNHSSQWRYETVTAEELLSPMADKSRYTGHLIDFNVRAERMGWLPSAPQLGTNPLTIAGEAEKAGMNPVDYTVKSLKEGSIRFAAEQPENGKNHPRNLFIWRSNLLGSSGKGHEFMLKYLLGTEHGIQGKDLGQQGGVKPEEVDWQDNGLEGKLDLVVTLDFRLSSTCLYSDIILPTATWYEKDDMNTSDMHPFIHPLSAAVDPAWEAKSDWEIYKAIAKKFSEVCVGHLGKETDIVTLPIQHDSAAELAQPLDVKDWKKGECDLIPGKTAPHIMVVERDYPATYERFTSIGPLMEKIGNGGKGIAWNTQSEMDLLRKLNYTKAEGPAKGQPMLNTAIDAAEMILTLAPETNGQVAVKAWAALSEFTGRDHTHLALNKEDEKIRFRDIQAQPRKIISSPTWSGLEDEHVSYNAGYTNVHELIPWRTLSGRQQLYQDHQWMRDFGESLLVYRPPIDTRSVKEVIGQKSNGNQEKALNFLTPHQKWGIHSTYSDNLLMLTLGRGGPVVWLSEADAKDLGIADNDWIEVFNSNGALTARAVVSQRVPAGMTMMYHAQERIVNLPGSEITQQRGGIHNSVTRITPKPTHMIGGYAHLAYGFNYYGTVGSNRDEFVVVRKMKNIDWLDGEGNDQVQESVK

SEQ ID NO: 806 - protein, 512 aa, Escherichia coli
MKIRSQVGMVLNLDKCIGCHTCSVTCKNVWTSREGVEYAWFNNVETKPGQGFPTDWENQEKYKGGWIRKINGKLQPRMGNRAMLLGKIFANPHLPGIDDYYEPFDFDYQNLHTAPEGSKSQPIARPRSLITGERMAKIEKGPNWEDDLGGEFDKLAKDKNFDNIQKAMYSQFENTFMMYLPRLCEHCLNPACVATCPSGAIYKREEDGIVLIDQDKCRGWRMCITGCPYKKIYFNWKSGKSEKCIFCYPRIEAGQPTVCSETCVGRIRYLGVLLYDADAIERAASTENEKDLYQRQLDVFLDPNDPKVIEQAIKDGIPLSVIEAAQQSPVYKMAMEWKLALPLHPEYRTLPMVWYVPPLSPIQSAADAGELGSNGILPDVESLRIPVQYLANLLTAGDTKPVLRALKRMLAMRHYKRAETVDGKVDTRALEEVGLTEAQAQEMYRYLAIANYEDRFVVPSSHRELAREAFPEKNGCGFTFGDGCHGSDTKFNLFNSRRIDAIDVTSKTEPHP

SEQ ID NO: 807 - protein, 236 aa, Escherichia coli
MIELVIVSRLLEYPDAALWQHQQEMFEAIAASKNLPKEDAHALGIFLRDLTTMDPLDAQAQYSELFDRGRATSLLLFEHVHGESRDRGQAMVDLLAQYEQHGLQLNSRELPDHLPLYLEYLAQLPQSEAVEGLKDIAPILALLSARLQQRESRYAVLFDLLLKLANTAIDSDKVAEKIADEARDDTPQALDAVWEEEQVKFFADKGCGDSAITAHQRRFAGAVAPQYLNITTGGQH

SEQ ID NO: 808 - protein, 225 aa, Escherichia coli
MQFLNMFFFDIYPYIAGAVFLIGSWLRYDYGQYTWRAASSQMLDRKGMNLASNLFHIGILGIFVGHFFGMLTPHWMYEAWLPIEVKQKMAMFAGGASGVLCLIGGVLLLKRRLFSPRVRATTTGADILILSLLVIQCALGLLTIPFSAQHMDGSEMMKLVGWAQSVVTFHGGASQHLDGVAFIFRLHLVLGMTLFLLFPFSRLIHIWSVPVEYLTRKYQLVRARH

SEQ ID NO: 809 - protein, 302 aa, Escherichia coli
MAAINTKVKKAVIPVAGLGTRMLPATKAIPKEMLPLVDKPLIQYVVNECIAAGITEIVLVTHSSKNSIENHFDTSFELEAMLEKRVKRQLLDEVQSICPPHVTIMQVRQGLAKGLGHAVLCAHPVVGDEPVAVILPDVILDEYESDLSQDNLAEMIRRFDETGHSQIMVEPVADVTAYGVVDCKGVELAPGESVPMVGVVEKPKADVAPSNLAIVGRYVLSADIWPLLAKTPPGAGDEIQLTDAIDMLIEKETVEAYHMKGKSHDCGNKLGYMQAFVEYGIRHNTLGTEFKAWLEEEMGIKK

SEQ ID NO: 810 - protein, 252 aa, Escherichia coli
MHYQPKQDLLNDRIILVTGASDGIGREAAMTYARYGATVILLGRNEEKLRQVASHINEETGRQPQWFILDLLTCTSENCQQLAQRIAVNYPRLDGVLHNAGLLGDVCPMSEQNPQVWQDVMQVNVNATFMLTQALLPLLLKSDAGSLVFTSSSVGRQGRANWGAYAASKFATEGMMQVLADEYQQRLRVNCINPGGTRTAMRASAFPTEDPQKLKTPADIMPLYLWLMGDDSRRKTGMTFDAQPGRKPGISQ

SEQ ID NO: 811 - protein, 891 aa, Escherichia coli
MSSTLREASKDTLQAKDKTYHYYSLPLAAKSLGDITRLPKSLKVLLENLLRWQDGNSVTEEDIHALAGWLKNAHADREIAYRPARVLMQDFTGVPAVVDLAAMREAVKRLGGDTAKVNPLSPVDLVIDHSVTVDRFGDDEAFEENVRLEMERNHERYVFLKWGKQAFSRFSVVPPGTGICHQVNLEYLGKAVWSELQDGEWIAYPDTLVGTDSHTTMINGLGVLGWGVGGIEAEAAMLGQPVSMLIPDVVGFKLTGKLREGITATDLVLTVTQMLRKHGVVGKFVEFYGDGLDSLPLADRATIANMSPEYGATCGFFPIDAVTLDYMRLSGRSEDQVELVEKYAKAQGMWRNPGDEPIFTSTLELDMNDVEASLAGPKRPQDRVALPDVPKAFAASNELEVNATHKDRQPVDYVMNGHQYQLPDGAVVIAAITSCTNTSNPSVLMAAGLLAKKAVTLGLKRQPWVKASLAPGSKVVSDYLAKAKLTPYLDELGFNLVGYGCTTCIGNSGPLPDPIETAIKKSDLTVGAVLSGNRNFEGRIHPLVKTNWLASPPLVVAYALAGNMNINLASEPIGHDRKGDPVYLKDIWPSAQEIARAVEQVSTEMFRKEYAEVFEGTAEWKGINVTRSDTYGWQEDSTYIRLSPFFDEMQATPAPVEDIHGARILAMLGDSVTTDHISPAGSIKPDSPAGRYLQGRGVERKDFNSYGSRRGNHEVMMRGTFANIRIRNEMVPGVEGGMTRHLPDSDVVSIYDAAMRYKQEQTPLAVIAGKEYGSGSSRDWAAKGPRLLGIRVVIAESFERIHRSNLIGMGILPLEFPQGVTRKTLGLTGEEKIDIGDLQNLQPGATVPVTLTRADGSQEVVPCRCRIDTATELTYYQNDGILHYVIRNMLK

SEQ ID NO: 812 - protein, 262 aa, Escherichia coli
MGFLSGKRILVTGVASKLSIAYGIAQAMHREGAELAFTYQNDKLKGRVEEFAAQLGSDIVLQCDVAEDASIDTMFAELGKVWPKFDGFVHSIGFAPGDQLDGDYVNAVTREGFKIAHDISSYSFVAMAKACRSMLNPGSALLTLSYLGAERAIPNYNVMGLAKASLEANVRYMANAMGPEGVRVNAISAGPIRTLAASGIKDFRKMLAHCEAVTPIRRTVTIEDVGNSAAFLCSDLSAGISGEVVHVDGGFSIAAMNELELK

SEQ ID NO: 813 - protein, 495 aa, Escherichia coli
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 814 - protein, 421 aa, Escherichia coli
MSNNEFHQRRLSATPRGVGVMCNFFAQSAENATLKDVEGNEYIDFAAGIAVLNTGHRHPDLVAAVEQQLQQFTHTAYQIVPYESYVTLAEKINALAPVSGQAKTAFFTTGAEAVENAVKIARAHTGRPGVIAFSGGFHGRTYMTMALTGKVAPYKIGFGPFPGSVYHVPYPSDLHGISTQDSLDAIERLFKSDIEAKQVAAIIFEPVQGEGGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERANQLGQRLKNTLIDAKESVPAIAAVRGLGSMIAVEFNDPQTGEPSAAIAQKIQQRALAQGLLLLTCGAYGNVIRFLYPLTIPDAQFDAAMKILQDALSD

SEQ ID NO: 815 - protein, 219 aa, Escherichia coli [sequence omitted]

SEQ ID NO: 816 - protein, 457 aa, Escherichia coli
MTAFSTLNVLPPAQLTNLNELGYLTMTPVQAAALPAILAGKDVRVQAKTGSGKTAAFGLGLLQQIDASLFQTQALVLCPTRELADQVAGELRRLARFLPNTKILTLCGGQPFGMQRDSLQHAPHIIVATPGRLLDHLQKGTVSLDALNTLVMDEADRMLDMGFSDAIDDVIRFAPASRQTLLFSATWPEAIAAISGRVQRDPLAIEIDSTDALPPIEQQFYETSSKGKIPLLQRLLSLHQPSSCVVFCNTKKDCQAVCDALNEVGQSALSLHGDLEQRDRDQTLVRFANGSARVLVATDVAARGLDIKSLELVVNFELAWDPEVHVHRIGRTARAGNSGLAISFCAPEEAQRANIISDMLQIKLNWQTPPANSSIATLEAEMATLCIDGGKKAKMRPGDVLGALTGDIGLDGADIGKIAVHPAHVYVAVRQAVAHKAWKQLQGGKIKGKTCRVRLLK

SEQ ID NO: 817 - protein, 377 aa, Escherichia coli
MKSKVLALLIPALLAAGAAHAAEVYNKDGNKLDLYGKVDGLHYFSDNSAKDGDQSYARLGFKGETQINDQLTGYGQWEYNIQANNTESSKNQSWTRLAFAGLKFADYGSFDYGRNYGVMYDIEGWTDMLPEFGGDSYTNADNFMTGRANGVATYRNTDFFGLVNGLNFAVQYQGNNEGASNGQEGTNNGRDVRHENGDGWGLSTTYDLGMGFSAGAAYTSSDRTNDQVNHTAAGGDKADAWTAGLKYDANNIYLATMYSETRNMTPFGDSDYAVANKTQNFEVTAQYQFDFGLRPAVSFLMSKGRDLHAAGGADNPAGVDDKDLVKYADIGATYYFNKNMSTYVDYKINLLDEDDSFYAANGISTDDIVALGLVYQF

SEQ ID NO: 818 - protein, 500 aa, Escherichia coli
MMTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 819 - protein, 475 aa, Escherichia coli
MMINVQTVAVIGSGTMGAGIAEVAASHGHQVLLYDISAEALTRAIDGIHARLNSRVTRGKLTAETCERTLKRLIPVTDIHALAAADLVIEAASERLEVKKALFAQLAEVCPPQTLLTTNTSSISITAIAAEIKNPERVAGLHFFNPAPVMKLVEVVSGLATAAEVVEQLCELTLSWGKQPVRCHSTPGFIVNRVARPYYSEAWRALEEQVAAPEVIDAALRDGAGFPMGPLELTDLIGQDVNFAVTCSVFNAFWQERRFLPSLVQQELVIGGRLGKKSGLGVYDWRAEREAVVGLEAVSDSFSPMKVEKKSDGVTEIDDVLLIETQGETAQALAIRLARPVVVIDKMAGKVVTIAAAAVNPDSATRKAIYYLQQQGKTVLQIADYPGMLIWRTVAMIINEALDALQKGVASEQDIDTAMRLGVNYPYGPLAWGAQLGWQRILRLLENLQHHYGEERYRPCSLLRQRALLESGYES

SEQ ID NO: 820 - protein, 401 aa, Escherichia coli
MREAFICDGIRTPIGRYGGALSSVRADDLAAIPLRELLVRNPRLDAECIDDVILGCANQAGEDNRNVARMATLLAGLPQSVSGTTINRLCGSGLDALGFAARAIKAGDGDLLIAGGVESMSRAPFVMGKAASAFSRQAEMFDTTIGWRFVNPLMAQQFGTDSMPETAENVAELLKISREDQDSFALRSQQRTAKAQSSGILAEEIVPVVLKNKKGVVTEIQHDEHLRPETTLEQLRGLKAPFRANGVITAGNASGVNDGAAALIIASEQMAAAQGLTPRARIVAMATAGVEPRLMGLGPVPATRRVLERAGLSIHDMDVIELNEAFAAQALGVLRELGLPDDAPHVNPNGGAIALGHPLGMSGARLALAASHELHRRNGRYALCTMCIGVGQGIAMILERV

SEQ ID NO: 821 - protein, 286 aa, Escherichia coli
MSSNTFTLGTKSVNRLGYGAMQLAGPGVFGPPRDRHVAITVLREALALGVNHIDTSDFYGPHVTNQIIREALYPYSDDLTIVTKIGARRGEDASWLPAFSPAELQKAVHDNLRNLGLDVLDVVNLRVMMGDGHGPAEGSIEASLTVLAEMQQQGLVKHIGLSNVTPTQVAEARKIAEIVCVQNEYNIAHRADDAMIDALAHDGIAYVPFFPLGGFTPLQSSTLSDVAASLGATPMQVALAWLLQRSPNILLIPGTSSVAHLRENMAAEKLHLSEEVLSTLDGISRE

SEQ ID NO: 822 - protein, 298 aa, Escherichia coli
MLEKSLATLFALLILATLINRFLLWRLPERKGGEVTLRIRTWWGIVICFSMVISGPRWMTLTFFALISFLALKEYCTLISVHFPRWLYWGIPLNYLLIGFNCFELFLLFIPLAGFLILATGQVLVGDPSGFLHTVSAIFWGWIMTVFALSHAAWLLMLPTTNIQGGALLVLFLLALTESNDIAQYLWGKSCGRRKVVPKVSPGKTLEGLMGGVITIMIASLIIGPLLTPLNTLQALLAGLLIGISGFCGDVVMSAIKRDIGVKDSGKLLPGHGGLLDRIDSLIFTAPVFFYFIRYCCY

SEQ ID NO: 823 - protein, 479 aa, Escherichia coli
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVAFGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 824 - protein, 197 aa, Escherichia coli
MIIRDENYFTDKYELTRTHSEVLEAVKVVKPGKTLDLGCGNGRNSLYLAANGYDVDAWDKNAMSIANVERIKSIENLDNLHTRVVDLNNLTFDRQYDFILSTVVLMFLEAKTIPGLIANMQRCTKPGGYNLIVAAMDTADYPCTVGFPFAFKEGELRRYYEGWERVKYNEDVGELHRTDANGNRIKLRFATMLARKK

SEQ ID NO: 825 - protein, 474 aa, Escherichia coli
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVGKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 826 - protein, 516 aa, Escherichia coli
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 827 - protein, 281 aa, Escherichia coli
MTPILNHYFARINWSGAAAVNIDTLRALHLKHNCTIPFENLDVLLPREIQLDNQSPEEKLVIARRGGYCFEQNGVFERVLRELGFNVRSLLGRVVLSNPPALPPRTHRLLLVELEEEKWIADVGFGGQTLTAPIRLVSDLVQTTPHGEYRLLQEGDDWVLQFNHHQHWQSMYRFDLCEQQQSDYVMGNFWSAHWPQSHFRHHLLMCRHLPDGGKLTLTNFHFTHYENGHAVEQRNLPDVASLYAVMQEQFGLGVDDAKHGFTVDELALVMAAFDTHPEAGK

SEQ ID NO: 828 - protein, 226 aa, Escherichia coli
MIQYLNVFFYDIYPYICATVFFLGSWLRYDYGQYTWRASSSQMLDKRGMVIWSNLFHIGILGIFFGHLFGMLTPHWMYAWFLPVAAKQLMAMVLGGICGVLTLIGGAGLLWRRLTNQRVRATSTTPDIIIMSILLIQCLLGLSTIPFSAQYPDGSEMMKLVGWAQSIVTFRGGSSEMLNGVAFVFRLHLVLGMTIFLLFPFTRLVHVWSAPFEYFTRRYQIVRSRR

SEQ ID NO: 829 - protein, 231 aa, Escherichia coli
MQILKVIGLLMEYPDELLWECKEDALALIRRDAPMLTDFTHNLLNAPLLDKQAEWCEVFDRGRTTSLLLFEHVHAESRDRGQAMVDLLAEYEKVGLQLDCRELPDYLPLYLEYLSVLPDDQAKEGLLNVAPILALLGGRLKQREAPWYALFDALLQLAGSSLSSDSVTKQVNSEERDDTRQALDAVWEEEQVKFIEDNATACDSSPLNQYQRRFSQDVAPQYVDISAGGGK

SEQ ID NO: 830 - protein, 514 aa, Escherichia coli
MKIRSQVGMVLNLDKCIGCHTCSVTCKNVWTGREGMEYAWFNNVETKPGIGYPKNWEDQEEWQGGWVRDVNGKIRPRLGNKMGVITKIFANPVVPQIDDYYEPFTFDYEHLHSAPEGKHIPTARPRSLIDGKRMDKVIWGPNWEELLGGEFEKRARDRNFEAMQKEMYGQFENTFMMYLPRLCEHCLNPSCVATCPSGAIYKREEDGIVLIDQDKCRGWRLCISGCPYKKIYFNWKSGKSEKCIFCYPRIESGQPTVCSETCVGRIRYLGVLLYDADRIEEAASTEREVDLYERQCEVFLDPHDPSVIEEALKQGIPQNVIDAAQRSPVYKMAMDWKLALPLHPEYRTLPMVWYVPPLSPIQSYADAGGLPKSEGVLPAIESLRIPVQYLANMLSAGDTGPVLRALKRMMAMRHYMRSQTVEGVTDTRAIDEVGLSVAQVEEMYRYLAIANYEDRFVIPTSHREMAGDAFAERNGCGFTFGDGCHGSDSKFNLFNSSRIDAINITEVRDKAEGE

SEQ ID NO: 831 - protein, 1246 aa, Escherichia coli
MSKLLDRFRYFKQKGETFADGHGQVMHSNRDWEDSYRQRWQFDKIVRSTHGVNCTGSCSWKIYVKNGLVTWEIQQTDYPRTRPDLPNHEPRGCPRGASYSWYLYSANRLKYPLIRKRLIELWREALKQHSDPVLAWASIMNDPQKCLSYKQVRGRGGFIRSNWQELNQLIAAANVWTIKTYGPDRVAGFSPIPAMSMVSYAAGTRYLSLLGGTCLSFYDWYCDLPPASPMTWGEQTDVPESADWYNSSYIIAWGSNVPQTRTPDAHFFTEVRYKGTKTIAITPDYSEVAKLCDQWLAPKQGTDSALAMAMGHVILKEFHLDNPSDYFINYCRRYSDMPMLVMLEPRDDGSYVPGRMIRASDLVDGLGESNNPQWKTVAVNTAGELVVPNGSIGFRWGEKGKWNLESIAAGTETELSLTLLGQHDAVAGVAFPYFGGIENPHFRSVKHNPVLVRQLPVKNLTLVDGNTCPVVSVYDLVLANYGLDRGLEDENSAKDYAEIKPYTPAWGEQITGVPRQYIETIAREFADTAHKTHGRSMIILGAGVNHWYHMDMNYRGMINMLIFCGCVGQSGGGWAHYVGQEKLRPQTGWLPLAFALDWNRPPRQMNSTSFFYNHSSQWRYEKVSAQELLSPLADASKYSGHLIDFNVRAERMGWLPSAPQLGRNPLGIKAEADKAGLSPTEFTAQALKSGDLRMACEQPDSSSNHPRNLFVWRSNLLGSSGKGHEYMQKYLLGTESGIQGEELGASDGIKPEEVEWQTAAIEGKLDLLVTLDFRMSSTCLFSDIVLPTATWYEKDDMNTSDMHPFIHPLSAAVDPAWESRSDWEIYKGIAKAFSQVCVGHLGKETDVVLQPLLHDSPAELSQPCEVLDWRKGECDLIPGKTAPNIVAVERDYPATYERFTSLGPLMDKLGNGGKGISWNTQDEIDFLGKLNYTKRDGPAQGRPLIDTAIDASEVILALAPETNGHVAVKAWQALGEITGREHTHLALHKEDEKIRFRDIQAQPRKIISSPTWSGLESDHVSYNAGYTNVHELIPWRTLSGRQQLYQDHPWMRAFGESLVAYRPPIDTRSVSEMRQIPPNGFPEKALNFLTPHQKWGIHSTYSENLLMLTLSRGGPIVWISETDARELTIVDNDWVEVFNANGALTARAVVSQRVPPGMTMMYHAQERIMNIPGSEVTGMRGGIHNSVTRVCPKPTHMIGGYAQLAWGFNYYGTVGSNRDEFIMIRKMKNVNWLDDEGRDQVQEAKK

SEQ ID NO: 832 - protein, 1015 aa, Escherichia coli
  unsure (1)..(1015): unsure at all Xaa locations
MDVSRRQFFKICAGGMAGTTVAALGFAPKQALAQARNYKLLRAKEIRNTCTYCSVGCGLLMYSLGDGAKNAREAIYHIEGDPDHPVSRGALCPKGAGLLDYVNSENRLRYPEYRAPGSDKWQRISWEEAFSRIAKLMKADRDANFIEKNEQGVTVNRWLSTGMLCASGASNETGMLTQKFARSLGMLAVDNQARVXHGPTVASLAPTFGRGAMTNHWVDIKNANVVMVMGGNAAEAHPVGFRWAMEAKNNNDATLIVVDPRFTRTASVADIYAPIRSGTDITFLSGVLRYLIENNKINAEYVKHYTNASLLVRDDFAFEDGLFSGYDAEKRQYDKSSWNYQLDENGYAKRDETLTHPRCVWNLLKEHVSRYTPDVVENICGTPKADFLKVCEVLASTSAPDRTTTFLYALGWTQHTVGAQNIRTMAMIQLLLGNMGMAGGGVNALRGHSNIQGLTDLGLLSTSLPGYLTLPSEKQVDLQSYLEANTPKATLADQVNYWSNYPKFFVSLMKSFYGDAAQKENNWGYDWLPKWDQTYDVIKYFNMMDEGKVTGYFCQGFNPVASFPDKNKVVSCLSKLKYMVVIDPLVTETSTFWQNHGESNDVDPASIQTEVFRLPSTCFAEEDGSIANSGRWLQWHWKGQDAPGEARNDGEILAGIYHHLRELYQSEGGKGVEPLMKMSWNYKQPHEPQSDEVAKENNGYALEDLYDANGVLIAKKGQLLSSFAHLRDDGTTASSCWIYTGSWTEQGNQMANRDNSDPSGLGNTLGWAWAWPLNRRVLYNRASADINGKPWDPKRMLIQWNGSKWTGNDIPDFGNAAPGTPTGPFIMQPEGMGRLFAINKMAEGPFPEHYEPIETPLGTNPLHPNVVSNPVVRLYEQDALRMGKKEQFPYVGTTYRLTEHFHTWTKHALLNAIAQPEQFVEISETLAAAKGINNGDRVTVSSKRGFIRAVAVVTRRLKPLNVNGQQVETVGIPIHWGFEGVARKGYIANTLTPNVGDANSQTPEYKAFLVNIEKA

SEQ ID NO: 833 - protein, 346 aa, Escherichia coli
MQNIIRKGGTMKAAVVTKDHHVDVTYKTLRSLKHGEALLKMECCGVCHTDLHVKNGDFGDKTGVILGHEGIGVVAEVGPGVTSLKPGDRASVAWFYEGCGHCEYCNSGNETLCRSVKNAGYSVDGGMAEECIVVADYAVKVPDGLDSAAASSITCAGVTTYKAVKLSKIRPGQWIAIYGLGGLGNLALQYAKNVFNAKVIAIDVNDEQLKLATEMGADLAINSHTEDAAKIVQEKTGGAHAAVVTAVAKAAFNSAVDAVRAGGRVVAVGLPPESMSLDIPRLVLDGIEVVGSLVGTRQDLTEAFQFAAEGKVVPKVALRPLADINTIFTEMEEGKIRGRMVIDFRH

SEQ ID NO: 834 - protein, 574 aa, Escherichia coli
MDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGMVLPELKDIQKVSRAIAFAVGKMAQQQGVAVKTSAEALQQAIDDNFWQAEYRDYRRTSI

SEQ ID NO: 835 - protein, 530 aa, Escherichia coli
MARLFTLSESKYYLMALDAGTGSIRAVIFDLEGNQIAVGQAEWRHLAVPDVPGSMEFDLNKNWQLACECMRQALHNAGIAPEYIAAVSACSMREGIVLYNNEGAPIWACANVDARAAREVSELKELHNNTFENEVYRATGQTLALSAIPRLLWLAHHRSDIYRQASTITMISDWLAYMLSGELAVDPSNAGTTGLLDLTTRDWKPALLDMAGLRADILSPVKETGTLLGVVSSQAAELCGLKAGTPVVVGGGDVQLGCLGLGVVRPAQTAVLGGTFWQQVVNLAAPVTDPEMNVRVNPHVIPGMVQAESISFFTGLTMRWFRDAFCAEEKLIAERLGIDTYTLLEEMASRVPPGSWGVMPIFSDRMRFKTWYHAAPSFINLSIDPDKCNKATLFRALEENAAIVSACNLQQIADFSNIHPSSLVFAGGGSKGKLWSQILADVSGLPVNIPVVKEATALGCAIAAGVGAGIFSSMAETGERLVRWERTHTPDPEKHELYQDSRDKWQAVYQDQLGLVDHGLTTSLWKAPGL

SEQ ID NO: 836 - protein, 511 aa, Escherichia coli
MQTSDTRALPLLCARSVYKQYSGVNVLKGIDFTLHQGEVHALLGGNGAGKSTLMKIIAGITPADSGTLEIEGNNYVRLTPVHAHQLGIYLVPQEPLLFPSLSIKENILFGLAKKQLSMQKMKNLLAALGCQFDLHSLAGSLDVADRQMVEILRGLMRDSRILILDEPTASLTPAETERLFSRLQELLATGVGIVFISHKLPEIRQIADRISVMRDGTIALSGKTSELSTDDIIQAITPAVREKSLSASQKLWLELPGNRPQHAAGTPVLTLENLTGEGFRNVSLTLNAGEILGLAGLVGAGRTELAETLYGLRTLRGGRIMLNGKEINKLSTGERLLRGLVYLPEDRQSSGLNLDASLAWNVCALTHNLRGFWAKTAKDNATLERYRRALNIKFNQPEQAARTLSGGNQQKILIAKCLEASPQVLIVDEPTRGVDVSARNDIYQLLRSIAAQNVAVLLISSDLEEIELMADRVYVMHQGEITHSALTERDINVETIMRVAFGDSQRQEASC

SEQ ID NO: 837 - protein, 470 aa, Escherichia coli
MTHKGDTPMTITPATHAISINPATGEQLSVLPWAGADDIENALQLAAAGFRDWRETNIDYRAEKLRDIGKALRARSEEMAQMITREMGKPINQARAEVAKSANLCDWYAEHGPAMLKAEPTLVENQQAVIEYRPLGTILAIMPWNFPLWQVMRGAVPIILAGNGYLLKHAPNVMGCAQLIAQVFKDAGIPQGVYGWLNADNDGVSQMIKDSRIAAVTVTGSVRAGAAIGAQAGAALKKCVLELGGSDPFIVLNDADLELAVKAAVAGRYQNTGQVCAAAKRFIIEEGIASAFTERFVAAAAALKMGDPRDEENALGPMARFDLRDELHHQVEKTLAQGARLLLGGEKMAGAGNYYPPTVLANVTPEMTAFREEMFGPVAAITIAKDAEHALELANDSEFGLSATIFTTDETQARQMAARLECGGVFINGYCASDARVAFGGVKKSGFGRELSHFGLHEFCNIQTVWKDRI

SEQ ID NO: 838 - protein, 681 aa, Escherichia coli
MTTMNPFLVQSTLPYLAPHFDQIANHHYRPAFDEGMQQKRAEIAAIALNPQMPDFNNTILALEQSGELLTRVTSVFFAMTAAHTNDELQRLDEQFSAELAELANDIYLNGELFARVDAVWQRRESLGLDSESIRLVEVIHQRFVLAGAKLAQADKAKLKVLNTEAATLTSQFNQRLLAANKSGGLVVNDIAQLAGMSEQEIALAAEAAREKGLDNKWLIPLLNTTQQPALAEMRDRATREKLFIAGWTRAEKNDANDTRAIIQRLVEIRAQQATLLGFPHYAAWKIADQMAKTPEAALNFMREIVPAARQRASDELASIQAVIDKQQGGFSAQPWDWAFYAEQVRREKFDLDEAQLKPYFELNTVLNEGVFWTANQLFGIKFVERFDIPVYHPDVRVWEIFDHNGVGLALFYGDFFARDSKSGGAWMGNFVEQSTLNKTHPVIYNVCNYQKPAAGEPALLLWDDVITLFHEFGHTLHGLFARQRYATLSGTNTPRDFVEFPSQINEHWATHPQVFARYARHYQSGAAMPDELQQKMRNASLFNKGYEMSELLSAALLDMRWHCLEENEAMQDVDDFELRALVAENMDLPAIPPRYRSSYFAHIFGGGYAAGYYAYLWTQMLADDGYQWFVEQGGLTRENGLRFREAILSRGNSEDLERLYRQWRGKAPKIMPMLQHRGLNI

SEQ ID NO: 839 - protein, 248 aa, Escherichia coli
MIVLVTGATAGFGECITRRFIQQGHKVIATGRRQERLQELKDELGDNLYIAQLDVRNRAAIEEMLASLPAEWCNIDILVNNAGLALGMEPAHKASVEDWETMIDTNNKGLVYMTRAVLPGMVERNHGHIINIGSTAGSWPYAGGNVYGATKAFVRQFSLNLRTDLHGTAVRVTDIEPGLVGGTEFSNVRFKGDDGKAEKTYQNTVALTPEDVSEAVWWVSTLPAHVNINTLEMMPVTQSYAGLNVHRQ

SEQ ID NO: 840 - protein, 808 aa, Escherichia coli
MSKNERMVGISRRTLVKSTAIGSLALAAGGFSLPFTLRNAAAAVQQAREKVVWGACSVNCGSRCALRLHVKDNEVTWVETDNTGSDEYGNHQVRACLRGRSIRRRINHPDRLNYPMKRVGKRGEGKFERISWDEALDTIASSLKKTVEQYGNEAVYIQYSSGIVGGNMTRSSPSASAVKRLMNCYGGSLNQYGSYSTAQISCAMPYTYGSNDGNSTTDIENSKLVVMFGNNPAETRMSGGGITYLLEKAREKSNAKMIVIDPRYTDTAAGREDEWLPIRPGTDAALVAGIAWVLINENLVDQPFLDKYCVGYDEKTLPADAPKNGHYKAYILGEGDDKTAKTPQWASQITGIPEDRIIKLAREIGTAKPAYICQGWGPQRQANGELTARAIAMLPILTGNVGISGGNSGARESTYTITIERLPVLDNPVKTSISCFSWTDAIDHGPQMTAIRDGVRGKDKLDVPIKFIWNYAGNTLVNQHSDINKTHEILQDESKCEMIVVIENFMTSSAKYADILLPDLMTVEQEDIIPNDYAGNMGYLIFLQPVTSEKFERKPIYWILSEVAKRLGPDVYQKFTEGRTQEQWLQHLYAKMLAKDPALPSYDELKKMGIYKRKDPNGHFVAYKAFRDDPEANPLKTPSGKIEIYSSRLAEIARTWELEKDEVISPLPVYASTFEGWNSPERRTFPLQLFGFHYKSRTHSTYGNIDLLKAACRQEVWINPIDAQKRGIANGDMVRVFNHRGEVRLPAKVTPRILPGVSAMGQGAWHEANMSGDKIDHGGCVNTLTTLRPSPLAKGNPQHTNLVEIEKI

SEQ ID NO: 841 - protein, 467 aa, Escherichia coli
MNTVRSEKDSMGAIDVPADKLWGAQTQRSLEHFRISTEKMPTSLIHALALTKRAAAKVNEDLGLLSEEKASAIRQAADEVLAGQHDDEFPLAIWQTGSGTQSNMNMNEVLANRASELLGGVRGMERKVHPNDDVNKSQSSNDVFPTAMHVAALLALRKQLIPQLKTLTQTLNEKSRAFADIVKIGRTHLQDATPLTLGQEISGWVAMLEHNLKHIEYSLPHVAELALGGTAVGTGLNTHPEYARRVADELAVITCAPFVTAPNKFEALATCDALVQAHGALKGLAASLMKIANDVRWLASGPRCGIGEISIPENEPGSSIMPGKVNPTQCEALTMLCCQVMGNDVAINMGGASGNFELNVFRPMVIHNFLQSVRLLADGMESFNKHCAVGIEPNRERINQLLNESLMLVTALNTHIGYDKAAEIAKKAHKEGLTLKAAALALGYLSEAEFDSWVRPEQMVGSMKAGR

SEQ ID NO: 842 - protein, 603 aa, Escherichia coli
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 843 - protein, 255 aa, Escherichia coli
MFNSDNLRLDGKCAIITGAGAGIGKEIAITFATAGASVVVSDINADAANHVVDEIQQLGGQAFACRCDITSEQELSALADFAISKLGKVDILVNNAGGGGPKPFDMPMADFRRAYELNVFSFFHLSQLVAPEMEKNGGGVILTITSMAAENKNINMTSYASSKAAASHLVRNMAFDLGEKNIRVNGIAPGAILTDALKSVITPEIEQKMLQHTPIRRLGQPQDIANAALFLCSPAASWVSGQILTVSGGGVQELN

SEQ ID NO: 844 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 845 - protein, 288 aa, Escherichia coli
MDVTAKYELIGLMAYPIRHSLSPEMQNKALEKAGLPFTYMAFEVDNDSFPGAIEGLKALKMRGTGVSMPNKQLACEYVDELTPAAKLVGAINTIVNDDGYLRGYNTDGTGHIRAIKESGFDIKGKTMVLLGAGGASTAIGAQGAIEGLKEIKLFNRRDEFFDKALAFAQRVNENTDCVVTVTDLADQQAFAEALASADILTNGTKVGMKPLENESLVNDISLLHPGLLVTECVYNPHMTKLLQQAQQAGCKTIDGYGMLLWQGAEQFTLWTGKDFPLEYVKQVMGFGA

SEQ ID NO: 846 - protein, 252 aa, Escherichia coli
MKTVTVKDLVIGTGAPKIIVSLMAKDIASVKSEALAYREADFDILEWRVDHYADLSNVESVMAAAKILRETMPEKPLLFTFRSAKEGGEQAISTEAYIALNRAAIDSGLVDMIDLELFTGDDQVKETVAYAHAHDVKVVMSNHDFHKTPEAEEIIARLRKMQSFDADIPKIALMPQSTSDVLTLLAATLEMQEQYADRPIITMSMAKTGVISRLAGEVFGSAATFGAVKKASAPGQISVNDLRTVLTILHQA

SEQ ID NO: 847 - protein, 401 aa, Escherichia coli
MRRWVLSCLKRLINRSIMMDFSLTEEQELLLASIRELITTNFPEEYFRTCDQNGTYPREFMRALADNGISMLGVPEEFGGIPADYVTQMLALMEVSKCGAPAFLITNGQCIHSMRRFGSAEQLRKTAESTLETGDPAYALALTEPGAGSDNNSATTTYTRKNGKVYINGQKTFITGAKEYPYMLVLARDPQPKDPKKAFTLWWVDSSKPGIKINPLHKIGWHMLSTCEVYLDNVEVEESDMVGEEGMGFLNVMYNFEMERLINAARSTGFAECAFEDAARYANQRIAFGKPIGHNQMIQEKLALMAIKIDNMRNMVLKVAWQADQHQSLRTSAALAKLYCARTAMEVIDDAIQIMGGLGYTDEARVSRFWRDVRCERIGGGTDEIMIYVAGRQILKDYQNK

SEQ ID NO: 848 - protein, 566 aa, Escherichia coli
MHPTGPHLGPDVLFRESNMKVTLTFNEQRRAAYRQQGLWGDASLADYWQQTARAMPDKIAVVDNHGASYTYSALDHAASCLANWMLAKGIESGDRIAFQLPGWCEFTVIYLACLKIGAVSVPLLPSWREAELVWVLNKCQAKMFFAPTLFKQTRPVDLILPLQNQLPQLQQIVGVDKLAPATSSLSLSQIIADNTSLTTAITTHGDELAAVLFTSGTEGLPKGVMLTHNNILASERAYCARLNLTWQDVFMMPAPLGHATGFLHGVTAPFLIGARSVLLDIFTPDACLALLEQQRCTCMLGATPFVYDLLNVLEKQPADLSALRFFLCGGTTIPKKVARECQQRGIKLLSVYGSTESSPHAVVNLDDPLSRFMHTDGYAAAGVEIKVVDDARKTLPPGCEGEEASRGPNVFMGYFDEPELTARALDEEGWYYSGDLCRMDEAGYIKITGRKKDIIVRGGENISSREVEDILLQHPKIHDACVVAMSDERLGERSCAYVVLKAPHHSLSLEEVVAFFSRKRVAKYKYPEHIVVIEKLPRTTSGKIQKFLLRKDIMRRLTQDVCEEIE

SEQ ID NO: 849 - protein, 792 aa, Escherichia coli
MSNNGSSPLVLWYNQLGMNDVDRVGGKNASLGEMITNLSGMGVSVPNGFATTADAFNQFLDQSGVNQRIYELLDKTDIDDVTQLAKAGAQIRQWIIDTPFQPELENAIREAYAQLSADDENASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKPTLAANRPAIVRRTMGSKKIRMVYAPTQEHGKQVKIEDVPQEQRDIFSLTNEEVQELAKQAVQIEKHYGRPMDIEWAKDGHTGKLFIVQARPETVRSRGQVMERYTLHSQGKIIAEGRAIGHRIGAGPVKVIHDISEMNRIEPGDVLVTDMTDPDWEPIMKKASAIVTNRGGRTCHAAIIARELGIPAVVGCGDATERMKDGENVTVSCAEGDTGYVYAELLEFSVKSSSVETMPDLPLKVMMNVGNPDRAFDFACLPNEGVGLARLEFIINRMIGVHPRALLEFDDQEPQLQNEIREMMKGFDSPREFYVGRLTEGIATLGAAFYPKRVIVRLSDFKSNEYANLVGGERYEPDEENPMLGFRGAGRYVSDSFRDCFALECEAVKRVRNDMGLTNVEIMIPFVRTVDQAKAVVEELARQGLKRGENGLKIIMMCEIPSNALLAEQFLEYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 850 - protein, 348 aa, Escherichia coli
MNRTDELRTARIESLVTPAELALRYPVTPGVATHVTDSRRRIEKILNGEDKRLLVIIGPCSIHDLTAAMEYATRLQSLRNQYQSRLEIVMRTYFEKPRTVVGWKGLISDPDLNGSYRVNHGLELARKLLLQVNELGVPTATEFLDMVTGQFIADLISWGAIGARTTESQIHREMASALSCPVGFKNGTDGNTRIAVDAIRAARASHMFLSPDKNGQMTIYQTSGNPYGHIIMRGGKKPNYHADDIAAACDTLHEFDLPEHLVVDFSHGNCQKQHRRQLEVCEDICQQIRNGSTAIAGIMAESFLREGTQKIVGSQPLTYGQSITDPCLGWEDTERLVEKLASAVDTRF

SEQ ID NO: 851 - protein, 309 aa, Escherichia coli
MVRIYTLTLAPSLDSATITPQIYPEGKLRCTAPVFEPGGGGINVARAIAHLGGSATAIFPAGGATGEHLVSLLADENVPVATVEAKDWTRQNLHVHVEASGEQYRFVMPGAALNEDEFRQLEEQVLEIESGAILVISGSLPPGVKLEKLTQLISAAQKQGIRCIVDSSGEALSAALAIGNIELVKPNQKELSALVNRELTQPDDVRKAAQEIVNSGKAKRVVVSLGPQGALGVDSENCIQVVPPPVKSQSTVGAGDSMVGAMTLKLAENASLEEMVRFGVAAGSAATLNQGTRLCSHDDTQKIYAYLSR

SEQ ID NO: 852 - protein, 222 aa, Escherichia coli
MSTPRQILAAIFDMDGLLIDSEPLWDRAELDVMASLGVDISRRNELPDTLGLRIDMVVDLWYARQPWNGPSRQEVVERVIARAISLVEETRPLLPGVREAVALCKEQGLLVGLASASPLHMLEKVLTMFDLRDSFDALASAEKLPYSKPHPQVYLDCAAKLGVDPLTCVALEDSVNGMIASKAARMRSIVVPAPEAQNDPRFVLADVKLSSLTELTAKDLLG

SEQ ID NO: 853 - protein, 463 aa, Escherichia coli
MNFPLIANIVVFVVLLFALAQTRHKQWSLAKKVLVGLVMGVVFGLALHTIYGSDSQVLKDSVQWFNIVGNGYVQLLQMIVMPLVFASILSAVARLHNASQLGKISFLTIGTLLFTTLIAALVGVLVTNLFGLTAEGLVQGGAETARLNAIESNYVGKVSDLSVPQLVLSFIPKNPFADLTGANPTSIISVVIFAAFLGVAALKLLKDDAPKGERVLAAIDTLQSWVMKLVRLVMQLTPYGVLALMTKVVAGSNLQDIIKLGSFVVASYLGLLIMFAVHGILLGINGVSPLKYFRKVWPVLTFAFTSRSSAASIPLNVEAQTRRLGVPESIASFAASFGATIGQNGCAGLYPAMLAVMVAPTVGINPLDPMWIATLVGIVTVSSAGVAGVGGGATFAALIVLPAMGLPVTLVALLISVEPLIDMGRTALNVSGSMTAGTLTSQWLKQTDKAILDSEDDAELAHH

SEQ ID NO: 854 - protein, 753 aa, Escherichia coli
MSQHNEKNPHQHQSPLHDSSEAKPGMDSLAPEDGSHRPAAEPTPPGAQPTAPGSLKAPDTRNEKLNSLEDVRKGSENYALTTNQGVRIADDQNSLRAGSRGPTLLEDFILREKITHFDHERIPERIVHARGSAAHGYFQPYKSLSDITKADFLSDPNKITPVFVRFSTVQGGAGSADTVRDIRGFATKFYTEEGIFDFVGNNTPIFFIQDAHKFPDFVHAVKPEPHWAIPQGQSAHDTFWDYVSLQPETLHNVMWAMSDRGIPRSYRTMEGFGIHTFRLINAEGKATFVRFHWKPLAGKASLVWDEAQKLTGRDPDFHRRELWEAIEAGDFPEYELGFQLIPEEDEFKFDFDLLDPTKLIPEELVPVQRVGKMVLNRNPDNFFAENEQAAFHPGHIVPGLDFTNDPLLQGRLFSYTDTQISRLGGPNFHEIPINRPTCPYHNFQRDGMHRMGIDTNPANYEPNSINDNWPRETPPGPKRGGFESYQERVEGNKVRERSPSFGEYYSHPRLFWLSQTPFEQRHIVDGFSFELSKVVRPYIRERVVDQLAHIDLTLAQAVAKNLGIELTDDQLNITPPPDVNGLKKDPSLSLYAIPDGDVKGRVVAILLNDEVRSADLLAILKALKAKGVHAKLLYSRMGEVTADDGTVLPIAATFAGAPSLTVDAVIVPCGNIADIADNGDANYYLMEAYKHLKPIALAGDARKFKATIKIADQGEEGIVEADSADGSFMDELLTLMAAHRVWSRIPKIDKIPA

SEQ ID NO: 855 - protein, 450 aa, Escherichia coli
MSQKLKVVTIGGGSSYTPELLEGFIKRYHELPVSELWLVDVEGGKPKLDIIFDLCQRMIDNAGVPMKLYKTLDRREALKDADFVTTQLRVGQLPARELDERIPLSHGYLGQETNGAGGLFKGLRTIPVIFDIVKDVEELCPNAWVINFTNPAGMVTEAVYRHTGFKRFIGVCNIPIGMKMFIRDVLMLKDSDDLSIDLFGLNHMVFIKDVLINGKSRFAELLDGVASGQLKASSVKNIFDLPFSEGLIRSLNLLPCSYLLYYFKQKEMLAIEMGEYYKGGARAQVVQKVEKQLFELYKNPELKVKPKELEQRGGAYYSDAACEVINAIYNDKQAEHYVNIPHHGQIDNIPADWAVEMTCKLGRDGATPHPRITHFDDKVMGLIHTIKGFEIAASNAALSGEFNDVLLALNLSPLVHSDRDAELLAREMILAHEKWLPNFADCIAELKKAH

SEQ ID NO: 856 - protein, 492 aa, Escherichia coli
MTLWINGDWITGQGASRVKRNPVSGEVLWQGNDADAAQVEQACRAARAAFPRWARLSFAERHAVVERFAALLESNKAELTAIIARETGKPRWEAATEVTAMINKIAISIKAYHVRTGEQRSEMPDGAASLRHRPHGVLAVFGPYNFPGHLPNGHIVPALLAGNTIIFKPSELTPWSGEAVMRLWQQAGLPPGVLNLVQGGRETGQALSALEDLDGLLFTGSANTGYQLHRQLSGQPEKILALEMGGNNPLIIDEVADIDAAVHLTIQSAFVTAGQRCTCARRLLLKSGAQGDAFLARLVAVSQRLTPGNWDDEPQPFIGGLISEQAAQQVVTAWQQLEAMGGRPLLAPRLLQAGTSLLTPGIIEMTGVAGVPDEEVFGPLLRVWRYDTFDEAIRMANNTRFGLSCGLVSPEREKFDQLLLEARAGIVNWNKPLTGAASTAPFGGIGASGNHRPSAWYAADYCAWPMASLESDSLTLPATLNPGLDFSDEVVR

SEQ ID NO: 857 - protein, 406 aa, Escherichia coli
MSQPITRENFDEWMIPVYAPAPFIPVRGEGSRLWDQQGKEYIDFAGGIAVNALGHAHPELREALNEQASKFWHTGNGYTNEPVLRLAKKLIDATFADRVFFCNSGAEANEAALKLARKFAHDRYGSHKSGIVAFKNAFHGRTLFTVSAGGQPAYSQDFAPLPADIRHAAYNDINSASALIDDSTCAVIVEPIQGEGGVVPASNAFLQGLRELCNRHNALLIFDEVQTGVGRTGELYAYMHYGVTPDLLTTAKALGGGFPVGALLATEECARVMTVGTHGTTYGGNPLASAVAGKVLELINTPEMLNGVKQRHDWFVERLNTINHRYGLFSEVRGLGLLIGCVLNADYAGQAKQISQEAAKAGVMVLIAGGNVVRFAPALNVSEEEVTTGLDRFAAACEHFVSRGSS

SEQ ID NO: 858 - protein, 268 aa, Escherichia coli
MKFVSFNINGLRARPHQLEAIVEKHQPDVIGLQETKVHDDMFPLEEVAKLGYNVFYHGQKGHYGVALLTKETPIAVRRGFPGDDEEAQRRIIMAEIPSLLGNVTVINGYFPQGESRDHPIKFPAKAQFYQNLQNYLETELKRDNPVLIMGDMNISPTDLDIGIGEENRKRWLRTGKCSFLPEEREWMDRLMSWGLVDTFRHANPQTADRFSWFDYRSKGFDDNRGLRIDLLLASQPLAECCVETGIDYEIRSMEKPSDHAPVWATFRR

SEQ ID NO: 859 - protein, 447 aa, Escherichia coli
MDQTYSLESFLNHVQKRDPNQTEFAQAVREVMTTLWPFLEQNPKYRQMSLLERLVEPERVIQFRVVWVDDRNQIQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSLPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 860 - protein, 653 aa, Escherichia coli
MRLFIAEKPSLARAIADVLPKPHRKGDGFIECGNGQVVTWCIGHLLEQAQPDAYDSRYARWNLADLPIVPEKWQLQPRPSVTKQLNVIKRFLHEASEIVHAGDPDREGQLLVDEVLDYLQLAPEKRQQVQRCLINDLNPQAVERAIDRLRSNSEFVPLCVSALARARADWLYGINMTRAYTILGRNAGYQGVLSVGRVQTPVLGLVVRRDEEIENFVAKDFFEVKAHIVTPADERFTAIWQPSEACEPYQDEEGRLLHRPLAEHVVNRISGQPAIVTSYNDKRESESAPLPFSLSALQIEAAKRFGLSAQNVLDICQKLYETHKLITYPRSDCRYLPEEHFAGRHAVMNAISVHAPDLLPQPVVDPDIRNRCWDDKKVDAHHAIIPTARSSAINLTENEAKVYNLIARQYLMQFCPDAVFRKCVIELDIAKGKFVAKARFLAEAGWRTLLGSKERDEENDGTPLPVVAKGDELLCEKGEVVERQTQPPRHFTDATLLSAMTGIARFVQDKDLKKILRATDGLGTEATRAGIIELLFKRGFLTKKGRYIHSTDAGKALFHSLPEMATRPDMTAHWESVLTQISEKQCRYQDFMQPLVGTLYQLIDQAKRTPVRQFRGIVAPGSGGSADKKKAAPRKRSAKKSPPADEVGSGAIA

SEQ ID NO: 861 - protein, 452 aa, Escherichia coli
MEQYDQIGARLDRLPLARFHYRIFGIISFSLLLTGFLSYSGNVVLAKLVSNGWSNNFLNAAFTSALMFGYFIGSLTGGFIGDYFGRRRAFRINLLIVGIAATGAAFVPDMYWLIFFRFLMGTGMGALIMVGYASFTEFIPATVRGKWSARLSFVGNWSPMLSAAIGVVVIAFFSWRIMFLLGGIGILLAWFLSGKYFIESPRWLAGKGQIAGAECQLREVEQQIEREKSIRLPPLTSYQSNSKVKVIKGTFWLLFKGEMLRRTLVAITVLIAMNISLYTITVWIPTIFVNSGIDVDKSILMTAVIMIGAPVGIFIAALIIDHFPRRLFGSTLLIIIAVLGYIYSIQTTEWAILIYGLVMIFFLYMYVCFASAVYIPELWPTHLRLRGSGFVNAVGRIVAVFTPYGVAALLTHYGSITVFMVLGVMLLLCALVLSIFGIETRKVSLEEISEVN

SEQ ID NO: 862 - protein, 326 aa, Escherichia coli
MKKIPLGTTDITLSRMGLGTWAIGGGPAWNGDLDRQICIDTILEAHRCGINLIDTAPGYNFGNSEVIVGQALKKLPREQVVVETKCGIVWERKGSLFNKVGDRQLYKNLSPESIREEVAASLQRLGIDYIDIYMTHWQSVPPFFTPIAETVAVLNELKSEGKIRAIGAANVDADHIREYLQYGELDIIQAKYSILDRAMENELLPLCRDNGIVVQVYSPLEQGLLTGTITRDYVPGGARANKVWFQRENMLKVIDMLEQWQPLCARYQCTIPTLALAWILKQSDLISILSGATAPEQVRENVAALNINLSDADATLMREMAEALER

SEQ ID NO: 863 - protein, 322 aa, Escherichia coli
MAKRNNDMDNLDVICIGAAIVDIPLQPVSKNIFDVDSYPLERIAMTTGGDAINEATIISRLGHRTALMSRIGKDAAGQFILDHCRKENIDIQSLKQDVSIDTSINVGLVTEDGERTFVTNRNGSLWKLNIDDVDFARFSQAKLLSLASIFNSPLLDGKALTEIFTQAKARQMIICADMIKPRLNETLDDICEALSYVDYLFPNFAEAKLLTGKETLDEIADCFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 864 - protein, 278 aa, Escherichia coli
MLADIRYWENDATNKHYAIAHFNVWNAEMLMGVIDAAEEAKSPVIISFGTGFVGNTSFEDFSHMMVSMAQKATVPVITHWDHGRSMEIIHNAWTHGMNSLMRDASAFDFEENIRLTKEAVDFFHPLGIPVEAELGHVGNETVYEEALAGYHYTDPDQAAEFVERTGCDSLAVAIGNQHGVYTSEPQLNFEVVKRVRDAVSVPLVLHGASGISDADIKTAISLGIAKINIHTELCQAAMVAVKENQDQPFLHLEREVRKAVKERALEKIKLFGSDGKAE

SEQ ID NO: 865 - protein, 347 aa, Escherichia coli
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLAMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 866 - protein, 358 aa, Escherichia coli
MKALARFGKAFGGYKMIDVPQPMCGPEDVVIEIKAAAICGADMKHYNVDSGSDEFNSIRGHEFAGCIAQVGEKVKDWKVGQRVVSDNSGHVCGVCPACEQGDFLCCTEKVNLGLDNNTWGGGFSKYCLVPGEILKIHRHALWEIPDGVDYEDAAVLDPICNAYKSIAQQSKFLPGQDVVVIGTGPLGLFSVQMARIMGAVNIVVVGLQEDVAVRFPVAKELGATAVVNGSTEDVVARCQQICGKDNLGLVIECSGANIALKQAIEMLRPNGEVVRVGMGFKPLDFSINDITAWNKSIIGHMAYDSTSWRNAIRLLASGAIKVKPMITHRIGLSQWREGFDAMVDKTAIKVIMTYDFDE

SEQ ID NO: 867 - protein, 331 aa, Escherichia coli
MTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 868 - protein, 284 aa, Escherichia coli
MQQKMIQFSGDVSLPAVGQGTWYMGEDASQRKTEVAALRAGIELGLTLIDTAEMYADGGAEKVVGEALTGLREKVFLVSKVYPWNAGGQKAINACEASLRRLNTDYLDLYLLHWSGSFAFEETVAAMEKLIAQGKIRRWGVSNLDYADMQELWQLPGGNQCATNQVLYHLGSRGIEYDLLPWCQQQQMPVMAYSPLAQAGRLRNGLLKNAVVNEIAHAHNISAAQVLLAWVISHQGVMAIPKAATIAHVQQNAAVLEVELSSAELAMLDKAYPAPKGKTALDMV

SEQ ID NO: 869 - protein, 361 aa, Escherichia coli
MMKTMRIAAIPGDGIGKEVLPEGIRVLQAAAERWGFALSFEQMEWASCEYYSHHGKMMPDDWHEQLSRFDAIYFGAVGWPDTVPDHISLWGSLLKFRREFDQYVNLRPVRLFPGVPCPLAGKQPGDIDFYVVRENTEGEYSSLGGRVNEGTEHEVVIQESVFTRRGVDRILRYAFELAQSRPRKTLTSATKSNGLAISMPYWDERVEAMAENYPEIRWDKQHIDILCARFVMQPERFDVVVASNLFGDILSDLGPACTGTIGIAPSANLNPERTFPSLFEPVHGSAPDIYGKNIANPIATIWAGAMMLDFLGNGDERFQQAHNGILAAIEEVIAHGPKTPDMKGNATTPQVADAICKIILR

SEQ ID NO: 870 - protein, 561 aa, Escherichia coli
MKKVWLNRYPADVPTEINPDRYQSLVDMFEQSVARYADQPAFVNMGEVMTFRKLEERSRAFAAYLQQGLGLKKGDRVALMMPNLLQYPVALFGILRAGMIVVNVNPLYTPRELEHQLNDSGASAIVIVSNFAHTLEKVVDKTAVQHVILTRMGDQLSTAKGTVVNFVVKYIKRLVPKYHLPDAISFRSALHNGYRMQYVKPELVPEDLAFLQYTGGTTGVAKGAMLTHRNMLANLEQVNATYGPLLHPGKELVVTALPLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFLRIVDRKKDMILVSGFNVYPNEIEDVVMQHPGVQEVAAVGVPSGSSGEAVKIFVVKKDPSLTEESLVTFCRRQLTGYKVPKLVEFRDELPKSNVGKILRRELRDEARGKVDNKA

SEQ ID NO: 871 - protein, 491 aa, Escherichia coli
MAVTQTAQACDLVIFGAKGDLARRKLLPSLYQLEKAGQLNPDTRIIGVGRADWDKAAYTKVVREALETFMKETIDEGLWDTLSARLDFCNLDVNDTAAFSRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 872 - protein, 480 aa, Escherichia coli
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSANDGVAAASEAVNLLRDKGYLMSGDLVIVTQGDVMSTVGSTNTTRILTVE

SEQ ID NO: 873 - protein, 815 aa, Escherichia coli
MIREEVMTLTRREFIKHSGIAAGALVVTSAAPLPAWAEEKGGKILTAGRWGAMNVEVKDGKIVSSTGALAKTIPNSLQSTAADQVHTTARIQHPMVRKSYLDNPLQPAKGRGEDTYVQVSWEQALKLIHEQHDRIRKANGPSAIFAGSYGWRSSGVLHKAQTLLQRYMNLAGGYSGHSGDYSTGAAQVIMPHVVGSVEVYEQQTSWPLILENSQVVVLWGMNPLNTLKIAWSSTDEQGLEYFHQLKKSGKPVIAIDPIRSETIEFFDDNATWIAPNMGTDVALMLGIAHTLMTQGKHDKVFLEKYTTGYPQFEEYLTGKSDNTPKSAVWAAEITGVPEAQIVKLAELMAANRTMLMAGWGIQRQQYGEQKHWMLVTLAAMLGQIGTPGGGFGFSYHYSNGGNPTRVGGVLPEMSAAIAGHASEAADDGGMTAIPVARIVDALENPGGKYQHNGKEQTYPNIKMIWWAGGGNFTHHQDTNRLIKAWQKPEMIVVSECYWTAAAKHADIVLPITTSFERNDLTMTGDYSNQHIVPMKQAVAPQFEARNDFDVFADLAELLKPGGKEIYTEGKDEMAWLKFFYDAAQKGARAQRVTMPMFNAFWQQNKLIEMRHSEKNEQYVRYGDFRADPVKNALGTPSGKIEIYSKTLEKFGYKDCPAHPTWLAPDEWKGTADEKQLQLLTAHPAHRLHSQLNYAELRKKYAIADREPITIHTEDAARFGIANGDLVRVWNKRGQILTGAVVTDGIKKGVVCVHEGAWPDLENGLCKNGSANVLTADIPSSQLANACAGNSALVYIEKYTGNAPKLTAFDQPAVQA

SEQ ID NO: 874 - protein, 474 aa, Escherichia coli
MSRLVVVSNRIAPPDEHAASAGGLAVGILGALKAAGGLWFGWSGETGNEDQPLKKVKKGNITWASFNLSEQDLDEYYNQFSNAVLWPAFHYRLDLVQFQRPAWDGYLRVNALLADKLLPLLQDDDIIWIHDYHLLPFAHELRKRGVNNRIGFFLHIPFPTPEIFNALPTYDTLLEQLCDYDLLGFQTENDRLAFLDCLSNLTRVTTRSAKSHTAWGKAFRTEVYPIGIEPKEIAKQAAGPLPPKLAQLKAELKNVQNIFSVERLDYSKGLPERFLAYEALLEKYPQHHGKIRYTQIAPTSRGDVQAYQDIRHQLENEAGRINGKYGQLGWTPLYYLNQHFDRKLLMKIFRYSDVGLVTPLRDGMNLVAKEYVAAQDPANPGVLVLSQFAGAANELTSALIVNPYDRDEVAAALDRALTMSLAERISRHAEMLDVIVKNDINHWQECFISDLKQIVPRSAESQQRDKVATFPKLA

SEQ ID NO: 875 - protein, 266 aa, Escherichia coli
MTEPLTETPELSAKYAWFFDLDGTLAEIKPHPDQVVVPDNILQGLQLLATASDGALALISGRSMVELDALAKPYRFPLAGVHGAERRDINGKTHIVHLPDAIARDISVQLHTVIAQYPGAELEAKGMAFALHYRQAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 876 - protein, 182 aa, Escherichia coli
MQFNIPTLLTLFRVILIPFFVLVFYLPVTWSPFAAALIFCVAAVTDWFDGFLARRWNQSTRFGAFLDPVADKVLVAIAMVLVTEHYHSWWVTLPAATMIAREIIISALREWMAELGKRSSVAVSWIGKVKTTAQMVALAWLLWRPNIWVEYAGIALFFVAAVLTLWSMLQYLSAARADLLDQ

SEQ ID NO: 877 - protein, 360 aa, Escherichia coli
MTKKGAFTSAFFIYAFSACIIRKSQQHTSEAVMPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 878 - protein, 457 aa, Escherichia coli
MTTRLTRWLTTLDNFEAKMAQLPAVRRYGRLTRATGLVLEATGLQLPLGATCVIERQNGSETHEVESEVVGFNGQRLFLMPLEEVEGVLPGARVYAKNISAEGLQSGKQLPLGPALLGRVLDGSGKPLDGLPSPDTTETGALITPPFNPLQRTPIEHVLDTGVRPINALLTVGRGQRMGLFAGSGVGKSVLLGMMARYTRADVIVVGLIGERGREVKDFIENILGAEGRARSVVIAAPADVSPLLRMQGAAYATRIAEDFRDRGQHVLLIMDSLTRYAMAQREIALAIGEPPATKGYPPSVFAKLPALVERAGNGISGGGSITAFYTVLTEGDDQQDPIADSARAILDGHIVLSRRLAEAGHYPAIDIEASISRAMTALISEQHYARVRTFKQLLSSFQRNRDLVSVGAYAKGSDPMLDKAIALWPQLEGYLQQGIFERADWEASLQGLERIFPTVS

SEQ ID NO: 879 - protein, 454 aa, Escherichia coli
MTMSHNVTPNTSRVELRKTLTLVPVVMMGLAYMQPMTLFDTFGIVSGLTDGHVPTAYAFALIAILFTALSYGKLVRRYPSAGSAYTYAQKSISPTVGFMVGWSSLLDYLFAPMINILLAKIYFEALVPSIPSWMFVVALVAFMTAFNLRSLKSVANFNTVIVVLQVVLIAVILGMVVYGVFEGEGAGTLASTRPFWSGDAHVIPMITGATILCFSFTGFDGISNLSEETKDAERVIPRAIFLTALIGGMIFIFATYFLQLYFPDISRFKDPDASQPEIMLYVAGKAFQVGALIFSTITVLASGMAAHAGVARLMYVMGRDGVFPKSFFGYVHPKWRTPAMNIILVGAIALLAINFDLVMATALINFGALVAFTFVNLSVISQFWIREKRNKTLKDHFQYLFLPMCGALTVGALWVNLEESSMVLGLIWAAIGLIYLACVTKSFRNPVPQYEDVA

SEQ ID NO: 880 - protein, 434 aa, Escherichia coli
MSFNTIIDWNSCTAEQQRQLLMRPAISASESITRTVNDILDNVKARGDEALREYSAKFDKTTVTALKVSAEEIAAASERLSDELKQAMAVAVKNIETFHTAQKLPPVDVETQPGVRCQQVTRPVASVGLYIPGGSAPLFSTVLMLATPASIAGCKKVVLCSPPPIADEILYAAQLCGVQDVFNVGGAQAIAALAFGTESVPKVDKIFGPGNAFVTEAKRQVSQRLDGAAIDMPAGPSEVLVIADSGATPDFVASDLLSQAEHGPDSQVILLTPAADMARRVAEAVERQLAELPRAETARQALNASRLIVTKDLAQCVEISNQYGPEHLIIQTRNARELVDSITSAGSVFLGDWSPESAGDYASGTNHVLPTYGYTATCSSLGLADFQKRMTVQELSKEGFSALASTIETLAAAERLTAHKNAVTLRVNALKEQA

SEQ ID NO: 881 - protein, 356 aa, Escherichia coli
MSTVTITDLARENVRNLTPYQSARRLGGNGDVWLNANEYPTAVEFQLTQQTLNRYPECQPKAVIENYAQYAGVKPEQVLVSRGADEGIELLIRAFCEPGKDAILYCPPTYGMYSVSAETIGVECRTVPTLDNWQLDLQGISDKLDGVKVVYVCSPNNPTGQLINPQDFRTLLELTRGKAIVVADEAYIEFCPQASLAGWLAEYPHLAILRTLSKAFALAGLRCGFTLANEEVINLLMKVIAPYPLSTPVADIAAQALSPQGIVAMRERVAQIIAEREYLIAALKEIPCVEQVFDSETNYILARFKASSAVFKSLWDQGIILRDQNKQPSLSGCLRITVGTREESQRVIDALRAEQV

SEQ ID NO: 882 - protein, 356 aa, Escherichia coli
MMSQKYLFIDRDGTLISEPPSDFQVDRFDKLAFEPGVIPELLKLQKAGYKLVMITNQDGLGTQSFPQADFDGPHNLMMQIFTSQGVQFDEVLICPHLPADECDCRKPKVKLVERYLAEQAMDRANSYVIGDRATDIQLAENMGITGLRYDRETLNWPMIGEQLTRRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 883 - protein, 258 aa, Escherichia coli
MLAKRIIPCLDVRDGQVVKGVQFRNHEIIGDIVPLAKRYAEEGADELVFYDITASSDGRVVDKSWVSRVAEVIDIPFCVAGGIKSLEDAAKILSFGADKISINSPALADPTLITRLADRFGVQCIVVGIDTWYDAETGKYHVNQYTGDESRTRVTQWETLDWVQEVQKRGAGEIVLNMMNQDGVRNGYDLEQLKKVREVCHVPLIASGGAGTMEHFLEAFRDADVDGALAASVFHKQIINIGELKAYLATQGVEIRIC

SEQ ID NO: 884 - protein, 203 aa, Escherichia coli
MLTEQQRRELDWEKTDGLMPVIVQHAVSGEVLMLGYMNPEALDKTLESGKVTFFSRTKQRLWTKGETSGNFLNVVSIAPDCDNDTLLVLANPIGPTCHKGTSSCFGDTAHQWLFLYQLEQLLAERKSADPETSYTAKLYASGTKRIAQKVGEEGVETALAATVHDRFELTNEASDLMYHLLVLLQDQGLDLTTVIENLRKRHQ

SEQ ID NO: 885 - protein, 388 aa, Escherichia coli
MKITISGTGYVGLSNGLLIAQNHEVVALDILPSRVAMLNDRISPIVDKEIQQFLQSDKIHFNATLDKNEAYRDADYVIIATPTDYDPKTNYFNTSSVESVIKDVVEINPYAVMVIKSTVPVGFTAAMHKKYRTENIIFSPEFLREGKALYDNLHPSRIVIGERSERAERFAALLQEGAIKQNIPMLFTDSTEAEAIKLFANTYLAMRVAYFNELDSYAESLGLNSRQIIEGVCLDPRIGNHYNNPSFGYGGYCLPKDTKQLLANYQSVPNNLISAIVDANRTRKDFIADAILSRKPQVVGIYRLIMKSGSDNFRASSIQGIMKRIKAKGVEVIIYEPVMKEDSFFNSRLERDLATFKQQADVIISNRMAEELKDVADKVYTRDLFGSD

SEQ ID NO: 886 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFSAAVAYYDSYRAAVLPANLIQAQRDYFGAHTYKRIDKEGVFHTEWLD

SEQ ID NO: 887 - protein, 293 aa, Escherichia coli
MKMRKGIILAGGSGTRLYPVTMAVSKQLLPIYDKPMIYYPLSTLMLAGIRDILIISTPQDTPRFQQLLGDGSQWGLNLQYKVQPSPDGLAQAFIIGEEFIGGDDCALVLGDNIFYGHDLPKLMEAAVNKESGATVFAYHVNDPERYGVVEFDKNGTAISLEEKPLEPKSNYAVTGLYFYDNDVVQMAKNLKPSARGELEITDINRIYLEQGRLSVAMMGRGYAWLDTGTHQSLIEASNFIATIEERQGLKVSCPEEIAFRKGFIDVEQVRKLAVPLIKNNYGQYLYKMTKDSN

SEQ ID NO: 888 - protein, 297 aa, Escherichia coli
MTNLKAVIPVAGLGMHMLPATKAIPKEMLPIVDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 889 - protein, 456 aa, Escherichia coli
MKKLTCFKAYDIRGKLGEELNEDIAWRIGRAYGEFLKPKTIVLGGDVRLTSETLKLALAKGLQDAGVDVLDIGMSGTEEIYFATFHLGVDGGIEVTASHNPMDYNGMKLVREGARPISGDTGLRDVQRLAEANDFPPVDETKRGRYQQINLRDAYVDHLFGYINVKNLTPLKLVINSGNGAAGPVVDAIEARFKALGAPVELIKVHNTPDGNFPNGIPNPLLPECRDDTRNAVIKHGADMGIAFDGDFDRCFLFDEKGQFIEGYYIVGLLAEAFLEKNPGAKIIHDPRLSWNTVDVVTAAGGTPVMSKTGHAFIKERMRKEDAIYGGEMSAHHYFRDFAYCDSGMIPWLLVAELVCLKDKTLGELVRDRMAAFPASGEINSKLAQPVEAINRVEQHFSREALAVDRTDGISMTFADWRFNLRTSNTEPVVRLNVESRGDVPLMEARTRTLLTLLNE

SEQ ID NO: 890 - protein, 373 aa, Escherichia coli [sequence omitted]

SEQ ID NO: 891 - protein, 286 aa, Escherichia coli
MKMYVVSTKQMLNNAQRGGYAVPAFNIHNLETMQVVVETAANLHAPVIIAGTPGTFTHAGTENLLALVSAMAKQYHHPLAIHLDHHTKFDDIAQKVRSGVRSVMIDASHLPFAQNISRVKEVVDFCHRFDVSVEAELGQLGGQEDDVQVNEADALYTNPAQAREFAEATGIDSLAVAIGTAHGMYASAPALDFSRLENIRQWVNLPLVLHGASGLSTKDIQQTIKLGICKINVATELKNAFSQALKNYLTEHPEATDPRDYLQSAKSAMRDVVSKVIADCGCEGRA

SEQ ID NO: 892 - protein, 321 aa, Escherichia coli
MSGARLHTLLPELTTRQSVMVVGAAVIDVIADAYALPWRGCDIELKQQSVNVGGCALNIAVALKRLGIEAGNALPLGQGVWAEMIRNRMAKEGLISLIDNAEGDNGWCLALVEPDGERTFMSFSGVENQWNRQWLARLTVAPGSLLYFSGYQLASPCGELLVEWLEELQDVTPFIDFGPRIGDIPDALLARIMACRPLVSLNRQEAEIAAERFALSAEITTLGKQWQEKFAAPLIVRLDKEGAWYFSNDASGCIPAFPTQVVDTIGAGDSHAGGVLAGLASGLPLADAVLLGNAVASWVVGHRGGDCAPTREELLLAHKNV

SEQ ID NO: 893 - protein, 308 aa, Escherichia coli
MIEFSHVSKLFGAQKAVNDLNLNFQEGSFSVLIGTSGSGKSTTLKMINRLVEHDSGEIRFAGEEIRSLPVLELRRRMGYAIQSIGLFPHWSVAQNIATVPQLQKWSRARIDDRIDELMALLGLESNLRERYPHQLSGGQQQRVGVARALAADPQVLLMDEPFGALDPVTRGALQQEMTRIHRLLGRTIVLVTHDIDEALRLAEHLVLMDHGEVVQQGNPLTMLTRPANDFVRQFFGRSELGVRLLSLRSVADYVRREERADGEALAEEMTLRDALSLFVARGCEVLPVVNMQGQPCGTLHFQDLLVEA

SEQ ID NO: 894 - protein, 253 aa, Escherichia coli
MAQVAIITASDSGIGKECALLLAQQGFDIGITWHSDEEGAKDTAREVVSHGVRAEIVQLDLGNLPEGALALEKLIQRLGRIDVLVNNAGAMTKAPFLDMAFDEWRKIFTVDVDGAFLCSQIAARQMVKQGQGGRIINITSVHEHTPLPDASAYTAAKHALGGLTKAMALELVRHKILVNAVAPGAIATPMNGMDDSDVKPDAEPSIPLRRFGATHEIASLVVWLCSEGANYTTGQSLIVDGGFMLANPQFNPE

SEQ ID NO: 895 - protein, 413 aa, Escherichia coli
MLMLTKDLSITFCGVKFPNPFCLSSSPVGNCYEMCAKAYDTGWGGVVFKTIGFFIANEVSPRFDHLVKEDTGFIGFKNMEQIAEHPLEENLAALRRLKEDYPDKVLIASIMGENEQQWEELARLVQEAGADMIECNFSCPQMTSHAMGSDVGQSPELVEKYCRAVKRGSTLPMLAKMTPNIGDMCEVALAAKRGGADGIAAINTVKSITNIDLNQKIGMPIVNGKSSISGYSGKAVKPIALRFIQQMRTHPELRDFPISGIGGIETWEDAAEFLLLGAATLQVTTGIMQYGYRIVEDMASGLSHYLADQGFDSLQEMVGLANNNIVPAEDLDRSYIVYPRINLDKCVGCGRCYISCYDGGHQAMEWSEKTRTPHCNTEKCVGCLLCGHVCPVGCIELGEVKFKKGEKEHPVTL

SEQ ID NO: 896 - protein, 506 aa, Escherichia coli [sequence omitted]

SEQ ID NO: 897 - protein, 222 aa, Escherichia coli
MPSLSKEAALVHEALVARGLETPLRPPVHEMDNETRKSLIAGHMTEIMQLLNLDLADDSLMETPHRIAKMYVDEIFSGLDYANFPKITLIENKMKVDEMVTVRDITLTSTCEHHFVTIDGKATVAYIPKDSVIGLSKINRIVQFFAQRPQVQERLTQQILIALQTLLGTNNVAVSIDAVHYCVKARGIRDATSATTTTSLGGLFKSSQNTRHEFLRAVRHHN

SEQ ID NO: 898 - protein, 489 aa, Escherichia coli
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 899 - protein, 362 aa, Escherichia coli
MNNREKEILAILRRNPLIQQNEIADMLQISRSRVAAHIMDLMRKGRIKGKGYILTEQEYCVVVGTINMDIRGMADIRYPQSASHPGTIHCSAGGVGRNIAHNLALLGRDVHLLSVIGDDFYGEMLLEETRRAGVNVSGCVRLHGQSTSTYLAIANRDDQTVLAINDTHLLEQLTPQLLNGSRDLLRHAGVVLADCNLTAEALEWVFTLADEIPVFVDTVSEFKAGKIKHWLAHIHTLKPTLPELEILWGQAITSDADRNTAVNALHQQGVQQLFVYLPDESVYCSEKDGEQFLLTAPAHTTVDSFGADDGFMAGLVYSFLEGYSFRDSARFAVACAAISRASGSLNNPTLSADNALSLVPMV

SEQ ID NO: 900 - protein, 313 aa, Escherichia coli
MREKDYVVIIGSANIDVAGYSHESLNYADSNPGKIKFTPGGVGRNIAQNLALLGNKAWLLSAVGSDFYGQSLLTQTNQSGVYVDKCLIVPGENTSSYLSLLDNTGEMLVAINDMNISNAITAEYLAQHGEFIQRAKVIVADCNISEEALAWILDNAANVPVFVDPVSAWKCVKVRDRLNQIHTLKPNRLEAETLSGIALSGREDVAKVAAWFHQHGLNRLVLSMGGDGVYYSDISGESGWSAPIKTNVINVTGAGDAMMAGLASCWVDGMPFAESVRFAQGCSSMALSCEYTNNPDLSIANVISLVENAECLN

SEQ ID NO: 901 - protein, 828 aa, Escherichia coli
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEDLLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 902 - protein, 394 aa, Escherichia coli
MKNCVIVSAVRTAIGSFNGSLASTSAIDLGATVIKAAIERAKIDSQHVDEVIMGNVLQAGLGQNPARQALLKSGLAETVCGFTVNKVCGSGLKSVALAAQAIQAGQAQSIVAGGMENMSLAPYLLDAKARSGYRLGDGQVYDVILRDGLMCATHGYHMGITAENVAKEYGITREMQDELALHSQRKAAAAIESGAFTAEIVPVNVVTRKKTFVFSQDEFPKANSTAEALGALRPAFDKAGTVTAGNASGINDGAAALVIMEESAALAAGLTPLARIKSYASGGVPPALMGMGPVPATQKALQLAGLQLADIDLIEANEAFAAQFLAVGKNLGFDSEKVNVNGGAIALGHPIGASGARILVTLLHAMQARDKTLGLATLCIGGGQGIAMVIERLN

SEQ ID NO: 903 - protein, 761 aa, Escherichia coli
MNQNLLVTKRDGSTERINLDKIHRVLDWAAEGLHNVSISQVELRSHIQFYDGIKTSDIHETIIKAAADLISRDAPDYQYLAARLAIFHLRKKAYGQFEPPALYDHVVKMVEMGKYDNHLLEDYTEEEFKQMDTFIDHDRDMTFSYAAVKQLEGKYLVQNRVTGEIYESAQFLYILVAACLFSNYPRETRLQYVKRFYDAVSTFKISLPTPIMSGVRTPTRQFSSCVLIECGDSLDSINATSSAIVKYVSQRAGIGINAGRIRALGSPIRGGEAFHTGCIPFYKHFQTAVKSCSQGGVRGGAATLFYPMWHLEVESLLVLKNNRGVEGNRVRHMDYGVQINKLMYTRLLKGEDITLFSPSDVPGLYDAFFADQEEFERLYTKYEKDDSIRKQRVKAVELFSLMMQERASTGRIYIQNVDHCNTHSPFDPAIAPVRQSNLCLEIALPTKPLNDVNDENGEIALCTLSAFNLGAINNLDELEELAILAVRALDALLDYQDYPIPAAKRGAMGRRTLGIGVINFAYYLAKHGKRYSDGSANNLTHKTFEAIQYYLLKASNELAKEQGACPWFNETTYAKGILPIDTYKKDLDTIANEPLHYDWEALRESIKTHGLRNSTLSALMPSETSSQISNATNGIEPPRGYVSIKASKDGILRQVVPDYEHLHDAYELLWEMPGNDGYLQLVGIMQKFIDQSISANTNYDPSRFPSGKVPMQQLLKDLLTAYKFGVKTLYYQNTRDGAEDAQDDLVPSIQDDGCESGACKI

SEQ ID NO: 904 - protein, 376 aa, Escherichia coli
MAYTTFSQTKNDQLKEPMFFGQPVNVARYDQQKYDIFEKLIEKQLSFFWRPEEVDVSRDRIDYQALPEHEKHIFISNLKYQTLLDSIQGRSPNVALLPLISIPELETWVETWAFSETIHSRSYTHIIRNIVNDPSVVFDDIVTNEQIQKRAEGISSYYDELIEMTSYWHLLGEGTHTVNGKTVTVSLRELKKKLYLCLMSVNALEAIRFYVSFACSFAFAERELMEGNAKIIRLIARDEALHLTGTQHMLNLLRSGADDPEMAEIAEECKQECYDLFVQAAQQEKDWADYLFRDGSMIGLNKDILCQYVEYITNIRMQAVGLDLPFQTRSNPIPWINTWLVSDNVQVAPQEVEVSSYLVGQIDSEVDTDDLSNFQL

SEQ ID NO: 905 - protein, 661 aa, Archaeoglobus fulgidus
MMVLEIRNVAVIGAGSMGHAIAEVVAIHGFNVKLMDVSEDQLKRAMEKIEEGLRKSYERGYISEDPEKVLKRIEATADLIEVAKDADLVIEAIPEIFDLKKKVFSEIEQYCPDHTIFATNTSSLSITKLAEATKRPEKFIGMHFFNPPKILKLLEIVWGEKTSEETIRIVEDFARKIDRIIIHVRKDVPGFIVNRIFVTMSNEASWAVEMGEGTIEEIDSAVKYRLGLPMGLFELHDVLGGGSVDVSYHVLEYYRQTLGESYRPSPLFERLFKAGHYGKKTGKGFYDWSEGKTNEVPLRAGANFDLLRLVAPAVNEAAWLIEKGVASAEEIDLAVLHGLNYPRGLLRMADDFGIDSIVKKLNELYEKYNGEERYKVNPVLQKMVEEGKLGRTTGEGFYKYGDGNYEFVKVEKEGKVGVLKLNRPRRANALNPTFLKEVEDALDLLERDEEVRAIVIAGEGKNFCAGADIAMFASGRPEMVTEFSQLGHKVFRKIEMLSKPVIAAIHGAAVGGGFELAMACDLRVMSERAFLGLPELNLGIIPGWGGTQRLAYYVGVSKLKEVIMLKRNIKPEEAKNLGLVAEVFPQERFWDEVMKLAREVAELPPLAVKYLKKVIALGTMPALETGNLAESEAGAVIALTDDVAEGIQAFNYRRKPNFRGR

SEQ ID NO: 906 - protein, 391 aa, Archaeoglobus fulgidus
MGAGITNFGRREASWKDLVVEAGKALFDDVPNLDKKDVDSFFIGAAQPERWTYQTHVAPLAAELLGIKPRRVVARTESACASGQIAIRYAWLAVASGLSDVAVVVGVEKMNTKFMNLSQTSMMNVGNREFDTAMGLTAPPYFAMVAQRHMHLYGTTEDQMALVREKAGEYASANPYAQFQKKISKEDVLNSRMVAPPLKLLDCSGITDGAAALLITTEEKARKFTDTPVWILGGIQRTMANSINEMGEMSDWLSLRYLAKDVYDLFNITPDDIDVAEVHDCFTISEIMEYEELGFCKKGEGGKFIEEGQSYIGGKVAVNPSGGLLANGHPLGATGVRQAWEMVMQFRGEVPDKRYVSGAELGLAHNLSGMAQFHHIMLYSLNRPREVKFGR

SEQ ID NO: 907 - protein, 416 aa, Archaeoglobus fulgidus
MLCMAEWPMDRPELRTIITTYSVPESKLLLNSFIMPKTFYGLAGLQMFAGAMVQFGRRRAFIVTDKGVRALALTVQKMLKGVGIEVEIFDEAKPEVPLSSIKPAAEKMEALQPDLIVAVGGGSVMDMAKASWILYEAPQTDLTNVDAMQPIGLRRKAFLACIPTTAGTGSEATNVAVITDDTVEPHRKEGVVHPELYPDFAVLDPRFVLKMPPNLTLGTGLDALSHAVDCYLCRSSNEISDALAVRATKLVFKYLPLALKYPDNPQIRLKTQIAAMIAGSAFSNGGIGTTHAVAHNIGALFEVHHGMACGVTIPYVIKFYAEVDDKYLSFAEELGVRGGSNEETLKKLIDIFMDFYRKIGAPTTMRDLGIKEDDFKEKLDTFAQYVVKDPTGPFAPRQLTVEEAKELLMDMYYGRL

SEQ ID NO: 908 - protein, 417 aa, Archaeoglobus fulgidus
MLNVMQRWREPSDCCLRRTGSDTTAGRPACRGDIMREVAVIGCGVTKFGHHWEKDHEDLLVEATYEAIADANVELKDVEAVWCGTFYPSTGISGNVFSDTLKFFGKPISRVENYCATGMDNIRNAAFAVASGAYDLVIAAGVEKLMDAGSRGLPPIEGIFSVAMPYVSAPAMFAMAANRAFKEWGWTREDLAMVAVKNHYNGARHPKAHFRSEVTVEKVLKAPMVAYPLGVYDCSAVSDGAAAVVLTRPEIAKEIVGDDYAVIKAVGMAVETMHPWHRPSESFLSFPATVKAAKMAYKMAGIENPRKELDFGIVHDCFTITELINYQDMQLCKPGEGAELIRNGVTAIDGDFPINPDGGLKSFGHPIAASGVRMVAELTKQVLGKAEGLQVKDAEAGFAHNLGGPYSVATVAIVSRP

SEQ ID NO: 909 - protein, 216 aa, Archaeoglobus fulgidus
MDFDEKRRILAERLRDELNLSEKVYNAIKKVPRHLFVPERYRTMAYVDTPLPIGYGQTISAPHMVAIMCELLDLREGERVLEIGTGCGYHAAVTAEIVGKRGLVVSVERIPELAEIAKRNLSALGYENVVVIVGDGSLGYEPMAPYDKIYVTASAPDIPKPLLEQLKIGGKMVIPIGETTQFLYVVERDNGVRKWSWGAVRFVPLYGKYGFRPLEE

SEQ ID NO: 910 - protein, 237 aa, Archaeoglobus fulgidus
MIEAEGISKKFRIPSEKRFTLFEELSAFFKGKRDFVEFWALRDVSFRVKKGETFGIFGPNGSGKSTILKIIAGILYPDTGSLSVSGKVTPILELGVGFNPELTAKENVYLYGVIMGMSKEEIRSKIEEIFRFAELEKFKNMKLKNYSSGMYARLAFATAVATEPEILLIDEVLAVGDIYFQRKCIGRIRELKQNGTTIVLVSHSPNTLLELCDRVMLIEAGTVKAIGEPGKVLEGYL

SEQ ID NO: 911 - protein, 196 aa, Archaeoglobus fulgidus [sequence omitted]

SEQ ID NO: 912 - protein, 375 aa, Archaeoglobus fulgidus
MDWIEREKKHILQTYTRQKVVIERGEGCYVYDVNGKRYLDLVAGIATVSIGHCNSHLVERLKEQLEKLIHISNLYYTTPQVELAEKLSEIAGMDRFFFCNSGAEAVEAALKFARRATGRKKFVSFTGDFHGRTMGALSVTHKEKFRKPFEPLVSPVEFAEFNNPESLEKVVDEETAAVIVELVQGEAGVYPADREFVKAIEELREKYGFLLIVDEVQTGFGRTGRWFAKDHYGIEPDMITMAKAMGSGVPIGCCALKEEVAEKIQVGDHGSTFGGNPLACTAALATIEVIEREGLVENSARMGEYFVKRLKESFENVIGVGLMIGFDVGDAAEFVRKCLENGLLVNNTSERRIRLVPPLVITEREVDKAVEIMLN

SEQ ID NO: 913 - protein, 542 aa, Archaeoglobus fulgidus
MELKYKIGFPSLYYPKISLADRIDAAAEKFGEKTAIISAEPKFPSEFPESMNFLEICEVTKKLASGISRKGVRKGEHVGVCIPNSIDYVMTIYALWRVAATPVPINPMYKSFELEHILNDSEATTLVVHSMLYENFKPVLEKTGVERVFVVGGEVNSLSEVMDSGSEDFENVKVNPEEDVALIPYTGGTTGMPKGVMLTHFNLAANALQLAVATGLSHMDTIVGCMPMFHSAEFGLVNLMVTVGNEYVVMGMFNQEMLAENIEKYKGTFSWAVPPALNVLVNTLESSNKTYDWSYLKVFATGAWPVAPALVEKLLKLAAEKCNNPRLRHNQIWGMTEACPMVTTNPPLRLDKSTTQGVPMSDIELKVISLEDGRELGVGESGEIVIRGPNIFKGYWKREKENQECWWYDEKGRKFFRTGDVGFIDEEGFLHFQDRVKEVIKYKGYTIAPFELEALLMKHEAVMDVAVIGKPDEEAGEVPKAFIVLKPEYRGKVDEEDIIEWVRERISGYKRVREVEFVEELPRTASGKLLRRLLREKEAEKG

SEQ ID NO: 914 - protein, 299 aa, Archaeoglobus fulgidus
MMRHLISIGDLDREDINYILKKAEEFEDVARGEKKLRILEGKILGNLFFEPSTRTRMSFETAMKRLGGDVINMTAQEASSIAKGETLADTIRVVSGYCDAIVIRHPLEGAARFAAENSSVPVINAGDGAGQHPTQTLLDLYTIKKECGRLDGITIALMGDLKYSRTIHSLIKALALFDMRIYLISPEALALPEDIIEDVSAEIRRARLEEVISEIDVLYVTRIQKERFPDEEEYRKVSGSYRITAETLKSAKDSMIVMHPLPRVDEIHPSVDSTKHARYFQQSFYGVPVRMAILSEVML

SEQ ID NO: 915 - protein, 153 aa, Archaeoglobus fulgidus
MRELVVSKIKEGTVIDHINAGKALLVLKILKIQPGTDLTVSMAMNVPSSKMGKKDIVKVEGMFIRDEELNKIALISPNATINLIRDYEIERKFKVSPPEVVEGVLKCPNHACISNAEREPITPKFYIKTEEMRATARCHYCGRKIENLDNYIS

SEQ ID NO: 916 - protein, 226 aa, Archaeoglobus fulgidus
MKVLILRPAELLSETIRRFREEGFDAYGCPFIKLIYTDFDVPEHDFAIVTSQNAARVLRERGVRLKRVIAIGKKTAELIEAEEVLLPSKFDSETLYEEFAEMLRGKRVVAFRSNAGSEAVKRLSEVADFREIQVYRIEKLQGEEQRREVEKVREGFYDAIVFSSSMIARSLLELCDEKCLEALKNIFVVAIGPPTAKVLAEKGIRAEIPEEYTFDGVIELLKSKKM

SEQ ID NO: 917 - protein, 359 aa, Archaeoglobus fulgidus
MVTGIVFHEEYLKHEQSPTHPERRERLAYTMDQLREEGIFESERIVLLEPFKASLEDVLEVHTEEYVRFLEMESKKGGIIDFDTNIPVGVFDRALLAAGGAIRAAQAVLNKECENAFAMIRPPGHHAKPYIGAGFCYLNNMAIMVKWLLKQGFERIAILDWDAHHGDGTQEIFYNDDRVLFISTHQMPLYPGTGYPEECGTGKGEGYTVNIPLPPGTGDEGYMMVIDEIIEPVVNEFKPQFIAISAGQDNHFTDPITSLALTARGYAEMMRRAVAMAEKHCDGRLVAVLEGGYSVEGALPYTNLGIIAAMAGFDLSAIREPENYLPELLWRKRDSALVKLKHNIEDVKRVHSKYWKCFK

SEQ ID NO: 918 - protein, 436 aa, Archaeoglobus fulgidus
MAIEVELHKLREWMWKYSLGRDGGNNSDHFLRIKIPGGIISPDRLRGVAELSDKYGRGYAEITTRQDIQLHWIEAEDALEIFAEMEKLGFTTDLCSQAFAETCHGDVRNAVCCPLSGKKGYDAYWLVREITDFFSGNPDYVSLPHKFKIGISTCESNCIREEAQDLAMQWNGEGFVPLVGGGLGASKPGVRKAKSLRIVVYEEDAFDFIRTVIDIYKDFRAERKAEARFKNFFETAGCEWLRREIELRMGVKFDLADDFNCNPPSEHTEGLQDDGSNYYTLPVFAGILDSERLSFIAEVAEEFDGGIRLTPWQNVVFTDIDDLKALKERLSEQFDLSAPRMHIACASNFCGKTLVHAKDVLRHIPASDRFVGVSGCSNACACHPLAEIGLCGKVKAGKQLYDVFIHGWKEAENLSVEEAVELIKKHLGDGYGAKAD

SEQ ID NO: 919 - protein, 896 aa, Archaeoglobus fulgidus
MKVSRRDFIKLSAATAFASGLGLGYFQKSRGVQQNAGEIKTVRSVCSPNCTGACGFDALVYNGRIETLTQAADYPEPEYNPRGCLRGQSMMNLIYGPDRLKRPLIRVGKRGEGKFKAVSWDEALDYVADRLADIMKRHGPESVAISIQVPGTGYVHKGAMMRLASMFGWSALHGYTMNGDLPAFWSQTFGVQTEEFESLEWTNSKYIAIFGSNIMVTRLPDAKFVNIAAERGAKVVVVDPNFSPTAAKADEWVQINPSTDSAFALAIAREIIENRLYDEEFIKTYTDMPLLVRMDTQKRLMAKEVKELEEIAGKLNVPEYRDVFVVYDVNEGFKPVNPETLERDFEPAIEGEFEVELVDGKRVKVKPVFQLLKEEVQKYTPEKVAEIITPPNRNKGEYVDMIKRLAFEMATVKPLHIIYGASNYQWYHGDLKGRALALIVALTGNLGKSGAGISTYAGQFKIRWPLGAWWSFKGRKNKWVTYLLWMNKEYRQSEEFKKYNRETPYPKNDVKAFLFGWNNPFDQHNMANRMIEYAENGDLELIVAIDFQMTTSCKWADVVLPGVAWYEKYELTATILHPYVQLQQPAIEPLFECMPEIWIFKELAKRLVQKWNDEELKSSISEFYPDPELFDEEERARKDGTWSFRLARNIAHKASLKAVELMLKTGGELVEGITLEKLLKGPVRLNLPTPNKRQIPFWEQINLKKPFPPQSYPVPLQKTARFVKSGRIEFYKEEDVFIDLGETLPVHKDPFVDTEYRLNPEAKRKYRYFYITRNALYRVHSTHSNNITMLELQDFRPRVWLHPITAKENGIAEGDLVEVYNDRGRVYGYAVLDEGLHPSVIIFEQGWWSRYLRGTSYNSLTFPWIKPTHIVYFVPGIWEPTTAWNEVACAVRKVEV

SEQ ID NO: 920 - protein, 540 aa, Archaeoglobus fulgidus
MRYNLTIKKTLFFPLHAFPNKEIVYRDINRYTYRRFYERLQRVASSLENIGARGAKIAFIDWNTHQYLEGMFAIPMMGSILHCVNLRLAPEEIVYTMRYVEDDFVVIRDEFLPLAEKLAPHVPSVKGWIVTGDDVDKVETSLKPVYIWEDLVKEGSSYDFPELDEHETAVVYFTSGTTGLPKAVHFSHRQVVMQCIINGLALSANESPARMSSADTIMHIPPFFHGMGWTFPYLATMLGMKQVLPGRYEPQVMLDLIKNEGVTFAGGVPVFLKMLIEHPEAEKYKDALSKFKFVCDGEHPQRVLFERAKQLGIKMIEAFGMSEGVGFTFAVLKDHMLDWDWERQVEYLNKAGLPAPFVEVRIVDDEGKEVPRDFQTMGEILIRSPGLTEGYWKNPEKTAESWDEEGWFHTGDLGVWDEEGYILILDRAKDVIKSGGEWISSVRLEGYILEHPAVSEAAVVAARSEKWSERPIAVVVPKPGMSVTEKEIIDFLMKNFVETGKMAKWWLPDRVFIVDEMPRTTVGKINKRAIREKYKDLVLP

SEQ ID NO: 921 - protein, 662 aa, Archaeoglobus fulgidus
MEPKILWEPDSEFIKNSNLAEFVEWLSSNKGLDFVVSENARENVENYKNLWKWSVENLEDFWESVWEFFEIKSYSDYKTVLDERKMPGAKWFEGATLNYAEHAFLKAGEGEAVVYVREDGLRRALTWSELERQTAAFAAWLKDMGVKKGDRVVAYCSQVPEAVIALLATASIGAIWAAVGGEVAPRAVIDRFKQLEPKVLIASDGHFYNGKEFNKLEDIKTVVSGIPSLERVVLIPNLYESHDLKLSIPLHYWEETVDRKEKLTFEPLPFDHPLWVLYTSGTTGIPKPIVHGHGGITVEIFKGSFHMDFKEGDRFLWYSPPSWMMWNTVVSGLLAGATIVFYDGSPLYNFLQPLWQICEKEKLNIFGTSAPFLHGCMKFGLQPGSQYDLSSLRMVGSTAAPLSPEGFEWVYRNVKEDVWLNSASGGTDVMTGFVGGCPILPVWSGELQCRWLGTKVEAYNIEGKPVINEVGELVIELPMPSMPLYFWNDKDFSWYKESYFSMFPNVWWHGDWLMITDRGTAIIFGRSDSTIKRKGVRMGTLDFYKVVESMNEIISSLVVEVKGKIFLFVVPAHGIEVNEELKEKINRALKENLGAYFVADYIIPVPDIPMTLNYKKLEVPIKKILLGWEVEKAVNLDSIMNPDAVFKVVEAAKPYVEQLEGE

SEQ ID NO: 922 - protein, 410 aa, Archaeoglobus fulgidus
MHFEFNEEQRMIANAARDIAKDFPPEYWREKEENGEFAEEFFKAVCDAGFMGIVIPEEYGGGGYGMTELLIAMEELSANGCGAGGVWYFVLTEVFGALPIVRYGTEEQKEKYLPKIAKGEMEFCMALTEPDAGTNTLRIKTFAEKDGEEYVINGNKIFISGVDRAKGMLLVARTTPPEKAPRRTLGITLFLVDLPNEAVKWNPIPKHAINFSKTCEVSINNLRVESNAILGEKDLGWYLLLDVLNPERMSAAAGAIGGAKLAISKAVEYSKQRKVFADPIGSYQGLQFPLAEAYAALECARLMMYKAAWLYDTKFAAEDVKDPKKRVEMAAVFREIGDAANMAKAVAVENALKAVYWAMQTFGGYGYAKEYDVERWWREVNLLRLAPITQQMALNYIAEHILGMPRSYRV

SEQ ID NO: 923 - protein, 601 aa, Archaeoglobus fulgidus
MKVVKDPELKIERKESLNKMLWNTVQSHPRVSAIGYWDDGKLKYLTYEEFWERVRKLSKFLISSGLRKGDRVAIYADTRYEWEIADFAVLTAGGVVVTVHSVLNREQVEYILRDSESRVVFTEKKYAENVPEDFEVYFLEELEKLVGEVSDDEFESRWKSVEPDDLASIVYTSGTTGEPKGAMLTHWNWRFNCHSVMSITPFYPGEPHICYLPLSHVYQRLVFFAGISRAATAVFCSPQQFLETSTAVKPVGLIVVPRILERVNAGIVEKVEKSPALAKKIFYWSRGVAIECGKRMSRGEKYGFWLNIKRIIADRLVFSKIRENLGLTRIRFVCSSAAELQKELAYMFNGMGIPVIEGYGMTETAAPSNLNPVGRFKPGTVGPPIPGIEEAIAEDGEILVRGDNVMKGYWRKEAETRKTFTEDGWLKTGDLGEFDEDGYLVFLGRKKHIIVLDTGKNVSPVPIEEELLKNPLVSDAVIIGDGKPYVTTLIVPNFSMLLEFADKNGIEYDRSRTIVQRSISGEEEIVAVDENLVENNAVKELYAKIVDDVNSRLAKHETIKKFKILPEAFSLEKGEITPTLKKRRHVILKRYEKFIEEMYKR

SEQ ID NO: 924 - protein, 380 aa, Archaeoglobus fulgidus
MRVAVVGFGQTPFRTKRKDKTHPELAFEAINAALDHAGLEMKDVEAVAYGCMDPFDGIYCPERWDATAAGLEKPIMKISTGGTTGMTTALAAYEHVASGLFDLVMAVCVQRVGECVDAQPVLNTAVDPIYERHSGLGAIHVASFQATAYMAKYGATEEDLAWVSVKDHKNALKNPYAHIKMDVSVEGVLKSRVVCSPLKLLECCPRSDGAAAVIFASEDVARKIRDNPAWVVAETTISDSYYLGDRPSFAEWDSLAIAGRRLFKAAGIEPDEIDVAELYSPFTIQEILELEALGFAKKGEGKNFAREGVTFVDGDFPTNPSGGVLCTNPIGATGLVRFGEAALQVMNEAKNQVDGAEVALAHAWGGTLQFHTLALLSSRR

SEQ ID NO: 925 - protein, 404 aa, Archaeoglobus fulgidus
MEEILRLRRSVSIDDYIEKVKPIVEAVKREGDKAVIRFTRDLDGVELDSLRVTEDEFEKAYDAVDDGLIDALEVAKENIYRFHYVTSVERDMKVEFEDCVMGKIYTPIEKVGAYIPGGRASYPSTALMIGVPAKIAGVEKLVACTPPNKDGKVNPLTLVALDIAEFDEVYKAGGAQAIAAMAYGTETVEKVYKIVGPGNIYVTAAKLLVAKDVAIDMPAGPSEILVIADETANADFIACDCLAQLEHDPMAVAVVLTTSRKVADEVEKKVKSEGDFSNFAVFVVEDLAEAFEISNEFAPEHLTVAVKNPEEWLGKVRNAGSVFLGNFSPVAAGDYASGTNHVLPTAGYAKIYGGLSVESFLKHFTFQMLSEESMRRIGGDVVKIAEAEGLRWHAESVRKRLEKI

SEQ ID NO: 926 - protein, 506 aa, Archaeoglobus fulgidus
MFSKILVANRGEIAVRVMRACRELGIKTVGVYSSADKRAFHRVYADECYYIGKADPRDSYLNIDRIIEVAKKSGAEAIHPGYGFLAENAEFAERCEEEGIVFIGPSPEVIRIAGSKVRSRESMQRAGVPVIPGSPKIDTVDEAKEWAEKIGYPVAVKASGGGGGIGIVVVNSQEELEEAFRKSKKLGESYFKDSTVYLEKYLARPRHIEVQILADQHGNVIHLGERECSIQRRHQKLIEEAPSPALNEEMREELGKLAVKGAREIGYTNAGTFEFLYENGNFYFLEINSRLQVEHTITEVVTGIDIVKYQIRIAYGEELRHGQEDVAIRGHAIECRINAEDPVNFYPRSGRILHYRSPGGIGIRVDSGIHMGYRIPEEYDSMISKLIAYGETREEAIARMKRALYEYIIEGVETNIPFHFAVLNDEEFVRGNIHTKFVEERNIAEKVKEYLRIFRPIKARLDEIFMESEFTWEEISAIVTAIDAYEQELERGIEERIWQAIFSLGA

SEQ ID NO: 927 - protein, 281 aa, Archaeoglobus fulgidus
MTPMTTLSLSAFSGCAHSDVIAASSIRAVSTALACLMVWISKAKYLNLAETVKSMLKVRNVHKRFGECSVLEGVNLEIDKSERVGIIGPNGAGKTTLFNIITGFLKPDRGEIRFRSRDITGLKPNQLAKMGIVRTFQIVKVFSNMTVEQNMLTVSDDLDYLREFGLWEKRHELAANLSYGELRKLSIALALAPNPKLLLLDEPFSGLSPKEARDLAGIIESINHNGQSIAIIEHRLKDLFNVAERVVVLNSGRIIFEGHPEEVVREKTVVEAYLGRKYAVA

SEQ ID NO: 928 - protein, 196 aa, Archaeoglobus fulgidus [sequence omitted]

SEQ ID NO: 929 - protein, 409 aa, Archaeoglobus fulgidus
MNIFDNILSSATIFKNRDVLRHSYTPEKLPHREEQINQLALLLSPMLRGGTPSNIFIYGKTGTGKTATVLFVARQLEEASRKAKLNVAVHYINCEIVDTAYRVLASLARKFGSNVPMTGWPTDQVYEEVKKALERRGTRVVVILDEIDKLVKKAEEALYGLTRINSELENSSICIVGISNNLKFKEYLDARILSSLSEEEIVFPPYNAEQLEDILQQRAKLAFEDGVLEDGVIQLCAAIAAQEHGDARKALDLLRVSAEIAERERDSMVRVEHVKKAVRKIETDYMIETVRTLPVHSKILLYSMSLISENSPKFTTGEVYCVYKKLCGKVGVDPLTQRRISDLISELDMLGILNSVVISKGRYGRTREMKLEADEKVLRKALEEDYRLQNLRKFEGELKKLANLNLFQF

SEQ ID NO: 930 - protein, 551 aa, Archaeoglobus fulgidus
MKEVIMKYVVQNAAKYGKASEKAVMGKVMAENPELRKKAKEVLELVKECITEFEALSEEVRKELIKKYSMDSEAKRELETKKLPELEGAEKGKVVMRFAPNPNGPPTLGSARGIIVNGEYAKMYEGKYIIRFDDTDPRTKRPMIEAYEWYLEDIEWLGYKPDEVIYASRRIPIYYDYARKLIEMGKAYTCFCSQEEFKKFRDSGEECPHRNISVEDTLEVWERMLEGDYEEGEVVLRIKTDMRHKDPAIRDWVAFRIIKESHPLVGDKYVVYPTLDFESAIEDHLLGITHIIRGKDLIDSERRQRYIYEYFGWIYPITKHWGRVKIFEFGKLSTSSIKKDIERGKYEGWDDPRLPTLRAFRRRGFEPEAIKSFFLSLGVGENDVSVSLKNLYAENRKIIDRKANRYFFIWGPVKIEIVNLPEKKEVELPLNPHTGEKRRLKGERTIYVTKDDFERLKGQVVRLKDFCNVLLDEKAEFMGFELEGVKKGKNIIHWLPESEAIKGKVIGEREAEGLVERNAVRDVGKVVQFERFAFCKVESADEELVAVYTHP

SEQ ID NO: 931 - protein, 551 aa, Archaeoglobus fulgidus
MRFVRGFPSTMMDEYQLNITNILRHAATNFPEREVVSRNLDGSLFRYSYGEAYERVSRLANVLEELGVDVGDRVGVLSWNTHRFFELFFAIPGIGAVLLEMNLRLHPREIAYVANHSGAKVIFVDESLLPIAEAIAPSIGVEKYVVMTDGETPETKLPEVYSYEELLRKASKDYDFPMVDETSAYAACYTSGTTGNPKGVYYSHRSMVLHSLIAAIGMGLRPEDAYMQLVPMFHANGWGVFFAATLAGSKLVFPGRYAVDNLAPVVELMQSEKVTATAGAPAIFLPMLNYLQKVEPKPKFNIRAWSGATEPPLAVMKGLKEFGIEIIHAYGATETSPLVCYNYVKPELREKLNEEELWELKRKQGIPVFGVEVMLVDEEGNRLPHDGKTIGELCIRGHWITGSYYKDARTFESFIDDGLLKWWKSGDAATIDEWGYIKIVDRFKDLIKSGGEWISSVDLENHLMAHPKVFEACVVGIPHPKWEERPLAFVVPKPEFKDSITKEELYEHLKQRFAKWQLPDDIIITDEIPKTSVGKFSKRTLREQYKDYYTK

SEQ ID NO: 932 - protein, 336 aa, Archaeoglobus fulgidus
MGADIGDLFEREEVELEYFSGKKIAVDAFNTLYQFISIIRQPDGTPLKDSQGRITSHLSGILYRVSNMVEVGIRPVFVFDGEPPEFKKAEIEERKKRRAEAEEMWIAALQAGDKDAKKYAQAAGRVDEYIVDSAKTLLSYMGIPFVDAPSEGEAQAAYMAAKGDVEYTGSQDYDSLLFGSPRLARNLAITGKRKLPGKNVYVDVKPEIIILESNLKRLGLTREQLIDIAILVGTDYNEGVKGVGVKKALNYIKTYGDIFRALKALKVNIDHVEEIRNFFLNPPVTDDYRIEFREPDFEKAIEFLCEEHDFSRERVEKALEKLKALKSTQATLERWF

SEQ ID NO: 933 - protein, 195 aa, Archaeoglobus fulgidus
MKLPEAFKGKWFVLFSHPADFTPVCTTEFVAFQNRYDEFRKLNCELIGLSIDQVFSHIKWIEWIKEKLDIEIEFPVIADDTGRVAEMLGLIHPAKGTNTVRAVFIVDPEAVIRAVIYYPQELGRNMDEILRAVKALQVSDQNGVAMPANWPNNELVGDAVIIPPPISEAEAKERLEKAKAGDISCYDWWFCYKKI

SEQ ID NO: 934 - protein, 396 aa, Archaeoglobus fulgidus
MMSENVAVIGVGHSKFGTRKDVNIAELCWESMKPAFESANLEPKDIEFFVVSNAGMWSSEAAVPALMAEYADLAPKGSMRVEAACASGSAAVRVGYTAVKSGMADIVLVLGVEKMQESPNPNVIELIGRFGSYFWEFENFGLTFPAYYALHGTAYMMKYGATEEDYAKVAVKNHYYGAKNPYAQFQREIDVETVMKSPYVAWPFKLFDCSPITDGSACIILASEEKVKELGIDEKIWILGQGVGTGTANLSRREEFSSLASATYAAEQAYKMAGIDIDDPTKYLDGANVHDCFTAPEIIAYEDLRFCKRGEGYKLIREEQTYIGGKIPVNVDGGLKAKGHPIGATGVSQAVEAYKQLLQKAEPGRQADINKGRWLAHNVGGTGHYSYVTIYGLEKR

SEQ ID NO: 935 - protein, 658 aa, Archaeoglobus fulgidus
MKVKKVCVLGAGAMGSGIAQVCATAGYEVWVRDIKQEFLDRGKAAIEKNLQKAVSKGKMTEEKAKEILSRIHFTLDMEEAVKDADLVIEAVPEIMDLKKQVFAEVQKYAKPECIFASNTSGLSITELGNATDRPEKFLGLHFFNPPPVMALVEVIKGEKTSDETIKFGVEFVKSLGKVPVVVKKDVAGFIVNRILVPYLVLAIDDVEKGVATKEEIDATMMYKYGFPMGPIELSDFVGLDILYHASQQWDIVPQSKLLEEKFKANELGMKTGKGFYDWSAGRPKIPQELAGKYDAIRLIAPMVNIAADLIAMGVADAKDIDTAMKLGTNMPKGPCELGDEIGLDVILAKVEELYKEKGFEILKPSEHLKKMVSEGKLGEKSGEGFYSYGKGEMTFKNIEIVKDTENKIAKLIINRPQRLNALSLDTLDEIFEALRMLEKDDDVRVVVITGAGDKAFSAGFDLQTAMQVPDFLAPANSMMVAAKGQWVFTQIERFPKPVIAAINGYAFGGGCELALACDFRIMKRGAKIGLTEISLALIPGWGGTQRLPKLVGLTKAKEMIMLAKRIDADEAERIGLVNKAVDPEKFEEEVMALAKELAAGPPVSLRAAKYAINFGAELPAEIGQMIEAGMFAVATSTQDVVEGVSAFFQRRKPEFKGK

SEQ ID NO: 936 - protein, 155 aa, Archaeoglobus fulgidus
MSFVIWITGPSGAGKTTLANALYKKLESMGYRVELLDGDGVRRKLYPNLGFSEEERWMHNRVVVEMARRLSRNGIITIVSVVSPYRAWREYARKEIEKFVEVYPRCPLEVRMKRDPKGLYSKALRGEIKGLTGLDGEYEEPENPEVVVDTDKNDR

SEQ ID NO: 937 - protein, 324 aa, Archaeoglobus fulgidus
MKVSIIGCGYVGLVTGLGFAELGNPVVFVDSNGSKIKSINDLIPPIYEPGLEELIKKNEGKFYATNDYFEALDNSEVSFICVGTPSKEDGSLDLRQVEEASSKLGKALAEKEFHVIVVKSTVLPGTTENFVKPIIEKESGKKAFDDFGLAMNPEFLREGNAVEDFFNPDRIVIGVKDERTKSVLEELYKPFDCPKLITEIKTAEMIKYASNAFLATKISFANEIGNICKKLGIDVYKVFEGVGLDHRINPSFFRAGIGFGGSCFPKDVRALIRKSEELGEDLQILKAVIEVNEKQPLKMIELLKKHIPDLRGKISVFCPFLGLK

SEQ ID NO: 938 - protein, 352 aa, Archaeoglobus fulgidus
MKGVLLHGGAGTRLRPLTFTGPKQLIPVANKPVSQYCLEDMIGAGIKEVAIILGETYPEMVEEHYGDGSRFGCKITYIHQGKPLGIAHAVYLAKDFVGDEKFVVYLGDNLIQDGIKEYVKRFDEEDFDAFILLKEVEDPRAFGVAKFEGERLVGLIEKPKEPPSNYAVIGVYMFKPVVFDIIKDLKPSWRGELEITDTLQKMIENGYNVGYAKLKGWWFDTGKAEDILKVNATILDERAKRSVKGEVLASQIEGRVEVGEGAKITNSIVRGPAVIGEDCIIENSFIGPYTSVGERTVIKNSSLEYCIVLSESIIEGVERIEESLIGRKVRIRKNDRKRFLRFTIGDYSEILL

SEQ ID NO: 939 - protein, 245 aa, Archaeoglobus fulgidus
MIDVIMTGELLKTVTRAIVALVSEARIHFLEKGLHSRAVDPANVAMVIVDIPKDSFEVYNIDEEKTIGVDMDRIFDISKSISTKDLVELIVEDESTLKVKFGSVEYKVALIDPSAIRKEPRIPELELPAKIVMDAGEFKKAIAAADKISDQVIFRSDKEGFRIEAKGDVDSIVFHMTETELIEFNGGEARSMFSVDYLKEFCKVAGSGDLLTIHLGTNYPVRLVFELVGGRAKVEYILAPRIESE

SEQ ID NO: 940 - protein, 395 aa, Archaeoglobus fulgidus
MNIEKHFILFNHPLIMWWFVVPKTVFGDDAIEHLQSERAERVLIVTDKVLSEMSYLEEVKKNLKAERIEVFDEVEPEPSIETALKCSKVARELDAQLIIALGGGSVMDVAKMARILMELDVDPEFITPFTDLYELGFQKKAKLIAIPTTSGTGADATWAMVLTDTKEKRKVLPANREAIPDLTILDYRFVENLPPKLVAGTGMDALTHAIEGALAPWRNDFSDAMCEKAIELIFDNLEKSYNGDKEARAKMHHAATMAGMGFGNSQVGPVHSLGHAFGAYFKVHHGICVAVFLPYVLQFYLNDEGSRAMMDYLAGRVGLESGESMVEKVMDLMKKIEAPTKVSDIVGEKEYFGAIEDIWSHAINDACMITSPRCPDTEQTRKLLEYAFYGKRVDF

SEQ ID NO: 941 - protein, 250 aa, Archaeoglobus fulgidus
MGLSRLGIETAYIGKVGSDEEGRILLADFEREGVSTDFVIRAEGRSGTAMIFVDEKGNRAILVDPGVNDTIAYDEIDVDSARKYDLIHLTSFICKNGLDSLNSQKRIVEEFDSVSFDPGMPYAERGLGDMEKILKNTTIFLPNRQEIEMLFSEDYRTAAERCIEMGIEIVAVKLGSEGCWIKKGDREVTVKPVSTKVVDTTGAGDAFNAGFLYGYLKGKDIEECGRLGNFVAAKCIEKYGAREGLPRSVD

SEQ ID NO: 942 - protein, 681 aa, Archaeoglobus fulgidus
MADPMEAMKKEFENRIIPPSWKDRVWEIEDYRKFHEDTIKDKESIEKWWEKWANEIFWFRKWDRALDDSNPPFYRWFVGGETNLAYLCTDWQIEQGRKNKVAIIWEGEPVKENGEPVEVRKLTYYDLYRESNRIAAMLKDKLGVKKDEILTFYLPMIPELPLFMLGVQRIGAKHSIVFSGFSAQALAVRIMDAGARYVVTADGVYRRGKVLNLKAIVDDAVKICEQEGHKVEKVIVVKRAGNEIPWNDSRDVWFEDLMADIGKNVKVECEKMGSEDFSFILYTSGTTGRPKGAQHSVGGYAVHLYTTMKLIFDIKDDDIFWCTADIGWITGHSYIVYGPLMCGATTMMYEGAPDFPDVSRWAAMIERYGVTIFYTAPTAIRMLMRFPEENYTKYDMSTLRIIHSVGEPINPEAWRWYYRVFGREDVVCSSTWWMTETGGMLTDHFPGLGKIIPLKPGTNGYPIPGVRMEVLDDEGNSVKPGERGYLVISTPWPGMLMTLFKDPNRFIDVYFGKYKSKGWYYYTGDFAMFDEDGYVWVLGRADDILKVAGHRIGTAEIESAMVSHPDVAEAACVGKSDPVKGEIPIIYVVLREGVEPSPDMVNELKKHLRATLGPVVASDAVITFVNTLPKTRSGKIMRRLLRAVAEGKELGDVTTLESEVAVEEAKKAYEMVKAALEGSKS

SEQ ID NO: 943 - protein, 397 aa, Archaeoglobus fulgidus
MASKWLVIFAGFLLNLMLGIVYAWSVFVNPLMNTFGWSKTIASLPFSIFLLIFALMMVPAGRTQDRIGPRKVAMLGGVLLGVGFLLSGLIESIQSPYWLIFSYGVIAGAGCGLGYACPIPVARKWFPERVGLATGLVVMGFGMSALIFAPLERILIDTYGISTTFYILGVILLIVAVFAASLLSNPPELPAVQASNPAKVEVVTGKPELGPSEMLRDYRFYVLWLSFFFMALAGLMVIGHIAPYAQERGLEPLAAAFAVSILSVANAVGRPGAGALSDKIGRAMTMFVLFLIQGITLIAFPHVALTLITIYICAAIIGFNYGANFSLFPSATGDFFGTKNLGVNYGLVFTSYGVGGLVGPIMAGYVFDVTGSYEIAFLVAGVLALIAAFMSFLLRRK

SEQ ID NO: 944 - protein, 183 aa, Archaeoglobus fulgidus
MQDYKIKIENVVASTQIGENIDLNKISREIKDSEYKPKQFPGLVLRTKEPKAAALVFRSGKVVCTGSKSVEDARRAVKQIVKMLKEIGISVIDEPEVKVQNIVASADLGVDLNLNAIAIGLGLENIEYEPEQFPGLVYRLDNPRVVVLIFGSGKMVVTGGKSPEDARKAVERISEELRTLGLM

SEQ ID NO: 945 - protein, 443 aa, Archaeoglobus fulgidus
MSWIDELSKIVEVFPPSDAYRFDETPPLVAPRAAENFVVVKPSNSEEVSAILKFANEKSIPVFMRGGGTGLSGGAVPTEEGIVLSTEKMTELEVDADNRVAICGAGVTLKQLDDAAFRHGLSFPPHPGAETATVGGMIATNAGGVRALKYGTMRNYVLSLEAVLADGRIINVGGKTIKNSSGYSLLHLLVGSEGTLAVITKATIRLFPQMRDMTVLAIPFPTMEDAMNCVVEVARKMLPMALEFMEKRAVEIGEKVSGERWVSREGEAHLLMVFESFDEAEEAAKIAQSLGAIDVYAATTKKDQDRLLKVRGMIYEGLRKEVIEVLDACVPPAKIAEYWRRSNELAEEYGIELITYGHAGDGNVHQHPLVYEGWEKSYFEFRKSLLSLAVSLGGVISGEHGIGAVKLSELEELFPEQFELMRQIKLLFDPKNILNPGKVVRKL

SEQ ID NO: 946 - protein, 284 aa, Archaeoglobus fulgidus
MFSAHAPALVDYIYLIDRYPQRGGHSIILSTRKSPGGAGANVAHNLASLGVESTLFTTLGRDEDGIYFVENTLAKVKAEITDEKTGKVHVFVDGEGERTFFVEPNAAGKPFVEVDGGDYLYLDPFPSEHSFEVQRKEAERFDGFVILNPGFPYSSLGFERLKQILQHVDMLIMSADEFSLLGVETADVLRFVDYLIVTQGKLGSACYTKKGSFQSPAFPAKVADTTGAGDAFAAGFIYGFIKNYPLEVCLTLGNFCGAYNVERVGARNFPSKSTIDEFLARVLR

SEQ ID NO: 947 - protein, 386 aa, Archaeoglobus fulgidus
MFKLADRLEKIPPYLFAEIDAMKRKKLQEGVKVIDFGVGDPDLPTPEHIVEALKNAAEKVERQKYPSYEGMLSFRESVARFYRRRKGVNLDPESEVISLIGSKEGIAHLPLAFVNDGDYVLVPEPGYPVYYSSTLLADGVPYEMPLKEENKFLPDFQLIPDEIARKAKIMFLNYPNNPTAAVAPKEFIKEAIDFCIDNKIILAHDAAYSEITFDGYKAPSFLEFEDAFEVCVEFNSLSKTYNMTGWRIGFACGNRDILAGLLKVKTNVDSGVFEAIQEAAIAAMDGPDRVIEENCKVYQRRRDLLVEGLRDVGIDAEKPKATFYVWAKVGGSSIEFVKQLIDKAGIVATPGIGFGKSGEGFVRFALTRGEGVIEEAIDRLKTILHK

SEQ ID NO: 948 - protein, 304 aa, Archaeoglobus fulgidus
MFEKIGVVGFGLMGTQITQFFAQQGLEVVAIDVSEERLRKGMEAIKAGRFGLQRLVEKGKITEEEMNAVLSRISTSTSHSALKDCDLVIEAVFEDVNLKLKVLREIDAVTDAVIGSNTSSISITKLSSAVSNPERFLGIHFFNPAQIQKLVELVKGLLSDEKLVNGIRDWFLKLGKVPIVVNDSPGFATSRLGLVLGKEALLMVQEGVATPQDIDIGMMLGYGYSMGPIETGDLVGLDTRLRIYEAMFEATKDPKWAPPKLLVQLVDAGYLGDPSLKPGSKGGVYEYFGQERATEVLRRLGVRK

SEQ ID NO: 949 - protein, 256 aa, Archaeoglobus fulgidus
MGERVKLELDGEIAVATLNRPEKLNALDTKTRMELAEVIEGIEEVARVLIITGSGKAFAAGADINELLQRDAIKAFEATKLGTDLFSRIEELEIPVIAAVNGYTLGGGCELAMACDIRIASEKAKFGQPEINLAIIPGAGGTQRLPRLVGLGMAKKLVLTGEIIDAQTALRIGLVEEVVEHERLMERAKEVAAKIIEKSPLAVKVAKKALNASINMPLKEGLRYEASLFALLFSSEDAKEGMRAFLEKRKPEFRGR

SEQ ID NO: 950 - protein, 382 aa, Archaeoglobus fulgidus
MDFKLTPEQEDIRRAAREFAEKEFTPEVIEECDREEKYPMEIVRKARDLGFSTVKIPEEYGGMGLSLFEEALVTEEFYRVSPGIGNACLSSTFGTELLILFGSEEQKEKYLRWVTERHGISAMATTEPEAGSDVANVKTKIVKEGDEWVINGTKMFITNGTVCDFVLVLGRTYEGEKRHHGLTFAIVESKSKGFKATKIKNKLGLRASDTAEIVLKDVKVPEENILGEPGKGFYYLMEFFNHTRPRVAAQAVGIAQGAFELALNYVKQRKQFGQPIAAFQHTQFKIAEMATRIQAARLLTWQAAWQCSIGQSRPELSSMAKWFAGETAVYVADWCVQLHGGYGYIGEYPAERYYRDAKLMEIYEGTKEVQKQIIARRLIGKL

SEQ ID NO: 951 - protein, 387 aa, Archaeoglobus fulgidus
MRVGVIGVGCSRFGRRDDAVIQELAYEAVKEALDDAGITQDEVELSVVGSVNTRGYELMPAVPVNEYCGFAGKGPLRVEAACATGAAAVYTAYTSIASGMADVAIAIGVEKMTEVDTATSLAIGGRAGNYLWEFHQYGTTFPAYYAMHATAHMAKYGTTEEQMAKVAVKAHRNAARNPKAHFQKEIAVEDVLNSRYITYPLKLYDCSPISDGSAAAILASEEKIRELGIDDVVWIDSVGYASDTSNMTNRESFVGLKATVLAREMAYRKAGIEEPVKQLDFATVHDCFTIAEIMAYEDLGFCRKGEGGKLVESGETELGGKLPVNTFGGLKAKGHPLAATGVAMVYEIVKQLRGEAGELQVELRNNRALLHNVGGTGHFAFVMIFGR

SEQ ID NO: 952 - protein, 446 aa, Archaeoglobus fulgidus
MRAGGAGELFGTNGVRGIANSELTADMALNLGRTIGTLRQGKIAIACDTRISSSMLKSAVSAGIMSTGSDVVDIGIAPTPALQYYVKETDCSAGVIVTASHNPREYNGIKFVQENGVEFYREMDEESERVYMSKKFRIAEWSEVGQLYQDNSGLRKYIEAIINSVELDKSYRVAVDCGNGAGCFTTPEILKELGCDVYGINCNPDGRFPARNPEPVEASLDLLKKAVVDFRADFGVAHDGDADRAVFVDEKGNFVNEDVMLALMAKHYVEKNGGGLVVTPVSSSKCVEDAVKMAGGEIIYTAVGSPVVAKVMIEKEAVFGGEGNGGLIFPEHLIARDGGMSVAKVLELLDEKRKRLSELAAEIPRYHIVKGKVECREKKRLLEGLKEEFPEANHIDGARIDFEDGWVLIRPSGTEPIARVYAEAKTEDRARELYELGLRAIKKILG

SEQ ID NO: 953 - protein, 410 aa, Archaeoglobus fulgidus
MHRLRNLREDVSDGSLGHGGGGLMYDVVVVGAGPAGSMAAKTAAEQGLKVLLVEKRQEIGTPVRCAEGISRESIEKFFEVDKKWIAAEVTGAKIYAPNKTEIVMSEEMAGNEVGYVLERKIFDRHVARLAAKAGAEVYVKTAMVDFERKDGKVKVKLRRLGEDWEVETKILIGADGVESKIGRKAGIIKTLKLNEVESCAQYLMTGLDIDESYTYFYLGRELAPGGYAWIFPKGNGSANVGIGVLPKMAERTAKEYLDAFIEKEGIEGKIVEFVAGAVPVYGEIETAVADNIMLAGDAAYHADPITGGGIANALSAGYYAGKVAAEAVQKNDFSADFLRRYDELWKNDFGKKLRRNKKLQLKFIDMDDALLNKLAGAIAGKNLREMSVAAIVKELLKAHPKLLWDLKDLF

SEQ ID NO: 954 - protein, 804 aa, Archaeoglobus fulgidus
MVKDTYISSASKTPPMERTVRVTGMTCAMCVKSIETAVGSLEGVEEVRVNLATETAFIRFDEKRIDFETIKRVIEDLGYGVVDEQAAVSAEVEHLSRMKRKLYVAAFAGVLLLFLAHFISLPYEDFVQLLIALPAIFYSGSSIFKAAFSALRRRTLNMDVMYSMGVGAAFLASVLSTAGVLPREYSFYETSVLLLAFLLLGRTLEARAKSRTGEAIKKLVGLQAKTAVVIRDGKEIAVPVEEVAVGDIVIVRPGEKIPVDGVVVEGESYVDESMISGEPVPVLKSKGDEVFGATINNTGVLKIRATRVGGETLLAQIVKLVEDAMGSKPPIQRLADKVVAYFIPTVLLVAISAFIYWYFIAHAPLLFAFTTLIAVLVVACPCAFGLATPTALTVGMGKGAELGILIKNADALEVAEKVTAVIFDKTGTLTKGKPEVTDLVPLNGDERELLRLAAIAERRSEHPIAEAIVKKALEHGIELGEPEKVEVIAGEGVVADGILVGNKRLMEDFGVAVSNEVELALEKLEREAKTAVIVARNGRVEGIIAVSDTLKESAKPAVQELKRMGIKVGMITGDNWRSAEAISRELNLDLVIAEVLPHQKSEEVKKLQAKEVVAFVGDGINDAPALAQADLGIAVGSGSDVAVESGDIVLIRDDLRDVVAAIQLSRKTMSKIKQNIFWALIYNVILIPAAAGLLYPIFGVVFRPEFAGLAMAMSSVSVVANSLLLRNYVPPIRRGGDSVEKIVLELSGLSCHHCVARVKKALEEAGAKVEKVDLNEAVVAGNKEDVDKYIKAVEAAGYQAKLRS

SEQ ID NO: 955 - protein, 409 aa, Archaeoglobus fulgidus
MSAVKLVELLLTAEIFNRYEELTEDDIPKEIRKLLYNKGGIKRPVVIREDTVMRYAGKVEQKPPFVDLNSFSRQYILTSFDLAVKWFASRGVELIKKNPALAYFYQNYDSLDVSYEEAKKANLPKHGDKEWLKGLIEELEKKDETREMLSLVRVLSPEEIPVDFREVALSEEQLEEVRKIEIALEERSFLRKIGLSDIGKLLFIGPPGTGKTTTARALSKKLYLPLLEVKLSMITSQYLGETSKNIEKIFDIARMMSPCILFIDEFDYVAKMRTSDEHAAIKRAVNTLLKSIDDINLVEDGVLLIAATNHPSLLDPAVWRRFDKVIEFPEPAEAIRKRIFEIFLARIDGNFNIDELVRETDGFTGADIKLVVREAVLDALLQGRRELTQEDLLNAIREVRERLKLKKSY

SEQ ID NO: 956 - protein, 213 aa, Archaeoglobus fulgidus
MSMIEEKIYKGTTTVGLVCKDGVVMATEKRATMGNFIASKAAKKIYQIADRMAMTTAGSVGDAQFLARIIKIEANLYEIRRERKPTVRAIATLTSNLLNSYRYFPYLVQLLIGGIDSEGKSIYSIDPIGGAIEEKDIVATGSGSLTAYGVLEDRFTPEIGVDEAVELAVRAIYSAMKRDSASGDGIDVVKITEDEFYQYSPEEVEQILAKFRK

SEQ ID NO: 957 - protein, 246 aa, Archaeoglobus fulgidus
MHLPQMGYDRAITVFSPDGRLFQVEYAREAVKRGATAIGIKCKEGVILIADKRVGSKLLEADTIEKIYKIDEHICAATSGLVADARVLIDRARIEAQINRLTYDEPITVKELAKKICDFKQQYTQYGGVRPFGVSLLIAGVDEVPKLYETDPSGALLEYKATAIGMGRNAVTEFFEKEYRDDLSFDDAMVLGLVAMGLSIESELVPENIEVGYVKVDDRTFKEVSPEELKPYVERANERIRELLKK

SEQ ID NO: 958 - protein, 781 aa, Archaeoglobus fulgidus
MERVEGWLIDADYETIGGKAVVRLWCKDDQGIFVAYDYNFDPYFYVIGVDEDILKNAATSTRREVIKLKSFEKAQLKTLGREVEGYIVYAHHPQHVPKLRDYLSQFGDVREADIPFAYRYLIDKDLACMDGIAIEGEKQGGVIRSYKIEKVERIPRMEFPELKMLVFDCEMLSSFGMPEPEKDPIIVISVKTNDDDEIILTGDERKIISDFVKLIKSYDPDIIVGYNQDAFDWPYLRKRAERWNIPLDVGRDGSNVVFRGGRPKITGRLNVDLYDIAMRISDIKIKKLENVAEFLGTKIEIADIEAKDIYRYWSRGEKEKVLNYARQDAINTYLIAKELLPMHYELSKMIRLPVDDVTRMGRGKQVDWLLLSEAKKIGEIAPNPPEHAESYEGAFVLEPERGLHENVACLDFASMYPSIMIAFNISPDTYGCRDDCYEAPEVGHKFRKSPDGFFKRILRMLIEKRRELKVELKNLSPESSEYKLLDIKQQTLKVLTNSFYGYMGWNLARWYCHPCAEATTAWGRHFIRTSAKIAESMGFKVLYGDTDSIFVTKAGMTKEDVDRLIDKLHEELPIQIEVDEYYSAIFFVEKKRYAGLTEDGRLVVKGLEVRRGDWCELAKKVQREVIEVILKEKNPEKALSLVKDVILRIKEGKVSLEEVVIYKGLTKKPSKYESMQAHVKAALKAREMGIIYPVSSKIGYVIVKGSGNIGDRAYPIDLIEDFDGENLRIKTKSGIEIKKLDKDYYIDNQIIPSVLRILERFGYTEASLKGSSQMSLDSFFS

SEQ ID NO: 959 - protein, 586 aa, Archaeoglobus fulgidus
MAIEGIVRKVTEVRPRIVEAAFACLNCGSITMVPQEDSQLRQPFECSKCSTKKMIFLPDSSISVDSQRVKIQEYPENLRGGEQPQTIDVILEGDLAGSVNPGDRVIINGIVRAKPRGLGQRKMTHMDLYIEGNSVEVLQQEYEEFEITEKDRELIMQLAASDDIYEKIVKSIAPSIYGHEDVKLAIALQLFGGVPKKLPDGTEIRGDIHILLVGDPGVAKSQLLKYVHRIAPRSVYTTGKGTTTAGLTATAVRDEVDGRWTLEAGALVLADKGIALVDEIDKMRKEDTSALHEALEQQTISVAKAGINAILKARCALLGAANPKYGRFEKFTPVPEQIEMSPTLLSRFDLIFVLKDEPDEEKDKRLVEHILYSHQLGEMTEKAKNVAAEYDEEFIRQRSERIVPEIDPDLLRKYIAYARKTVYPVLTDEAKEKIKEFYLSLRSRVKENSPVPITARQLESIVRLAEASARVRLSDRVEPEDVDRVIEIMMRSLREIAVDPETGEMDIDLAYSGTSKTQRDRIMILKKIIEQLEEEHERGVPEELILEEAEKEGIDRTKAKEILSKLKLHGEVYTPKHGHYKLVSKL

SEQ ID NO: 960 - protein, 267 aa, Archaeoglobus fulgidus
MKEKRLIIKRSGYPSKGEIVIGTVKRVLDFGAFVSLDEYEGREGMVHISEVASGWIKDIREHVKKGQKVICKVLDVNPKRGHIDLSIKDVNERQRREKLQQWKNEMKAFKWLEIIGEKLNIDFKELEKIGKKLMKEYDSVYSAFEEAAFEGYEVLAPIVGEEFAKEMAEIARENIKPKRVKVRGYFELKSSASDGIERIKKALLEAKKALVNGVEMKLEYVGAPKYRIVVEADDYKTAENVLKKATENVLKAIKKLGGEGNFIREAA

SEQ ID NO: 961 - protein, 257 aa, Archaeoglobus fulgidus
MLKIATFNVNSIRSRLHIVIPWLKENKPDILCMQETKVENRKFPEADFHRIGYHVVFSGSKGRNGVAIASLEEPEDVSFGLDSEPKDEDRLIRAKIAGIDVINTYVPQGFKIDSEKYQYKLQWLERLYHYLQKTVDFRSFAVWCGDMNVAPEPIDVHSPDKLKNHVCFHEDARRAYKKILELGFVDVLRKIHPNERIYTFYDYRVKGAIERGLGWRVDAILATPPLAERCVDCYADIKPRLAEKPSDHLPLVAVFDV

SEQ ID NO: 962 - protein, 304 aa, Archaeoglobus fulgidus
MGILILPHLKLYLSCSPQNFMVILVGGTNGLMALKVAKISGLPLCYSHVDRYPDGEKYFRFASNIDGEDVVIFNSMHPNPDEIIFETLLIAETAYSNGARSVTCVFPYFAYARSLDTVKGEALPIKTVVKVLKAAGVKKIITVDFHLQENVFGVEHVDLTGMEKLAEYCLEEFSDSFTVLAPDEKAAFWAEKFAAKANCDVVALRKIRIDAENVIIDDLRTGVEGDVVIVDDIVSTGGTVCQAARIAKRAGARRVFVACTHAILARDAMMRILESGIEDIVSTDTILSPVSHVSVADVIASALS

SEQ ID NO: 963 - protein, 424 aa, Archaeoglobus fulgidus [sequence omitted]

SEQ ID NO: 964 - protein, 465 aa, Archaeoglobus fulgidus
MWNGPLLNYRDTFPQFRTFVAIVNAINNIRINLISVLTRHHTMKIAILGSGYVGIVTGIGFAELGHEIVFIDVDERKVEMLNSSKPPIYERGLEELMKKNRGKYRATTDYREALESSELTFICVGTPSKGDGSIDLKYAESASKEIGKALKNNDNFHVVVVKSTVVPGTTEDKIKPIIEKESGKKAFEDFGLAMNPEFLREGNAVYDFFNPDRIVIGVKDERTKSVLEELYKPFDCPKLITEIKTAEMIKYASNAFLATKISFANEIGNICKKLRIDVYKVFEGVGLDHRINPSFFRAGIGFGGSCFPKDVRALIRKSEELGENPKILKAVMEVNERQPLKMIELLKKHIPNLRGKKIGVLGLAFKPDTDDVRESRAIPIVKALLEEGAEIIAYDPKAIENFRKFFPQVEYANSAEDVITKSDAVLIVTEWKEFEELDYSGKIVIDGRRVEKAMKEAKIYKGVCW

SEQ ID NO: 965 - protein, 358 aa, Archaeoglobus fulgidus
MKIAQVCPRFYPHIGGVETHVYEIASRIAKKFDVEVLTTDPGGKLPKVEEIDGLTVRRFKSLAPSEAYYFSPELYDYLKKNSSDYDVVHAHNYHAFPALFAALTKGKNKLIFTPHYHGSGHSFFRNVLHKPYKIFGRKIFKRADAIVCVSNYEKNLVLKNFKVAEDRTYVIPNGINLDEFKDIEKIKRNKESWKKTILYVGRVEKYKGLDYVVKSLKHLPDNFTLEVVGKGSYKSKIVEMAKKLDVIDRIRFYQDLSRKELIDRYAKADVLVLLSKHEAYGIVVAEALAAKTPCIVANTSALSEWIDNKNVFGIDYPINVSELARLIERVSNVKAGDMKLLDWDDVNERLIRIYSAKI

SEQ ID NO: 966 - protein, 205 aa, Archaeoglobus fulgidus
MKAGIDEAGKGCVIGPLVVAGVACSDEDRLRKLGVKDSKKLSQGRREELAEEIRKICRTEVLKVSPENLDERMAAKTINEILKECYAEIILRLKPEIAYVDSPDVIPERLSRELEEITGLRVVAEHKADEKYPLVAAASIIAKVEREREIERLKEKFGDFGSGYASDPRTREVLKEWIASGRIPSCVRMRWKTVSNLRQKTLDDF

SEQ ID NO: 967 - protein, 556 aa, Archaeoglobus fulgidus
MMLFAEFAEFCERLEKISSTLELTARIAAFLQKIEDERDLYDVVLFITGKVYPPWDERELGVGIGLLYEALENVSGVKRSEIESMIREYGDLGLVAEQLIKKKKMTTLAFEELTVRKVRETFDEIASLTGEGSMKRKIMLLTGLYGLATPLEARYLTRLILNEMRLGVGEGIMRDAIARAFRADPETVERAYMITNDLGRVAVVAKKEGEEGLRKMKIEIHIPVRMMLAQVAESLESAVREMRTAAVEWKFDGSRVQVHWDGSRVTIYSRRLENVTNALPDIVEEIKKSVKPGVILDGEVIAVKEGKPMPFQHVLRRFRRKHDVAKMVEKIPLEAHFFDILYHDGECIDLPLRERRKLLESAVNESEKIKLAKQIVTDSVDEVRKMYDEAISAGHEGVMIKLPSSPYIPGKRGKNWLKVKAIMETLDLVVVGGEWGEGKRSHWLSSFELACLDPVTGKLLKVGRVATGFTEEDLEELTEMFRPLIVSQQGKKVEFIPKYVFEVAYQEIQKSPKYESGYALRFPRFVRLRDDKDVDEADTIERVENLYKLQFEVKRQ

SEQ ID NO: 968 - protein, 326 aa, Archaeoglobus fulgidus
MKKIVVIPGDGIGKEVMEAAMLILEKLDLPFEYSYYDAGDEALEKYGKALPDETLEACRKSDAVLFGAAGETAADVIVRLRRELGTFANVRPAKAIEGIECLYPGLDIVVVRENTECLYMGFEFGFGDVTEAIRVITREASERIARYAFELAKREGRKKVTALHKANVMKKTCGLFRDVCREVAKDYPEIQYNDYYIDAACMYLVMDPFRFDVIVTTNMFGDIVSDLAAGLVGGLGLAPSANVGERTAIFEPVHGAAFDIAGKGIANPTAMILTACMMLRHFGYVEEAKKVEEAVEKTIKEGKKTPDLGGNLKTMEFANEVASLLD

SEQ ID NO: 969 - protein, 275 aa, Archaeoglobus fulgidus
MHIDSYFSLSNCDAEEAEYLIYGIPYDATQSFKPGSRFAPNAIREASWNLESYSNLFDVELSLVKVGDAGNINCDGGFEQIVERTKEFLGEVEGFPVAIGGEHSISFAATSKFRKACFVVFDAHFDLRDEFDGDRFNHACTTRRIFESGMRVAIFGVRSGIKEEKRFAEENGIKYLHAWDFEVEKAVKMVEDFDKIYVSLDVDAFDPAFAPGVSTPEPFGLKPIDFIRFFAGIADRVVGFDVVEVVPDSNKVTQTLAAKIILEAIAAKVRCDIPK

SEQ ID NO: 970 - protein, 412 aa, Archaeoglobus fulgidus
MQYEKVKPPENGEKIRYENGKLIVPDNPIIPYFEGDGIGKDVVPAAIRVLDAAADKIGKEVVWFQVYAGEDAYKLYGNYLPDDTLNAIKEFRVALKGPLTTPVGGGYRSLNVTIRQVLDLYANVRPVYYLKGVPSPIKHPEKVNFVIFRENTEDVYAGIEWPRGSEEALKLIRFLKNEFGVTIREDSGIGIKPISEFATKRLVRMAIRYAIENNRKSVTLVHKGNIMKYTEGAFRDWGYEVAKQEFGEYCITEDELWDKYGGKQPEGKIVVKDRIADNMFQQILTRTDEYDVIALPNLNGDYLSDAAAALIGGLGIAPGSNIGDGIGVFEPVHGSAPKYAGQNKVNPTAEILTGALMFEYIGWKDASEMIKKAVEMTISSGIVTYDIHRHMGGTKVGTREFAEAVVENLQSL

SEQ ID NO: 971 - protein, 360 aa, Archaeoglobus fulgidus
MNTFGHFLRVTTWGESHGRAVGCVIDGFPAGLEVDEEFIQREMERRRPGKKYTTQRKEVDRVEILSGVFEGLTTATPISMVVWNVDADSSAYESLKTVFRPGHADYTYWAKFGVRDWRGGGRASARETAARVAAGAMAKLLLRRYDVKVMGYAKEIAGVSCEVDDAEKAFERAERSPLRMPDERAEKEAEQRLKEAMSEGDSVGGVVEVVAKNVPAGLGEPVFGKLDAYLAYAVMGIPAVKGVEIGAGFEAARKRGSENNDPIVLKDGRIRFATNNAGGILGGISNGEDIVLRAAIKPTPSISKKQRTVDYEKMEEAEISVKGRHDPCIVPRAVPVVEAMVALVLADCMLMQGLIPRSLL

SEQ ID NO: 972 - protein, 414 aa, Archaeoglobus fulgidus
MLENDALLTEEEIKIREEAKELVNAIDPELLRKMDRDEVDYPFEFLEEAAKRKMLGLRFPEEYGGRGLSWTAESVAVEEVGVLGNGIGCSYAMVSIVGEAIYRFGQEWQKEEFLKPIIKGKKVSAEGLTEPRGGSDFFGTTTRAEKKGNVWVLNGAKRFIAGGKVADFYLIYARTDPTAPGHKALTAFLVERDMGVEVEELYNLLGFRGMGTARIVFKDVEVPDEYRLGEVNGARVIFNRMMIPERMTSAAGALGTARAALEVAVKYSNKRKAFGRKIREFQGVNFMVAEAVTKLDAARALTYNAARAVDLYDAGKGPDPRRLVSEAKYFATDVGWDVVNKAMQILGGIGYTQVYPVERMLRDMRLAPIWTGSNEIMKVLIQHETYKMMGLPSKDRDVEKDAMDWYKEWEKVYE

SEQ ID NO: 973 - protein, 504 aa, Archaeoglobus fulgidus
MAYFCLGESVFTIPYLLERAAKLFPNKGVVGREGTKSYSEVRKRVLGLTAFFENIGIRNEVVAVADWNTPEFFELIYAITAAGGILYPVNIRLPPDQIAYTLKKSESGLLIYSDDFSALAKVHEGESLHIKEVAEKADEAEPEVNVKQDDMAVMLFTSGTTGLPKAVRYTHEKMIHGALSIAHQLAHHETPANLTPRDVIFPQIPIYHILAWGTVFIAPYMGLNLVMGGRFDPAEAVRLIKKEGVTWINAVPTMVNMLLETKEDLSGIKVLIGGSTITIDLARRMEKAGMKFSTIYGGTDMLAASIAIMTEEAKVKGVDYIRQVTHPVPFAEFKIVPQEGMGGESGEIYFRAPWLPMEYYKDEEKTKEAYTEDGWFKTGDLGVEMPDGGVKILDRVKDAIKSGGEWIPSSILESVISEIEWVEYVAVLGKPDEKWGERPFAVIKPVDRSKASIEEVKEHLAKAVEEGRIAKWWIPEEIAIVDDMPLTSTGKINKLSLRKMLLER

SEQ ID NO: 974 - protein, 643 aa, Archaeoglobus fulgidus
MEEFRKLWQEAYENPEKFWNERAEEAMDDINWFEPWKNVFKWEYPKFSWFEGGKTNICYNCLDYKVKRYGSKPAYIYENPEMDLSYAITYRQLYSMVKKYAASLRGAGLSKGDRILLYLPNSIEAAAMLLAAARIGVISVTVFAGFSPKAVADRIELTTPKLIFTQDFSTRRGKLVRLKDNIDEALSYVPENVRENVGMVVVKRAMPEEEVDLKEGRDFTLKEFLDLKGGESSDYVEMDAMDPIFVMPTSGTTAKPKPVVHVQGGYQIWNYYAAKWVYGLKPDDVIFNTSDIGWIVGQSYMVFGPLLAGSTCILFDGTPDYPEPGTWWEVVERNGATLIWTSPTGARILRKLGVEKAKEYDVSSVERVVCAGEVLNPEVWYWLYRDVFEEEIPIIDHMWQTETTGALFGYPYGLYGDEIKEYIKPGSAGLPLPGIIPVVLDELSGEELPPREKGVMYLKRPFPGLTPTLWDSFDRYVRSYWEVGAGRGMYCTGDAAYIDEDGYVWFTGRADEVIKIAGHRIGTIEVENALISHPAVAEAGVSGIPDEIRGEVVAAFVVLKPGYSPSEELKREIIDHVRKTLGPIVVFKDIQFVNMLPKTRSGKIMRRVMKRLFLGQELGDLSTIEEEASVEEIKEAVEKLKKL

SEQ ID NO: 975 - protein, 563 aa, Archaeoglobus fulgidus
MEHDIVIVGAGIAGMRAAIAAAEKSRKLSIALIAKTYPIRCHSVCAEGGTAAVLREGDSFDLHAWDTVKGADFLADQDAVEFFVRECPKEIIRLENWGCPWSRNEDGTIAQRPFGGHSFNRATYAKDRTGFHEVHTLYERMLMYDNVEIFPEYFITNLAIENGAVQGVSAIQLKTGEMEFFEAKAVIFATGGAGRLYGFTTYSHQVTGDGLAIAYRNGIPLKDMEFFQFHPTGLVPSGILMTEGCRGEGGYLLNKNGERFMKRYAPEKMEIAPRDVVSRAMWTEIIEGRGFEGEYGPYIALDLRHLGEEKIEERLPLIRDAAIKFAGVDPVEEPIPVRPVAHYTMGGIDTNVRCETAVKGFFAAGECACVSIHGANRLGSNSTAECLVFGRVAGEVAAEYALKAKQGKISAEFREKEEKRIFDELLGKSGDESPYQIKKELNETMEANMWIFREEKGLKEAVKKIKELKERYRNVEINDKSRGFNTDLTSAIEIGYMLDLAEVVAIGALKRQESRGAHYRLDYPKRDDENWLKHTLAYYTPEGPKFDYKPVTITKWQPVERKY

SEQ ID NO: 976 - protein, 236 aa, Archaeoglobus fulgidus
MVEFRIRRFDGTKAYWQSFEVPAKRGMTVLEALYYIKENLDSSLAFRASCRMGICGSCAMKINDKPRLACETQVLTLGNAVKVEPLDNFKVIKDLITEFDGFFAKHKAVKPYLIRKDDNYAEPKELLQTPEELNEYYVFTLCIKCGACYSVCPAAATLDGYLGPAAMTAAYRFCADSRDDGQRERYEIASSSNGVWRCHLAMECSEVCPKNVEPAKAVQMLRKKTAFSILKSLLGW

SEQ ID NO: 977 - protein, 549 aa, Archaeoglobus fulgidus
MRGEDVFYEINDENVRELRKRYNKIRRWVIADFLRRSGRRYPEKTALIFNHPDGREIRLTYSELDKMANKVANALLNLGIKKYDRVAILAHNTLHHVLTIFGCAKAGAIYLGLNYLMYGKDLAYCINHSEAKVLIVEDALFERIEPAMDQLKTVDTFLWSNQGVGVEGEGRWESFDDFFDGESDTEPDTILNIEDPVQMTYTSGTESLPKCVVHTNESLIAQYVGCIVDGEYTANDIMLNTMPIYHCAQRDVFMMPIFYVGGTNVMMTEPNLDLMLEYIDRYKPTMLFLAPTVWIGLLRHPDIDKYDLQSLRKCYYGASIFPEEPLKELMEKLPQARFFQYYGQTELAPYHTVANHEEILEYTKTAGRSGLNLESRLENDEHEEIAEIGVPGEITARGPHVMLMYYKDPEKTEEAFKCGWFHSGDIAVKYRESYFEIVDRKKDMIKTGGENVSSREVEEVIYKHPDVWEVAVIGLPHEKWIEAVTAIVVPKPGKTINPEEIIEFCRKELSPYKVPKGVIVLKPEDLPKTPSGKIMKRELRKIFKDYYSA

SEQ ID NO: 978 - protein, 462 aa, Archaeoglobus fulgidus
MRIVMKFGGVSVKDGENIYHCANLVKKFSEGNEVVVVVSAMQGVTDALLKAAHRCCSEPSAGFIKMFIADMMKRHYEAIEYAVRNDEIKAKVIAAVERLLDELEKVLLGISYLGELTRRSEDYIVSFGERLSAPIFSAALLSLGVDSVALTGGDAGIITDRNFGRAKPLPGVYTTIRNRLEPLLTIKKTIPVVTGFIGATDDGSITTLGRGGSDYTATILAAALDADEVWLWKEVDGIMTCDPKYVPNARVIPEISYQEAMELSHFGAKILHPRALEPVMRKNIPVRIKNTFNPDAPGTVIGPTTKDSSEIVKALSLIPQAGIVNVSGAGFDFAEIMSEVFGRLAEERVNVIMVAQSSSELNLSIVVDIRDLEKAYNALKSLENGVIKVEKIPYIAVVSAVGSGMAGTPGVAGKIFSALGKNGINVIMISQSCSEYNVSFVVDGSDGVNAVKVVHDEFGLGN

SEQ ID NO: 979 - protein, 753 aa, Archaeoglobus fulgidus
MPVLWLADVDKNDIPLVGGKGANLGELLRAEIPVPDGFVVDARTFREFIQKTGIAEKIYSLLRELDVEDTEKLDAVSREIREIIEKTEMPEDIEREIREAYRKLCEEEGKEVYVAVRSSATAEDLPDASFAGQQETYLNVVGEDEVVEKVKKCWGSLFTPRAIYYRVQKGFRHEDVSIAVVVQKMVNSEKSGVMFTSHPVSGEKKCIIEAVFGLGEAIVSGLVTPDTYVYDRVKRKIEEVKIGEKKFMLTRKDGKTVKVELPPEKANERVLSDEEIEKLVTLGELIEDHYGKPQDVEWAIEGGKIYIVQSRPITTIRKEKKEAEEEVSEEAEGKILLKGLGASPGIASGKVKVIFSEKEISKVEEGDILVTTMTTPDMVPAMKRAAAIVTDEGGMTCHAAIVSRELGVPAVVGTKVATKVLKDGMVVTVDGEKGIVYEGRIEKKEEPKPVVASAPIITATEVKVNISIPDVAERVARETNADGVGLFRIEHMVLGLEKHPMKFIRDGEIDRYIDLLYQEMKKVVKAFYPKPVWIRTIDAPTDEFRAMEGGEDEPIEANPMLGFRGIRRDLAEEEHFRAEMRAIKKLVDEGYTNVGVMLPLITSPEEVKRAKEIAISEGLPLDKIEFGVMVETPAAALILEDIIKEGIDFVSLGTNDLTQYTLAVDRNNENVAYLYNETHPAVLKLIERTIKVCKEHGVKSSICGQAGSYPHVVEKLVEFGIDSVSANPDAVQRIREVVARAEKRIILEKLRKI

SEQ ID NO: 980 - protein, 299 aa, Archaeoglobus fulgidus
MNPLETEIGGLRMKNPLMLASGIMGSKVHSLNLIARDAGAVVTKSVGVEEREGYRNPTVVNWKCGLINAVGLASPAAKDFAEELKDYTNEAPLLISLYGHSVEEFSDLVDTFDSALPYLHGYELNLSCPHVKGAGLDIGMDLELSAAIVEELKGKTKNPVFAKLSAMHDYLKLAKVLEDAGVDGITISNTLRGMKIDIMSGKPVLSNLSGGVSGPAIKPIALKCVYDLYKEIEVPIVGCGGITSFEDVLEFIMAGARAVQIGSAVYYSRRIFYSLKESLIAFTRARDCTISDLIGIAHS

SEQ ID NO: 981 - protein, 280 aa, Archaeoglobus fulgidus
MRIAFTKMHGNGNDFVLIDEFEGVIVGEEEKPRFVRAVCHRNFGVGADGALFVQPSQKADVRFRYFNSDGSEAAMCGNGIRCFSRYVVEEGYAGERLRVETLAGILELEVKRENGWWVKVDMGKPKFGREEIPAKTDVWGYEVEHDGRKFRIYAANTGVPHVAVFVDSLDFDIVPLARKIRYSEIFPEGTNVNFAKVDGDTITVRTYERGVEGETLSCGTGSVAVAAIANRLGLTGSKVDVVTKGGLLKIELTEDTAYMTGGASRVFDGILRLNELRYDI

SEQ ID NO: 982 - protein, 322 aa, Archaeoglobus fulgidus
MEHVVYVVGHKNPDTDSVCSAIAFAYLWNKWKEGGNVAKMMKIEAEAKPVIQGDVNPETKYVLEKFGFEVPEIMTNGEGKKVALVDHSEKAQTVDGIDKAEVVAIVDHHKIGDVTTPQPILFVNLPVGCTATVIKLLFDKTGVEIPKDIAGILLSSILSDTVIFKSATTTELDKEVAEELAKIAGIDDLTKFGVEIKAKLSAVDDLTAMDIIKRDYKDFDMSGKKVGVGQIELVDLSLIESRIDEIYEAMKKMKEEGGYAGIFLMLTDIMKEGTELLVVTDYPEVVEKAFGKKLEGKSVWLDGVMSRKKQVVPPLEKAFAEL

SEQ ID NO: 983 - protein, 151 aa, Archaeoglobus fulgidus
MERTFVMVKPDGVQRGLVGEVIGRLERKGLKIVAMKMLWIAREMAENHYAEHREKPFFSALVDYITSGPVVAMVVEGKNAIKVVRTLVGATNPAEAAPGTIRGDFGLDVGRNVVHASDSPQSAEREISLFFSDDEIVNWEKADEDWIYEER

SEQ ID NO: 984 - protein, 595 aa, Archaeoglobus fulgidus
MSKKKEEAKALRTPIVAVLGHVDHGKTTLLDRIRKSKVVAKEAGGITQHIGATEVPLDVIKQICKDIWKVEVKIPGLLFIDTPGHKAFTNLRRRGGALADLAILIVDINEGFKPQTEEALSILRTFKTPFVVAANKIDRIPGWQSHEDTPFMKSYAMQEDFAKQNLENRLYNLIAELYQRGFSAERFDRISDFTRTVAVVPISALKGEGIPELLLILVGLAQRYLEKNLRLHIEGKGRGTVLEVKEERGLGVTCDAILYDGTLKVGDRIAIAGKDEVIVTNVKAILKPPPVREMRVESKFQSVKSVTAAAGIKIVAPNLENVLAGSEFEVVESEEDIKKFEERVRKEYEEIAIRTDEEGVVLKTDTLGSLEALINELRQEGIPIKKAEVGDVDKRDVVDASANKDELNKVVLAFNVKLLPGVEEEAKKYGVRIFSHEIIYTLIESFVKWREEERLARERQKVEALIKPGKIKLLKEFIFRRSKPAIVGVRVLAGELRRGVDLIKPDGTKVGAVRTMQKEGKNVAIASAGDELAIAIEDVTIGRQLEGDEELYVDVPERHAKVIERDLLDSLDEETKRAFKEFLEIKRKDNPFWGK

SEQ ID NO: 985 - protein, 419 aa, Archaeoglobus fulgidus
MFSTSDGILTVEGVKVTEIVRETGTPVYVTSRALLERNLEAYKKAFSNEGLLYAVKANNNLALMRIIASHGFGADVFSDGELYLASLAGFRKDMVLFNGNSKSRKEIEMGVTAGVKFSVDSLDELRTISKIAKEVGKEVEIAFRVNPDVDPKTHPKIATGLRESKFGIPHEMVREAYEMALKLDGVVPVGIHCHIGSQILDLSPFVHALNKVMDIAVDIEKLGVELSFVDMGGGLGIDYEGKGAPTPKDLASAILPEFEGRKADLTSDPQLWLEPGRSIVGNTTVLITRVNAVKKGYKNFVAVDAGFNVLIRPAMYGSYHRVAVANKMDAEPEEVYTVVGPICESGDVLARDRKLPKVEVGDLIAVFDAGAYGFVMSSQYNGRPRCAEVLVSGDRWDVIREKESYGDLIEKQRLPEWLL

SEQ ID NO: 986 - protein, 461 aa, Archaeoglobus fulgidus
MKITKELEKILGKGNVSTDPLVVTLHSTDAIGKAGNATAVVFPENTEQVARIAKLCYENNIKIYPQGSSTELSGSSVPEDGIVINFSKMNKIEEINVVDGYAVAQPGVRIAELEERLNEHSYTFPVDPGSVRSATVGGAINTGAGGMRGAKYGTMVDWVLGLEVVTADGEVLNIGSRTLKCRQGYNLTKLIVGSEGTLAIVTKAILKIAPLPENIVYAGAFFDSPEKAMQAVVEIKHMWPAIMEFLDSDLVKAGREISGIDEEGNMLVVGIECNHEASERIASALESILSQTARRVIIARNQRELEEKNLLALRRAFYPLAIKLASKEFGTKKSLVLIEDISVPVSKLPEAIRGIKEIARKYDFTVFIAGHVGDGNLHPTIWTSPEDEELMSRSHKFYTEVMELALRLGGTISAEHGIGVVKKEGLEMEMKYKKSEKALEIMREIKKLFDPKNILNPGKVV

SEQ ID NO: 987 - protein, 271 aa, Archaeoglobus fulgidus
MLAKRIIPCLDVTLDESEARVVKGVEFVNLRDAGDPVELAKRYDEEGADELVFLDITASPEGRRTMIDVIERTAEQVFIPFTVGGGIKSIEDINTILSAGADKVSINTAAVKNPEFVREAADIFGSQCIVVAIDCRRNFDLSKGEYIVELEDGTKAWYEVVIYGGRKPVGIDAVWWAKRVEELGAGEILLTSMNRDGTKDGFDIPITRKISEEVNIPVIASGGAGTKEHFYEGFVEGKADACLAASIFHYREIGIREIKEYLAERGVQVRL

SEQ ID NO: 988 - protein, 248 aa, Archaeoglobus fulgidus
MLKVEGVGIRFGGLIALNNVTFEIRKGEVLGIIGPNGAGKTTLFNVISGLYKPDEGVIIFEGKNITTMPPHKIVRLGISRTFQTVSLYFNLPAIGNLLITLTAWYRSGVLSALREENGDETFKEAMELLNFVGLDEKAFTPVKNLPQEAQRRLSIAIALATKPKLLLLDEPTAGLNLEETDRILEIIRTLKERGVTVAIIEHKMRFIMGVSDRIVVLDSGEIIAEGSPKEIVENERVIKAYLGESYVV

SEQ ID NO: 989 - protein, 577 aa, Archaeoglobus fulgidus
MNVLGVEGENIREVDVTKINRVWTKFYDEGVRANIDYPVMPAYRILEDAAASDPDKICFEFFGTKWTYRQMKDASDKVANFLFDIGVEKGDRIVVALPNLPHYAIIANAIYKVGGIVVQCNPIYTEREIRYIVKNSGATRMFAFEGMYPRIRPLIEDGTLEKVVICRIEDFLGFVMSALFKAFLKKKMVGKVDIDRRKEVVFWQDVLKYERTDKRAEINPKEDVAMFQYTGGTTGFPKAVMLTHYNLVVNAYQVAEWDPRTTPSDVAVGCLPVFHVYGMTMLNSSAVLRMKVIPIPDPRDVEAILKAVHKYKATTFTGVPTMFISMLNHPKLSKYDLTSLRVCVSGAAPLPVEVKRKWEEITGGKLVEGYGLSEASPVTHCNPLYGLNKAGSIGVPYPDTYAVVIDEEGNILPPGEEGELAIYGPQVMKGYWMMDEETEKTLINGWLLTGDMAKMDEDGYFYIVDRKKDMIVAGGYNIYPREVEEVLFEHPAVAEAAVVGVPDPYRGETVKAFVVLRPEYKGKVTEKDLDKFCRERLAAYKVPRLYEFRDELPKSLVGKVLRRVLREEEAEKLKKKS

SEQ ID NO: 990 - protein, 337 aa, Archaeoglobus fulgidus
MGATIIVGGFWGDEGKGKIVAHVAHSDKPVIIARGGVGPNAGHTVEIDGQKFGVRMIPSGFVYKDAKLLIGAGVLVNPEVFLKEVELLKVGDRARVDYRCAIIEPKHIEADKGSEHLSKKIGTTGTGCGPANVDRVNRVAKQAKDIPELKDYLADVPLEVNQAIENGQFVLIEGSQGFGLSLYYGTYPYVTSKDTTASAIASDVGVGPTRVDDVIVVFKCFPTRVGAGPFPTEMPQEEAEKLGIVEYGTVTGRRRRIGYWDGEFARYSAMVNGATQVAITGVDKLDKECYGVTEWEKLTPKAKKFIEQVEEDVRVPVTLISTGPELKQIIDLRKEKL

SEQ ID NO: 991 - protein, 381 aa, Archaeoglobus fulgidus
MNFEFEEEHRILRDSVREFAEKEIMPYGKEYDEKGEYPWEIFRKAAKLGYVAADIPEKYGGAGLDYLGCAIIAEEFTRADSSIGSAVLTASLGCPMVKYFGTEEQKERYLPKVVKGETPSAIAITEPDAGSDVQAIKTKAERVDGGWKLNGTKTFITNGSVSEWVVILAKTQPDAGYRGISAFLVETGWDGYEARRIKKMGLNCHDTAEIYLKDVFVPETHIIGQENFGFYQLMRFFNESRVFVGAVQLGMAVGAYERALEYAKQRKAFGKPLIEHQAIQFKLADMWKDIEAAKLLIYKAAWLIDRGKANPALSSAAKLFASETAIKATYEALQIFGGYGYSKEYDIERYYRDARVGTIYEGTSEIQKLIIARAIAGKLRL

SEQ ID NO: 992 - protein, 294 aa, Archaeoglobus fulgidus
MKLGFVGAGRVGSTSAFTCLLNLDVDEIALVDIAEDLAVGEAMDLAHAAAGIDKYPKIVGGADYSLLKGSEIIVVTAGLARKPGMTRLDLAHKNAGIIKDIAKKIVENAPESKILVVTNPMDVMTYIMWKESGKPRNEVFGMGNQLDSQRLKERLYNAGARNIRRAWIIGEHGDSMFVAKSLADFDGEVDWEAVENDVRFVAAEVIKRKGATIFGPAVAIYRMVKAVVEDTGEIIPTSMILQGEYGIENVAVGVPAKLGKNGAEVADIKLSDEEIEKLRNSAKILRERLEELGY

SEQ ID NO: 993 - protein, 492 aa, Archaeoglobus fulgidus
MIGVIDAGTTTIKLAVYDEDKLVAIKKEPVVKHNPKPGWVEIDAEDLARKCVSFADTAIDEYGVEVIAITNQRTTAVLWDGKTGRPVFNALGWQDMRANALAEEMNRDSTIRMARTAGMIARGVVKLLPTLKNKRRVKWLITLSRLSIRPNHTSVKLCWMLRELGEKKEKYDLKAGTVDSWLVYRLTGEHLTDYSNAAATGLYDSYYLRWSEPILKIVGADEEMLPKTLESDRIFGEYRNVPVTGVIADQSASLYALGCWEEGDIKATNGTGTFVDLNVGEEPQASPGGLLPLIAWKLKSEMRYMMEGMLFYSGSAVEKLKEIGIYDDVSKTSEMAFRSKNDDMLLIPSFTGLATPHYVSVPGLLYGISNAMTREDIVKALLESIAFRIAEIVEIMRKEFPYETDRIRCDGEMSSNDFFLQRIADVTGLKVERGAVLSGTSFGAHLVAGRALGKWKKDFCMPFDKVFEPSLDLSEKYRRWKRLLEISKKLKV

SEQ ID NO: 994 - protein, 447 aa, Archaeoglobus fulgidus
MIAIEKALEEIRAAGIAVSTNMEDRIAYCKDYNPLHLPKLLRREFSAMPDAVVFPKSTEEVSVILKVANTYGIPVYVFGGGSGVIDAATPYEGGIALSTLSLDQIEIDEENMVVRAGAGVVGGRLEKILNHRGFTLRHSPQSLYCSTVGGWVATAASGQFSTGYGNIENLLVSLTAVLPDGEVVTERATPRRAGPDLKKIFVGSEGLLGVVTEAVMKIFPLPEEFLTLSVEYDGIGEAVRDAKALMQLRPALMRIFDDEESLRYFDSESFTLIAVFEGRAASAKLKEARNLVRGRLVEGRAEKWLEKRFDVSDISRIVPLGFIFDTIEVACFWKDAERVYSEVLKAIRSVEGTVTASAHASHFYESGLCFYFTFAGLPADIESYYFEVWRRAIEASLKNGGNLTHHHGVGRLRKRWLSAEIGGYYPLLRDLKSVLDRRNILNRGVML

SEQ ID NO: 995 - protein, 335 aa, Archaeoglobus fulgidus
MIVSILGAGAMGSALSVPLVDNGNEVRIWGTEFDTEILKSISAGREHPRLGVKLNGVEIFWPEQLEKCLENAEVVLLGVSTDGVLPVMSRILPYLKDQYIVLISKGLIDFDNSVLTVPEAVWRLKHDLRERTVAITGPAIAREVAKRMPTTVVFSSPSESSANKMKEIFETEYFGVEVTTDIIGTEITSALKNVYSIAIAWIRGYESRKNVEMSNAKGVIATRAINEMAELIEILGGDRETAFGLSGFGDLIATFRGGRNGMLGELLGKGLSIDEAMEELERRGVGVVEGYKTAEKAYRLSSKINADTKLLDSIYRVLYEGLKVEEVLFELATFK

SEQ ID NO: 996 - protein, 483 aa, Archaeoglobus fulgidus
MLRESRMKKGMDPKALKLSSSIEHDKNIFLYDILVDVAHVLTLKKGGYLSEEEAKEIILALKKVKDSGFREDWPYEDVHEAIEAEVTKITPHGAKMHTGRSRNDEVATCLRMFARDHLLNLAEAILNALDVLIKKAEKSHFLMPGFTHLQYAQPTRLSHHLLAYHDMLSRDFERAIEAFRRVNKSPLGSAAFASTGYSLDRVYAARLLGFDGVVEHSEDAVASRDFVIESIFVAAEAMLSISRIAEEIVLFSSEFGFITLPDEFSSTSSIMPQKKNPDIAELLRANAGKIAGNLTSAMMIYKATPFSYNRDFQEMNPLLYESLKRTHLAVEVFASMMGKIKFNPEITERKASKGFATATELADMLVMKYGVPFRMAHRIVGRLAAKELERPTASDVNSAAKELGVEINVRDEDVLEALDVEKVVENRGNLGGTSKAEVERMIKARKSDLKDRKTLLRKLRGEVKMGLKMLYDEAKKLGVDINV

SEQ ID NO: 997 - protein, 326 aa, Archaeoglobus fulgidus
MKLVRKFARDIEVDELAICIPLEYKSACLIYELSRYTNVYAAKLDDFSTKPEVVSWLKEKGVEVKMKRDVVNAEYFLDCAAVLSRVAVKSGKERLKVVELTKTGEEYLRKMDVRMKAISLDSSTLKGTGENTHGTAFGLLDALLRLNVFLPGKKALILGFGRVGRGCARLLKSVGCDVAVWDNDETRQIEALYEGFRVEKDFTAEVVVTCTGVKGVLGKEELEEISDGSIILNMGAEMEIEPAGELIKDYGLVKEYEIAGKRYFLVADGYAANLALGSGTPIEVMDRTFSAAILALNHLSRSDFDGIIPLPHHIESTILEAIMMYK

SEQ ID NO: 998 - protein, 419 aa, Archaeoglobus fulgidus
MKKVHIFLRLRTQVGASRYRWVVFGVMASIYFFVYFHRTSSAILATTLMEEFAVTALAVGVLSSAYFYPYGLMQIPVGYLSDTKGPRLTTTVFTLLAFVGTVLFAVSPNFEVAVLGRFLIGIGVSGVYIPTIKLLSRWFRVDEFATLTGVLFAVGNMGALVSAYPLATMVSLFGWRVTFLFIGAITFVLALSCWIFVRDSPGGVLEKSREGGRFATNFRVVVLNPVVWLIATSAFLRYGIVMGYQGLWGGPYLMDVYGMQREEAGGVLMMVGLGTILGAPIIGFLSDKVFRTRKWFLVAAGIGFTFTMAPLVFFTASLTVFQLYAISFLIGLFSAAGPVAYALIKESYPLEVTGLATSIVNVFPFFGGALFQVFMGYLMDTVGMVDGSYPPEAYSLAFSFCLAASVVSAVLILFVHEKR

SEQ ID NO: 999 - protein, 257 aa, Archaeoglobus fulgidus
MRVAVSGAAGRMGRLVVKNAVAEGLKVVQAFDINEVGKDAGELAGVGKIGVPIEDDISKLDADVLIDFTTAEAAMKNAEVAAEKGVRVVMGTTGFTDEDRKRLAELAEKVPMIVSPNFSLGVNIFWKIVEYAAKMLYEWDAEIVELHHRHKRDSPSGTALKLAEIIRKVKEEKGIEADLKTCREGISPRESEIGVFGIRGGDVVGEHTVFFFGSGERIELTHRAMSRECFAIGAVRAAKWIAKVDKPGFYTMDDFLE

SEQ ID NO: 1000 - protein, 289 aa, Archaeoglobus fulgidus
MFEGVIPAMVTPFKEDFSVDYEGIAKNLDYLEKHVNALVPAGTTGEAATLSYEEHIDVVRYVAETSKLPVIGGAGSNSTREAIWLAKEVEKAGAEAAMLVTPYYNKPNAEGLYQHYKAVASEVSIPIIVYNVPSRTGINTTPELVRRLAEIDNIFGIKEASGNLKQISEIIRTTPDDFVLLSGDDFLTLPILCLGGKGVISVAANVAPHLMKEMYEAFVEGNIERAREMHHRLTPLFDVLFIDTNPIPVKKALQLMGLAAGKPRLPLVELSEEKTQKVKEVLKSLELIS

SEQ ID NO: 1001 - protein, 326 aa, Archaeoglobus fulgidus
MIKIAIVGFGTVGQGVAELLIRKREEIEKAIGEFKVTAVADSKSSISGDFSLVEALRMKRETGMLRDDAKAIEVVRSADYDVLIEASVTRVDGGEGVNYIREALKRGKHVVTSNKGPLVAEFHGLMSLAERNGVRLMYEATVGGAMPVVKLAKRYLALCEIESVKGIFNGTCNYILSRMEEERLPYEHILKEAQELGYAEADPSYDVEGIDAALKLVIIANTIGVKASYEDVEVTGITQITPEAFQVAAEKGYTIRLIAEVSREKLKVSPRLVPFHHPLAIKGTMNAAMFKTDTAGSIFVAGRGAGKEETASAILSDLYEIYAGPR

SEQ ID NO: 1002 - protein, 423 aa, Archaeoglobus fulgidus
MAKEKEHINVAFIGHVDHGKSTLIGRLLYETGEIPEHIIEKMRKEAQEKGKATFEFAWVMDRLKEERERGVTIDVAHRKFQTDKYYITIVDCPGHRDFIKNMITGASQADAAVLVMDVVEKVQPQTREHIFLARTLGINQIIVAINKMDRVNYDQKEYEAAKEAVSKLLKMVGYKVDEIPFIPVSAYYGDNVAKKSDKTPWYNGPTLLEAFDLLKPPEKLVDKPLRIPIQDVYSISGVGTVPVGRVESGVLRVGDKVVFEPAGVSGEVKSIEMHHEPIQEAYPGDNIGFNVRGVSKKDIRRGDVAGHPDNPPTVVKDFTAQLVVLQHPTAITVGYTPVVHAHTAQIACRFVELQKKIDPRTGQVKEENPQFLKTGDAAIVKLEPTRPMVIERVKDIPPMGRFAIRDMGMTIGAGMVLDLTPRK

SEQ ID NO: 1003 - protein, 259 aa, Archaeoglobus fulgidus
MAAVEYREEDGVLWVKFNRPEALNAINKDFVKGLREVVDYARNNKTVRVIVLTGEGKAFCAGADIKMFSESSHFVARSTIEELGKVLEEMEDLEVPVIAAINGFALGGGCEIAMACDIIIASERASFGQPEINLGIIPGAGGTQRLARIVGWKKAMELCLTGERISAEEAYRLGLVNKVVEHDKLMDEAKKMAEVIKSKSPYAVMLVKQAVNRGFKMGLRDGIMYERDLFALSFSSPDAEEGIKAFVEKRKADFRRERE

SEQ ID NO: 1004 - protein, 394 aa, Archaeoglobus fulgidus
MNFELSEEQRMIANAARDIAKDFPPEYWREKEENGEFAEEFFKAISDAGFMGIVIPEEYGGGGYGMTELLIAMEELAANGCGMAGVWYMVLTEVFGALTIVRHGTEEHKEKYLPKIAKGEMEFCMALTEPDAGTNTLAIRTTAVKDGDEWVINGNKIFISGADRAKGMLIIARTTPREKAEKKTHGISLFLADLPNDAVKVNPIPKHGINYSKTCEVSFNNLRLPENALIPPLDGGWYHLLDTLNPERMSFTTAAIGISRLAISKAVEYSKQRKVFADPIGSYQGLQFPLAEAYATLECAELMNFKAATLFDQGAHYREVGAAANMAKAVAVEAGIKAVYWAMQTFGGYGYAKEYDVERWWREINLIRLAPVTQQMALNFIAEHILGMPKSYRT

SEQ ID NO: 1005 - protein, 642 aa, Archaeoglobus fulgidus
MRKMGFIWHPPKELVEESNVKAFMDAEGFSDYKQMVEKSTDDIEWWWSKAVEWLNVEWFKPYEKVYDMSKGIEWTDWFVNGRVNAAYNALDRHRKKRNKLAFIWQGEDGEVRRYTYLELYREVNRLANALKAFGVGKGDVVALYLPMFPETVVTLFAAMKIGAIAMPIFSGYSSAAIQTRLADSDAKVVVTADASYRRGRAVPLKPELDKALEGTKVEKVVVVNRADTEVEMKEDRDVYWDEVKESSRCETVEMDPNDAALLLYTSGTTGKPKGVVLSHAGVILQSSKEIFFNMDLKPEDVFLWITDIGWMMGPWQIIGCQHLGGTHVLFEGAPDYPNTDRIWAMIEEFEITQLGGSATVYRLLKRYGDEAVKQHDLSSLKATGNTGEPIDHDTWMWLLKVVGEERCPIINLSGGTEIFGCFLLPSPAMPLKPTTLGYPGLGMDVDVFDDAGNSVRQQIGYLVCKKPAPSMTRGFWKDPERYIKTYWSRWKGVWYHGDWAYVDEDGFWFLFGRADDVIKVAGKRMGPAEIETIVNSIPAVQESACIGVPHELKGEVVWVFVTLKPGYEPSEELEKEIVDKIVKEFGKPFKPDRVVFVPDLPRTRSGKIMRRLIKAVVAKQELGDTSALENPDSLEKIKEVLG

SEQ ID NO: 1006 - protein, 551 aa, Archaeoglobus fulgidus
MEIERYIVPKETWPEIIIPVEVQEYIGERKELNLAEELLDRNIREGRGRKVAVYFEDRRVTYRDLYRLSNKIANFLVGIGVQPYDRVGFRTRNMPEAIAVNFGIMKAGAIPVPLNPMWAGKEVSFVSNNAEIKALFVSGDERVFPAVNEVKDEIKTAKAMVVMDGEKEGFIPFSEVTAESAKFDPILLKIGTPALILYTSGTTGLPKGCVHFVENVISSVYLVGKHVWKLTPDDVVGGPAPVSFAMGYGNGCLIPYFHGAAASIWPRFSVENFFKYVEEHGITVFSSLPTSYRMILADPKLEEYMNKYDISSLRLFTGGGEALGAETAKRWKEVFGMDIYESLGATEMLHICIANACAPKPVAGSIGFPVPGYIAKIVDPETGKECGADEVGSLYIKGPTGIRYWNHPSRDLSEKQAKSVKNGWNVLGDFVRKDENGYIYFVSRDDDLIKSSGYRIGPDEIEQPLNTHPAVAECAVIGVPDPEGIRGQVVKAIIRLKEGYTPDEKLKEDILAFLEKHIAKYKLPRIIEFTDKPLPRTPTGKLLRRLLKQSS

SEQ ID NO: 1007 - protein, 178 aa, Archaeoglobus fulgidus
MKKFSRKTEETEVEVVLGEELKVDTGIAFLDHMLKTLSRHSGIKLRVKAKGDLEHHVIEDVAIALGKALAGVDKKGLERFGDAIVPMDDAVAICGLDFSGRGVLVVEGTFGDGEMREEDFLHFLDTLCRNAGLNVYLSVKGSNSHHKMEAAVKAVAISLKKALTKNGNDYRSAKGVLD

SEQ ID NO: 1008 - protein, 395 aa, Archaeoglobus fulgidus
MFRGVDFYNVDELLSDEDRLVRQSVREFLEKEVVPLVADAWHEEKPLNFHELGKKFGELGMLGTFLPEEYGCPGMTYTTFGVVCQEVERVDSALRSFVAVTSGLVMYPIWRYGSEEQKGEYLPKLARGEIIGAFGLTEPNHGSDPGSMEATARRDGDEWVLNGTKTWISEADVADIAVVWARDVEDGKIKGFIVERGTKGFQQTAITKKASMRAGSVGELGLVNCRVPEENRLPEARGLGAPLSCLNQARFGISWGAIGAAMDCYETALNYTKERKQFGAPLASYQLVQEKLVNMLIEITKGQLLAWRLAKLMDEGKATTEQISMAKKNNVRVARYCARTARELLGANGISLDYSPIRHMANIESVYTYEGTDDIHTLILGRAITGYQAFRRELR

SEQ ID NO: 1009 - protein, 337 aa, Archaeoglobus fulgidus
MSEESNEETKIIELEDIPGVGPETARKLREAGYSTIEAVAVASPSELANVGGITEGNAVKIIQAARKLANIGGFESGDKVLERRRSVKKITTGSKDLDELLGGGVETQAITEFFGEFGSGKTQICHQLAVNVQLPEDEGGLEGSVIIIDTENTFRPERIIQMAEAKGLDGNEVLKNIYVAQAYNSNHQMLLVDNAKELAEKLKKEGRPVRLIIVDSLMSHFRAEYVGRGTLADRQQKLNRHLHDLMKFGELYNAAIVVTNQVMARPDVLFGDPTKPVGGHIVAHTATFRIYLKKGKDDLRIARLIDSPHLPEGEAIFRVTERGIEDAEEKDKKKRKK

SEQ ID NO: 1010 - protein, 285 aa, Archaeoglobus fulgidus
MNILEISNLSVRFGDFYAVKGLTLNVRRGEILGLLGPNGSGKTTTIRAIFGMVPYEGEIRNYATSVGWMPQNSPLYLNLSVEENLRFFASLYGIEDERRVEEMLKLVQLERYRKRLVKNLSGGMRQRAMLACAMLHDPELLVLDEPTAGVDPPLRVSFWEQFEKLREEGKTILVTTHYMDEAERCERLVLIRNGSKIAEGTPEEIKRRACGDRLLLEVDDALAASRILSDYRSWINGKVVVEVDDAASEAPKIIEMLSRAGVKVFRVEIRRCTLEEAFMRLMEHA

SEQ ID NO: 1011 - protein, 364 aa, Archaeoglobus fulgidus
MDAAVVGGGPAGSLAAILLGKSYDVALFEEHQSAGFPVQCAGLVSDKCYKKLKEHCKAEKAIENHIKGAFFFSPSGKIVLEGRGEAVVVERKILDRLLFERAAERAKVFVKEKARLNGFRIITPSREVSAEKIIGADGVNSTVREHFGFPTMGFFTAVQVEAKFEPLDENCVELYFGGNWSDSFFAYAIPLGDTARIGVVSRSSPLRYLENLMKRHPSVSGRVEGSAVELNAGAIPDRLVKFSKRDVALIGDAAGMVKPYTGGGLYYHLIAAEKLAESFPDLKGYEKSYLKEMGREYRFGYAVRKLYSLPDEKLEQLFSAMADFDFRGVHMDSPSTLIRKAADISFRLLRKPSLAFYLVKSLFL

SEQ ID NO: 1012 - protein, 373 aa, Archaeoglobus fulgidus
MEIKTVAVLGAGLMGHGIAEVCAMAGYNVTMRDIKQEFVDRGMNMIKESLAKLEQKGKIKSAEEVLSRIKPTVDLEEAVKDADLVIEAVPEVVEIKKQVWEEVDKLAKPDCIFTSNTSTMRITMLADFTSRPEKFAGLHFFNPPVLMRLVEVIRGEKTSDEVMDLLVEFVKSIGKTPVRVEKDVPGFIANRVVAPRGVLLHAVVEAENLTPEEVDAAFRKAGYPMGPFELADYVGIDVNYNAARYFARAVSPEYEPPERVRKMVEEGRLGRKTGRGWYDWSGGKPKIDLSKATGKINVEDFLMVEINEAVKLVEMGVAKPEDIDIALKLGYGRQKGPFELLEEFGKERVARRLEELAKKYGKKIFEPAESLRT

SEQ ID NO: 1013 - protein, 397 aa, Archaeoglobus fulgidus
MLAEYILTEEQKAIKEAAREFAEKEFPNYVEECDREEKFPFELWKKAAQLGFIGMSIPEEYGGQGLGILDSCLVVEEFWRVDAGVGQIVGTVFGSEQITLFGNEEQKKKYLPPLAKGEKICAACYTEPQAGSDVAGIKTRADKDGDEYVINGTKMFITNGSIADYYIVLARTDPNPPKRHHGMSVFLVEREREGVQANKLKNKLGIRANDTAEVVFKNVRVPKENLIGEEGKGFYQTMIFFNVTRIPVAFQAVGLAQGAFELAYHYARNREVFERKLADFQVTQEKLAKMRTELEAARLLAYQAAYFQDKMGMPDPGLTAMAKYYTAKAAQFIVNEALQIHGGYGFMGEQHISRMYRDVRILEIYEGTREIEMEIIGRSLLGKVPSRLGAVRKHPLQ

SEQ ID NO: 1014 - protein, 396 aa, Archaeoglobus fulgidus
MEEVYIVEYARTPFSRSRPKKPERDVFHKIRGDELMALVLEKLPERAGIEKKEVGRILLGCAFPVSENWPYGGKMASLLAKYPPETSASHVDMQCGSSLATTAYAYLEIASGNEDMMISGGYEHMTRVPMGADNPHVDRHPKLLTEEYKDYRMDIGFVMGLTAETLFEMAGYLTKEDLDRWSLRSHQLAAKALKDGYFKGEIIPVEAPQADGSVITVDSDQSIRPDTSLEQIASLPPAFKPGGVITAGNSSPLNAGASGLLLASKKKVQELGLEPIAKIIGYGTAGVPPYIMGAGPVPASRKALEKTGLKVSDIDYWEINEAFAIVPLYAIHELGIEPERVNIHGGAVAIGHPLAASGARLIGTLARILQENNGDYGVATACVGGGQGAAVVIERV

SEQ ID NO: 1015 - protein, 593 aa, Archaeoglobus fulgidus
MRVMEVPEFVKNRYWLERAWIEGVPADVEIPEKPLYEVIDEVCQKYADRTAIIFYGAEIKYGQLKEYTDRFATSLAKMGIKKGDVVAIYSPNCPQFVIAYYGAMKAGATVTALSPLFAPREVEYQLNDSGAKVLVTVEQLYPNFAAVRENTGVEEVLVANIAGGEAKVEGKFRDFREMLASPPEPPEVSWNVKDDVAVLQYTGGTTGLPKAAMLTHYNVVANMYELIPFTDLIRGWLKSHKVIREEGDYVIVDLDGKEYRTFRDYYYNDYSPRVAILPWYHIYGQTVDLNTGLATGDILVVFAQFEPEKILEAIERYRVATFMGAPAIFVFLANNPDLLKRYDLTSLLYVNNGAGPVPPEIIEKWDELLKDAGRGILVEGYGLSEASPVTHTTVGPPFRKRKIGSVGPPIPNTYAAIINPETMEFLPIGEEGELVIAGPQVMKGYWNRPRETEDVFFEAGGMKWLRTGDIAKMDEDGYFYIVDRLKDIIKYKGHSVYPREIEDIMYEHPAIKEVCVIGLPDEVAGETIKAFVVLHEDYRGKITEQDIINWCKERMAAYKYPRIVEFRDELPKSAAGKYLRRILREEELKKMKR

SEQ ID NO: 1016 - protein, 886 aa, Archaeoglobus fulgidus
MILLKELQIKNFRSHSDSKIEFDTGINLIAGRNGAGKSSILEAILVAFYGLKPATLRKNDLVRVNSSGYSLSLTFSLNGDDYTISRKSNGESILTGKEIVEGDSNITEWVERHLCPAHVFTGAIYVRQGEIDSIIRDDESRERIIRQITRIEDYENAWKNLGAVIRMLEREKERLKEFLSQEEQIKRQKEEKKAEIERISEEIKSIESLREKLSEEVRNLESRLKELEEHKSRLESLRKQESSVLQEVRGLEEKLRELEKQLKEVVERIEDLEKKAKEVKELKPKAERYSILEKLLSEINQALRDVEKREGDLTREAAGIQAQLKKAEEDNSKLEEITKRIEELERELERFEKSHRLLETLKPKMDRMQGIKAKLEEKNLTPDKVEKMYDLLSKAKEEEKEITEKLKKLIAKKSSLKTRGAQLKKAVEELKSAERTCPVCGRELDEEHRKNIMAEYTREMKRIAEELAKADEIEKKLKERLEKVEKALEKQETVLKYRQMVDELKALENELSSHDAEKLSAESEEYRKVKERLDGLRGQQKILLSSASRIKELKSSLREIEEALKNVESERGELHRKIREEGFESLEELEREVQSLRPFYNKWLELKDAESRLESELKRREKLEDEISEAIAKLEEANGKAEEIRGQIDELLRIYSEEEHRRLSDEHLRKSKELAGLKSRLETLRESLQSAEKDLKFLEEQLAKMDEYRKKVEVFEKIAIPELTRIREKFRKYRNLVAENSMREVERYASQIFEELTEGKYSGVRLKKTTERGKEKLKVFVVYQGEEREIGFLSGGEIIALGLAFRLALSMFMIRGKIPLLILDEPTPFLDEERRRKLVDITTNYLRKIPQVIIVSHDEELKDAADKVIFVESQGGVSRVRYVEAQ

SEQ ID NO: 1017 - protein, 650 aa, Archaeoglobus fulgidus
MKVLVVGAGTMGHGIAEVCALAGNEVILCDINENILKNALSRIEWSVRKLEQKGRIKGADDVLKRLKTTTDLVEAAKEADFVIEAVVEKTEVKHEVFKTLDENCRDDVILATNTSTIPITDIAMATKRKDKVVGLHFFNPPTLIRLVEIIRGRDTSDETVRKTVEFAKSIGMDYVLVERDVPGFLINRINIRVFVEAIRLLEEGFKPEQIDAAVKYRAGLPMGLFEVVDFSGVDTVYNVLNEVRKRGFEVEVPGLLERMVLEGRLGMKTGKGFYEYSGFYTRAKISKDLAYSVNPINLLAPGINEAAWLIRNGIATKEDIDKATVKGMGYPKGILDFADSYGIDRVVSVLETRKGKTGLKEYEPDELLKELKENGKLGKKTGEGFYKWNYELEDIGPVRYEKRHNYAVITMRRAEKLNALNEEMWVGLTKAFRKARLDRDVRAVIITGEGRAFCAGDDIAVMGSWKSFRDGVEFFENIAMPLVSELADYDKPIISLVNGNAFGGGMELNMFFDIVIASEDASFAVPEGLIGAIPPIASSFGYALFGRRMAYYALTGETMDAKEAKEFGLVDLVVPKHCLEDAGIEHVDKVCRVAPLAAQSIKRSMNAVRQLFRNALELAGKEIELLIPTEDFAEGMAAFVQKRRPQWKGR

SEQ ID NO: 1018 - protein, 366 aa, Archaeoglobus fulgidus
MAPSGASTGSGEAVVVSPYRYEEIEEEVSKAIIGMSVFDQESVDEALRELDGTDNFSRIGGNFAITASLAVAKAAAEILGLPLYAYVGGVFAKELPYPLGNVIGGGRHAEGSTSIQEFLVIPVGAKTFFEAQRANAAVHKQLKKIFKERGIFAAKGDEGAWAAQISDEQAFEILSEAIQRVEDELGVKVRMGIDVAATELWDGERYVYSDRKLTTEEQIAYMAELADRYDLLYIEDPLHEKDFEGFAELTKQVKCMVCGDDIFVTNPEIIKKGIEVGAANTVLIKPNQNGTLSGTAKAVKIAKDNGYSVVVSHRSGETEDETLAHLAVAFNAKLIKTGVVGGERISKLNELIRIEELMDKPRMVMI

SEQ ID NO: 1019 - protein, 232 aa, Archaeoglobus fulgidus
MLSEVSFVAENEILGLLGPNGSGKSTLMKIIAGVIPPDEGDVIVNGVSVAENPLKVKELVGFVPETPVLYESLTASELFSFVGAVRKIESSLLKERVERLAEALEFTAMDELFANLSLGNRQKVSIIAAMLHNPSVLILDEAFNGLDVASAKVFRDLIFQFREEGREVILSTHIMPIAERICDRILIIQNGRIIAQGTPDELKKDEDLEDVFLKLTKIERDIKPLLEVLSSG

SEQ ID NO: 1020 - protein, 387 aa, Archaeoglobus fulgidus
MAIGFTFTEEQEDIRRAAREFAEKEFTPELARECDREEKFPYELWKKCAKLGFHAVDIPEEYGGGGYGPIEKMIVMEEFSAVNPGLGLACLLPTFGFEILVLHGSEEQKEKWLTKLARGDVIMGMANTEPDAGSDAANIKTRAVKEGDEWVINGTKQFISNGSIADFLLVTARTREMDPKAKHRGISYFIVETNREGYKANKIKGKMGIRATDTAEISFSNVRVPAENLVGEEGKGFYYMMEFFDMSRVWVGAQAVGIAKGALKLVIDYVKQRKAFNVPLATFQYIQFKIAELATKIEAARTLVYRAAAVQVEQGKPDNTLSSMAKWYAGEVAVETANWALQFHGGYGYIDEYAINQFYRDAKITEIYEGAKEIEKLIIARNLLGFR

SEQ ID NO: 1021 - protein, 407 aa, Archaeoglobus fulgidus
MMIDGLPTLDDIPYRGKHVLLRVDINAPIVNSTILDTSRFESHIPTIEALEDSKLVLLAHQSRPGKKDFTSLESHASTLSKLLGKRVEYIDEIFSKGVLRRIKEMENGEVILLENVRFYSEEQLNRSAEEHAECHMVRKLSTAFDLFVNDAFSASHRSHASLVGFVPVLPSVVGRLVENEVTALSKPLKGEGRKIFVLGGAKIKDSVKVLKNVLENNIAEKVVLTGVVANYFLMLKGYDIGEVNRKVVEDNKEDVSDEEMINILKKYSDKIILPIDLGIEKDGVRVDIPLEKFDGKYRIMDIGLETVNQLSEIIPKYDYVVLNGPAGVFEDERFSLGTYEILRAATRAGYSVVGGGHIASAARLFGLSDKFSHISTAGGACIRFLSGEKLVALEVIKEYWAKKWGKS

SEQ ID NO: 1022 - protein, 379 aa, Archaeoglobus fulgidus
MEITDIGGVLCNGIKEGKYGLGLVRVRGSIAGVFTQNKIRAAPVIVCEENIRDGVVEGVIVNSGNANAYTGEQGMRDAREMCRIAANLLGCEERRVAVASTGVIGRKLDMEWIRKKAPEVYSGLGNSVENAERFGRAIVTTDRFVKKAYSEKARIAAVAKGAGMIAPNMATMLCFAFTSAKFDSGELYDMLRRAADKTFNRLTVDGDTSTNDTVLLISTGKERVERDVFEEELCSVFYSIAKQMARDGEGATKVFEVRVDGARNDEDANLIARAVASSLLVKTAIFGCDPNWGRIIAAAGYSGADVDERITLSLSDGRDEVFLIDSGRPLGNEERARVLMEKAEELVIRLRLEKGNGKGFAIGCDLTYDYVKLNAEYTT

SEQ ID NO: 1023 - protein, 676 aa, Archaeoglobus fulgidus
MLKPERMVRVSVVGPREKLGETADLLHRLNLVHIEEPEESEYFRIGEPHPDASVVSRALVQMRSFISHLKLDPSRIVPRRKFRESEIEAQLKEKLDEYQQLIGERIEYLRSVDEKIASLQEQLNQIEPLKRLGIPARLLKGYKTLRVFVGFVKENPTEKFAQVTSDFEVFATEYEKELVVAVFVKAEYGDEFLRILQECGYREIQVPDVEDFEAKISEIEKEIESLKSRKEQVEKEIEEVKVKEAETLLAIEEYLSSQMDKYELPLRTLVSKYSFVLVGYLPAKALNEFKAKMDANGVAVEVLDEEGEPPTKLSNPAGVRNFELLTTTFGIPKYKEIDPTVFIAIFFPIFFGMMLGDIGYGLLVTVISLYLKRVFKTEGWQRMLNIGVYAGVMSIIFGFIYGECFGPFIVPGEYEPYQIHFIGSQLEHLYEFHHGHPIFDRVEEMGVKILLFATIVIGIAKILFGFALGFYNVYVEHGLKDAILEKLSWIIGVLGLAMIIFGFAYNVGVFYQLGMGPNPGDVPPLPLPGLMEGWQAGLNVYYLAALPLLVVWFILFVMGEVPKMGAMGVILAVELLTWFGQIMSYARLLAIGLSSVYIAFVINFIGMKLIDPVGISIPIVGAIVLLIGHVGNLILGILDPGLQSLRLHYVEFFTKFFEGGGRLYEPFGRIKRFIEE

SEQ ID NO: 1024 - protein, 581 aa, Archaeoglobus fulgidus
MEVKEAGYVGEIYRISGPLVVAEGLKARMYDLCKVGEEGLMGEVVGLVGQKVLIQVYEDTEGVKPGDKVENTGMPLSVELGPGLIRNIYDGVQRPLPVLKEVSGDFIGRGIEAPGLDRKAKWEFKPLVKKGEKVKPGEIIGTVQETEVVEQKILVPPNVKEGVIAEIYEGSFTVEDTIAVLEDGTELKLYHKWPVRIPRPYVEKLPPVVPLITGQRILDTFFPVAKGGTAAIPGPFGSGKTVTQHQLAKWSDAQIVVYIGCGERGNEMTEVLEEFPELEDPRTGKPLMERTVLVANTSNMPVAAREASVYTGITIAEYFRDMGYDVAIQADSTSRWAEAMREISGRLEEMPGEEGYPAYLASRLAEFYERAGRVKTLAGNIGSVTVVGAVSPPGGDFSEPVTQNTLRIVKVFWALDAKLAARRHFPAINWLQSYSLYVDTLKDWFAENVSEEWNELRRWAMEVLQEEANLQEIVQLVGSDALPESQRVLLEVARIIREVYLIQYAYHPVDTYCSVQKQYDMLKAIKQINDWFYQALEAGKTIDEIAGVEGLEEFARAKFEEDYKPAMEAALEKIRKNLLGE

SEQ ID NO: 1025 - protein, 472 aa, Archaeoglobus fulgidus
MKMKEYKTITQVAGPLVFVEKTEPVAYGELVTITLPDGSTRRGQVLDTSKDVVVVQVFEGTRGVDTSSTVRFTGDIVKLNCSQDMLGRILSGSGEPIDGGPKIVPEERRPIVGAAINPYARQYPREFIQTGISAIDGMNTLVRGQKLPIFSGSGLPHNDIALQIARQAKVRGEGEEFAVIFAAMGITYEEAYQFMKEFERTGALERAVVFLNLANDPAIERLLTPRMALTAAEFLAYEYDLHILVILTDMTNYCEALREISAAREEVPGRRGYPGYMYTDLATIYERAGRIRGRKGTITQMPILTMPGDDITHPIPDLTGYITEGQIVLSRELHAKGIYPPINVLPSLSRLMKEGIGEGYTREDHPQWNDQMYAAYAEGVDLRGLVAIVGEEALSERDRLFLKFADEFERRFVQQGRYEDRDIEYTLDLGWELLAMLPERELTKVERKFIEKYHPKYRKKEAKPEEATEEAS

SEQ ID NO: 1026 - protein, 209 aa, Archaeoglobus fulgidus
MAEVQPTRMELIKLRRRIKMATRGHALLKMKRDGLIMEFRQLLEEAKEVIGGMVQKYEKAQSKLALAIAVDGIVAVRSIALSCCQIPPEFSMKRKNIMGVVVPVIKREPIRKKPTERGYGILSTSTRVDEAVEAYEELVDAVLEVAEIETTLRKLIEEIERTKRRVNALEYRVIPTMEELAKFISFKLEEMDRENIIRLKKLKMKKAKS

SEQ ID NO: 1027 - protein, 437 aa, Archaeoglobus fulgidus
MVWMPKYLDLDELSEEDRMLKEEVHRFAEEVIRPASIELDRMPPEERVKPGSPYFKVWKQIKKLGYHRMYLPENKGGPGLTPLQRYILFEEIAWGSLGFATALGVDMIPFVSAAFFGTPEIYEDLVVPWIEDSEGKFHGCWGVTEPEHGSDYLITLREEPELVAKFGKGNVVAEKDGDEWVISGQKSAWVSSAPVATHCGLHAQLKGSRSIAEGLFCIVPLDADGVKKGRPADMLGMRDDPQGELFFDGVRIPEHYVVVAPGFFYGVFFDQLLCLTSCGMGAFAVGLARACFEEALHYARQRVQGGVPIVKHKNVKLKLYEMFEKVETARYYVRKATEYTHKKIIEQQTADASPRHARAAQIYAKKIAYEVAHDALQIFGAYGLIKEFVIEKFFRDARCMLIEDGTVEVLSLEAAEDVIDNYEKEFYDVNHVMRVLG

SEQ ID NO: 1028 - protein, 312 aa, Archaeoglobus fulgidus
MEAVIAVIGAGTMGAAIALLFANAGFEVTLVDKSRGALRRAEDRHRGESLEELEEAGLRKQDNPASLITYTTELRVYECDFIVEAIVERLRDKIELFRKIEEINSPAVLATNTSSFMPSEIARHLANPERLTLFHFSNPPILMPLVEVGGEIVSDETVERAVEMAKSIGKEPVVLRKECRGHVLNRMLAAAGVAVGYCLLYSRPEEIDAALRNLGMRYGFFETIDLIGLDVAKDVLESFREYYGDKYRGIRAMDFFMEKMVEWGKLGKKSGEGFYKWDGRRASIPESQSCGCNTTRCRNCQRGVQNRGGRDC

SEQ ID NO: 1029 - protein, 295 aa, Archaeoglobus fulgidus
MKLEDIKVIGVVGAGVMGHGIAQVAARTGYDVVMVDVSEEVLKKAMELIESGPFGLRRLVEKGKMSEDEAKAVMARIRTSTSLEALKDADFIIEAVTEKADLKKKIFAELDRICKPETIIASNTSAIMISDLATAVERKDKFIGMHWFNPAPVMRLIEVIRGALTSDETFNITVELSKKMGKIPIEAGDGPGFFTTRFINSWLVEAVRLFEIGIAGIKEIDEMCKLAFGFPMGPFELMDLIGLDTALHIAEYLYNETKEPHYAAPNTLKKLVLSGYVGRKPGSRGGWYDYYGIER

SEQ ID NO: 1030 - protein, 240 aa, Methanococcus jannaschii
MKVVITRPKERADVFASLLKKEGFEPIIFPTLEIVYNKDLDVNLDSYDWIAFTSPSGVIGLYNILTENERENVKNKKIAVIGEKTAKTFKKYFGRDPDIMPNEYTAESLLREIKKVSKEEEKFLIPTTPSTRDVLKNNLNADLLFVYKSAEPENLKEDIKKLKELIAKDKFILTFTSGLTAKNFFKYVDDEFAEIIKDNYIVAIGPITAKVIEKFGFKPLIPKVYTIEGMLEVIRTLKER

SEQ ID NO: 1031 - protein, 542 aa, Methanococcus jannaschii
MAMAGAPIVVLPQNVKRYVGRDAQRMNILAGRIIAETVRTTLGPKGMDKMLVDELGDIVVTNDGVTILKEMSVEHPAAKMLIEVAKTQEKEVGDGTTTAVVIAGELLRKAEELLDQNIHPSVIINGYEMARNKAVEELKSIAKEVKPEDTEMLKKIAMTSITGKGAEKAREQLAEIVVEAVRAVVDEETGKVDKDLIKVEKKEGAPIEETKLIRGVVIDKERVNPQMPKKVENAKIALLNCPIEVKETETDAEIRITDPAKLMEFIEQEEKMIKDMVEKIAATGANVVFCQKGIDDLAQHYLAKKGILAVRRVKKSDMEKLAKATGARIVTKIDDLTPEDLGEAGLVEERKVAGDAMIFVEQCKHPKAVTILARGSTEHVVEEVARAIDDAIGVVKCALEEGKIVAGGGATEIELAKRLRKFAESVAGREQLAVKAFADALEVIPRTLAENSGLDPIDMLVKLRAAHEKEGGEVYGLDVFEGEVVDMLEKGVVEPLKVKTQAIDSATEASVMLLRIDDVIAAEKVKGDEKGGEGGDMGGDEF

SEQ ID NO: 1032 - protein, 420 aa, Methanococcus jannaschii
MTLVEKILSKKVGYEVCAGDSIEVEVDLAMTHDGTTPLAYKALKEMSDSVWNPDKIVVAFDHNVPPNTVKAAEMQKLALEFVKRFGIKNFHKGGEGICHQILAENYVLPNMFVAGGDSHTCTHGAFGAFATGFGATDMAYIYATGETWIKVPKTIRVDIVGKNENVSAKDIVLRVCKEIGRRGATYMAIEYGGEVVKNMDMDGRLTLCNMAIEMGGKTGVIEADEITYDYLKKERGLSDEDIAKLKKERITVNRDEANYYKEIEIDITDMEEQVAVPHHPDNVKPISDVEGTEINQVFIGSCTNGRLSDLREAAKYLKGREVHKDVKLIVIPASKKVFLQALKEGIIDIFVKAGAMICTPGCGPCLGAHQGVLAEGEICLSTTNRNFKGRMGHINSYIYLASPKIAAISAVKGYITNKLD

SEQ ID NO: 1033 - protein, 354 aa, Methanococcus jannaschii
MEAVLILEDGTILKGKGFGAEKEVFGELVFTTVMTGYVEVLTDPSYKGQIVMMTYPLEGNYGVKKDWFESDGIKAEGFVVREVTSKALDDFLKEYDIPGIQDIDTRFLTRKIRDKGVVKSCLKVAEEISDDEISELLERVKRYSDISDIDLVPLVSTKEPKIHKTANPKARCVLIDCGVKLNIIRSLVQRNCEVIQVPYNTKYDEILEYKPDFVLISNGPGDPARLKEVIKNIKNLIGVVPITGICLGNQLLSLAFGGETYKMKFGHRGGNQPVKDLKTQKVYITSQNHGFAVRKESLPDDVEVSFINLNDMTVEGIRHKDLPIFSVQFHPEARPGPHDTMFLFDEMIKLKDRK

SEQ ID NO: 1034 - protein, 262 aa, Methanococcus jannaschii
MKPKIKVENLTKYFGDKKVLDEISFEVYEGEIFGLLGHNGAGKTTTLRILAGIIEEYTGYVEVNGKIGYLPEERGLYRDEKVVDVLKFFGELAGMKKEEIAKSIDYWLNKLKISNYKYSKIKELSKGNQQKVQFIVSVIHNPDIVILDEPFSGLDVVNVRLLRDIIFELKEEGKTIILSTHQLEKIERLCDRVLILKKGKAVHYGKIEDICRKMAYIEYLDNGKLIKKEIPYEEAVLILKEKAEDVIKFEVRYSLEDLFLDE

SEQ ID NO: 1035 - protein, 636 aa, Methanococcus jannaschii
MKNLASREVNIYVNGKLVGTTDKPEELVNFIREKRRKGELPQYTTVAYNEESNDIHINTDAGRIVRPLIVVENGKPKLTKEHIEKLKKGEITFSDLVKEGVIEYLDAEEEENAYIALSEEELTEKHTHLEIDPLTILGIGAGVAPYPEHNSAPRITMAAAMGKQSLGIPMSNIKWRLDTRGHYLHYPQVPIVRTKHQEILGFDKRPAGQNFVVAIMSYEGYNMEDAIVFNKSAIDRGLGRSTFFRTYDACERRYPGGQMDRFEIPDKGVRGYRSEECYRYLEEDGIVAVESHVKGGDVIVGKTSPPRFLEEHEITIQVKPQRRDSSVVVRHGEEGYIDKVILTETKEGNRLVKVKVRDLRIPELGDKFASRHGQKGVMGLTVPQEDLPFTESGIVPDIIINPHAIPSRMTVGQLLEMLGGKVGALEGRRIDGTIFSGEKEWDLRKALEALGFKHHGKEVMYDGKTGKKFEVEIYIGIAYYQKLHHLVAGKIHARSRGPVQVLTRQPTEGRAREGGLRFGEMERDVLIGHGAAMLLKERLMDESDPYDICICSKCGDFAILDYKRGLKYCPICGEIENLYSSKKIPFVRIPYAFKLLLDELKSMCILPRIKVRDKVELEDFEEFVEKLEKEKVKQKQ

SEQ ID NO: 1036 - protein, 895 aa, Methanococcus jannaschii
MNISVIGTGYVGLIQAVGLAEFGFDVVGIDIDESKVKALNRGECPLYEEGLEGLLKKHVNKNLTFTTSYKPIKDSDVIFLCVGTPQDKDGNADLRFLFSAVEKIKETIDKEDYKVIVIKSTVPVGTNRRVKELLKDYNVDVVSNPEFLREGIAVYDFFNPERVILGFENLNNKKPIEIMEEVYKYFKDKNIPFVITNWETAELIKYASNAFLATKISFINELAKLSDKVKADIKTISYAMGLDPRIGNKFLNAGIGYGGSCFHPDEVLFIDRGRGLECITFKELFELEDKDNVKILSFDGEKLSLKKLKLASKRYYNDDLITLRFNLGREIKITKDHPVVILEDGELKIKLTSDVKEGDKVILPYGNFGEEREIEIDILEELSKTDLIEKVWIHNKDLATNEFNIIKPYLSNKYPHDVKRNGTIRAKDILPIKEILDKYGSKNRLFTAKSKSTTIPYKIKIDKDFARLIGYYLSEGWISKDYGRNGVVRKRIGLCFGIHEEEYINDVKNILNKLGIKYIEKIKDGSHSILISSKILAYVFENILNCGINCYNKNIPPQMFNAKEEIKWEFLKGLFRGDGGIVRLNNNKNLNIEFATVSKKMAHSLLILLQLLGIVASVKKCYNNKSTTMAYIIRINGLEQVKKIGELFGKKWENYKDIAESYKRNIEPLGYKKSDNFAILEVKEIIKEHYSGYVYSVETENSLLITSYGILIHNCFPKDVKALIKQFENNNIEPILIKATDIVNEEQIKWFFEKIKNYYGNLNGKTFAVLGLAFKPNTDDLRESRAIKLIDMLLESGAIVKGFDYVEKARENTINMYKLDKSKGFYGYNLYVLDDLYETVKNVDGIIITVEYDFNKEDWEKIGNLVKEKVVFDGRNILDVEKIKKLGFKYYGVGR

SEQ ID NO: 1037 - protein, 392 aa, Methanococcus jannaschii
MRKIKLIIFPGYYIPHIGGLETHVDEFTKHLSEDENYDIYIFAPNIPKYKEFEIRHNNVKVYRYPAFEIIPNYPVPNIFNIKFWRMFFNLYKIDFDIVMTRTRFFSNTLLGFIFAKLRFKKKKLIHVEHGSAFVKLESEFKNKLSYFYDKTIGKLIFKKADYVVAISKAVKNFILENFVNDKDIPIIYRGLEIEKIESIGEDKKIKEKFKNKIKLCFVGRLYKWKGVENIIKAYVDLPKDLKEKIILIVVGYGEDLERLKKLAGNYLNNGIYFTGKVDFEKAIAIVKASDIYIHSSYKGGGLSSSLLQAMCCGKAIVASPYEGADEVVIDGYNGILLKDNSPEEIKRGIIKLIENNNLRKIYGENAKNFIKENFNWKKSVKEYKKIFERLVN

SEQ ID NO: 1038 - protein, 282 aa, Methanococcus jannaschii
MINAKTKVIGLIGHPVEHSFSPIMHNAAFKDKGLNYVYVAFDVLPENLKYVIDGAKALGIVGFNVTIPHKIEIMKYLDEIDKDAQLIGAVNTIKIEDGKAIGYNTDGIGARMALEEEIGRVKDKNIVIYGAGGAARAVAFELAKDNNIIIANRTVEKAEALAKEIAEKLNKKFGEEVKFSGLDVDLDGVDIIINATPIGMYPNIDVEPIVKAEKLREDMVVMDLIYNPLETVLLKEAKKVNAKTINGLGMLIYQGAVAFKIWTGVEPNIEVMKNAIIDKITK

SEQ ID NO: 1039 - protein, 312 aa, Methanococcus jannaschii
MIIETPSKVILFGEHAVVYGYRAISMAIDLTSTIEIKETQEDEIILNLNDLNKSLGLNLNEIKNINPNNFGDFKYCLCAIKNTLDYLNIEPKTGFKINISSKIPISCGLGSSASITIGTIKAVSGFYNKELKDDEIAKLGYMVEKEIQGKASITDTSTITYKGILEIKNNKFRKIKGEFEEFLKNCKFLIVYAEKRKKKTAELVNEVAKIENKDEIFKEIDKVIDEALKIKNKEDFGKLMTKNHELLKKLNISTPKLDRIVDIGNRFGFGAKLTGAGGGGCVIILVNEEKEKELLKELNKEDVRIFNCRMMN

SEQ ID NO: 1040 - protein, 375 aa, Methanococcus jannaschii
MRIIIKLSLEILLILIRIFIPKENPNNKKKIGERMKEVAIIGATGYTGAELLRLLANHEKVNVTYITSRKEAGKHVFKVHPHLKGIEKYKNLCFTGDIDKVDAYLVFTATPHGASMDIVPDFIERGMKVIDLSGDYRFEDLSLYEKYYKIKHKGLPDVKIAYGLPELHREEIKEAQLVANPGCFPTGAILAVAPLVKENIIEERIIFDSKTGVSGAGIKPTETTHFPNVNENINPYKITTHRHTPEIEKELKKLGKAKVSFTPHLAPITRGILTTAHTFLAKDVDREEIIKIYEKFYGSEVFVRIFSEEIPKLTWVRGTNFCDIGGFEIDEHGRLVVISAIDNLVKGASGQAIQNMNIMFGFDEKEGLFDVGLNP

SEQ ID NO: 1041 - protein, 438 aa, Methanococcus jannaschii
MKIMFLGNDTVEIKDGRFFIDGYDAIELAEKFGTPLYVMSEEQIKINYNRYIEAFKRWEEETGKEFIVAYAYKANANLAITRLLAKLGCGADVVSGGELYIAKLSNVPSKKIVFNGNCKTKEEIIMGIEANIRAFNVDSISELILINETAKELGETANVAFRINPNVNPKTHPKISTGLKKNKFGLDVESGIAMKAIKMALEMEYVNVVGVHCHIGSQLTDISPFIEETRKVMDFVVELKEEGIEIEDVNLGGGLGIPYYKDKQIPTQKDLADAIINTMLKYKDKVEMPNLILEPGRSLVATAGYLLGKVHHIKETPVTKWVMIDAGMNDMMRPAMYEAYHHIINCKVKNEKEVVSIAGGLCESSDVFGRDRELDKVEVGDVLAIFDVGAYGISMANNYNARGRPRMVLTSKKGVFLIRERETYADLIAKDIVPPHLL

SEQ ID NO: 1042 - protein, 448 aa, Methanococcus jannaschii
MGRLFGTSGIRMKNLSPKIAYKVGLAVAKKYKKVVVGRDTRTTGKLIETALTAGILNGGGEVTTINIVPTPVLGFNARNYDVGIMITASHNPPEYNGIKLFNKNGLAFNKKEEDEIEEIIFKEDFIEVEWHSVGEIWEDSRAIRNYMEHILKNVEINEKFNVVIDCANASACLVSPYLFTDLGCHVISVNSHMDGRFIGRLPEPDEKNLKKTMDMIKGLNMSGDNYIGIAHDGDADRMVAIDEKGRLADFDKLLAAFSRYMVEKTGNKKIVTTVDASMIIDEYLKDLDVEIIRTKVGDVAVAEEMIKNSAVFGGEPSGTWIHADIHLTPDGILSGLRVLEMLDFYNKKLYEILDEIPSYVNLREKIPCEDDKKEKVMSYVIENGESLFKTVPETVDGARFNLENGWVLIRPSGTEPYIRVRVEAKNNKDAKELLEKGIKLVKEALSAL

SEQ ID NO: 1043 - protein, 408 aa, Methanococcus jannaschii
MDAIILCAGKGERLRPLTENRPKPMIPIAGKPILQHIIEKVEDLVDNIYLIVKYKKEKIVDYFKNHPKIKFLEQGEIDGTGQAVLTAKDYVDDEFLVINGDIIFEDDLEEFLKYKYAVAVKEVKNPENFGVVVLDDENNIIELQEKPENPKSNLINAGIYKFDKKIFELIEKTKISERGERELTDAIKHLIKEEKVKGIKLNGYWNDVGRPWDILEANKYLLDKINTDIKGKIEENVVIKGEVIIEEGAIVKANSVIEGPAIIKKGAVVGPLAYIRPYTVLMENTFVGNSSEVKASIIMKNTKIPHLSYVGDSIIGENCNFGCNTITANLRFDDKPVKVNIKSKRVESVRKLGVIMGDNVKTGIQVSFMPGVKVGSNCWIGASCLIDRDIESNTFVYKRDELIFRKLK

SEQ ID NO: 1044 - protein, 176 aa, Methanococcus jannaschii
MDKKSKLINLLKEVGCIRFGEFILASGKKSNYYIDIKKATTNPEILKLVGEIIAEQIKDEDVKVAGVELGSVPIATAVSIIAQKPLLIVRKKPKDYGTKNKIEGELKEGDKVVIVEDVTTTGGSVLKAVKEIRENGGIVDKVFVVVDRLEGAKENLQKENVELIPLVTVKELQSTQ

SEQ ID NO: 1045 - protein, 295 aa, Methanococcus jannaschii
MEFTKMHALGNDYIVINEFDGEKVKEEEKAEFSRKICRRGFSVGADGVIFIQKPTSDEYDVRFRIFNSDGSEAEMCGNGIRCFSKYVYERIMKKNPLKVETKGGLRVSEMEIEGDEVKKIKVYMGVPKFKLKDIPMVVDGYKEDDEFLNGELKLKNPYLPKVKLSVVNVGNPHAVIFVEDNNIDLDFVREHLDVIGKEIEHHEAFPERINVHFVKVLNPNEIRIVTWERGAGYTTACGTGTTASVIMAHKLGKTNNRVLAHLDGGDLEIEIKDDGVYMIGDAVMVYDAKLINIGW

SEQ ID NO: 1046 - protein, 343 aa, Methanococcus jannaschii
MPAKVLINGYGSIGKRVADAVSMQDDMEVIGVTKTKPDFEARLAVEKGYKLFVAIPDNERVKLFEDAGIPVEGTILDIIEDADIVVDGAPKKIGKQNLENIYKPHKVKAILQGGEKAKDVEDNFNALWSYNRCYGKDYVRVVSCNTTGLCRILYAINSIADIKKARIVLVRRAADPNDDKTGPVNAITPNPVTVPSHHGPDVVSVVPEFEGKILTSAVIVPTTLMHMHTLMVEVDGDVSRDDILEAIKKTPRIITVRAEDGFSSTAKIIEYGRDLGRLRYDINELVVWEESINVLENEIFLMQAVHQESIVIPENIDCIRAMLQMEEDNFKSIEKTNKAMGIQ

SEQ ID NO: 1047 - protein, 108 aa, Methanococcus jannaschii
MVKFCPKCNNLMLPKDGKLKCAVCGYEEETTAEGSKEYEYKEHLENKKEKITVIESEGLETLPTTRIECPKCGHNEAYWWLQQTRCADEPETRFYKCKKCGHTWREYD

SEQ ID NO: 1048 - protein, 903 aa, Methanococcus jannaschii
MVKELKVAEAYQGDVGRGIARIDPYTMEELGLKPGDVIEIEGPKGKAYAIVYRGFLEDAGKGIIRIDGYLRQNAGVAIGDRVKVKRVEIKEAKKVVLAPTQPIRFGPGFEDFVKRKILGQVLSKGSKVTIGVLGTALTFVVVSTTPAGPVRVTDFTHVELKEEPVSEIKETKVPDVTYEDIGGLKEEVKKVREMIELPMRHPELFEKLGIEPPKGVLLVGPPGTGKTLLAKAVANEAGANFYVINGPEIMSKYVGETEENLRKIFEEAEENAPSIIFIDEIDAIAPKRDEATGEVERRLVAQLLTLMDGLKGRGQVVVIGATNRPNALDPALRRPGRFDREIVIGVPDREGRKEILQIHTRNMPLAEDVDLDYLADVTHGFVGADLAALCKEAAMRALRRVLPSIDLEAEEIPKEVLDNLKVTMDDFKEALKDVEPSAMREVLVEVPNVKWEDIGGLEEVKQELREAVEWPLKAKEVFEKIGVRPPKGVLLFGPPGTGKTLLAKAVANESGANFISVKGPEIFSKWVGESEKAIREIFRKARQSAPCIIFFDEIDAIAPKRGRDLSSAVTDKVVNQLLTELDGMEEPKDVVVIAATNRPDIIDPALLRPGRLDRVILVPVPDEKARLDIFKIHTRSMNLAEDVNLEELAKKTEGYTGADIEALCREAAMLAVRESIGKPWDIEVKLRELINYLQSISGTFRAAAVELNSVIKATKERESAEAGEFSELKNAIGKIISVLSPAKEKIEAVEKEIDKFLEVINKEELKPSEKDEAQKLAKYLKDILGKLKEMIDNIYELENKLNTLKEQVSAEEIDEIIKTTQNIIQRFTTSLDELKNILKDIESIRLKVSTKDVKIKKEHFMKALEKIKPSVSKEDMRVYEKLAQEYGRATSVEKKKEEGKEVI

SEQ ID NO: 1049 - protein, 378 aa, Methanococcus jannaschii
MVTLMNTYGDMFRVTVFGESHGKAVGAVVDGCPANLPLSEEDIQKELDRRRPGQSIFSTPRKEEDKVEILSGIFEGKTTGAPICSIVYNKNMRPKDYSKIKDTPRPGHADLTYRLKYKNYDYRGGGRASGRVTIGHVIGGAIAKKLLSYTYNIKIIGYTIKIGKIEGDFSYYKNPEVFENEKSLERLIEIIESNPLRCPSMNEKEMEEYVLKAMENKDSVGGVVEIVALNVPVGVGNPIFNKLNGELARALMSINAVKGVEIGAGFKAAEMYGSEMNDEMYFDDDKNIRFKTNNCGGILGGISCGTPIVLRIAVKPTPSIGKKQKTINLKTLENVEIEIEGRHDPVIVPRIVPVAEAMVAITLADLMIKGGFIHPCSL

SEQ ID NO: 1050 - protein, 430 aa, Methanococcus jannaschii
MVFEEFISTELKKEKKAFTEEFKEEKEINDNSNLKNDLLKEELQEKARIAELESRILKLELEKKELERENLQLMKENEILRRELDRMRVPPLIVGTVVDKVGERKVVVKSSTGPSFLVNVSHFVNPDDLAPGKRVCLNQQTLTVVDVLPENKDYRAKAMEVDERPNVRYEDIGGLEKQMQEIREVVELPLKHPELFEKVGIEPPKGILLYGPPGTGKTLLAKAVATETNATFIRVVGSELVKKFIGEGASLVKDIFKLAKEKAPSIIFIDEIDAIAAKRTDALTGGDREVQRTLMQLLAEMDGFDARGDVKIIGATNRPDILDPAILRPGRFDRIIEVPAPDEKGRLEILKIHTRKMNLAEDVNLEEIAKMTEGCVGAELKAICTEAGMNAIRELRDYVTMDDFRKAVEKIMEKKKVKVKEPAHLDVLYR

SEQ ID NO: 1051 - protein, 288 aa, Methanococcus jannaschii
MIMFALPNKGRISEPVMKVLEKAGLKITVKGRSLFANTVDDNIKVMFARARDIPEFVADGVADIGVTGYDLVLERNVEDKVDFLLDFGFGFAKLVLAAPESSNINSIDDIKEGMRVATEFPNLTKKYFEKLNKKVEIIELSGATEIAPFIGIADLISDLTSTGTTLRLNRLKVIDEIVSSTTRLIANKNSLKDKEKREKINQIVIAIKSVLFAETKRLIMMNAPKDKVEEIRKLIPGMAGPTVSKVLSDDNMVAIHAVVNEDEIFTLVPKLHALGARDILVVPIERIL

SEQ ID NO: 1052 - protein, 501 aa, Methanococcus jannaschii
MFNKVLIANRGEIAIRIIRACWELGIKTVAVYSEADKRSLHATLADEAYCIGPAPAAKSYLNIDAILNVAEKAKVDAIHPGYGFLAENAEFARAVKKAGFEFIGPNPDAIEAMGSKINAKKIMKKAGVPLIPGSEGAIEDIDEAIEIAEAIGFPVVVKASAGGGGMGMSVAYSKEELKEVIESARNIAKSAFGDPTVFIEKYLENPRHIEIQLLGDKHGNIIHLGDRECSIQRRHQKLIEEAPSPIMTEELRERMGEAAIKAGKAINYDSAGTVEFLYENGNFYFLEMNTRIQVEHTVTEQVTGIDLVKAMIKIAAGEELTLKQEDVKIRGHAIECRINAEDPLNDFVPCPGKIKLYRSPGGPGVRIDSGVYGGAEIPPYYDSMIAKLITYGNSREEAIARMKRALREYVIIGVKTNIPFHRAVLEEENFLKGNISTHYVEQNMHKLREKMVKYALESRDLYSVVSEKVFEKNKKIAAAVGGLTMYISQIMKENEVNNKEW

SEQ ID NO: 1053 - protein, 567 aa, Methanococcus jannaschii
MVKIVDTTFRDAQQSLIATRMRTEDMLPIAEKMDEVGFYSMEVWGGATFDACIRYLNEDPWERLRALKKRIQNTPLQMLLRGQNLVGYRHYPDDIVEKFVIKAHENGIDIFRIFDALNDVRNMETAIKTAKKVGAEVQGAICYTISPVHTIDQYVELAKKLEEMGCDSICIKDMAGLLTPYEGYELVKRLKEEISLPIDVHSHCTSGLAPMTYLKVIEAGADMVDCAISPFAMGTSQPPTESIVVALKGTKYDTGLDLKLLNEIRDYFMKVREKYKMLFSPISQIVDARVLVYQVPGGMLSNLVSQLKEQGALDKFEEVLQEIPRVRKDLGYPPLVTPTSQIVGTQAVLNVLTEERYKIITNEVVNYVKGFYGKPPAPINPELLKRVLDEGEKPITCRPADLLPPEWEKVKKEAEEKGIVKKEEDILTYALYPQIAVKFLRGELKAEPIPKEKDIGKILEIPTEYIVEVDGEKFEVKIEPKIGTELKRKKEVITAEMEGAVTSPFRGMVTKIKVKEGDKVKKGDVIVVLEAMKMEHPIESPVEGTVERILIDEGDAVNVGDVIMIIK

SEQ ID NO: 1054 - protein, 224 aa, Methanococcus jannaschii
MDVMKGTTTVGLICDDAVILATDKRASLGNLVADKEAKKLYKIDDYIAMTIAGSVGDAQAIVRLLIAEAKLYKMRTGRNIPPLACATLLSNILHSSRMFPFLTQIIIGGYDLLEGAKLFSLDPLGGMNEEKTFTATGSGSPIAYGVLEAGYDRDMSVEEGIKLALNALKSAMERDTFSGNGISLAVITKDGVKIFEDEEIEKILDSMKAKPKKKTTKRSRRKSK

SEQ ID NO: 1055 - protein, 294 aa, Methanococcus jannaschii
MVLRDKMILLDENTKAIVQGITGRQGSFHTKKMLECGTKIVGGVTPGKGGQNVHGVPVFDTVKEAVKETDANASVIFVPAPFAKDAVFEAIDAGIELIVVITEHIPVHDTMEFVNYAEDVGVKIIGPNTPGIASPKVGKLGIIPMEVLKEGSVGMVSRSGTLTYEIAHQIKKAGFGVSTCVGIGGDPIVGLRYKEVLDLFEKDDETEAIVMIGEIGGGAEEEAAKFIEKMKKPVIGYIAGQSAPEGKRMGHAGAIVEKGKGTAESKMKALEEAGAYVAKNISDIPKLLAGILGK

SEQ ID NO: 1056 - protein, 437 aa, Methanococcus jannaschii [sequence omitted]

SEQ ID NO: 1057 - protein, 140 aa, Methanococcus jannaschii
MKERTFVALKPDAVKRKLIGKIIERFENKGFEIVAMKMIKLDREMAEKYYEEHKGKEFYERLINFMTSGRMIVMVVEGENAISVVRKMIGKTNPAEAEPGTIRGDFALTTPDNIIHASDSKESAEREIKLFFKEDEIFDK

SEQ ID NO: 1058 - protein, 372 aa, Methanococcus jannaschii
MFREKLRREIEIIKNNGLYRFLRKKDDGVLDFSSNDYLCLSKHPEVIEAVKEGLKYGAGSTGSRLTSGNINHQRLEEKIAEFKETERTLVYSSGYATNVGVISALCKKGDLILSDKLNHASIIDGCKLSKADVLIYNHCDVEHLTNLIEENWGKYNNLFIVTDGVFSMDGDIAPLRDLKKIADEFNAILIIDDAHGTGVLGDGRGTLKHFNLKPSDNIVQIGTLSKAIGGLGGFVCGIEEVVEYLINTSRSFIFSTALPPHVVEGCIKAFEIIEKTDIVKKLQKNIKIANKVFKKYEFIKEDNLTPIYPFIFKEKTMEIAEHLIKNNIFCVGIRYPTVPKGLERIRVSINVGHEKEDFELLCERIKEVYSSD

SEQ ID NO: 1059 - protein, 464 aa, Methanococcus jannaschii
MNKMNIDKNLLEKWDKEYIWHPYTQMKEYRESKNLIIERGEGNYLIDIYGNKYLDAVSSIWCNLFGHSRKEIIEAIKNQADKICHSTLLGCGNVPSILLAKKLVDITPKHLTKVFYSEDGAEAVEIAIKMAYQYYVLRGDKGRTKFISVKEGYHGDTVGAMSVGGSELFHGVFKPLLFKGYHANPPYCYRCKYHNFKDTDERNEKGCEMECLNEMISLIEKHAEEVFCVILEGGIMGSAGMIPYPDGYIEGVAKACKENDVIFILDEVATGFGRTGKMFFCDNEELKKLEKPDILCLGKGLTGGYLPLAATLTTDEIYNQFLGEFGESKQLYHGHTYTGNQLLCSAALATLEIFEKENVIENIQPKIKLFHKELRKLKELEHVGDVRGRGFMVGIELVKDKETKEPYPYGYKAGYRVAEKLLEKGIYMRPIGNVIILVPPLSITEKEIIYLCDALYEAIKEADL

SEQ ID NO: 1060 - protein, 492 aa, Methanococcus jannaschii
MSYMERESWSSNLGFILASVGSAIGLGNIWRFGYMVYTNGGGAFLIPYIVALLCVGIPLMILEFAIGHYTKKSAPLALEKLHKGSEWTGWFAVISGFIITSYYVVIIAWCLYYLIILVIYGYPSDPNAYFFHNILQISSGVEDIGGVSYGILVSTLAVWGIVALILSAGIKNGLEKANKIMIPFLLFLIILLVLNALTLPGALTGIEWYLTPDFSALFNYNVWLSAFSQIFFSLSLGFGILIAYASYLPKKSDLTINAVTVSLLNCGFSFLAGFAVFGTLGYMSYTSGIPLDKAVSEGIGLAFVTFPKALSLLPFASRLFGIVFFLALVFAGISSAVSIVEASVSAIIDKFSLSRKKALLAVLALFIIISPIFTTGAGLYYLDIIDHFASGYLLPIAAILEIIIAIWLFGGDKLREHVNKLSEIKLGVWWKYLAGVVSPIILTAVVFLDASNVLTSGYGGYKTTYVIFGALIIPLAFVVSVILQKMKTIKGW

SEQ ID NO: 1061 - protein, 1005 aa, Methanococcus jannaschii
MSMILKEIRMNNFKSHVNSRIKFEKGIVAIIGENGSGKSSIFEAVFFALFGAGSNFNYDTIITKGKKSVYVELDFEVNGNNYKIIREYDSGRGGAKLYKNGKPYATTISAVNKAVNEILGVDRNMFLNSIYIKQGEIAKFLSLKPSEKLETVAKLLGIDEFEKCYQKMGEIVKEYEKRLERIEGELNYKENYEKELKNKMSQLEEKNKKLMEINDKLNKIKKEFEDIEKLFNEWENKKLLYEKFINKLEERKRALELKNQELKILEYDLNTVVEARETLNRHKDEYEKYKSLVDEIRKIESRLRELKSHYEDYLKLTKQLEIIKGDIEKLKEFINKSKYRDDIDNLDTLLNKIKDEIERVETIKDLLEELKNLNEEIEKIEKYKRICEECKEYYEKYLELEEKAVEYNKLTLEYITLLQEKKSIEKNINDLETRINKLLEETKNIDIESIENSLKEIEEKKKVLENLQKEKIELNKKLGEINSEIKRLKKILDELKEVEGKCPLCKTPIDENKKMELINQHKTQLNNKYTELEEINKKIREIEKDIEKLKKEIDKEENLKTLKTLYLEKQSQIEELELKLKNYKEQLDEINKKISNYVINGKPVDEILEDIKSQLNKFKNFYNQYLSAVSYLNSVDEEGIRNRIKEIENIVSGWNKEKCREELNKLREDEREINRLKDKLNELKNKEKELIEIENRRSLKFDKYKEYLGLTEKLEELKNIKDGLEEIYNICNSKILAIDNIKRKYNKEDIEIYLNNKILEVNKEINDIEERISYINQKLDEINYNEEEHKKIKELYENKRQELDNVREQKTEIETGIEYLKKDVESLKARLKEMSNLEKEKEKLTKFVEYLDKVRRIFGRNGFQAYLREKYVPLIQKYLNEAFSEFDLPYSFVELTKDFEVRVHAPNGVLTIDNLSGGEQIAVALSLRLAIANALIGNRVECIILDEPTVYLDENRRAKLAEIFRKVKSIPQMIIITHHRELEDVADVIINVKKDGNVSKVKING

SEQ ID NO: 1062 - protein, 391 aa, Methanococcus jannaschii
MLFLLSLKRIFIFRNHKFNIVGDVMGIEEEIRRIEEELKKTPYNKATQKHIGRLKAKLAKLREQAQSRGGGGGGKGYAVKKSGDATAAFVGFPSVGKSTLLNKLTNAKSEVGAYAFTTLTIVPGILEYKGAKIQLLDAPGIIVGASSGKGRGTEVLSAVRSADLILLTVDIYTLDHLPVLEKELYNVGIRLDQTPPDVKIKVKERGGINVSSTVPLTHIDEDTIEAILNEYRIHNADVVIREDITLEQFIDVVAGNRVYIPSLVVVNKIDLADEEYLKYIKQKLEEFGKDYILVSGNKGINLDLLKEKIYEKLGFIKIYLKPQGKKPDFDEPLIMRRGATVKDVCEKLHKDFVRNFRYAQVWGKSAKHPGQRVGLDHKLEDGDILTIVIKR

SEQ ID NO: 1063 - protein, 393 aa, Methanococcus jannaschii
MAMIGLVGKPNVGKSTMFNALTEKPAEIGNYPFTTIQPNKGIAYITSPCPCKELGVKCNPRNSKCIDGIRHIPVEVIDVAGLVPGAHEGRGMGNKFLDDLRQADAFILVVDASGKTDAEGNPTENYDPVEDVKFLLNEIDMWIYSILTKNWDKLARRAQQEKNIVKALKDQLSGLNIDEDDIKMAIRDMDESPIKWTEEDLLNLAKKLRKISKPMIIAANKADHPDAEKNIERLKKEFKDYIVIPTSAEIELALKRAEKAGIIKRKENDFEIIDESKVNEQMRRAFDYIKDFLKKYGGTGVQECINKAYFDLLDMIVVYPVEDENKFSDKQGNVLPDAFLVKKGSTARDLAYKVHTELGEKFIYAIDAKKKIRVGADYELKHNDIIKIVSAAK

SEQ ID NO: 1064 - protein, 283 aa, Methanococcus jannaschii
MIRKAVIPVAGFGTRLLPITKAQPKEMLPVVNKPIVQYVVEDLVEAGVKDILFVTGKGKQAIENHFDVNYELECKLEKSGKYELLKIIKEIDRLGNIFYVRQKEQKGLGDAILYGEEFVGEEYFIAMVGDTIYSKNIVKDLIKAHEKYGCSVIALERVPKEDVYKYGVIDGEEIEKGVYKIKNMVEKPKVEEAPSNLIITGAYLLSPKIFEKIRETPPGRGGEIQITDAMNLLLKEEDIIGVEINCKRYDIGDALGWLKANVEIGAERFPEFREFLKEFVKNL

SEQ ID NO: 1065 - protein, 154 aa, Methanococcus jannaschii
MKKDEVKVVVIGSSDVGKTTLMENLIDKIGKVEYKGITTAIDYGSLTIKDKKIHFFGTPGQKRFEFMRELALKGTNFALVVLDASKGITKEDEEIIKLLESKKIPYGIFINKTDVGDIDTSEVYNFCNPKFIVKGCAVKKDGLDELINKIMSHT

SEQ ID NO: 1066 - protein, 291 aa, Methanococcus jannaschii
MKFFGDKMIVVSGSQSQNLAFKVAKLLNTKLTRVEYKRFPDNEIYVRIVDEINDDEAVIINTQKNQNDAIVETILLCDALRDEGVKKITLVAPYLAYARQDKKFNPGEAISIRALAKIYSNIVDKLITINPHETHIKDFFTIPFIYGDAVPKLAEYVKDKLNDPIVLAPDKGALEFAKTASKILNAEYDYLEKTRLSPTEIQIAPKTLDAKDRDVFIVDDIISTGGTMATAVKLLKEQGAKKIIAACVHPVLIGDALNKLYSAGVEEVVGTDTYLSEVSKVSVAEVIVDLL

SEQ ID NO: 1067 - protein, 553 aa, Methanococcus jannaschii
MEEKILPIALRNAIKYNGKANPKAVLGIFLSENPEYRSKAKEVMPIVEKVVEEVNKLSLDEIKKKLEELGEDVKKKEKKEKGLELPNVKDKVVMRFAPNPSGPLHIGHARAAVLNDYFVKKYGGKLILRLEDTDPKRVLPEAYDMIKEDLDWLGVKVDEVVIQSDRIELYYEYGRKLIEMGHAYVCDCNPEEFRELRNKGVPCKCRDRAIEDNLELWEKMLNGELENVAVRLKTDIKHKNPSIRDFPIFRVEKTPHPRTGDKYCVYPLMNFSVPVDDHLLGMTHVLRGKDHIVNTEKQAYIYKYFGWEMPEFIHYGILKIEDIVLSTSSMYKGIKEGLYSGWDDVRLGTLRALRRRGIKPEAIYEIMKRIGIKQADVKFSWENLYAINKELIDKDARRFFFVWNPKKLIIEGAEKKVLKLRMHPDRPEFGERELIFDGEVYVVGDELEENKMYRLMELFNIVVEKVDDIALAKYHSDDFKIARKNKAKIIHWIPVKDSVKVKVLMPDGEIKEGFAEKDFAKVEVDDIIQFERFGFVRIDKKDNDGFVCCYAHR

SEQ ID NO: 1068 - protein, 482 aa, Methanococcus jannaschii
MESIKKVMVFGSGPIVIGQAAEFDFSGSQACKALKEEGIYTILVNSNPATIQTDTDMADKVYLEPLHPTIVEKIIEKERPDAILPTMGGQTGLNLALELHRRGILDKYGIKLLGSNIRTIEIAEDRELFAEAMAEINEPVTKCKAVNSVDEAVEFAEEIGYPVIVRPAFTLGGTGGGIAHNKEELIDITSKGLKYSIINQVLIDESVLGWKEFELEVMRDRKDTCIIVCGMENIDPMGIHTGESIVVSPIQTLPDEFYQKLRNAAIKIIRHLGIEGGCNIQFAVNKEMTEYRVIEVNPRVSRSSALASKATGYPIARIAAKIAIGKTLDEILNDVTKETPASFEPTLDYVVVKIPRWPFDKFKTVDKKLGTSMKSTGEVMAIGRSFEEALQKAIRSLDIGRFGIIGDGKDKDYTDEEIEEILKNPTDERIFVIAKALEKGWSVEKIVELTDIDEFFIKKIKNIVDMKKELEKLKEEIKKLNA

SEQ ID NO: 1069 - protein, 618 aa, Methanococcus jannaschii
MDMEKLKEILLKAKKLGFSDKQIANLLGMDEIEVRDLRKKLNIIPLYKMVDTCAAEFEAKTPYYYSAYETFVYKEQDESNPSDRKKVIIIGSGPIRIGQGIEFDYSSVHAVLALKEMGIEAIIINNNPETVSTDYDTSDKLYFEPITFEEVLNIAEREKEKGELLGVIVQFGGQTAINLAMKLKNAGVNILGTTPENINAAEDREEFSKLLKKLNIPQAEGGTAYTKEEALEIAKRIGYPVLVRPSYVLGGRAMQIVYSEDELIEYMEEAVKVSEEHPVLIDKFLEDAIELDVDAVCDGESVLIGAIMEHIEEAGVHSGDSATVIPPQTLPKEIIDTVIDYTAKLARALNIVGLLNVQYAVKDGVVYVLEANPRASRTVPYVSKSVGIPLAKLATKIMLGKKLEELIKDYDVEKVAEKVWIAKPKYVSIKEAVFPFQKLPGVDPVLGPEMKSTGEAIGIDKDFGRAYYKAQLSANMELPIVGNVFISVRDRDKKHIVDVAKKLHELGFTIYATEGTAKVLRENGIPAILVKKISESPNDNILKLMRDGKMHLIINTSSGKKAKSDGYYIRRAAVDLGIPYITTIPGAKAAVKAIEAVKTGELSVYSLDELDARIKNRF

SEQ ID NO: 1070 - protein, 415 aa, Methanococcus jannaschii
MYEVRDINLWKEGERKIQWAKQHMPVLNLIRERFKEEKPFKGITIGMALHLEAKTAVLAETLMEGGAEIAITGCNPLSTQDDVAAACAKKGMHVYAWRGETVEEYYENLNKVLDHKPDIVIDDGCDLIFLLHTKRTELLDNIMGGCEETTTGIIRLKAMEKEGALKFPVMDVNDAYTKHLFDNRYGTGQSALDGILRATNLLIAGKTVVVAGYGWCGRGVAMRAKGLGAEVVVTEVNPIRALEARMDGFRVMKMEKAAEIGDIFITTTGCKDVIRKEHILKMRNGAILANAGHFDNEINKKHLEELAKSIKEVRNCVTEYDLGNKKIYLLGEGRLVNLACADGHPCEVMDMSFANQALAAEYILKNHEKLEPRVYNIPYEQDLMIASLKLKAMGIEIDELTKEQKKYLEDWREGT

SEQ ID NO: 1071 - protein, 418 aa, Methanococcus jannaschii
MESYIQNLFAERIGGKKFGKEDVIYKFEKIKRAKQEAMKRHPDMELIDMGVGEPDEMADPEVIRVLCEEAKKWENRGYADNGIQELKDAVPPYMEKVYGVKDIDPVNEVIHSIGSKPALAYITSAFINPGDVCLMTVPGYPVTATHTKWYGGEVYNLPLLEENDFLPDLESIPEDIKKRAKILYLNYPNNPTGAQATKKFYKEVVDFAFENEVIVVQDAAYGALVYDGKPLSFLSVKDAKEVGVEIHSFSKAFNMTGWRLAFLVGNELIIKAFATVKDNFDSGQFIPIQKAGIYCLQHPEITERVRQKYERRLRKMVKILNEVGFKARMPGGTFYLYVKSPTKANGIEFKTAEDFSQYLIKEKLISTVPWDDAGHYLRLAACFVAKDENGNPTTEEKYEDMVLEEFKRRLEGMDLEFE

SEQ ID NO: 1072 - protein, 149 aa, Methanococcus jannaschii
MIPMEELKVKKITNGTVIDHIDAGKALMVFKVLNVPKETSVMIAINVPSKKKGKKDILKIEGIELKKEDVDKISLISPDVTINIIRNGKVVEKLKPQIPDEIEGTLKCTNPNCITNKEKVRGKFKIESKNPLKIRCYYCEKFLNEVIFE

SEQ ID NO: 1073 - protein, 463 aa, Methanococcus jannaschii
MFIDGKWINREDMDVINPYSLEVIKKIPALSREEAKEAIDTAEKYKEVMKNLPITKRYNILMNIAKQIKEKKEELAKILAIDAGKPIKQARVEVERSIGTFKLAAFYVKEHRDEVIPSDDRLIFTRREPVGIVGAITPFNFPLNLSAHKIAPAIATGNVIVHHPSSKAPLVCIELAKIIENALKKYNVPLGVYNLLTGAGEVVGDEIVVNEKVNMISFTGSSKVGELITKKAGFKKIALELGGVNPNIVLKDADLNKAVNALIKGSFIYAGQVCISVGMILVDESIADKFIEMFVNKAKVLNVGNPLDEKTDVGPLISVEHAEWVEKVVEKAIDEGGKLLLGGKRDKALFYPTILEVDRDNILCKTETFAPVIPIIRTNEEEMIDIANSTEYGLHSAIFTNDINKSLKFAENLEFGGVVINDSSLFRQDNMPFGGVKKSGLGREGVKYAMEEMSNIKTIIISK

SEQ ID NO: 1074 - protein, 1102 aa, Methanococcus jannaschii
MKFMCGIIGYIGNDKAPKILLNGLRRLEYRGYDSCGIGVVDNNKLIIKKNVGKVEEVAKKERFLDIDGNIGIGHCLHPDTYVILPDGRMKKISEIDEDEVLSVNFEDLKLYNKKIKKFKHKAPKILYKIKTAFSELITTGEHKLFVVENGKIVEKCVKDLNGSELIGVVRKLNYSFNDNVEFKDVYVERHYKLDETIRNKLRKVREKLGLTRKDVEKLCGVKEIYIVKIETGKLESIEEERLKKLCSLYGINFEEIIYRDNLHYTNPVKFPKTPTPELMQIIGYIIGDGHFPSNRMLRLKDERKEVLEEYNQLFKTVFNLEGNIKKGDGNYYILEINSKYLIDWFRENIPELFNKTGNERTPEFVFRLNNDLVASYLRGIFDAEGYIRAEAKQIGIGMTSKCFIKEIQFLLLRFGILASYSKIKRKEENWNNTHKLLISDKKSFELFKKYIGFTAKDKMEKLEAILNKMKGLNFRYISIPLTKKEIREFVGVPLKTIKNGDNYCTDYTIEKIIEELNSKGLYDKAEYLKRFLDADIVWTKFKIEEVESDVEYVYDLEVEDYHNFIGNLIINHNSRWATHGNVCKENAHPHTDCKEEIAVVHNGIISNYKELKDELMKKGHKFKSETDTEVVPHLIEEELKKFKEINEENYIKAVKNAIKKLKGTYALVIINKNFPNLLIGARNESPLILGINDDGYFLGSDITAFLDYTNKAIPLEDGDVVVIKKKENGYEVTIENNGNTVEREMMEINWDISSAEKMGYPHFMLKEIMEQPEVLKVSAKISAEEIKELAKCIKDYDRVYFVAMGTSLHAAMVVEYLFAKLGKLVIACDASEFLNKGVVDDKTLVIGITQSGETYDTLKALRFAKKNKAKTGAIVNVLGSTATREADITVMMGAGIEIAVCATKTYTSQLMILYRLFIEYGKLLGRDMSEYEKEIDKIPNYIKEVLDKKETIKEIANNLKVNNYIFISKGINIASALEGALKFKEITYLHAEGMSGGLLKHGTISLIDENMDTVAIVPPRDSAVFNSILSNIEEVKARGGKVIAITPTEIDGAENILVPEVIEEISPIVYAPAFQLLAYYKAVELGRDVDKPRGLAKSVTVE

SEQ ID NO: 1075 - protein, 1847 aa, Methanococcus jannaschii
MVIIMEKPWVEKYRPKTLDDIVGQDEIVKRLKKYVEKKSMPHLLFSGPPGVGKCLTGDTKVIVNGEIREIGEVIEEISNGKFGVTLTNNLKVLGIDEDGKIREFDVQYVYKDKTNTLIKIKTKMGRELKVTTYHPLLINHKNGEIKWEKAENLKVGDKLATPRYILFNESDYNEELAEWLGYFIGDGHADKESNKITFTNGDEKLRKRFAELTEKLFKDAKIKERIHKDRTPDIYVNSKEAVEFIDKLGLRGKKADKVRIPKEIMRSDALRAFLRAYFDCDGGIEKHSIVLSTASKEMAEDLVYALLRFGIIAKLREKVNKNNNKVYYHIVISNSSNLRTFLDNIGFSQERKLKKLLEIIKDENPNLDVITIDKEKIRYIRDRLKVKLTRDIEKDNWSYNKCRKITQELLKEIYYRLEELKEIEKALEENILIDWDEVAERRKEIAEKTGIRSDRILEYIRGKRKPSLKNYIKIANTLGKNIEKIIDAMRIFAKKYSSYAEIGKMLNMWNSSIKIYLESNTQEIEKLEEIRKTELKLVKEILNDEKLIDSIGYVLFLASNEIYWDEIVEIEQLNGEFTIYDLHVPRYHNFIGGNLPTILHNTTAALCLARDLFGENWRDNFLELNASVSKDTPILVKIDGKVKRTTFEELDKIYFETNDENEMYKKVDNLEVLTVDENFRVRWRKVSTIIRHKVDKILRIKFEGGYIELTGNHSIMMLDENGLVAKKASDIKVGDCFLSFVANIEGEKDRLDLKEFEPKDITSRVKIINDFDIDEDTAWMLGLYVAEGAVGFKGKTSGQVIYTLGSHEHDLINKLNDIVDKKGFSKYENFTGSGFDRKRLSAKQIRILNTQLARFVEENFYDGNGRRARNKRIPDIIFELKENLRVEFLKGLADGDSSGNWREVVRISSKSDNLLIDTVWLARISGIESSIFENEARLIWKGGMKWKKSNLLPAEPIIKMIKKLENKINGNWRYILRHQLYEGKKRVSKDKIKQILEMVNVEKLSDKEKEVYDLLKKLSKTELYALVVKEIEIIDYNDFVYDVSVPNNEMFFAGNVPILLHNSDERGIDVIRTKVKDFARTKPIGDVPFKIIFLDESDALTADAQNALRRTMEKYSDVCRFILSCLTGDAKITLPDEREIKIEDFIKMFEERKLKHVLNRNGEDLVLAGVKFNSKIVNHKVYRLVLESGREIEATGDHKFLTRDGWKEVYELKEDDEVLVYPALEGVGFEVDERRIIGLNEFYEFLTNYEIKLGYKPLGKAKSYKELITRDKEKILSRVLELSDKYSKSEIRRKIEEEFGIKISLTTIKNLINGKIDGFALKYVRKIKELGWDEITYDDEKAGIFARLLGFIIGDGHLSKSKEGRILITATINELEGIKKDLEKLGIKASNIIEKDIEHKLDGREIKGKTSFIYINNKAFYLLLNFWGVEIGNKTINGYNIPKWIKYGNKFVKREFLRGLFGADGTKPYIKKYNINGIKLGIRVENISKDKTLEFFEEVKKMLEEFEVESYIKVSKIDNKNLTELIVKANNKNYLKYLSRISYAYEKDNFARLVGEYLRIKEAYKDIILKEIAENALKEADGEKSLRELARKYNVPVDFIINQLKGKDIGLPRNFMTFEEFLKEKVVDGKYVSERIIKKECIGYRDVYDITCHKDPSFIANGFVSHNCNYPSKIIPPIQSRCAVFRFSPLKKEDIAKKLKEIAEKEGLNLTESGLEAIIYVSEGDMRKAINVLQTAAALSDVIDDEIVYKVSSRARPEEVKKMMELALDGKFMEARDLLYKLMVEWGMSGEDILNQMFREINSLDIDERKKVELADAIGETDFRIVEGANERIQLSALLAKMALMGR

SEQ ID NO: 1076 - protein, 344 aa, Methanococcus jannaschii
MILKPENEKKLIIDVLKKFGVPEEDAKITADVFVDADLKGFTSHGIGRFPQYITALKLGNINPKPDIKIVKESPATAVIDGDLGLGQVVGKKAMELAIKKAKNVGVGVVATRNANHFGIAGYYSELAMNQDMIGITITNTEPAMAPFGGKEKILGTNPIAIAFKGNKYKFSLDMATASIARGKILEALRKKIKIPEGCAVDKDGKPTTDPAKALEGCILPFGGPKGYGLALAIEMLSAIGGAEVGTKVKGTANPEERCTKGDLFIAINPEFFMGKEEFKRKVDELLDEIKNSEPAEGFEILIPGEIEERNKMKRKDGFEIDKNLYNQLKEICNELGLNIEDYIE

SEQ ID NO: 1077 - protein, 328 aa, Methanococcus jannaschii
MIIQTPSRIHMGLIDLNGSIGRVDGGIGLALEEPNIKIEGKESDDISIEFDKKLIEKYGEDYIKSVRDRVYNTAIKVLDVIGGEGVDLKILSLFPAHSGLGSGTQLSLAVGKLISKIYNKEMNAYNIAKITGRGGTSGIGIGAFEYGGFLIDGGHSFGKGKDKEDFRPSSASKGVKPAPIIFRHDFDWETILIIPKGEHVYGKKEVDIFKKYCPVPLNEVEKICHLVLMKMMPAVVEKNLDDFGEVINKLQYLGFKKVELSLQSDIVKDLINELHKDVYAGLSSFGPTIYAFGDKKLIVEKANDIFDKYGVYGEIIITKANNVGHKIW

SEQ ID NO: 1078 - protein, 1226 aa, Methanococcus jannaschii
MKITFYMWASYCSILKKALDELKKEGVDVEYKIYSNRNPIDDEFLEDAKDYDLVFIYRTSSDDIDLEKIKKFNENVIVVAQDPNFWNSEKSAKCYLFITYGGLDNFKNMVLYLMGKDKDVVKHPFQGIYYRGKIYEELEEFLKDVEFNKKYTVGILFSRHYLVNDDMDVIEKLLNRLDKEFNVIPVFSYGAKCEDLNALGSGESVLKYFLKDDKPIIDALINLLSFPLGTVKDKANLNKISGVEILKKLDVPVFHPIMSYYKSYEDWKKDEQGLSADIGWTIALPEFEGVIEPIIIGTTENENGLEKKFGIEERIDKVVRRIKRWIELKYKPKKDRKVIFILHNNACASVEATVGSAAHLDSFQSVINIMKKLKEEGYYVENIPENGEELAQLIMQKKAISEFRWTTVNEIIAKGGYLYLMDEEEYYEYFNTLPENVKNKILETWGDLNGKDIPAGMIYKVNGKNKIVITGLKFGNVYVCVQPKRGCAGARCDGRVCKILHDPYCPPTHQYIASYKYFNDIADIIIHVGTHGTLEFLPGKNVGLSNECYPDICIGDIPHLYIYNSDNPPEGTIAKRRSYATIIDHMQTVMVDAFYEELETLDSYIEEYLKEMDASRRHQLEHLIVEEVKKTNLLKIKEKIEKIEKEGKIHENFKEIFDELRDILEMIKNSKCNDGMHIFGELPSGEKRVEFIKSILEAIFIQNNTMNSKRRGIAERSEAMHPGYPNRGLPPMEFEYKDKNLKKKVSDVLNGKSIEDKKLEEKIKDINERIEKSDEIGSLLRGIDAKYIEPGPSGLITRGNYDILPTGRNFYSLDPYRIPTKSAYRVGVLLAEKLINRYLEEEGRYPENIALYWMASDIMWADGEGMGMILYLLGVKPVYRGGRVVGLEVIPLEELGRPRIDVTIRVSGITRDMFPNCIELVDEAIMKVANLDEPLEMNFVKKHVVENLNKGLSFRESTFRIFCSPPGTYGNGVKYAVYASAWENDEDLKDAFIYWNSYAYGKDVYGKKAINAFENILKTVDLTFNKVVTDEYDLFGCCCYFGTHGGLTNAARVLKGEEVKAYYGDTRNPNNVEVRTLKEEIERVSLTKLLNPKWIEGMKRHGYKGAGDIAKRIGRVYGWSATTKEVENWIFDEIFNTFVKNEENRKFFKEHNIYALEEIARRLLEAYQRGLWKTTEGNIEELKRAYLEIEGDIEETYSSIADIGEFQGGSVDIDMIWKEKLMSNGR

SEQ ID NO: 1079 - protein, 220 aa, Methanococcus jannaschii
MICLPVVEDSVEKAIKTAEKYLEIADIVEFRIDMLKEVSEEDIEKFAKYPCIITVRADWEGGYWKGNNEERLNLIKKAIECNAKFVDIELREEKNKELVKFRDEIGSKTKIIISYHDFEKTPSKEKLVEIVEKALSIGDIAKFATMANSKEDVLNILEVINKYPGKIIGIGMGEKGKLTRILGVYFGSILTFASYKGKSSAPGQVDIDTLKEIWRLMDLK

SEQ ID NO: 1080 - protein, 429 aa, Methanococcus jannaschii
MVTGMIIKKIKELTKEEEEKIINRNKANFEEILPTVMEILKDVKEKGDEALKYYTKKFDGVEIEDFKVTDEEIEEAYNSVDYKVVEAIERAKENIYFFHKKQMEQIKDLNVENNGIILGQVVRAIEKVGCYVPGGRAFYPSTVLMTTIPAKVAGCEEIYITSPPTKDGKGNPATLIAGDIVGVSAIYKVGGVQAIGALAYGTETIPKVDIIVGPGNIYVTTAKKMVYGEVAIDFLAGPSEVLIIADETANAEFVALDFIAQAEHDPNASCVITTTSEKKAEEIKNKIFEEIEKAERKEIILKALENSAILIGDLEECIEFSNKYAPEHLEILTKNPEEVLNKIKHAGSVFLGEYSPVPVGDYASGTNHVLPTSQFARMSSGLNVETFLKKITYQKLDKESLKNIADIVITLAEAEGLFGHAEAVRRRLK

SEQ ID NO: 1081 - protein, 432 aa, Methanococcus jannaschii
MRNPIIDVGAKELSYEIREIVDVAKKIEEFGINITWENIGDPVAKGEKIPDWIKDIIAEIVKNDCSYAYCPTKGLLETREFLAEQVNKRGGVQITAEDIIFFNGLGDAIAKIYGLLKRQVRVINPSPSYSTHSSAEASHAGSPPVTYFLDPYNYWYPDIDDLEKRIKYNPAVSGILVINPDNPTGAVYPKKILNEIVDLANEYDLFIICDEIYCNLVYNGKKQHLLCEVIDDVCGLSLKGISKELPWPGARCGWIEIYNADKDEEFKKYVESIYKAKLIEVCSTTLPQMAIPRIMGHRNYKKYLEERNRFFEKRSNTAYKKLKDLDGVIANKANGAFYMSVVFEDNYLNGNNSIKIENEKLKEFIEHQIKDASIDKKFVYYLLASTGICVVPLTSFCSQLNGFRVTLLERDDEKFEWIFDTLAEKIDEFLKT

SEQ ID NO: 1082 - protein, 393 aa, Methanococcus jannaschii
MVKFMAIGTPLLKGSIKFLLLGSGELGKEVVIEAQRLGIECIAVDRYQNAPAMQVAHKSYVIDMKDYDALMAIIEREEPDYIVPEIEAINTDALIDAEKMGYTVIPTAEATKITMNRELIRRLAAEKLGLKTAKYEFADSLEELRDAVEKLGLPCVVKPIMSSSGKGQSVVRSEEDIEKAWKIAKEGARGIGNRVIVEEFINFDYEITLLTARTAEGTKFCEPIGHVQIDGDYHESWQPHNMSAELKEQAQDIAKKVTDALGGYGIFGVELFVKGDEVIFSEVSPRPHDTGMVTMITQEMSEFEIHVRAILGLPVSTKLIHPGASHVIKAEINKYAPKYHIEDALKVPNTKLRLFGKPNAKVGRRMGVALAYADSVEKARELAEKCAHAVRIE

SEQ ID NO: 1083 - protein, 682 aa, Methanococcus jannaschii
MISSYGDVDMELRDEDLILEEVRDYLTAYLRNIHQEDIILDNERVVVDLNQLYNYGLMEFVEFLINNPQKGIDFIKECYNDAYYTLRNEYPTNVIIAVKNLPKIFKTTRKGKIFTIEDIRSKTLGKLVEFEGIIVMASKIRPMLKKAYYICPKCGREVVREIDILNTDSEKAVCECGAELNLIEHKSIYTDFQEIKVQQPLDLMENPEEPPKYITVFLENSPGIYAGRVKITGIPIKVKKSKKLPIYDIHVKALHCEVLDGEVKIKLTNSDIENIKKIAKRKDVVNILADRLIPEIKGHSAIKKAVLLQQIKGVKKPGKRADIHILLITDPGIGKTVILRKIAEIPGNLYGSVTTATGVGLTAAVVREKTEIGEDTWVIKPGLLVKAHKGTACIDELTVNKELQSYVLEAMESQTIHISKGGINAKLPAECAILAACNPRWGRFNPEVSVAEQINIPAPLLSRFDLIFPIRDVSDKDKDKDIAEYIVDLHRAYLDEKINREMGLDYLEVDGVKIDKEFIIKYIYYARQKKPIISEKAKELFVNYYVEMRKKHQITARQLEAAIRIAEAHAKAKLKDVVDEEDAKEAINIITECLKEIAYDPETGIFDVDKILGVSKKERDKLTTVYEIIKELSEKSELVEHEDIAEEAKKKGIKEDELENIIKKLIKYGDIDEPKPGRYRLL

SEQ ID NO: 1084 - protein, 371 aa, Methanococcus jannaschii
MSKIGFNPIKIKSFSKIKTYDDTLPSLKYVVLEPAGFPIRVSSENVKVSTDDPILFNIYARDQWIGEIVKEGDYLFDNSILPDYAFKVISTYPKEGGMITSETVFKLQTPKKVLRTQFKKAKFSEIIGQEEAKKKCRIIMKYLENPKLFGEWAPKNVLFYGPPGTGKTLMARALATETNSSFILVKAPELIGEHVGDASKMIRELYQRASESAPCIVFIDELDAIGLSREYQSLRGDVSEVVNALLTELDGIKENEGVVTIAATNNPAMLDPAIRSRFEEEIEFKLPNDEERLKIMELYAKKMPLPVKANLKEFVEKTKGFSGRDIKEKFLKPALHRAILEDRDYVSKEDLEWALKKILGNRREAPQHLYL

SEQ ID NO: 1085 - protein, 219 aa, Methanococcus jannaschii
MLIVINYKTYNESIGNRGLEIAKIAEKVSEESGITIGVAPQFVDLRMIVENVNIPVYAQHIDNINPGSHTGHILAEAIKDCGCKGTLINHSEKRMLLADIEAVINKCKNLGLETIVCTNNINTSKAVAALSPDYIAVEPPELIGTGIPVSKANPEVVEGTVRAVKEINKDVKVLCGAGISKGEDVKAALDLGAEGVLLASGVVKAKNVEEAIRELIKFI

SEQ ID NO: 1086 - protein, 345 aa, Methanococcus jannaschii
MAGIVGYGAYIPKYRIKVEEIARVWNKDPESIKKGLLVYEKAVPSLDEDTATIAVEAARNALKRAEIDPKDIGAVYVGSESHPYAVKPTATIVAEAIDATPDLTAADLEFACKAGTAGIQMCMGLVESGLIKYGLAIGADTAQGAPGDALEYTAAAGGAAYIIGKSNVIAEFNGTYSYTTDTPDFWRREGKPYPRHGGRFTGEPAYFRHVINAAKGLMEKMGTKPEDYDYCVFHQPNGKFYIRVAKILGFKEEQYKIGLLTPYIGNTYSGAVPLGLSNVLDNCEGGERILAVSYGSGAGSDAFDITVTDRINKVKDKAPKTAYYLERKEYIDYAIYAKFRKKIKM

SEQ ID NO: 1087 - protein, 392 aa, Methanococcus jannaschii
MRDVAIIGYGQTKFGELWERSFRSLIVEAGVKAVEAAGIDGKDIDEMYVGNMSAGLFVGQEHIASLIAEHAGLNPIPSTRVEAACASGSLALRQAVLNVASGASDVVLVGGVEKMTDVVDATSAISSASDQEWEALFGATFPSLYAMMAQRYMYEYGLTLEELSMWSVIMHENASKNRYAQFPFKVTLEQVLNSSPVAEPLRLLHCSPVSDGAAALIVCEAEKAKEFVNKDDIIYIKASVQASDTIALHSRESITSLKAAKVASEKAYKMANIEPKDVDVAEVHDCFAINGLILMEELGFCKKGEAGKIVYDKKIAIDYDGFPAVNPSGGLKAAGHALGATGIRQVGEIYWQLKQDKEVKDRQVEIKNGYGITVNVGGTGGTVCIHILSDKR

SEQ ID NO: 1088 - protein, 306 aa, Methanococcus jannaschii
MKHLISMKDIGKEEILEILDEARKMEELLNTKRPLKLLEGKILATVFYEPSTRTRLSFETAMKRLGGEVITMTDLKSSSVAKGESLIDTIRVISGYADIIVLRHPSEGAARLASEYSQVPIINAGDGSNQHPTQTLLDLYTIMREIGRIDGIKIAFVGDLKYGRTVHSLVYALSLFENVEMYFVSPKELRLPKDIIEDLKAKNIKFYEKESLDDLDDDIDVLYVTRIQKERFPDPNEYEKVKGSYKIKREYVEGKKFIIMHPLPRVDEIDYDVDDLPQAKYFKQSFYGIPVRMAILKKLIEDNEGE

SEQ ID NO: 1089 - protein, 347 aa, Methanococcus jannaschii
MMKVCVIEGDGIGKEVIPEAIKILNELGEFEIIKGEAGLECLKKYGNALPEDTIEKAKEADIILFGAITSPKPGEVQNYKSPIITLRKMFHLYANVRPINNFGIGQLIGKIADYEFLNAKNIDIVIIRENTEDLYVGRERLENDTAIAERVITRKGSERIIRFAFEYAIKNNRKKVSCIHKANVLRITDGLFLEVFNEIKKHYNIEADDYLVDSTAMNLIKHPEKFDVIVTTNMFGDILSDEASALIGGLGLAPSANIGDDKALFEPVHGSAPDIAGKGIANPMASILSIAMLFDYIGEKEKGDLIREAVKYCLINKKVTPDLGGDLKTKDVGDEILNYIRKKLKGY

SEQ ID NO: 1090 - protein, 336 aa, Methanococcus jannaschii
MDIIIVGFGAIGKGIAKVLYDKKDYLKKNYEEFKVVAITDSSGAAIDEDGLDLLKAIEVKEKTGKIKNYPEKGREMSSIDVIKEVDADVVVEVTPSNLETGDPAKTHILESFKNKKHVVTANKGPLALCYKELIEEAKKHGVIFRHEASVGGAMPIINLAKETLAGNEILSIRGILNGTTNYILTKMEKEGLDFETALKEAKELGIAETDPTQDIEGLDTAAKIVILANSIMGMNKTIKDVKVKGISRITPEALFLANKRGYTIKLIGQIKDGYLIVEPMLVPIDSPLNVKGTLNVAMFETDLAKEVVVVGRGAGPIETASAILSDLIHIYNSTKK

SEQ ID NO: 1091 - protein, 401 aa, Methanococcus jannaschii
MLSYDYENALKVGEISLEDINKVDFANAYSNLMEKLDNGVVGFRDVIYDENLDKYKSLNGYENVVVIGMGGSILGTMAIYYAISPFNNNAYFIDNSDPEKTLSILKKVDLNESIIYIISKSGNTLETLVNYYLIKKRIEKLNSFKGKLVFITNGGKLKREAEKNNYDIFSIPENVPGRFSVFTAVGLAPLYSLGVDISKILEGAREMDKICQNEDILKNPALLNGVIHYLYDKRGKDISVIMSYVESLKYFGDWYKQLIGESLGKNKHGITPLLSIGAKDQHSLLQLYMDGKKDKIITFMVAKKYRLDEEIEFEDINDEKISCRYSDIIRSQQKATEIALTNNGVPNVRITLDEINEMAMGALLYMYEMQVGFMGELYNINAYNQPAVEEEKKICWRLIKQ

SEQ ID NO: 1092 - protein, 521 aa, Methanococcus jannaschii
MKIVILAPTITPIVSYGGLGDVMRDLPKFLKKGNEVVVLTLNHYNRYFTLPYEDIKKITVIYKGAKITFDVLRTKHPTTGVDLIVFSNESVNNLNVWDPIKYEIFADLVITYLDEVKDIDVVSGHDWMCGLAIAKCNDILDLPTTLTIHNEAFKGEMIEYKGEVMTFLELGIKYADAVNTVSPSHAEEIKNYPYIKKYLNNKPFCGILNGIDIDEYDPMKIIERMCNLSNNKLDPRNYAYISPYSAEDSHNIKPKIKYSWFYRGGVYEYVEDWNKIDKGISATDVEVHGGVDGDIETPLIGFVGRATHQKGFNTMFEAIPELLEKHDIRFVFLTKGDRDIEERLKNLANEHDGRILALIGYSLPLSSLVFAGSDWIIMPSYWEPCGLVQMEAMAYCTPVIATETGGLKDTIIPLHPNPYEHPNFDKATGVLFKVPDKVGFMWGVEHALNWTFYKLNEICMFMQYIRYKCPKHPYDENSPLSMMMKNCYYHVFRNLSWQNSPSIRKYKGLFGGAIYNHYLQP

SEQ ID NO: 1093 - protein, 390 aa, Methanococcus jannaschii
MKIAMVTWEYPPRIVGGLAIHCKGLAEGLVRNGHEVDVITVGYDLPEYENINGVNVYRVRPISHPHFLTWAMFMAEEMEKKLGILGVDKYDVIHCHDWMTHFVGANLKHICRMPYVQSIHSTEIGRCGGLYSDDSKAIHAMEYLSTYESCQVITVSKSLKEEVCSIFNTPEDKVKVIYNGINPWEFDINLSWEEKINFRRSIGVQDDEKMILFVGRLTYQKGIEYLIRAMPKILERHNAKLVIAGSGDMRDYLEDLCYQLGVRHKVVFLGFVNGDTLKKLYKSADVVVIPSVYEPFGIVALEAMAAGTPVVVSSVGGLMEIIKHEVNGIWVYPKNPDSIAWGVDRVLSDWGFREYIVNNAKKDVYEKYSWDNIAKETVNVYKIAMEMMGR

SEQ ID NO: 1094 - protein, 496 aa, Methanococcus jannaschii
MFLKKLIEAKKAYTFDDVLLVPNASWVEPKDTDVSTDLAGLKLNIPIVSAAMDTVTEKEMAIALARLGGLGVIHRNMSIEEQVHQVQAVKKADEVVIKDVITVSPDDTVGEAINVMETYSISGLPVVDNEDKLVGIITHRDVKAIEDKTKKVKDVMTKDVVCAKEDVEEEEALELMYANRVERLPIVDDENRLIGIITLRDILKRRKYPQAARDKKGRLLVAAACGPHDFERAKALIEAEVDAIAIDCAHAHNMRVVENVKKFKEMLEGTDIKLIVGNIATKEAAEDLIKAGADVLKVGIGPGSICTTRVVAGVGVPQLTAVAEVADVAKEHNVPIIADGGIRYSGDIAKAIAAGADAVMLGSLLAGTDEAPGQLMVINGRKYKQYRGMGSLGAMTGGVGAGADRYFQAPAKSHMKHVKLVPEGVEGAVPYKGPVSEVVFQLIGGLRASMGYCGAKNLKEMQEKARFVIITPSGQVESHPHDIIITNEAPNYPLGK

SEQ ID NO: 1095 - protein, 1169 aa, Methanococcus jannaschii
MVTLEKIELKNFKSFKKLSLDIPKGFTAIVGPNGSGKSNIVDAILFVLGKTSAKKLRANRFSGLITYHNGKRADFAEVCLYFTNENNAFNVNADKVGILRRIKSSGETDYYLVWKENDKEKRKKMTKHEIIDLFRRLGLLGDNVISQGDLLKIINISPIERRKIIDEISGIAEFDEKKKKAEEELKKARELIEMIDIRISEVENNLKKLKKEKEDAEKYIKLNEELKAAKYALILKKVSYLNVLLENIQNDIKNLEELKNEFLSKVREIDVEIENLKLRLNNIINELNEKGNEEVLELHKSIKELEVEIENDKKVLDSSINELKKVEVEIENKKKEIKETQKKIIENRDSIIEKEQQIKEIEEKIKNLNYEKERLKEAIAESESIIKHLKESEMEIADEIAKNQNELYRLKKELNDLDNLINRKNFEIEKNNEMIKKLKEELETVEDVDTKPLYLELENLNVEIEFSKRGIKELEEKKKELQAKLDELHAEYVKENARIKALKEMEELSMDRAIREILNANLPGIIDIVGNLGKTKIEYKTAIEVAAGNRLNHIVVKRMDDAVRAIKYLKERKLGRATFLPLDRIEGREAYYIDEDGVIGRAIDLVEFDEKYRRVFEYVFGNTVVVENIDIAKELAKKYRKVRFVTLDGDVIEPSGAMIGGTFKSKAKIKVDVDLSKLNKIADEIIAIESELRKIKEEIERLSKIVKRSSAKKMEIENTLEIIKKNEMRKREIAEKNTIKIKELELKNKDILEELEELNLKREEILNRINEIESKINELIERREKIINELKEYESDENLKRMNEIEGELKILEKEKAKLKNEIDKGLTLVKEILIPKIEELNKKVSELINKKVILEKNISFYKESIEKNLSILEEKRKRYEELAKNLKELTEKKEQLEKEIETLERERREILRKVRDIENRINELMVEKAKYESKLEEEERKLYLCEKVDVSKELEKKDIEELEIYIGELENEIKSLEPVNMRAIEDYNYVAERYKELIEKRKEYERDEKKYLQLMEELENKKKEVFMEVFNKVAKNFEEVYKEIGGIGKLSLENEKNPFEGGILIDASPRGKKLLSLDAMSGGEKSLTALAFLFAIQRLNPSPFYVLDEVDAALDVKNVSLIADMIKNASKDSQFIVISHREQMVSKADVVYGVYMENGLSKVVGIRL

SEQ ID NO: 1096 - protein, 761 aa, Methanococcus jannaschii
MAEIMTALIICEKPSVAKKIANALGKAKKKSIDGVPYYELERDGKKIIVASAVGHLFTLVEKENKEFGFYPVFDIKWVPASVDKGKEYVNKYIKALKKLSKDADEFYIATDWDIEGELIGYHALKYCCGREKAKRMRFSSLTKKEIVRAFENPDEIDYGLVDAGESRHILDWYFGINLSRALMNAIRAVNRWKTMSVGRVQGPALAFLTERELEIKKFIPKPYWVIEALLKDNLKAIHEKEKFWNEKEAKNVYEKIKDEKSAKVVEIKKTKRKLKPLPPFDLGTLQREAYSYFKISPKETQEIAQKLYENALISYPRTSSQKLPKDRKYLEDILNIIKNHPVYGKWAERILKENLKPVEGKKEDPAHPAIHIVDIPKEELSEKEKEIYDLIARRTLAAFWDNAEREYLNVKIDIKGEKFKLSGSRTVKEGWHEIYYFPKFDEIELPPLKKNDIIKVEKITITRKETQPPKRYTVASIIKELEKRGLGTKATRAEIIDKLIKRGYVIDDGSLKVTDLGISVIETLKRFCPEIIDEKMTRDLEEKLEKIQFRKIKKDDVLDEAEKRLRKILEEFKKKEEDIGIYLIKNLDATNKKAKIVGKCPKCGGDLILIRHKKGRFVGCSNYPECDVKYSLPDKGRIKIPNKVCDACKSPILKIGDREICINPECPLKQVEVKEEDRICPKCGAKLILKKGVYGAFYGCSNYPKCKYTEPINKKEVVGKCPKCGGDLVVREGKFGKFVGCSNYPKCRYTEKLKLNEKEEK

SEQ ID NO: 1097 - protein, 183 aa, Methanococcus jannaschii
MLLEETLKSCPIVKRGEYHYFIHPISDGVPVVEPKLLREVATRIIKIGDFEGATKLVTAEAMGIPLVTTLSLYTDIPYVIMRKREYKLPGEIPVFQSTGYSKGQLYLNGIEKGDKVVIIDDVISTGGTMIAIIDALKRAGAEIKDIICVIERGEGKKIVEEKTGYKIKTLVKIDVVDGKVVIL

SEQ ID NO: 1098 - protein, 161 aa, Methanobacterium thermoautotrophicum
MIITIGGLAGTGTTTVARILSERMGIPCVSAGDVFRQMAAERELDILEFSRIAEENPEIDIEIDRRQARLADEHEDLILEGRLSAHFARADLKVLLIAPFDVRAQRISVRESKDIETVREEIRIRERSEAQRYREIHGIDVDDLEVYDIVINTNRFDAEAS

SEQ ID NO: 1099 - protein, 416 aa, Methanobacterium thermoautotrophicum [sequence omitted]

SEQ ID NO: 1100 - protein, 303 aa, Methanobacterium thermoautotrophicum
MKSSASAPAKAILFGEHAVVYSKPAIAAAIDRRVTVTVSESSSTHVTIPSLGIRHSSERPSGGILDYIGRCLELYHDASPLDIRVEMEIPAGSGLGSSAALTVALIGPLDRYHGRDHGPGETAARAHRVEVDVQGAASPLDTAISTYGGLVYLDSQRRVRQFEADLGDLVIAHLDYSGETARMVAGVAERFRRFPDIMGRIMDTVESITNTAYRELLRNNTEPLGELMNLNQGLLDSMGVSTRELSMMVYEARNAGAAGSKITGAGGGGSIIAHCPGCVDDVVTALNRNWKAMRAEFSVKGLI

SEQ ID NO: 1101 - protein, 325 aa, Methanobacterium thermoautotrophicum
MMEVMDILRKYSEMADERIRESISDITPETLLRASEHLITAGGKKIRPSLALLSSEAVGGDPGDAAGVAAAIELIHTFSLIHDDIMDDDEIRRGEPAVHVLWGEPMAILAGDVLFSKAFEAVIRNGDSEMVKEALAVVVDSCVKICEGQALDMGFEERLDVTEEEYMEMIYKKTAALIAAATKAGAIMGGGSPQEIAALEDYGRCIGLAFQIHDDYLDVVSDEESLGKPVGSDIAEGKMTLMVVKALERASEKDRERLISILGSGDEKLVAEAIEIFERYGATEYAHAVALDHVRMAKERLEVLEESDAREALAMIADFVLEREH

SEQ ID NO: 1102 - protein, 553 aa, Methanobacterium thermoautotrophicum
MVPVEDLVYRYALLNAVKHRGRANPGAVMGAVMSNEPELRKMAPQVKEAVEAAVERVNSLSPEEQQQEMERLGLEITERKQKKRKGLRELAGVKGEVVLRFAPNPSGPLHIGHARAAILNHEYARKYDGRLILRIEDTDPRRVDPEAYDMIPADLEWLGVEWDETVIQSDRMETYYEYTEKLIERGGAYVCTCRPEEFRELKNRGEACHCRSLGFRENLQRWREMFEMKEGSAVVRVKTDLNHPNPAIRDWVSMRIVEAEHPRTGTRYRVYPMMNFSVAVDDHLLGVTHVLRGKDHLANREKQEYLYRHLGWEPPEFIHYGRLKMDDVALSTSGAREGILRGEYSGWDDPRLGTLRAIARRGIRPEAIRKLMVEIGVKIADSTMSWKKIYGLNRSILEEEARRYFFAADPVKLEVVGLPGPVRVERPLHPDHPEIGNRVLELRGEVYLPGDDLGEGPLRLIDAVNVIYSGGELRYHSEGIEEARELGASMIHWVPAESALEAEVIMPDASRVRGVIEADASELEVDDVVQLERFGFARLDSAGPGMVFYYAHK

SEQ ID NO: 1103 - protein, 403 aa, Methanobacterium thermoautotrophicum
MNPLKKIKDWIARGKAGWHLSGGRSSLKQGKYKEALKEFRKALKASPNDPEILHYNAMTLLKLKRPEKALKCYEKILKNNPKLAEAWNNKGVVLKELKRYDEALECYERALQIDPQDDGTWNNKGALLDTIGKPEKAIECYEKALEINQKNAKAWYNKGNGLRSLGKYEEALECYEKALQINAEFVEAWYNKALIFEELKRYDEALECYGRALQIDPQDDGTWNNKGALLDTIGKPEKAIECYEKALEINQKNAKAWNNKGVVLEELKRYDEALECYEKALEINLENDETWANKGVLLRKLGKYEEALECFEKALEINPEFADAWEWKGIILEDLKKPEEALKCYEKALKLNPQDKTLWYMQGKTLQKLGKHQKAKKSYKKALKIDPEYKKAKKALKELQMKG

SEQ ID NO: 1104 - protein, 331 aa, Methanobacterium thermoautotrophicum
MKAMKIVLGLPKGSLNNVNRGNTYRLFRDAGYEVKGYEPGREENEIEITNDPEIKAYLTRPQSAPVELNREMLDIAIIGEDWVREESINSGNGSIKKIGDLDYGQTRLIVAVPQEEPYRSLEDFFLKNSGRERPLLCFTEYPNLTRDFFMKNPGYRELFGDSKPVVQIRGLRDGDNEMVQIINSDGATEVYIAKGADLIVDNTQTGSSLRKAGLKIIDTIMESSAGLYAGPSCTGEKLEKAEMIFKQLYGATKARNYFDVKFNIANHRADDVVEFLVRMKYCSDEPTVVRGREFSQVNVLIDKSRFPEMLEEIKGFGASAIVRENVKQYIE

SEQ ID NO: 1105 - protein, 484 aa, Methanobacterium thermoautotrophicum
MYRKKLTEAETGYTFDDFLLLPQASYVEPRDVETAGRVSRNIELKIPVISSAMDTVTEYDMAIAMAQEGGMGVIHRNMSIRDQVEQVKKVKRSGDITIRDVITISPDSTLREAHEIMDQEEISGLPVVEDGVLIGIISRRDIEPIFNSDADKKVDQVMTRDVVTVDESITPNEALDIAYENKVERLPVVKDGRIVGMLTMKDILERKRYPNASRDSEGYLRVAAATGPFDLERARALDEAGADVLAIDSAHGHNMNLVKSAGAMKKEIEADLIVGNIATREAAEDLIAQDVDGLKVGIGPGSMCTTRIIAGVGVPQLTAIAEVADVAAEYGVPVIADGGIRYSGDIAKAIAVGADCVMLGNLLAGTYEAPGDVVVMNGRKYKQYRGMGSLGAMTGGIGAGTDRYFQEPRGHMKHTKVVPEGVEGVVPYRGTVSEVLFQLIGGLRASMGYCGAANLSEMKERAKLVRITSSGYQGEPPPRPPHNQ

SEQ ID NO: 1106 - protein, 590 aa, Methanobacterium thermoautotrophicum
MWIIQWQSAVHGHCQRRWAGDTMIRVENLTKTYKLENGDEFRALSDVNLEVAEGEILGILGMSGSGKTTLLRILRGVEPFDSGRITLDDVTVEADSSQYYFSKLKKKTAIHLQRSFGLWAETALENVIRKLYATRYGDESMTDFDYASDEFGEDAMELLRVVGLEHKADHFAPVLSGGEKQRLIMARQLAKKPRVLLLDEPATMSCPRTKQEILDAIKNINRELGVTVVLVSHLPEVHEYLADRVVLMDGGRIVDEGEPSSIIGRFLEDIEPPVEYTPGARGKEILRVRGLGKRFVLLKGGAVLEMSDVNLDIAEGEMVSIIGPSGAGKTVLLRMIGGLDLPDEGTVEFRLNSEWVNMHEPGVKRMGIRRKMGFMHQEFALVHHATIRSQIASRLGVKGEHVVAEAKKRADELGISDMVLDVLYQLTDLPETEARYRLEKLGLSPEILEELFPSFPDSEVKRYAEPIFRALDLPLSILDRRSYELSGGERVRATLALVLASRPDVLILDEPFGDLDPITLRMVSNSLKRINMEFGTTIIMVSHHVDFIRELSTRAVMVEDGRIVMDGEPGELCDEFVERSHARYLQRVKG

SEQ ID NO: 1107 - protein, 226 aa, Methanobacterium thermoautotrophicum
MGEKVYELRKIKKKGRGMPLIGDKFPEMEVQTTHGPMELPDEFEGKWFILFSHPADFTPVCTTEFVAFQEVYPELRELDCELVGLSVDQVFSHIKWIEWIAENLDTEIEFPVIADTGRVADTLGLIHPARPTNTVRAVFVVDPEGIIRAILYYPQELGRNIPEIVRMIRAFRVIDAEGVAAPANWPDNQLIGDHVIVPPASDIETARKRKDEYECYDWWLCTQSRG

SEQ ID NO: 1108 - protein, 253 aa, Methanobacterium thermoautotrophicum
MAVTRPPERSAEAVELIEGAGGRALVAPTLELKEAHTESLREVCRRADEWDLVIFTSQAAVESLFQLCREFAGKIRKDCLVAVIGPRTARVAGEHGLRVDIVPEDYTAEGLLDALTGLNIEGWKVALPRTLSARKVLPRGLEMMGAEVLVAEAYRSGLPEDTGPAEELIDGLLDGKVDAVTFTSPLTVENLFKIAGNRRKELIEVLKRVKVAAIGPITLRKLEEHGITAVTPERYTVKDMIAALAVSMGEDVD

SEQ ID NO: 1109 - protein, 590 aa, Methanobacterium thermoautotrophicum
MCGIVACILKDGSAAPVLLECVRRLEYRGYDSVGIATSDPMIRIKKDSGKIDEVDAELDLADLPGTMGIAHVRWATHGLPTAENAHPHTDCSGEIAVVHNGIIENYLEVKEELESEGHIFRSETDTEVIPHLIEKYMDEGMDLEAATATALRKLRGAYAIAAVSSREPGRIVGARKESPLIVGVGEGEYFLASDVPAILNHTSRVIYLDDGEMVILDGDLRVTDMEGNTVEKEVHSIDWSADMAEKGGYDHFMLKEIHEEPSAVRDTLTEWDEVLGVVEEIGEVERICFVACGTSYHASLVGKYLFESLLGIPTDVILASEFRYSAGALNDRTLAIFISQSGETADTLNALRAANSRAKTLAIVNVLGSSATREAQHVLYTRAGPEIGVAATKTYVSQLTVIYMLVAAMGAPELMDRLERVPEFMERALEDEDGIKELAATCSDVSDFFFIGRGFAYPTALEGALKLKEITYIHGEGYAAGELKHGPLALIDNGVPVVAISPPGPCHDKTLSNVEEVRARGARVIGVGSISDESLRKEADDFIGLDPEVDDVISPLVYIVPLQLLSYHVSVERGLDPDKPKNLAKCVTVE

SEQ ID NO: 1110 - protein, 402 aa, Methanobacterium thermoautotrophicum
MYTMELRFIRGGVCAVDGVLAAGCREGKYGVGLIINRGSTAAAVFTSNRVRAEPVKLTERVIADGSISAIVANSGNANCFTGREGMDDARRMARKVAESLSMDESEVAVASTGVIGRRMPIDKIEFLIQSAAAQLENSEAASGALAEAIMTTDTFPKEVAVEFELETGEKARIGAVAKGSGMIAPNMATMLSFITTDVDASSSELTEALRVAVDESFNMLIVDGDESTNDMVIISSTRTSGRIDSNFREALVAVCRELARMMARDGEGVTKSFQVDVVNAGTHEDAKMAARAIAGSSLVKTAIFGADPNWGRIVAAAGYSGAEFDPEEISVTLESDSESVVIVDHGDILAFEGTEELETAERVMTSKEIRIIVDLAAGDESATAYGCDLTYDYVRINAEYTT

SEQ ID NO: 1111 - protein, 293 aa, Methanobacterium thermoautotrophicum
MKTVNILVEALPYIKKFHRKKIMIKYGGHAMIDEAAMDSTARDTVLLKYVGMEPVVVHGGGPEISRAMNKMGKEPKFIEGLRVTDEETMEIVKMVLVGKINTSIVSKICYHGGRAIGLSGKDSNLLLARKRAPHVVRDDETGERREIDLGLVGEIESVDPGIINMLTDNNYIPVISPIGVDRDANTLNLNADTVAGEVAAGIGAEKLIVLTDVPGILEDPSDPDTLIRRISVDELSDLVKSGIVEGGMLPKTLTCIQAINDGVSSAHIIDGRVEHSLLLEIFTKKGIGTMITE

SEQ ID NO: 1112 - protein, 331 aa, Methanobacterium thermoautotrophicum
MYRITVIPGDGIGVEVMEAALHVLQALEIEFEFTHAEAGNECFRRCGDTLPEETLKLVRKADATLFGAVTTVPGQKSAIITLRRELDLFANLRPVKSLPGVPCLYPDLDFVIVRENTEDLYVGDEEYTPEGAVAKRIITRTASRRISQFAFQYAQKEGMQKVTAVHKANVLKKTDGIFRDEFYKVASEYPQMEANDYYVDATAMYLITQPQEFQTIVTTNLFGDILSDEAAGLIGGLGLAPSANIGEKNALFEPVHGSAPQIAGKNIANPTAMILTTTLMLKHLNKKQEAQKIEKALQKTLMRGIMTPDLGGTASTMEMAEAIKEEIVKGE

SEQ ID NO: 1113 - protein, 325 aa, Methanobacterium thermoautotrophicum
MKVSIIGSTGRVGRATALCLAEEEAVKTLHLISRKESLEQNLGEVLDMSDALAAKGVSVKLENSADIENVYGSRIVVITAGVPRTADMDRDDLAFKNGRIVADYARQIARFAPDSIILVVTNPVDVMTYVALRYSGFHPSRVFGLGNHLDSLRLKNYMARHFNVHVSEVHTRVIGQHGPYMVPLISSTSIGGIPIEHYARRDYFSGYKKFDLKKTIDKVIHAGSNIISRKGATEYGPAFAISNIVTTILNDERRILTVSTLMEGEIDGIRDVCLGVPVKLGKNGIEGVVPVLMDRDEREAFREAANHVRDSTRRVMEFLDEELPL

SEQ ID NO: 1114 - protein, 425 aa, Methanobacterium thermoautotrophicum
MKGLEFSEFDISGDINRALDDMGFESTTPIQALTLPVTLDGMDVVGEAQTGTGKTAAFAIPVLENLEAERVPQALIICPTRELCLQVSEEIKRIGKYMKVKVLAVYGGQSIGNQIAQLRRGVHVIVATPGRLIDHIERGTVDLGGISTVVLDEADEMLNMGFIDDIERILSHVPERRQTMLFSATVSKPILRIARKYMRNPQVMRVEKKHSPKIDEFYFKTREEDKVELLDWILSSNNIRMGLIFCNTKRRVQRLRRQLNRMGYSADEIHGDLSQSKRERVMERFRRGDFSLLVATDVAARGIHVPDVEAVVNYDLPFENEYYVHRIGRTGRAGSSGKSFTLVVGSEVHRLRRIQSFTGKRIKQSNMPSPEEIRRGYEMDLREILRRNLESKTYSDSEILESLAGEGYSFRDISHALLDVLESSK

SEQ ID NO: 1115 - protein, 257 aa, Methanobacterium thermoautotrophicum
MTVLKIISWNVNGLRAVHRKGFLKWFMEEKPDILCLQEIKAAPEQLPRKLRHVEGYRSFFTPAERKGYSGVAMYTKVPPSSLREGFGVERFDTEGRIQIADFDDFLLYNIYFPNGKMSEERLKYKLEFYDAFLEDVNRERDSGRNVIICGDFNTAHREIDLARPKENSNVSGFLPVERAWIDKFIENGYVDTFRMFNSDPGQYTWWSYRTRARERNVGWRLDYFFVNEEFKGKVKRSWILSDVMGSDHCPIGLEIEL

SEQ ID NO: 1116 - protein, 558 aa, Methanobacterium thermoautotrophicum
MSKDTSVLLEEKRVFKPHYTVVEEAHIKNWEAELEKGKDHENYWAEKAERFEWFRKWDRVLDESNRPFYRWFVNGKINMTYNAVDRWLDTDKRNQVAILYVNERGDERKLTYYELYREVNRTANALKSLGIKKGDAVALYLPMCPELVISMLACAKIGAVHSVIYSGLSVGALVERLNDARAKIIITADGTYRRGGVIKLKPIVDEAILQCPTIETTVVVKHTDIDIEMSDISGREMLFDKLIEGEGDRCDAEEMDAEDPLFILYTSGSTGKPKGVLHTTGGYMVGVASTLEMTFDIHNGDLWWCTADIGWITGHSYVVYGPLLLGTTTLLYEGAPDYPDPGVWWSIVEKYGVTKFYTAPTAIRHLMRFGDKHPKRYNLESLKILGTVGEPINPEAWMWYYRNIGREKCPIIDTWWQTETGMHLIAPLPVTPLKPGSVTKPLPGIEADVVDENGDPVPLGKGGFLVIRKPWPAMFRTLFNDEQRYIDVYWKQIPGGVYTAGDMARKDEDGYFWIQGRSDDVLNIAGHRIGTAEVESVFVAHPAVAEAAVIGKAYPIKG

SEQ ID NO: 1117 - protein, 552 aa, Methanobacterium thermoautotrophicum
MHAIYLRGDLMAQGQQPIFILPQDTSRYVGREAQRINILAGKVLAETVRTTLGPKGMDKMLVDSLGDIVITNDGVTILREMDISHPAAKMLVEVAKTQEDEVGDGTTTAVIIAGELLKEAEKLIEMGVHPTIIALGYRNAALKAQEILEEISMEASDRDTLMKVAITAMTGKGSERAKEKLAELVVDAVMQVEEDGEIDKDNINIQRIQGASVNESRIVNGIVIDKSRADTSMPKRIEKARIALLKYPIEVKDLETDAKIRLTDPSQMQAFIEQEEQMIRDMVEKIKSSGANVVFCQKGIDDLALHYLSREGIMALKRVKKSDIKRIEKATGARLVTNIDDLTAEDLGEAGVIYEKKIFDEVLTFIEECRDPKAISIILRGSTKHVAEEMERALEDAIGVVASTLEDREVVAGGGAPEVEIARKLREYADTISGREQLAVSAFADALEIVPKTLAENAGLDSIDVLVDLRAAHEESPYMGIDVFDGNIVDMKEAGVIEPQRVKKQAIQSAAEAAEMILRIDDMIAARGFDVSSKDEEDMEGMGGMGGMPPMM

SEQ ID NO: 1118 - protein, 426 aa, Methanobacterium thermoautotrophicum
MLMKITEFDYRRISELVERARLDVDDVLGPVADIISMVRDGGDDALRELTGRFDGVTVENFRVSREEIEEAHKNLEPGVKEALREAASNIEEFHRMQMPSGWMSEVRPGVMAGQLVRPIDSVGCYIPGGRAVYPSTILMTVIPARIAGVERIVCCTPPAQDGSVPDAVLVAADMAGASEIYRVGGAQAVAAMAYGTETIRPVDKIVGPGNIFVTAAKKLVYGEVDIDFPAGPSEVLIIADETASPEYIALEILAQAEHDPQAASVLVTDSRDLALEVKEMVHENIKYMERANIIRESLERYGMIVLTADIDEAVDFSNAYAPEHLVIMTDSPEETLEGIRNAGSIFLGELSPVAAGDYGSGTNHVLPTSGCARMYSGLSTESFIKKPTVQRITKEGLRNLQGTVLKLAEYEGLHAHAESFRRRLRD

SEQ ID NO: 1119 - protein, 420 aa, Methanobacterium thermoautotrophicum
MKSEELFRRASNVLPGGVSSPVRRFDPHPFFAAGGSGCLLESVDGESYIDYCLAYGPLILGHAHPRVVEAVNEQIKRGTTYGVPTEGEIELAEAIIERVPCAEMVRFTNSGTEATMAAVRLARAFTGRDRIVKFEGSYHGAHDYVLVRPGSGAATAPDSPGIPVDTVRNTLTVPFNHEEAMAELIEGAGEDIACILVEPVMGNIGCIEPENGYLQFLRDITRENDIILIFDEVITGFRLAPGGAQEYYRVEPDLVTLGKIVGGGFPMGALAGRREIMENISPAGNVYQAGTFNGNPVSVTAGRETLRLLDGRMYSDLERKGSTLRAGLRDLLSDLDLEYQVTGPASMFQLYFTGEEVRNYGDAKKSDTVLFMEYFHGLLERGVFIPPSQFECCFISAAHESEHIEATLEAAEEVLSGLKN

SEQ ID NO: 1120 - protein, 1321 aa, Methanobacterium thermoautotrophicum
MNYDKSQGGENMKRFLLIALILLLISVPSVSAADNNTTSNTTESKMLKDTEMVVLLTGCVVGTVDPIMNEAYRNDLLPAGYNFTLKIYTMDTFNINSTASTQFKNDLKTVDIFFIFTRPGYPTTGMSYGTEFDALVDLQAIAASLKPGARIFVLGPVKPNITGVNVTNLPAYGPVAAPALSRENIKRTLLEVLRLSGAVNLTANDTKLVPGMQDFLYHPLAPQVYTDRAPYMDWYMNTTLYRPGAPWVGVAILNRYYLSGNMDVYETLIQKLESRGLNVIPYFYCSDPIGASRRFFMVNNTSVIDALVACVQFGYWPDNQTITFFTDLNVPVQGPLPVFLQTSLDDYINSTRQQGLRGLEYYWLSMFEMQGRIEPILIGGSRISGPDPLTGVTIKEYVAYEPGIDQLVNRTLAWVNLRKKANSDKKLAMVYFDSTHDEGMPATNGLNLYRSLSNILLAMRAAGHSTGNGNLTEEYIYELINRAGRNPRNMTQTELRKLVDAGCITIPVSEYLKWYSGLPASLRGQVEALWGPAPGNIMIYNNSIVIPGIMMGNILLAPQPVWKWNGTLNNGTLPPTHQFIAFYLYLQKGFGADAVVHIGQHGTLELLPGHVNAMTEDDWPNTLIGSIPNIHLLKMEDPLEAVINPTKRRAYAVTISYLIPPVMRTELYGVYQELSDLMGSYSTAEASGDTDRMNSLESLIRDGVTRAGLEVRLGVNSSTAFSVLRDRLHEYLEELSGILTPYGLHTFGELPDSETLEKFIDAIISFDPANRTARRDEIRNLLIMSASNEMNSLLRALNGEFIQPVSARSPVINLETLPTGRNMYTFDPSSIPDPAAVVIGSRAAEEMLKRYRNSSGGRYPETVAVDIGDVISTGGQSIAAIFYFLGVRPIYESGALIGTEIIPLSELGRPRIDVVISDFHNFRGAIPATMDVIDNTIKRIVNLNESSEMNYVRKHYLAMKAGIYAELVAAGMNTSEADANADRLARTRIFGLPPGADPHGAGVDRILWSRDDWTPEQLAETYLSYYSYAYGRDLNGVQSPKLLESLLRTVDTTMVISPYRAPGEGTCLYRVSVTVNFMVNYLTGRNINSYIARTAYGTPLIRTLQESTYDDLAVTLLNPVWVQGKLREGPSGSASIALQVRDLFTSDALVDVASPDVWRRIADTFLFDSSVRSQFDPSALQMIARYVRQAHTRGLVSLSQEELVAISEMLGEKSGSDGNDQGTTTTPHGGTTGGSATSGGRTGTGSPGLSPGVSGAISMDSQSSGAASASPGEGQERAGRSYEISTPTAAKSSGTQLYAIAGIIGLFCLLGVGYYFGPMRK

SEQ ID NO: 1121 - protein, 321 aa, Methanobacterium thermoautotrophicum
MIIMNGPWVEKYRPQKLDDIVGQEHIIPRLKRYVEEKSMPNLMFTGPAGVGKTTAALALAREILGEYWRQNFLELNASDARGIDTVRTSIKNFCRLKPVGAPFRIIFLDEVDNMTKDAQHALRREMEMYTKTSSFILSCNYSSKIIDPIQSRCAIFRFLPLKGHQIIKRLEYIAEKENLEYEAHALETIVYFAEGDLRKAINLLQSAASLGEKITESSIYDVVSRARPKDVRKMIKTILDGKFMEARDMLREIMVLQGISGEDMVTQIYQELSRLAMEGEVDGDRYVGLIDAIGEYDFRIREGANPRIQLEALLARFLEHA

SEQ ID NO: 1122 - protein, 260 aa, Methanobacterium thermoautotrophicum
MHNAAFRSLGMDWIYVPFPVKPENLKAAVEGLRALGVEGVNVTIPHKEAVLEYIDDIHGTAALIGAVNTLKFDDGTVRGYNTDASGCLRALEEVTSVEGSSVLILGAGGAARACAFQLAEKGASDITILNRTPEKARLLAEDMADKLGFEASYGGYELIQGSVKSADILIDTTPVGMHPHTDDRPLVGAELMHEGLVVHDLVYNPQRTVLLREAERASAIPVSGIRMLLYQGVEAFRIWTGRDPPLDVMEDALKRVLNRD

SEQ ID NO: 1123 - protein, 151 aa, Methanobacterium thermoautotrophicum
MMEKSFVMLKPDAVKRRLAGRIIARFEDRGLKIVAFKMLQIPEDLAMEHYQEHREKPFFRDLVDYITSAPVIAMVIEGKDCISLIRKMVGATNPAEADLGTIRGDFALETGRNIIHASDSPESAEREIKLFFDESEICSYEMPDREMIYEE

SEQ ID NO: 1124 - protein, 594 aa, Methanobacterium thermoautotrophicum
MKIRSPIVSVLGHVDHGKTTLLDHIRGSAVASREAGGITQHIGATEIPMDVIEGICGDFLKKFSIRETLPGLFFIDTPGHEAFTTLRKRGGALADLAILIVDINEGFKPQTQEALNILRMYRTPFVVAANKIDRIHGWRVHEGRPFMETFSKQDIQVQQKLDTKVYELVGKLHEEGFESERFDRVTDFASQVSIIPISAITGEGIPELLTMLMGLAQQYLREQLKIEEDSPARGTILEVKEETGLGMTIDAVIYDGILRKDDTIAMMTSKDVISTRIRSLLKPRPLEEMRESRKKFQKVDEVVAAAGIKIVAPGIDDVMAGSPLRVVTDPEKVREEILSEIEDIKIDTDEAGVVVKADTLGSLEAVVKILRDMYVPIKVADIGDVSRRDVVNAGIALQEDRVYGAIIAFNVKVIPSAAQELKNSDIKLFQGNVIYRLMEEYEEWVRGIEEEKKKKWMEAIIKPASIRLIPKLVFRQSKPAIGGVEVLTGVIRQGYPLMNDDGETVGTVESMQDKGENLKSASRGQKVAMAIKDAVYGKTIHEGDTLYVDIPENHYHILKEQLSGDLTDEELDLMDKIAEIKRKKNPDWGMKAPF

SEQ ID NO: 1125 - protein, 408 aa, Methanobacterium thermoautotrophicum [sequence omitted]

SEQ ID NO: 1126 - protein, 468 aa, Methanobacterium thermoautotrophicum
MNLRAGRLNSGMEDEAAEFTSSLTFDHHIFEADIECNMAHTRMLAHEGIIPEEVAAKIIDALESLREEGIEALDMDPSVEDIHMAVENYVTARIGEEAGFMHTGKSRNDQVATDLRLALRERIRTISRELLDFIDSISDLALDHTETVMVGYTHLQHAQPTTLGHHLMAYASSLRRDYERLQDTLKRVDQNPLGSAAMTTTSFPINRELTTRLLGFSDYMKNSMDAVSARDFIAETVFDLSMLAVNLSRISEEMILWSTHEFGIVEIPDEFSSTSSIMPQKKNPDVAEIARAKTSTVQGELVTILGIMKALPYTYNRDLQEVTPHLWRAVDTVLSMIRVVRGMLLGIRVNRNRALELAGANFATATDLADIIVRERGIPFRVAHRIVGRLVTRAIEDGLAPGDVDSVYLDEVSLEVTGRKLELDPELVEKALDPLENVRMRRIPGGPAPEMVRVAVEEMKSFIESERK

SEQ ID NO: 1127 - protein, 397 aa, Methanobacterium thermoautotrophicum
MIIMVTEVDVLVIGAGPAGSTAAKHAALGGADVLLIDKKSEIGAPKRCAEGVSIGGLESLGIEPNPRWITKKLDGVRMVSPNGTDVWLTSDKVELPEAGYILERKVFDKFMAMDAARAGSRIMVKTIATGMERTDDGYLVSAECMGEKFEIKARIVIAADGPESRVARWAGLNTATRPKDMESAAQFEMVGVEMEDNNCIEFYFGSVAPGGYALDIPEGDDIANVGLGVLSTETDKSAYEHLLEFVESCPATRNAQPVELNIGGDPVGGMPKKLVADSLMVVGDAAGQVNPLTGGGIISGMKGGMLAGQVAAAAVSEGDVTARRLGEYERLCREEIGDEISKYLKVKEYLLTLSDSELDSIAEAFQDVEFEKVSTTELVKKLIKVSPKALLKLGKLF

SEQ ID NO: 1128 - protein, 826 aa, Methanobacterium thermoautotrophicum
MWGWLQDNTTLYNTGKLPPTHNLLAFYWWMRKVYRADAILSVFSLVPLMPGKQEGLSSKDWGAVLLQDMPIIHVLPMDAPAIFDKRRANMLIINFMTPVLIPSGLYGNLSELYDNIRLYMETVDDTLKNAYRDKIINQSRTVGFNYTGDSFDEFLADVTAYLDDIRKSYIPYGPHVLGRAPEGEELIQLLIAMLPPINGTATESLLREVVLNNLTPEEAQIRTTGSLNATITGYLQLAIEYTQRIRNCTSEITAILTALEGGYITPGPRGDPIRNPDALPTGRNPYPLDSRTIPTRTAWETAVKLVDSFLEDYLSKHGTYPTKVAFVLWASETMRHQGVMEAEILYLMGVKPVWDSKGRVKDVELITNLTRPRIDITVVTSGLYRDLHMDIITLIDRAVKLAAGASDTPNHIRNNSETIYLKLLGEGFSETDARRLSLLRIFSEEPGAYSPGLQEAIPASETWNNSDQLASFYLERVSSAYGENITGLKVPSIFRENLMDVTVAMFSRSSNLYGALEHPMVAAYFGGLSLAVERVSGSKPEMYINNLRSDAKIETMSQFLTRDLLTRYLNPRWIEGMMKGGYDGARYIDSFVENLWMWQVTNPELVSESTWDMVNSIYVRDSYDMGLNEFFSKSNPYARASIIARLIETVRKGYWSPSDQVKASLANEYINMVNQYGVVCCHHTCANIVLNQWIVSLSTLNSAAIEKFKHTMAAAWGENLPATDTDKPSNEGNGEHSVSDGSSRGESDAMSAATSSGTSGSAGVSQSTSASSSPTENGDVKAYEVAASTEGTSETTQMPVYALIGIIAIVGLMGAGYLLSGRRKIK

SEQ ID NO: 1129 - protein, 400 aa, Methanobacterium thermoautotrophicum
MWRGGQNPSFRWLETRRVHVEEEDLMRIAFVYDGAYPWIKGGVEKRVYEIGRRLAERGHDVHWYCVGWWLPDNGERTIEIDGIKYHAVCEPLEIYVNGRRSIKAAIKFSISLTRPLLREKFDIIDCQQFPYFSCFSAKLASLVNKSSLIITVLEYWGDYWYEYLGKVGIFGKIVERLTFNLTSDYITISSHVRNYLSFCKDSIHIVPDGVPFNKIRKIKPSSEKANLIFVGRLIKHKNVDVLLKALHLLRDDGFKLTCIIIGDGPEKENLMKITRDLGLEAQVKFMGRVPSDDEVYKYMKSCNIFVFPSSREGAGLVTLEANAAGLPVITTNHKLNASRELINGKNGVLFNLDPHDLKEKIILIMNEHEKLRKDCIKFAESYSWDKIADLTENVYLEVLK

SEQ ID NO: 1130 - protein, 348 aa, Methanobacterium thermoautotrophicum
MKSALITGITGQDGAYLAKFLLEKGYEVYGIYRRLSTPNFWRLQYLEIFDRINLVPADLTDEFSLLESLKISDADEVYHLAAQSFVGTSFEQPTSTAHVTGVAVTSMLEAIRHYNPHIRFYQASSSEIYGDGHTTILNENSPFKPSSPYAAAKLYGYWMTRIYREGYDIFACNGILFNHESPLRGLEFVTRKISNTAAKIALGLEDELLLGNLDAKRDWGYAPDYVEAMHMMLQHKEPDDFVIATAETHTVREFCEKSFEELGLDWQDYVKVDKRFFRPLDVNYLCGDYSKARENLGWQPKTKFEELVKIMVREDLERWERWQNGEKFPWDASNYPDETKLITRALRS

SEQ ID NO: 1131 - protein, 1561 aa, Methanobacterium thermoautotrophicum
MEGIRVILMAVFLVFVLPGTVSAENTADNGTVDVLVIHSIEGTRVVNDAAHRVLEEYPDRNITVRVRSSPQIVNSTPEEIEALLNSSDVIICNYLGTDDYTKILRVLTDKPEILNGKFFALFDGASGIELVRMSRINDTQVFSGVPDTVVTAVSRALRVLEPLPFLEGYVNQYPQIAIWAQGEGYYCYRNVESYRNQILWAADTWARTRNITLNVTYGPPRAVSRELLYRDGKLYDNLTDYLRDYPIDPSRPTVGLIEAESNMLGGGAAHIDMLIDRLKDTLNIISVVARYGDNAYSAMVRFFTTAPNIAAFEANRTLYTSRVEAIVSFSTYLLGGTSSEKVNSLLKFMNVPVLRGVVVNTRTVDDWLVSSDGVTPWSRDDIMGQAGFPETQGLIEPIIIAAAEFQADNITGAYTYSYSPLPDRIEKLAQRLINWVNLRIKPESEKKIAIIYYNYPPGKSEIGASYLNVPESIYEILLNLRASGYSAGNISGAAELIGLMVERGINIANWAPGELERLADTPGVVLWDAEEYQAWFQTLNPIARRYVTEGPTAYIEELVKLALSRGTSAVTLMKTVDTWYAEMKDNIKSSEKQVEGLQLLEVMYTALRGVINGNSSMWTTFRAARESFMLLAIPGLCGWGEAPGNVMTVTRNGRKYIVIPGFILGNVFIGPQPQRGWEADPEMLYSVGILPPHHQYLAYYAWINRVFNASAMIHMGTMGSYEWLPGKEVMLSEYDFPDIVVDTTPSIYIYRVDNAADGLAAKRRGLAVIIDHLTPAMKSTTLYGELLQLKNLITGYKNAADDPLRNQYLAEIRTAALKAKLGDELGLNIENTTADALIPAISSYLLKIEGTLIPYGLHTFGREWSHEAITYMVASMISTGDTSIYRLLAADYGWIYEEITVDQRMILENRTLEMIQALLNGSKPENITSSPDIIAVLRSAAEYIELIRNSTRMEMSSLLNALAGGYVEPGLGKEPLMNPSALPTGRNFYTIDPSIVPTSAAYSLGAEIVRKVLATYTEPPEKLAVVIWGVDTARDDGAMVGFVLNLLGVKPIWSSSGQVTGVTLIPLSELGRPRIDAVVTVSGLFRDVYGQAAVTMDRAFRLALAASYRTVLTEHPEVSEALEAAVKPLRAVKLFQEGNDPIQMNRVAGHWLELVLKYMNAGMNASTAGNLAIYRIFAPPMGSYGTGVKEAGEMSWTYNNTDELADLFISRMGTSYSETGWGVKNVDLFADLLKGVSAVYQGRSTYLVGVAENDDMADYLGGLSLAIKKLTGTAPSVNIITTAAGNPQLMSLQEALALDMRSRYLNPEYVRSLISEGYAGANRLSTAVRSIWLWQTTAPGSVPSWTWDALADTYIRDVNGLGVRDWLSGRNSYALISITGTMLTAAYEGHWNPDEATLRLLASTWASLTAENGVACCDCSCGNIAMMQWTMQYLNPDLLSRVREKLYAATRSSAFAPASDGGSTPGVPSNPGTVTPGTSENHDGGSAHSTGSSRRATSPETETESSDTSPGETGTGSAYEVTEKGGTVQAKTGLPVAAILGVVVLVALVGVGYFIGGKGRI

SEQ ID NO: 1132 - protein, 321 aa, Methanobacterium thermoautotrophicum
MMVTVIGAGSFGTAIAQVLSWNAEMVRLMARRSEVVENINRTRENSAYHPGVKLRDNIEATLMDGSVLEESEYVFMAVPSGNLRSIVRSMNSSLEDKKIVSCIKGIEHPGLKTMSSVIREETGSRTVFSISGPNFADELIRGMTSGITVGASTRYAREIAGLLKSPRIILDHSENVEGVEFCGILKNVYAVAMGILDGQITGENHRHSLLTLCFREMNLILNEMGYGELHDRFCGFGDFLLTSTTDKSRNRTLGLMLGKKMRLSEDSTITIESLRSIRAIRELTEGLELPVLEMVYQTMQEPENVNLYIREFQERISRPEF

SEQ ID NO: 1133 - protein, 395 aa, Methanobacterium thermoautotrophicum
MVTGPRKRRFIGLRILHVTPYFKPSWEAGGPPRSVYDLASRQVSAGHEVTVYTTDGFKRRLDVEVNRPLDVDGIRTYYFRNLSMYLAGNMNLPVPLKLPYVAWREIREFDVVHIHEHRTFLAAVVATLASRAGVPYIVQPHGSVPTMSRATLKEVFDFIAGNRIMYGASRIVATSTVESGFYRKVYPKLDAEAIVKVPNPVDIPHRPSRGLFRKKWGLEDARIILYLGRIHERKGLDILLRAFRDMDEDTVLVITGPDDHYLERLMGLIDELGIGERVLLTGPLYEMDKLEAYVDADVFVLPSASKYESFGNSAAEAIACGTPVVVTSSCGISEWMDPGDGIIARPSARDLRDAIIRVLKERDSFNPSAEKFDPESISETFEDIYLEVTHKASRH

SEQ ID NO: 1134 - protein, 334 aa, Methanobacterium thermoautotrophicum
MLPGKPLFLQGKSSKIGSDANMETQRILVTGGAGFIGTNLVNELRNRGHEVLAVDLMHTEREDYMRADVREYRQVERIFEEDKFDYVYHLAAEYGRWNGEDYYENLWKTNVIGTKHMLRMQEKLGFRMIFFSSAEVYGDYSGLMSEDVMVKNPISDTYQMNDYAITKWAGELMCMNSAEMFGTETVRVRPVNCYGPHEKYSPYKGFIPIFIYHALHRKPYTVYKGHKRIIDYVEDSVRTFANIVDNFIPGEVYNVGGRTEWEHDIKEYSDMVLEAVGIDDSIVTYRESEPFTTKVKTMDFSKAIRDLKHDPQVPPEEGIRRTVEWMKWYYRIED

SEQ ID NO: 1135 - protein, 332 aa, Methanobacterium thermoautotrophicum
MIMDEFRAYDGKCVLVTGGAGCVGSNLTGNLAKAGANVIILDNLSSSYEWNIPEYENIEFVKGDILDDEVLKRVFKERPDYVFHLAAHFANQNSVDNPEKDLLVNGLGILKVLEYAQLVGVERFVYSSSGCGVYGLDSKIPFEEHDISISLHTPYQVTKLLGELYTNYFHNLYEMPIVNARFFNVFGPGEVPGKYRNVIPNFFYWAMNQQPLPITGDGSETRDWTFVEDIVRGLMAMGVRREAIGEAINLGSGTEHQVIEMAGIINELTENPAGVVYRPRRDWDAKTRLLSSIDKARRLLDYEPQVSFREGLERTHRWFTENWELIRKSAEF

SEQ ID NO: 1136 - protein, 298 aa, Methanobacterium thermoautotrophicum
MRFDAVGLGALNMDQLHMVERIAGPDEETFVRGLVESCGGSAANTMIGLSRLGLRTAHIGKVADDREGGLLRSNLSSEGVTDFTVVADTGRSGRVMGFVDPDGNRALYVDPGVNDTLRVDEVADEALNTELLHLTSFAGDGINVQVEVIEALDESVTVSLDPGHIYASRGVSELSDILERTDILLTNQRELELMTGSADPEEAASLLGIGVVVVKMGARGVRAWDGESVMVDALSTECVDTTGAGDAFNAGFIYAWLEGFGLEVSCRFGNYIASRCIGGYGATESLPGTGPGCPQEVR

SEQ ID NO: 1137 - protein, 340 aa, Methanobacterium thermoautotrophicum
MRVMRICLVGLGAVGQGFLRAVQMKGEYLRERYGLDIRFTGVADSSGALHDPDGLDIRGVLEHKKRAGLGSHPSGYEGMTGDELLDEAEYDCLVEATPTNIEDGEPGRSLVLKAMGDGKHVVTSNKGHLALFYSELMEAASEAGVEFMFEASVGGAMPIINLARETLASCTIESVIGILNGTTNFILSRMASEGSSYRQALIEAQELGIAETNPAQDVEGTDAACKAVIIANSILGRPCTLRDVRVEGITGITQGAIELAAQEGYLIKLIAEISGDRLEVGPRLVRMGSPYAVDGTLNMATLRTDLAGEVTAVGRGAGSLETASAMLTDTITIWRKSGGR

SEQ ID NO: 1138 - protein, 591 aa, Methanobacterium thermoautotrophicum
MDNHYFPFTAIVGQELLKKALILNAINPSIGGVLIRGDKGTGKSTAVRSLRDVLPDRKMVEGCRFGCDPDGAEICMECRRKLEEQGSLPSRQVRMEVVDLPVSATEDMVVGSLDIKRALRDGIKALEPGILARANGNILYIDEVNLLDDYIVNVLLDAAAMGVNIIEREGISIQHPSRFILAGTMNPEEGDLRPQILDRFGLSVDVEAIKDPDERIEVIKRAMKFQEDPESFHSRFRRKQEELREKIIRARSLLEMVELDDETLGLIVEIAAALGIRTHRADIITARTARALAAFNGRRRVTGDDVMEAALLAMKHRLRQLPFQRQQELSQEIIEDIMNGEFEDDSEIDRERRLRRDLKIPDLKGSLQGQSSSTVTGRRGKYVRARENPEPSSVAVDATLRKAASAGTGTIEPEHLMEKVRIGKSRALYIIVLDTSSSMRLERKIKFAKTVSWLLLRDSYEKRNRIALIAFRGYEANLVVEPTSNLETVEEALEGLRSGGRTPLTPALRLAAEVASSSSDEACTAVVISDGRCNVFINSNLEEDMNMLETELRNLNLLFVNAEPEKRSLGILEDMASRFGSEIFYLDDILI

SEQ ID NO: 1139 - protein, 859 aa, Methanobacterium thermoautotrophicum
MEIVLGITLPELDGGFEPVFTAGMRTLNDPDLGEVRVVDVVPERMDRFAARILNWLKLRTMENHEKRIGIILYDYPPGEANLGNAGYLDVFESLEVFLRRLRERGYSVRIPDEPIKDILMREGLINSPSYHEYGGQRIPLSDYLEFFSRLPERIQDDVRARWGEPPGELMVDGDDIIIPVTELGSVYLCIQPSRGIMETDSYHSRDNPPHHQYLAFYAYLNSLGLDAIIHFGMHGTLEFLPGRETALGAECYPDLLLGELPNIYLYWAGNTSESTIARRRTYALPVAHASPPVRQSDLYGDYLVLEELIDQWHGDPDDGLRDEIIERASQLNLRGDIPEIESELFRMKRRLIPRGLHIMDSEWDPNDMVSYLLGVLRFDREYPSIHSMVAEKLGLDYRGSMDTATGWEIERHAAEALKRILTGKSVDLPPEYVEWVRSLSERCDFRGESRGLLEALEGRYVNPSRGGDPIRDPEVYPTGYSMHAFDPMKIPAPLAESRGRLAARKLLEDYLEENGRYPETVAVVLWGFETLKTGGDTISMILELLGVRINRKYGPWAKNIDVIPLNELGRPRVDVLVNICGIFRDTLGSQIEILNRAFKTVAGLDEDPEDNYILKHNLEDGEVKVPPRIFGPGPAEYASSIPDIIGGGAWDQEDELAAAYLGEMCYAYLPDSVREAPDEFRRNLQRVELVAQERDNVEYEVTDLDHYYEFMGGLTSSVRNLGGSCSVRVVDSTEDEIYVEGLDEVIGRAARCRILNPVWLDGMLAHDHHGAKNIKDRVEHLLGFSATTGAVDNWVYDDVAETLILDDEMRRRISENNPYAAVRMGEILLETAERGYWDAPDETLNRIREVFLGLEYELE

SEQ ID NO: 1140 - protein, 413 aa, Methanobacterium thermoautotrophicum
MQILRGIGAGAGRSSGRVRIIRNLEDARNLEWGEVAVFRKISRDMLPEIRRAGAVIANYGGLTSHAAITLRELGIPCVLGTEVATEVLREGMIVTVDGKTGGIYRGVMDWVKAEDTPGFHETATDVMVNLNFPWLAPKVAEFADGVGSVRIENMVIETGKHPHLLLKEGKLAGVLEKGLREILEAFHPKPVIFRTFDIPVDELTNLRGSFEASERNPFLGMRAITRDLMEPEILMAEFEALGNLLDSGYRNLQLKFPFLRDVDEYVTAVELLEESGITPHRDIVVGASVETPSVALQIDELLAAGADFISLGMSDLTMCSLAVDRRSTRVAGLFNLSHHAVLGLVEDVIGACHEGGVNVYAAGYAATSYMLVRRLVEMGVDGISTSPDKILRMKYFIARIERSLMLRGAGRVE

SEQ ID NO: 1141 - protein, 916 aa, Methanobacterium thermoautotrophicum
MTGSLCRKGEACTEKQKMAVKKTEGPLVVVAGPGAGKTRVLVERVAYLVKRKGVSPENILVITFTEKAAGELKARLINCVGLDAELMQISTIHSFCSKVLSDHPEEHEFGAGFEILDEESQLIFLRTVFYKIGLDRYMKMGEVHRAIEFFNRCTENCIEPEELINALRRKYPDREEYQGIAVCYARYLELLREQKKIDFPGLEKEVYLLLNSSERVLESVRKKYRYIMIDEYQDTSPIQELILREIAGKNSSICVVGDEDQSIYGFRGATPENFIRFREEYDAEVVTLEDNFRSRAGIVLTADSFMRGERHYEKTIKPVRDGGTDVVILKSRDVNSEARNIVSLIKKLKSSGKIPEYGYVALLFRSVRNHADKVLAELRREGIPYIVRGDGSFLKRYEVRSMLYFLAYVDPPDYGGRFRKWDGWWNISRFRGEFLDLTGETLRALESLDRNCRLSDFTSRRELEEIGVHGEDAEKILGLNRIRHEVGKGSLTVLSTFYSILEVTGYLRRLIEDGSDSSRAKIFNLAKLSSLIDRYEAIKPGARIQDLLWYLYLLPTHLHHDEAALEDPASVKIMTVHQAKGLEFPVVFICSVINGRFPVKRRKERDTIPIPGELLLSPGEVPDEDRRLFYVAMTRAQDALIISTAPRINTRKVGVSPFITDLREKCGIYECDCTSVSRCLEREWSEEPLRINFSALFTYEECPFRYMLIYHYGFVYPETFMQRYGIILHRCLEELHLAMKNSEEINGALIRRIVERCWIPMGRDDKVKKRRLERELLNYYHDTRDHTGEVVSVEEPFSIPDTDIIIEGRTDLIIRTRDGELELVDFKAREHGGVERMALEYQLRTYEYALRERYRFDSLSAYAIKDSMRISFDSDPEFRVKERIAETVARIREECFEPRKNPFCSRCVFRTFCGAG

SEQ ID NO: 1142 - protein, 553 aa, Methanobacterium thermoautotrophicum
MADFRCTVCNYIFHEEADGEFDSLPADWRCPVCNAPRTAFVRVPSTLEEGGRTVSEVFISQLAAWGLKYVFGIPGTSTLGLVDALRRNDEIRYIQVRHEAAAAFMASSYGKLTGQPAVCMAVAGPRASNLITGLLDAALDRAPVLAVTGHVETYRIGTGASQEIDQHSLFESFSVYNMTLVSPDEAAEIAREAVKHAILERGVSHVDVPRDVQTMECTAPVKPLRGMMAEAAVTPPRNRLRAAADLINRAERPVIIAGFGALEAADSVVELAERIGAAIVSTFRGKGIVDNDYPLYLGCHGSLGSAAAAEAVRKADLLLVIGSSFSDLTRIPPRRTLQVDIDPMMVARRHPVEQGLTGRSSLIVQELISMVEEKERGPYLAELGELRDEWLGLLESEADPSLRPIRPQYIISVLNRELDDDAIITLDVGENGWWFGRNFQMKSTRGFSFQVTWGSMGFGLPAAIAAQLEFPDRQVVCINNRNLAMIMQEQRVEGFPVWQTELQDCDFAGFAENCGGRGLRVDDPGELEDSVREALGTDGPVLVDIETDPRRFI

SEQ ID NO: 1143 - protein, 683 aa, Methanobacterium thermoautotrophicum
MPFMTGEIQLTDEQRRAVEHFTGPLLVVAGPGAGKTRIIVERVAHLIDERGAEPSSLVVITFTRKAADELKERIIRRVGGRAEEMQISTIHSFCNRILRMYPDHHTLGSNFHVLDEENQLMFIYEHREQLGLGNVQRERFPLIQGFFSECQENMVDPETLIQHYRNKGAGRFEMTVAEAYQRYLNLMDENGLLDFAGMQWRVVRLLENDSKILDDLRSRYRFLMVDEYQDTNQIQERFLELLAGEECNIFAVGDEDQSIYGFRGSTPENFLGFQKKYGAEVVMLEKNFRSVPSIVDVTQRFMDGYREYPKDIRPVRDSENRVFILDNPTHQDEPSNVVGIIRALVDHGVIPHQGYVTLLFRSVKHDAVEIMNELRREGIPFNVYGEGGFFDREEILYIMHLLHHTRNERRKIIRKLKYEHLEGEFMDLTPGSVNRILDMDEEELRGLREHREFRGAGFTDPDDIRKLVALNRLIDSDLGVLERYYEILELTEYPHRLLERGDDESREKLYNLARFSSLIKDYERISLEPGVEGLMEFIRMAMSGRIKKYDQILLDNPYSVNIMTMHRAKGLEFPVVIICSVFNGKFPRKVRERSELELPEELRRSTMRTDEIEERRLFYVGMTRAQDMLIVSATKNHRGRIGYSEFIEDLIKTSRITSDRLGRIDPEDARIEIIKNSCQVGGH

SEQ ID NO: 1144 - protein, 1045 aa, Methanobacterium thermoautotrophicum
MVKYIQYLMGETTSNPVENGQGPVMAAPDWGLYHPDRGVMSVAASREQIRTWIEGNPGLIPPYDSLRWIDQNFSSWAENQRNDVYREFENWYSANKNITGPFIVVVSYNPSNTVDAIIREAERQGRAAFNLYQGATSPAVSSLLEELTLGVNGKGPLNRNISAVISLYSWSLNYANLPSGGALSELERINLPVLKAVQLYSNSSLTNPLGAQYEWTWQVTIPGFEGVFSPVVVSYTDSSQNEVVIQSGVRKMVELANAWARLRELENSEKKIAVILYSYPPGKDGFTASYLDVFRSLHELLVKLNESGYRVERIPSPEELYTIVSEFGNKGTWAQPLLERYVSEHRRELEARGQLLDIQRYLEWFNALPEKLRSEVISRWGQPPGNIMTVNGSIVIPGLMLGNIFITVQPARGWDEVTDYHNPYLPPHHQYLAFYRWIDEVLGADAMVHLGTHGTLEFLPGRMIGLMEDDWPFQLTSLPNIYPYIVSNPGEGMVAKDRSGALIIDHMTPAMVQSGLYGALIEIHDLIHQYENALKVGNNQILPALESRIKTEASEMGFNMTGNFTEALERLHLSLHEIESDIIPLGLHSLGRVLEGDELLEEVLTIASSRSDLLENIRKQLYPGLPAYTEMLKDPLRYSDEIASVKNLARLWIGSIINGTVPSGINATDLEFINDTIMKIRGNTEWQSILAALSGGFIRPGLAGDPAWCDVLPTGANFYSTNPRKMPTRAAWETAVRIVDSMLAEYYQKHGSFPELIGMVMWGTELLRTDGIAIAEFLYLLGVKPQWNSNGDVNPAPVLMNASELMITVNGTRIPRPRIDVFVTAVTGNQLWIDLMNKAVELAASASDTENYVKKHYSECGSLDRVFGLRGLVLEGTGVSDMTPATSRWNTSSELADVYLSRVSYAWRSTPGGVDIQQNRGTFQYLLGKVNLVTQNLDSTWRLMDTDDYYDWFGGMVLASRHLGGNPDTALIDIRNRNTVTVRTVAEEIELEIRSQLLNPKYMDSLLNHPAGGLNMLQGTKMSLELQLQPAASAMNSGTSSQGTF

SEQ ID NO: 1145 - protein, 169 aa, Methanobacterium thermoautotrophicum
MMCLSRYEKATFGAGCFWGVEDAFRKVDGVVSTRVGYMGGHLENPTYEDVCTGLTGHAEVVEVTFDPDVVGYSDLLDVFWSIHDPTTLNRQGPDVGEQYRSVIFYHSDEQRRAAIESRRRLEESGRFRDRIVTAIEPAGTFYEAEEYHQQYLEKNPRRRCYLMRLLSTR

SEQ ID NO: 1146 - protein, 424 aa, Methanobacterium thermoautotrophicum
MKPNLRRELGLFDAVNLVVGTIVGADIYIVAAYGAGSLGPASILAWLLAGLMALIIALVFSEASAMLPRTGGPYVYAGEALGRFTGFITGWSLWVSSWVAIAVFPLAFIYYLEYFIPLDPPAEAVIKVLFILSLTIINIAGVGRAGKVNDILTILKVAPVLLFAVLGAIHLALNPGLLVSNYTPAAPMGLGALGTVTVLVFWAYVGFELVTVPADEVRDPERTIPLSITLGMIFVTLFYILTNAVILGLVPWRVLASSTAPLTVAGYSLMGGIGALILTAGAVFSIAGSEEAGMLTTARLLFAMSEDGFLPGFLSRVHRRFGTPHMSILVQNLTALLAALTGTVSGLIELSVVTLLLPYAVTCISLAILRRRDGSGIPLKSVLGVLVCIYLLMNTTPSTTAWGLLLILSGAPLYLIFGFKRLRR

SEQ ID NO: 1147 - protein, 395 aa, Methanobacterium thermoautotrophicum
MKNLIFPFTAIVGQEKVKKALILNAINPGIGGVLIKGDKGTGKTTAVRALADLLPSLRTVKGCPFNCDPDEPEGACDMCRGGDVDVEYRKMRVVELPLGATEDRVVGSLDISKALTEGIKALEPGILAEANRNILYVDEINLLDDHLVDVLLDAAAYGVNTVEREGISLQHPSRFILVGTMNPAEGELRPQLSDRIGIHINVETVTDIKQRVLIMKRRDEFEDDPEGFVERFAESQSSLRDRIMAARKLLPAVTIDDDLLELIARVCVDAGVDGHRSDIAIVRTSKAIAAFNGRRRVREEDVEDAIVLVLGERIPGRSYNRENTRREMQRAREEMERERESEEDQGNSDSSSGGEGSGGSEGEESGQESGASSRGEASGSGASASLAGLSAEGSL

SEQ ID NO: 1148 - protein, 397 aa, Methanobacterium thermoautotrophicum
MSIMDDLMEGRIKLYEIERHVPVDEAVRIRREFIERTCGVKLEHVSNYSIDMERASRRNIENPIGVVQIPLGVAGPLRVRGEHADGEYYVPLATSEGALVASVNRGCSVITRAGGATVRVTGDSMTRAPVIRTGSVVEALQLREWIYENMDALREEAESTTRHGKLVKIDPIIVAGSYVYPRFVYTTGDSMGMNMVTIATERALELLTRETGAHVIALSGNLCTDKKPAAVNLIEGRGKSITAEITVPGEMVESVLKTTPEAVVEVNTAKNLIGSAAAGSMGFNAHYANIIGAIFLATGQDEAHIVEGSLGVTIAEERKGDLYFAVNLPDVPLATVGGGTGLETASECLDIMGVRGGGRVHAFAEIVGGAVLAGELSLMGALAAGHLARAHSELGRG

SEQ ID NO: 1149 - protein, 293 aa, Methanobacterium thermoautotrophicum
MRGSIMILLDEDTRCLVQGITGKQGSFHTRQMLEYGTRIVAGVTPGKGGQEFLGVDVYNSVEEVTEEMDVNASIIFVPAPFAKDAAFESIKHLDLVVIITEHIPVHDSMQIMEYASRMGKTVIGPNTPGIITPGIGKLGIMPTHIFTEGTIGIVSRSGTLTYEFAAQLTEAGFGQSTCVGIGGDPVTGLGFVDVLERFEDDPGTDAVVLIGEIGGDAEERAASYIEQMSKPVFAFISGATAPPGKRMGHAGAIIEGGTGTASSKREALEAAGAVVVDRPSAIVDEIRAQLGVR

SEQ ID NO: 1150 - protein, 221 aa, Methanobacterium thermoautotrophicum
MNTKICVPVFEKTAPEVTESAGRAIDAGADILEIRIDGLQNPGEVNIRELIEDIGFPVIATNRSPVEGGHFSGSEDERIKLLMAAAEVADFVDIELSSAREDIERVTGSARRSIVSYHNFRETPSLEALLRIVRMAKEMGDIAKVAVMPENLADTLVVLQLLTFEEDTVAISMGELGKYTRVAAALFGSPITFASMGRGTAPGQMDVDVTRKMIGELMPED

SEQ ID NO: 1151 - protein, 323 aa, Methanobacterium thermoautotrophicum
MMPMFEPATPLERKRYYREEWNVRDLPDFIADNLHMREFGFDHNGRGPSDRYRVFRDERSLARFMRVRYPFAAYSSVAFYREPWKRKGWQRSELIFDVDAKDLPVRSCECDGVCPTCLDEARELVLMMVDTLKGDLGLGDIHVIYSGRGYHVRVLDPEVMELGSEVRAEILRYTAGAREPRRKFTDGVSSYEMEHFSIPLGYHRVFTERARHVLLHLRGDEDIEDVTARTVKTAVRNRNLILEDRWGEFRSVIGPRVYPRLVKGISKINMRMLDAKVTIDLKRILRLPTSLHSKVSMICMEVKNPETFDPLKSAVPRFVDERE

SEQ ID NO: 1152 - protein, 340 aa, Methanobacterium thermoautotrophicum
MTCTVLVGGGWGDEGKGKCITYLCYNDKPSIIARAGVGPNAGHSVEFRGDKYGLRLTPSGFFHEDARLLIGAGVLVDPEVFLHEMEYLSKYSVADRTGVDYRCAIIERKHKEQDQSSSYLSKKIGSTGTGCGPANAERVMRTAKLAREVEELGDFLTDVPLEVNEALDEGEDVFVEGSQGFGLSLYYGTYPYVTSKDTTASTAAADVGIGPTRVDEVIAVFKSYITRVGEGPFPTEISQEEAEEMGLEEYGTVTGRRRRIGLFDMEMARESCMINGATQIAVTCVDRLYPECERVREYSDLSAEVKRFIEDIESATGVPVTIISTGPSLEDTIDLRDELL

SEQ ID NO: 1153 - protein, 285 aa, Methanobacterium thermoautotrophicum
MKAVIPAAGLGTRFLPATKAQPKEMLPVFDKPTIQYVVEEAVASGIDDILIITGKGKRSIEDHFDRSFELEYFLRKNNKMNYLDEVEAISDLADIYFVRQKEQKGLGDAIYCARKHIDGEDAFAVLLGDTITSSGVPCTRQLMDIYERYGASAIAVEEVPRDKVERYGIIDGEEVSEGIYSIRDMVEKPPVTEAPSNLAIMGRYVLESEIFDHIREVPPGFGGEIQLTDAMRCLEEVYGCVFRGRTYDIGNRVDWLKTSLEFAMNDDEIRPELIEYLKNLIDGYR

SEQ ID NO: 1154 - protein, 703 aa, Methanobacterium thermoautotrophicum
MISLSTTALKVLEERYLLRGEGGEVVETPEEMFRRVARAVASADEAYGDDPAVAEEAFYSVMGNLEFLPNSPTLMNAGTPINQLSACFVLPVEDSIDSIFSSLRDMAIIHKSGGGVGFSFSRLRPRGDIVASTMGVASGPVSFMRIFDVAVDVIKQGGRRRGANMGVLHVSHPDIFSFIDAKSREGPLRNFNLSVAVPDEFMDDRPVDLINPRNGEVVDSVESRVILKRIVEAAWRSGDPGILFEDRINRYNPTPQLGRIEATNPCVSGDTIVMTSGGPRTVAELEGKPFTALIRGSGYPCPSGFFRTCERDVYDLRTREGHCLRLTHDHRVLVMDGGLEWRAAGELERGDRLVMDDAAGEFPALATFRGLRGAGRQDVYDATVYGASAFTANGFIVHNCGEQPLLTHESCNLGSVNLSLMVGPSGINWEKLRRTIHVAVHFLDNVIDVNSYPLRPVEEMTLRTRKIGLGVMGFADMLIKLGIPYNSVAALEVAGRVMSFISSEARRASMELARERGSFPEFKGSIWDIQGFECMRNATLTTIAPTGSLSIIAGTSSGIEPLFAVSFTRNILGRSFHELHPLFKTMAGRLDKRSLEAIESRGSLRGVPGVPARIRRLFVTAHEIDPVFHVKMQAAFQRYVDNAVSKTVNLPADSSPADVERVFRAAHELGCKGVTVYRYGSKVDEVLRFPEYAGSCRDMTCPN

SEQ ID NO: 1155 - protein, 548 aa, Methanobacterium thermoautotrophicum
MVFTEDTIGEFFEKQVERYADKEFIVYPDRDLRFTYREFNERVNLLAKGLLSIGIGKGDHVGIWATNVPDWLTFLFATAKIGAVLVTVNTAYKSHELEYVMKQSDMKALAIIDGFRDVDYVQTLYELVPELKTHERGHLRSERFPELRSVIYIGAQKHRGMYNTNELMLLGKHVPDTELRTVMSTLKNTDVINMQYTSGTTGFPKGVMLTHRNILNNGYYIGERQRFTEEDRLCLPVPLFHCFGIVLGVLALLTHGGTLVMIELFDPLLVLAAVEKERCTALYGVPTMFIAEFTHPMFDMFDLSSLRTGIMAGSPCPIEAMKRVMNDMNMKEVTIAYGLTEASPVFTQTSVDDPIEKRVETVGTPLPHIEVKIVDPETGEELGPGEPGEICCRGYNVMKGYYKMPEMTAEAIDEDGWLHSGDLAVMDEDGYYSIVGRIKDMIIRGGENIYPREIEEFLHTMPGVKDVQVVGIPDEKYGEIVGAFIIREDGADILEEDVRDYAIQRIARYKVPKHVFFVDEFPLTASGKVQKFKLREMAVELLKKKEQP

SEQ ID NO: 1156 - protein, 1708 aa, Methanobacterium thermoautotrophicum
MDIEKFKGGEKIMRKHLITVTAVLLMLMFCQSVAAADNSTEDNSTTVLVIGSSTATKSYNEVAYTVMNLTNRDAKRVNFQIRSTTQIGNMTGDEILSLINSSSIIIAEWGTQLAGNGSFEAVIRAHPSILENKLFFAFESGPTLVKLSRINNTEVFTGVNDSDIGTYDRPGTLIGACHDGDLTSLIAYKQKYPGNTALHQWIDCALYYAAAGKTNLENQFKLALKMYYNMRGIPWNSSWEPATVEPASPLSSEFLYRDGQRFTKEDYFTRYPLDPAKPTVAVLSYVGSTGEVTYADAMQQIIDALVSRGLNVIPVIGTWSNYVILNQTGMQNIIQTLCMPNQTYNITAIRGIGNYTDLTSILGVTSVSSANVYEVQILDNGNLIRSLKISTVQPVNVYSALVKFLTDASNVVQYEANPEKYPVKANVIIDMLTFITGSTTSGASVTKFFDRSNIPVLRAMITSSTYRTIGQWIVSEEGFSWMSVYWQCAQPEMQGQIEPLAIGVGEIGSDPETGAQWDITVTIPERIEKLVSRAFNWIRLQTMANSDKKVAIVYYNYPPGKQNIGASYLNVPESIIEILKRMKAEGYSVGEIPQDADALVEMMIKNGINVANWAPGELEKLANSSNAILWPYEDYLAWFNTLDPVARKEMVEGPVGYIEELTRVAVQCINEGDCRVRDEMLKTLNRWTQEMISNANTHPQIAGTAIDLINKMSAALTAVIWNTSNTTAWDLFYIYKNQFMALNVSGMTGWGEPPGNVMVVTRNGRKYVVIPGLMFGNVFIGPEPQRGWEADAANLYHSTIVPPPHCYLAWYAWVNTVFGANAQIHVGRHATYEWTPRKQYALSSFDYPDICIGDTPSLYIYIMDGVGEGLQAKRRGLAVIIDHLTPPLTRTKLYGDLQELAGLVSSYEATPTGNPMRDEYAKQIRETIIKLDLARDLGINATNMTDDDIDRVHDYLLSITSTLMPYGLDTFGLNWTDSEVALMVSGMLSPDSDVDPSLQRLISMMNGWNFSNLTFEQAEALNNATVEMIMELLRGTSIDTLLENITDPSLKATLHSKLELALQYASLLKDSPSSEMDALMEGLSGHYITPAKGGDPVKAPYALPTGRNFYAQDDNTLPTKVAWDLGKRLADMALAQLDTIPEKMAAVVWCVETARDDGAMVSFVLRMLGVQPKMDDKTWLGGGKLSYIVPTNLTELLSDLNNVRSSMGLSNLTSRPRIDVIVTTSGLFRDLFPNLLAKMDVAYRVALGASYSKILQAYPELKTQLDLALDPLLTGQFKQAKTMADLLKIIDKNDSLNVNYIAKHWVELVLAGYDGDTAITRIFAPPVGDYGAGVNHGVEEAWTWDNRSELADVYLRRMSHAYSNTRWGASMEGLFENLLKGVTVAYHSRSTNLYGVIDNDDYYDYYGGLSMAIEKVNGGVAPSLNVLYYANPSRPEVVSLQEFMRREMRTRYYNPEWIKSMMNEGYSGARTISNKFVAYLWGWQVTAPQLVDDYDWNEITDIYIKDKYNLGVNRWLSTGNRAYSMISITGTLLTAAHKGFWKADEATLRLVANTWASTVAEYGVACCDCSCGNLAMMEWAMQYVNPDLLARVKSKIYEATGAAAFAPSENPNQGGESGSTPGGQPHDGSSGTSGGSEGVSAASPGTQSSSQNVGAGSESSQGAGKSYEVTASGSSGSSDTGMPVYAILGVIALVALVGVGYFMGPGRK

SEQ ID NO: 1157 - protein, 248 aa, Methanobacterium thermoautotrophicum
MQPLQSAGYDRAITVFSPDGRLFQVEYAREAVKRGTTSLGVKSKEGIVLVVDKRPTSKLVEPKSIEKIFQIDEHIGAATSGLVADARAIIEKARLEAQINRITYNEPIRVESLAKKICDMKQMYTQHGGVRPFGTALIIGGVNGRGCRLFETDPSGALIEYKATAIGAGRPAAMEEFEKKYSDDMNLNQAIELALDAVYEATEGKTTPESVEIAVIEAADKKYRRLPDDEIRDHVEELLIRKEKEEEE

SEQ ID NO: 1158 - protein, 425 aa, Methanobacterium thermoautotrophicum
MTALINEFVNRVEFDSYEDFRDNFRINVPENFNFAYDVVDRYAEIEPDKVALVWCNDHGEEKRITFGELRDLSSRAANFFTKEGIQKGDTVMLTLKARYDFWYALLGLHRIGAIAIPATHMLKEKDIVYRIREADIKMVVCIAEDGVPEVFEGAIAELGSDTRRVLVGDTDRDGWINLRKEIMKLPADFERPEACAGGDDTLIVYFSSGTTGMPKMIEHDHTYPLGHIITAKYWQNVREDGLHYTVADTGWAKAMWGQIYGQWIAGSAVFVYDYDRFDPEKMLEKLEKYEITTFCAPPTIYRFLIKEDLSRYDLSGIEYAVTAGEPLNPEVFERFREHTGLQLMEGFGQTECVVCIANFPWMEPKPGSMGKPSPGYPVELVDRNGDPVDVGEEGEIVIRTAEGKPLGLFNGYYRNPEKTSEVWHD

SEQ ID NO: 1159 - protein, 1787 aa, Methanobacterium thermoautotrophicum
MTYNVTALVGNAGNQDTSGVRVDFVDNGVRVGSYTIPLLRSGETTTVVFNWTPMTVGSHTLQLIIDPENHIQETNETNNRIILNVTVNQALPDLICKSTELVADLIVNETYTFTARISNIGPANASGVRVDFVDNGVRVGSYTIPLLRSGETTTVVFNWTPMTVGSHTLQLIIDPENHIQEINKTNNKFNRFCTVKKSGNVLVFIISDEGQTIVINEAVHDANVLGYAPVREKVQIQIRSCEQLTKMSDNELLQVLSACDIFLGEYLSDSASQRLQKLLSTNPGITNKTGGIFLILEPAIVYNPAYTSLMRYSNIKGEYILSNIQDELLIDYYQNTKKGANFEHVLNYISSSNITGIFSLEYNMAVLYKDINNNNAFVNQIVWALNLIGVPNTGYWKPPIWATSGEKPYGIYRHGWYNLTEYINKYFRANATGCIGLLESKMYVDNQKLQPYYAIIDALEARGFNVIPVVAYGATPEQLKVMVESFTDAPDVESFFANPSKYKVYVDAIVSMPAYGLGGDLFTNVTKFFELINVPVFKALHSDYLLAEQWDLSTLGLRQLTGDRWWHIAVSESQGIIDSTIVATNSEPITDPDTGLSYSLYEIIPANIEHLADEIKGWVKLKRLSNNEKKVALIYYNYPPGKDNIGSSYLDVITSIYNLLNILKDNGYTVENIPANTTILHDMIIQKGINVAPWAPGELEKLAKNAILYPVDKYMEWFSKLDEITKIQVIEGPVGYIGELCKRAVGLNYTTGMGDRIDSWYDGIISLLPENKTNVAISVLDKIVAALKNYILTGDQRYYNEFLGYKRQFFALNISGLSGWGQPPGDIMTVEKNGTKYFVIPGMWFGNIFICPEPQRGWEGDINKLYHSMVVAPPHQYLAVYAYLQENTDAMVHLGRHATYEWLPGKEVLLASSDFPKVVTGATPQIYYYIVDGLAEGIQAKRRGSAVIIDHLTPPLTFTALYGGYASLATLVGQYDGADNSTKTEIISKIRKTIQDNNLTQLIEMAMGVSLNKLYGDKLVQTIEDYLGQVQDTLYPHGLHAIGKNWTEEEVAMLVSSILSVPFQVSTTEETTLQDEVALLFYRKSYGNLTSIQKEKVQENCIGIVKSVITNGVNATLNNLTSMPTAGLKKALELAREYAMKVYESMDAEVEALLDALNCGYIPPGAGNDLVSNPDALPTGRNFFQDQAAEIPTRSSFEYGKSLALLTLQNLNATVEKIAVGIFCTETARDDAALVSMVLALLGMEPDWSDSPSAGVGGAKLKEMPKYVELKDLVRPEGWEKKRIDVVIITTGLFRDLYSRQAGLLDKAFRVALARSYYTILDDTRLKQKYGDKIEKALNYVVGPVGFYGIGDESLDYNYVAKHWVEDFEYYMSLNMTPEIAGEYAISKIFAPPENDYGAGISKSIQLSWTWDDRMELADFYLNRMGNIYSSTQWGSSNPLVFKRALNGVKTVFTSRNTNLYGVLDNDDFFDYWGGLSVAIERVNGEAPTMYVLSYGNRGSPRALTLESFMSLEATTRYFNPEWIRAMMQSDPTGRYISRKFISNLIAWTILRDSYTHDEVFSSTFYSNLWQTAYNVYLQDSLQTGVTDWLSSGNRAYAMISITGTMLNVIYMGYWKTDETITRNIANRWAKMIAEHGVACCDCSCGNLAMIEWAMQYVNPDLIEKVKAKIYAATKNANFAPAEDHGEGGESGSTPRTQEGTGTGSAGSSARDSSVRSAGTTASLDEVGLQRGTGEPGKAGEGKSYEITRRGSQGFSSTGISFYAIMGVLILVVLMAIGYFRASRKEY

SEQ ID NO: 1160 - protein, 375 aa, Methanobacterium thermoautotrophicum
MTDYDVLIMGAGPAGSTLARLTATKGFRVGLFERKKIIGLPLQCAGLVSHRIMEVNVLPDEFILNSVRGAVLHSPSGIKLRVSKDRPEAHVIDRTAYDQHLAELAMEAGAELTKGTAVRDFNEKTGHVRVNGDELSADVLVDARGQSAAPSRYPARQYLVRFRDSEMDTDFVDLKVDSRLSPGFMWRIPIDEQTARVGVFGPQQNLKEFLKGFISDLSSDFEILESHHGFIPRPDLDLRLVRGRCILLGDAAGQVKPTTGGGIVLASRAAGVAAEVIQGVLEGDADLKEYEDACRKIHMSEMKNQMRVQRTFRLLSDKDLDHIFLKMKEYGAEDIISEYGDMDRQTPLIREFLKRGILFRIIPSILTSKVAGIWK

SEQ ID NO: 1161 - protein, 410 aa, Methanobacterium thermoautotrophicum
MENNSQNVLKKIEDLKKEVRMLKEENSKTKRNLMWKIRKLEKDKLLIENERTRLDREVKSLRGEIERFRTPPLVIATVTEVLDDHRVAVKSTTGPHFVINYSRFIDRKQLEPGARVALNQQTFSIVDVLPSEKDPVVTGMEVEEKPDVSYEQIGGLEEQVREVKETVELPLKKPELFEKIGIEPPKGVLLYGPPGTGKTLLAKAVAHETNATFIKIVASEFVRKYIGEGARLVRGVFELAKEKSPSIIFIDEIDAVAAKRLKSSTSGDREVQRTLMQLLAELDGFESRGNVGIVAATNRPDILDPALLRPGRFDRFIEVPLPNEDGRREILKIHTSGMALAEEVDIELLARITDGASGADLKAICTEAGMFAIRDERDEVTMADFMDAVDKIMGVEKEEEYKQETGVMFG

SEQ ID NO: 1162 - protein, 326 aa, Methanobacterium thermoautotrophicum
MSDNMEFPTKRMRRLRKSPQIRNILRETRLHPSDLIYPMFVSEKLGRGDVEAIDTMPGQFRYSVDDAVSEASRLEDEGLSSVLIFGMPSAKDELASAAHDPHGVVQRTVRRLKEETDLVVMTDVCLCQYTSHGHCGIVVDGEIVNDETLEVLSRIALSHAEAGADVVAPSDMMDGRVAAIRRSLDDAGFQDTLIMSYAVKYASAFYAPFRGAVSSAPAFGDRRSYQMDPANIDEALIEAELDLREGADILMVKPALAYLDVIGKVRERFSVPLAAYNVSGEYSMLKAAIKSGYLTDEAIYESILSIKRAGADLIISHFAPDLLGVI

SEQ ID NO: 1163 - protein, 374 aa, Methanobacterium thermoautotrophicum
MILCGDSVAGNSTGEMFRVTTFGSSHGPAVGAVIDGCPAGLELSEDDIQQELNRRRPGTGALTTPRAESDRVEILSGIFRGRTDGTPIAGIVRNLDADSKSYSNIKNTPRPGHGDYTWRARFRNYDYRGGGRGSGRVTIGHVIGGAVAKKLIGNYGLTVTGHVVQVGDVKADTVSLKRIGEYAESNPVRCADPRAARQMEKVILDARSRGDSVGGVVEVVVLGAPPGLGDPVFSKLDADMARALMGIGSVKGVEIGMGFEVAEHRASEINDEFYLDDDGKVRTTTNTSGGILGGISSGMPITARIAVKPTPSISVPQKTVDLERMEETTIEVRGRHDPCICPRVVPVAEAAVAIVLADHMIRAGFIHPTYIGNE

SEQ ID NO: 1164 - protein, 419 aa, Methanobacterium thermoautotrophicum
MDLTVEKSGNLEGTVKAPPSKSYTHRAVIIAALAEGVSEIRDPLIAEDTLSSLNACRAFGIRVDEGDAWTVHGSGGELETPDDVIYLGNSGTTLRLMTSVAGLAENYTVLTGDESLRTRPMQPLLDALRPLGVEALSSRMNGLPPIIVRGGLRGGSTSIRGDVSSQFISSILIAAPLTEGVEVMVEGDFISRPYVDMTVDVMERFSVPVDYSEGTFRVEPAVYRGLDYTVEGDYSSASYLAGAVAAAGGDVLIENLFRDSRQGDRIILDIISDMGAEVRRGEDHVRIASTGELSGVSVNLHDAPDLLPTVAVLGALATGRTEIGGVEHARYKETDRISTCAAELRRLGVDVTELPDGMIIEGGASGGTVWSHGDHRLAMAFTLIGLREGITIRDAEVFSVSFPDFPERMMQIGCRMNLS

SEQ ID NO: 1165 - protein, 285 aa, Methanobacterium thermoautotrophicum
MIIGCSASQKLAASVADLLDEPLCPVETRKFPDGERYIRVKEEVEGEVTVVQSTGYPQDENLMELLFMIENLKDLGADYVRAAIPYFGYGRQERRFKSGEAVSAKIVAHLLEAAGADEIVTVNLHENCLSEFFRVPVRELSAMPLIAEHISFLDDPVIIAPDKGALGHAREVSDILGCECDYMEKVRISPEVVETRVSDLDVEGKDAVVVDDIISTGGTIVNAAGILGKCGASSITVCCVHPVLVEDALLKIFSAGVERVIATDTLKSDVSEISVAPLIADVMKD

SEQ ID NO: 1166 - protein, 349 aa, Methanobacterium thermoautotrophicum
MILMAGIVGYGVYIPSYRIKVEEIARVWGDDPQAISRGLVVEEKSVPGPDEDTATISVEAARNALRRSQIDPSEIGAVYVGSESHPYAVKPTATIVAEAVEATPEMTAADLEFACKAGTAGIQACMGLVDSGIIKYGLAVGADTAQGAPGDALEYTASAGGAAYVIGGKNCLADIKETYSFTTDTPDFYRREGMPYPRHGGRFTGEPAYFKHVLGAARGMMEKTGLSADDFDYAVFHQPNGKFYLKAARKLGFESEQVKPGLLTPVIGNTYSGATPVGLAATLDVAEPGARILAVSYGSGAGSDAFIIEVNDLIEERRDLAPSVAEIIKNKRYVDYALYAKFKGKLRMA

SEQ ID NO: 1167 - protein, 383 aa, Methanobacterium thermoautotrophicum
MRDVAVIGVSQTKFGELWDVSFRDMITEAGLGAIEDAGVEGADLDAMYVGNMSAGLFIKQEHISSLIADHAGLTPIPSTRVEAACASGGLALRSGIMAVASGYHDIVIAAGVEKMTDVVDPTPAIATASDQEWEAQQGVTFPSLYAMMARRHMYEYGTTREQLAMVSVINHENASNNPRAQFPMKVTVEQVMNSTMVADPLRLLDCSPISDGAAAVILCPADMAREYTDTPVYVKASAQASGTIALHDRRDITRIDATVNAARNAFKMAKLTPGDIDLVEVHDCFSINGILAVEDLGFVEKGEGGRAFEDGMTRIDGDIPVNPSGGLKARGHPLGATGIAQAAEVVWQLRGEAGKRQVEGAEIGMTHNIGGTGGTAAVHIFSR

SEQ ID NO: 1168 - protein, 538 aa, Methanobacterium thermoautotrophicum
MAQGQQPILVLPEGTSRYLGRDAQRMNILAGKILAETVRTTLGPKGMDKMLVDSLGDIVVTNDGVTILKEMDIEHPAAKMLVEVAKTQEDEVGDGTTTAVIIAGELLKKAENLLEMEIHPTIIAMGYRQAAEKAQEILDDIAIDASDRDTLMKVAMTAMTGKGTEKAREPLAELIVDAVKQVEEDGEVEKDHIKIEKKEGAAVDDSTLVQGVIIDKERVHPGMPKKVENAKIALLNCPIEVKETEVDAEIRITDPSQMQAFIEQEEQMIRDMVNSIVDTGANVLFCQKGIDDLAQHYLAKAGVLAVRRVKKSDMEKLSKATGANIVTNIEDLSPEDLGEAGVVSEKKISGEEMIFVEECKEPKAVTILVRGSTEHVVSEVERAIEDAIGVVAATVEDGKVVAGGGAPEIEIAKRLKDYADSISGREQLAVSAFAEALEIVPKTLAENAGLDSIDVLVDLRAAHEESTYMGIDVFDGKIVDMKEAGVIEPHRVKKQAIQSAAEAAEMILRIDDVIAASSSGSSEEGMEEMGGMGGMPPM

SEQ ID NO: 1169 - protein, 347 aa, Methanobacterium thermoautotrophicum
MVNVGVLGATGMVGQRFIQMLDKHPEFELTTLAASSRSAGKPYGEVANWYLDCEMPESVRDMEVVETDPSAVGDVDILFSALPADVARKVEPKFAEKYIVASNASAMRMEPDVPLVIPEVNPEFLDLIEVQQRRRGWDGFIVTNPNCSTIALTLTLKPIYDAYTIKRVYVSTMQAVSGAGYNGVPSMAILDNLVPFIGGEEEKIETETLHLLGELDEGVVKPASFGVSASCHRVPVVDGHTEAVFIELDDEFDIDDVREAMDKFRGLPQKLGLHSAPEKPVVVRDEENRPQPRMDRDMDGGMAVTVGRLREDAAFKNSLRYVLVGHNTVRGAAGASILNAELINEIL

SEQ ID NO: 1170 - protein, 273 aa, Methanobacterium thermoautotrophicum
MIRVAVTGACGRMGSGIIRRVLEEEDMELVAAIEAPGTPLRGRDIGEFTGRGSVGVEVTDASNLADTLAETEPDVLVDFTVASAAVETIKTSTEAGVNLVVGTTGFSEEEMQTVRDCIERSGVRAVIAPNMAVGVNVFFKVLRDLAPILSDYDVEIIEAHHRHKKDAPSGTAVRALEVISEATGRRASEVAVHGRSGLTGERSRDEIGVHAVRGGDIVGDHIVLFAGDGERLEIVHRAHSRDAFIGGVIRAIRFIEDAEPGRIMDMGDVLGIN

SEQ ID NO: 1171 - protein, 283 aa, Methanobacterium thermoautotrophicum
MKIEGTVVAMVTPFTEDDVVDEAGLRENINYLIENGVDGLLVAGTTGESATITHEEQRRMIDILVDEVNGRVRTVAGAGSNSSREAMGLVEYAEDAGADAALVITPYYNKPQPHGLIEHYTMLEEAADIPLIIYNVPSRTGTDIDVDTVAELAKLDGIIGIKEASPDLDKVSMLRSRLMDLGLDDFTVLSGNDNLTLPMISMGAEGVISVVANVDPARMSRLVNEALSGDFESAMKTHYELYSLMKVLFIESNPVPVKEALNMMGKARGSCEDAPGTPAGCKP

SEQ ID NO: 1172 - protein, 406 aa, Methanobacterium thermoautotrophicum
MELIVAKFGGTSIGNGRRIKKAARSVVKEYMKGRKVVVVVSAINKTTDELLQIVDEAMEDAVTEKQLAEIVSMGEMTSVRIFSSAIEALGVKSEYIDPFMDEWPIITDSNLLNAKVDFEATEEKSRELLKLLDQGIIPVVCGFLGRDPNGYITTLGRGGSDITAFLLGHCLKADEVIIVTDVGGVMSTDPNKLQGAKKLDKISVEEMRDLATHGAQVLHPHALKYKDPDIKAKIIGFEHGDLSAPGTEIIGPSKNKMVKTTTLNPDPISVVAVVGEKILNKPGILARLTSRLAENSINIIGISTGQNSVTIFVDKKDADEAHRLLHDVVIADDDLSSLSLGRDIAMITISSPDFIDTPGIISEITKPLRDNDLNIVEISSSQTSVVIFVDWNDGKKAYELVRGVLE

SEQ ID NO: 1173 - protein, 217 aa, Methanobacterium thermoautotrophicum
MMDERRRMVQDLMERGYIKSEAVRRAMERVPREEFVPEDEMHRAYMDMPLPIGEGQTISAPHMVAMIAEILDLEPGMKVLEIGTGCGYNAAVIAEIIGPEGHLYTVERIGILYERARKKLRSLGYDNITVIHGDGSQGFADEAPYSRIYVTAAAPYIPDPLMKQLEIGGKLLIPVGSDKFYQELVLIERTSADDYRSRNLGGVAFVPLIGKHGWKFH

SEQ ID NO: 1174 - protein, 431 aa, Methanobacterium thermoautotrophicum
MDDQRIAVFGLGHIGLPTAALFARAGFKVTGVDINPETVEKVNIGRSPVLEPGLDELVAEVVGTGNLGATMDGERAAAESEVMIIVVPTPVNSENTSDLSAVISAAETISRGLKKGDLVIVESTVPPGACQNVVLPILEKTGLKVSEDFGLAYTPERALPNNTLHEMQNNARVIGGADPESARRAAALYRRITSGEVIVVDDLMTAEMVKLMENTYRDTNIALANELAVICEALGIDAINAIEAANHHPRVNIHTPGPGVGGHCLSIDPYFIVEMAERKGVPARLIRTAREVNESMPLHVLEIVRETLESRGKTLKGSNVGILGVAYKGDVADARETPTRPLVAALLSEGARVLVNDPHVSPEIIRGMGVEPVSLEEALNSDCVVLMTDHTEYLEITPEMIPGGIFICTRPVMDPERFRTRGITFRGVGRP

SEQ ID NO: 1175 - protein, 382 aa, Methanobacterium thermoautotrophicum
MGGVPPSQVIRGGRQHGLSYQLRHLNHNTLLNQFTKVIITVKSIKVIKMISVGIIGASGYTGGELLRLLENHREVEVVSATSRQYSGVPVSRVHPHLQDTDLKFEDVGAGEIDADLVFTATPHGASMKIVPQLIERGIRVVDLSGDYRFDDTETYEEWYGIKHESPLEAVYGLPEIHREEIASADLVANPGCFPTGAILACLPLVYEKIADTFIIDSKTGVSGAGVKPTALTHYPHCSDNVIPYNVTGHRHTPEIRQELSRLNPVRLSFTPHLVPVTRGILTTAHTFLLEDLEQGEIADIFMGFYDGEPFVRVVEGIPGLSAVRGSNFCQIGCFEVDDNQRAVIVSAIDNLVKGASGQAIQNMNIMFGFREVEGLDFPGMYP

SEQ ID NO: 1176 - protein, 174 aa, Methanobacterium thermoautotrophicum
MKGNRGCPFPIQRQIIRGMDMKKPFELRVKPIKNGTVIDHITANRSLNVLNILGLPDGRSKVTVAMNMDSSQLGSKDIVKIENRELKPSEVDQIALIAPRATINIVRDYKIVEKAKVRLMDEVRGILRCPNPNCITNSDEGVENRFYVISEEPVLLRCYYCERLIEADEIESQF

SEQ ID NO: 1177 - protein, 334 aa, Methanobacterium thermoautotrophicum
MKYGMFNELMEQPESLRRTLKSEGDRMARISNEILECRRIYLVGCGSSLSTCYSARDAIAMNYEVNMDVMTGYEFYYHRQIDYSDSAVIFTSQSGETADTLAALRRANELGLRTVTITNEPGSTMASESMETIVTRCGREEAILGTKTYMTQLLALYRILFGMYSDEKSDEIMGELEKLPGEVEDLLRRTEVECRDLAEEYSGEDIFYCMGSGPNYGLAYKLAMTMLMEGALKHSCPLYSGEFRHGLIERVEEGVPVIFLESGLPGDELTERALRFCEKLGAENLVFRMSDYSDLNGLMSPFVLAVPLEWFVYYLAHFNGEDPGSTRHIGKVRY

SEQ ID NO: 1178 - protein, 286 aa, Methanobacterium thermoautotrophicum
MLIHTHEPLKFAFSTTDHERIPELSFGIMGVPFDSTTSYVPGARFGPMAVREASYSFEAYNLRFSENVKVKSFDFGDLEVSPGNFMKTAGFIGDSVSEVLDMGLKPLIIGGEHTVTLPVIENLPEHDSLTVVHLDAHMDLADTYAGERYSHATVMRRVHELGAEIIQIGIRSASSEEAEFAGEEGVRFCMAHEVMGDPAGAIELIDGIRGPVYISVDMDVLDPAYAPSVGNPAPAGLTPHIMEELVLALSGKDVVGLDVVEVASGGMADPTSVNAAKIIYDILTLL

SEQ ID NO: 1179 - protein, 289 aa, Methanobacterium thermoautotrophicum
MIAGTRGSRLALVQTNHVIEMLSEVCKEKIEKKIIKTKGDRIRDSQLYSMDSRGLFTRELDMAVLNEEVDLAVHSLKDVPSDLDPDLAIAAVPPRESPAEVLVSRLDWEDLPQGSKLGTSSLRREAFCNHHQKNFKMEPLRGNIDTRIRKVMDGEVHATIMAEAGLKRLGLEEHIKRRFPVEYFTPAAGQGALAVITRADSELISSIGRITHHPSLQEVTAEKTLLRELGAGCQCPLGVIGRATGNQLTLYAVLLTREGEMLRKVTVRGPLAEAEDIGKKAAKEMEDYI

SEQ ID NO: 1180 - protein, 310 aa, Methanobacterium thermoautotrophicum
MRSDVSEIEKETKCPECGSDDLRGDYERAEIVCGKCGLVIDDNLVDMGPEWRAFDHEQRDKRTRVGAPITYTIHDKGLSTMIDWRNKDIYGRDIPARNRAQWYRLRKWQRKIRISGATERNLAFALSELDRDSSRLGLPRSVREAASMVYRRAVENKLIRGRSIEGVVAASLYAACRKCNVPRTLDEIAEVSRVSKKEVGRTYRFLTRELNIKLPPTSPVDYVPRFASELGLSGEVQSKAIEIIEMAMENGLTSGRGPTGVAAAALYIASVLLGEHKTQRDVAEVAGVTEVTIRNRYKELTEQLDLGVTL

SEQ ID NO: 1181 - protein, 1668 aa, Methanobacterium thermoautotrophicum
MKMIRKRSVTLLITVVFVFMLQGSSMAAEIDGGEGGTPFNITDSEGRFAFENVTGDSHVVWVDGRTLPERHRFDDMLRVTVSASSNASARSGKMILEASLSDSKITGRLYADLNDNTIFDDGDEPLAGVSIFDPPEIRFLIISWPTEAGQLIQPVKNIMQKHPEITIKVRNTDQTRMNLTETEQLIEWADIVYISNVQTTNGPSGPVPDLLMSMKSQGKLNGKVIAAYPNPYHCFPVTRLTNINNTRFVDANGTELTDSQLQAIFDSVSRAVPPKTPLMVLRELQQQYPAMASYLKFQEYKTSDTASPENREQGLMYLLALAFPGRGYNFTEPVIVPKYALYRNGRLYYNFTDYEQFLTPGRPTVGITSWMALTWERGDLLMLDRLISEMESRGINVIATIAQGNPVDGTPVINAMRSYFFDSQNRTRIQGLITLQSFKIGGATAAIAERMIMDNNILVFRSLVVSDSEETWYISDSGMDFTSITSQIVLPEFQGQILTMVTASTRKTIDTVTGLEVECYQPIDERVETFADRVYSWLRLRFLSNADKKVALIYYNYPPGKQNLAGASYLDGPSSILEILGLLQENNYTVRGAPSCVDDLLTEMMARGLNIANWAPGELERLANSTILWDVERYMEWYSRLPELARREIEEGPFGYIEALFRYSTENPKLLETLDRWQSSLITTIDDMQISNGSEAKNQVNRAYNALKNIYSGLNQWDVFYSAKSAFLALRVPGLCGWGAPPGNIMTVERNGKRYLVIPGMFYGNVFVGPQPQRGWEGDVDKLYHSQIVPPHHQYLAFYAYLQTEFGADAMIHLGRHGTYEWLPRKESALSGADYPDICLGGIPSIYIYIMDGVGEVIHAKRRGLAVSISHLTPPLEATEIYGDIASLKTLIDQYHAAPGNRSEEIRLIREKAVQLHLDTIIDLNLDPDELVDRIDDYIRELEGTMMPLGLYVFGRDLNQTQLTIMVKSMASVPRISAGNNTFLSVTQALSGINRTVEDLILEFYSGKSLQTLMAELQAVLGRNLTATEITALNMTLNDVLNIKGSGARERQMLLQALAGGYIPPIAGGDPIRNPAAVPTGGNLYGEDPSLLPTQAAWIRGSMLADEALRAYNATPEQLGVVIWATETQNDKGATVAFILRLMGLEPIYGFGGSVMGVRATPLTVLNRSRVDVLMTTSGIFRETFPLLGVLLDRASRVALAASFNTLMAAINQESAENRTMLLAALNASVSSIQKAGLFIPGSDPLDRNPIARHWLYDVKELIKLGMKPEDAGIAAISRLFGPSLGNYGTRLPEAVQQDWTWEERTELGRLYIDSMKYALSEDGWGVSLEEVLTMRLRDVEGVYHSRSTNLYGVVDVDHNFEFLGGFRLAVEAAGGRVPGMYIINQVNPSNARIETLNQFLYRELQSRYYNPRWIQAMMQSGYAGAREISNNFVANLWGWNVMSPETISDWMWEETVDIYIRDRYGLGVKDWLSQGRNSYAMISMTGTMLTAIHRGYWNPDDATKRLIATTWAQAIAENGVACCDCSCGNIAMMEWAMQYLNPDLLSRVREKLYAATKSSAFAPSSDGGSTPTAPSNPGQPQAPGTSADNGEPHHEESQDSDVSTSAPGVEAATHSSAGENQGKAYEVSSASGSANPETGLPVYAIVGIVAIVGLLGLGYFFGPGRTD

SEQ ID NO: 1182 - protein, 213 aa, Methanobacterium thermoautotrophicum
MAQEMIEGINPTRMELLKLKQREKLAVKGYSLLKEKRNALIMEFFNILERVKGSREKVEEHLKEAFSDLTEAQVLMGDTAVERAAMSVRESVEVDIDSRSIMGVVVPVVDARATQRTVVERGYGLVDTSVKLDEAARKFEESLALIIELGEIEKTIRLLAGEIESTKRRVNALEHIIIPRLKNTVKYIEMRLEEMERENFVRLKMIKKSMEME

SEQ ID NO: 1183 - protein, 465 aa, Methanobacterium thermoautotrophicum
MKMNVNIKTREYTTVTEVSGPLMIVEGVEGVAYSEIVEIETPTGEKRRGQVLEVREDLAVVQVFEGTSDLNTETTKIRFTGETAKIGVSLDMMGRIFDGTGKPIDGGPEIIPEKELDINGSPMNPAAREFPAEFIQTGISTIDGMNTLVRGQKLPIFSGSGLPHNELAAQIARQAKVLAEESEFAVIFAAMGITHEEANYFMRDFERTGALERVTVFMNLADDPAIERIITPRMALTTAEYFAFEHDMHVLVILTDLTNYCEALREISAAREEVPGRRGYPGYMYTDLASLYERAGRIVGKEGSITQMPILVMPQDDITHPIPDLTGYITEGQIVLSRDLHRKGIYPPVDVLPSLSRLMSGGIGEGRTREDHSGVSDQLYSAYAEGRDLRDLMAVVGEEALTERDRKFLKFADEFEKRFITQARDEDRSIEETLNLGWELLSLLPRSELKRVREEHIPKYLPGAE

SEQ ID NO: 1184 - protein, 584 aa, Methanobacterium thermoautotrophicum
MTQEGRIIKIAGPVIIAEGMRGSQMYEMVKVGEDKLIGEIIELEGDTATIQVYEETAGIKPGETVERTGGPLSVELGPGILGSIFDGIQRPLENIKALTGDYIERGVDVPSLPKDKKWTFKPTAREGQMVKGGDIIGEVEETSSITHRIMIPPNVEGKLTMIAPQGEYTVLDDIAEVETESGTEKIQMLQKWPVRKGRPYKKKLDPDVPLVTGQRAQDTFFSVAKGGTAAIPGPFGSGKTVTQQQLAKWADADIIVYVGCGERGNEMTEVLKEFPELEDPKTGNPLMDRTVLIANTSNMPVAAREACVYTGITIAEYFRDMGYDVALMADSTSRWAEAMREISGRLEEMPGEEGYPAYLASRLAQFYERAGRVTTIGSEDKIASVSVVGAVSPPGGDLSEPVTQNTLRICKVFWALDASLADKRHFPSIDWLQSYSLYIDSVQEWWASNVDPEWRKFRDEAMALLQKEAELQEIVQLVGPDALPDRERITLETTRMIREDFLQQNAYHEVDTYCSPSKQFEMLRTIIMFHRNATAALEKGAPAADIISLPVKEDIGRMKYIPEEEFPARIKEIQERIVKECSEV

SEQ ID NO: 1185 - protein, 106 aa, Methanobacterium thermoautotrophicum
MSSNIAVVGDRDTVTGFRLGGVREGYVVETPDEAEETIRNLIRDGFSIIIVTEKIGDELREFIEETTSSSALPMIIEIPDKTGPSERETDPLRDLIKRVIGVEMVK

SEQ ID NO: 1186 - protein, 206 aa, Methanobacterium thermoautotrophicum
MSSGAEKIVSSIMSEAQAKADAIIREAEDEAAGIVDEGEKRARMASERILESARKQADMRYQQIISEAKMNARRAELEAREEVIQEAFKKAEEELKNLASTSQEEYVSALRGMIKEAAVEIGGGDLVVSMREDDRSLDLGLDKIAAEVEAETGKKTTLKVGDSIRTIGGAVVRTEDGLIEVNNTIEARMSRFRKALRSEVARVLFE

SEQ ID NO: 1187 - protein, 658 aa, Methanobacterium thermoautotrophicum
MSDMFLPARMRKLKIITLDQYSDSVVRSLHEEGVTQIDDISERIQQDAEWRQILKPSRATPYTGRVSSLLMKTSGILDFLGSVAAEEKGLRDTIREFINPPIFEKREVEELDTESLIERAEETLGRVESETRVMEEKLNELDSERSAVESSLSVAEKLKDFDIDFSDLQDSEYITGIAGRITAENLPELRDKLADITDELVISDREGENKAERILIIVTLKKHADSIASVLRRMEFERFEISELQGRPSEIISSSKTRLEEISRERKEIISKLRDINAEWEDELLVLREQLEIEKERNEVFSLFGETRKTVMLEAWVPLKEADRVIAVVEESSEGTALTDLEDPDPEEVPVLLDNPRFAKPYETFVEMYSPLKYNEIDPTIFMAFVFPFFFGFCLTDAGYGIIDALIGFILYRGLGKVNNFMRNFGIIMMSCGVWAFILGMVTNGFIGDFFPRFFNITLPTVIPAIDAFVNPQNILIMALTVGVLHINFGLILGARNNIRLGNMREALGSQIVWLILELGIILYLVGGMIFGAPLIILAFAMLLYYNGLFGLMDVSGFLGTLLSYARLLALCLSTGGIAMTVNILTGLSYEMIPVIGVVLAPIIFVFGHIANNAFQSLGAFINSLRLHYVEFFAQFYMGGKNKFNAFRAERNFTKIRR

SEQ ID NO: 1188 - protein, 455 aa, Methanobacterium thermoautotrophicum
MEMIIDGEGVSGEKIFTVRNPFNGDEVDRVPLAGRSDVERAIRAAHRARDAMADLSARKISEKLYDVADELKTELDEFARLITLESGKPIRFSRDEVKRSVETARLSAEEAGRLYGESIPMDAGIGGKGLTGFTVRIPLGVVAAITPFNYPLNLAIHKVGPALAAGNTTILKPSLEAPLSALKLAWILSEHFPAGAVNAVTGRGSEVGDVIIDSPLVDKITFTGSVEVGRYISARASMKKITLELGGNDPLIVMDDADIDSAVEAAVRGSYLYSGQVCIAVKRMIVHEDVADEFADKLVNITGSLRAGDPMDVRTDVGPLINEDAAIEVERVIGAAVEDGAELLCGGSRRGNFVEPTVLDHVVPGMEVIERETFGPVSPIIRFNGADEAIRIANGTCYALQAGVFTENIRTALRMAREIEAGTVLVNKQSTFRVDHMPFGDSGAVEWVRRVSSTP

SEQ ID NO: 1189 - protein, 341 aa, Methanobacterium thermoautotrophicum
MTDRGLMKTGFVEDVSSSLEEEGLEYVIFDDVTPNPRDHEVMEGAEVFDAEECNMIVALGGGSPIDCAKAMGAVVSNRMHVLDFEGVDMIPTPSVPIICIPTTAGTGADVSQFAIILDTRRMVKIAIISKAMIPDASLIDPETTVTMDRELTASTGMDALAHSIEAYVSNASFHLTDLNALDAIRIISRCLPSAVDEPENMEYREGMMLASLEAGLAFSNASLGLVHAMAHSLGGKLDMAHGEANALLLEHVIEFNYPGATERYHEIARAMGLRGSGPAELIDYIREFRSSIGIDMTLEDLGVGEDDIPELAEASMKDPCIVTNPVRPSIEDVEAIFRRAL

SEQ ID NO: 1190 - protein, 828 aa, Methanobacterium thermoautotrophicum
MENIDPMGIHTGESVVVAPAQTLSDEDNQRLRDAAIKIIRALKIEGGCNIQFAVHPETGEYKVIEVNPRVSRSSALASKATGYPIAKIAAKIAVGMTLDEIQNDITKETPASFEPTIDYVVTKIPRWPFDKFKGISREIGVQMKSTGEVMAIGRTLEESLNKAIRSLDIGADGFTETPYTRADLENPTDQRLFQVYTALRDGMSIEEIHGLTQIDPFFLQKISNIAEFESSITRESLEDPRILLKAKRMGFSDSRLASLTGMDESSIRALRLENNIKPVYKMVDTCAAEFEARTPYYYGCYDLEDEVEVSDRRKVLIIGSGPIRIGQGIEFDYCCVHAAMALTEDGYETIMVNNNPETVSTDYDISDKLYFEPLTLEDVLAIIEKEKPEGVVVQFGGQTSINLAVPLAEAGVRILGTPHESIDRVEDRERFTEVLNKLGIPQAPYGIAKSFEDARAVAERIGYPVLVRPSYVLGGRAMEIVYDDVELEEYMREAVRVSPEHPILVDKFLEDAIEVDVDALCDGTDVYIGGIMEHIEEAGVHSGDSACVIPPQSIPEDIIDTIKEYTRKLALELEVVGLINIQYAVKPDSDPSVYILEANPRASRTVPFVSKATGVPLAKMAARLMMGAKLRDLGLTEEKDIEHVAVKESVFPFIKLPGADSVLGPEMKSTGEAMGIDENFGIAYYKSQLSASMDLLNEGKVFISVRDQDKDKIADIVKKADELGFRIMATRGTARAVSDIADIEVVRKVSQGSPNIRDAILDGEVGLIINTPSGKQSADDGYLIRRMAVELGIPYVTTLAGARAALNAIEAVRMGKITVKSLDEYHGM

SEQ ID NO: 1191 - protein, 230 aa, Methanobacterium thermoautotrophicum
MPRDESINKVLIIGSGPIQIGQAAEFDYSGSQACKSLREEGIETVLVNSNPATIQTDMEMADRVYVEPLTPEIVAKIIQKEKPDAVLPTMGGQTGLNVATGLAEMGALEGVRVIGSSIETIRNVEDRDLFDSFMKKLNEPVPAARAVSSVEEALEAVEEIGYPVIVRPAFTLGGTGGGVAHSRDELIEIATRGLEMSFINQVLIDQSVLGWKEFEYEVMRDRNDTCIIVL

SEQ ID NO: 1192 - protein, 374 aa, Methanobacterium thermoautotrophicum
MNIDQSNPIKGNQDHGGEMFKEAKLALEDGTIIRGEAFGSETVKTGEVVFATGMTGYVESLTDPSYRGQILMPTYPLQGNYGVTEEWYQSDGIKAEGLIVREMCPAPSHSLSEKTLPEFLEEYGIPGIAGVDTRALTIKIRDKGTMKGALATEEIDDDELLEMAVKQPDITEIDLVDMVCVREPVILNEDASGRVVIVDCGIKRNSIDALLEKDLGVVIVPYTTSPAEIMDYEPDGLLISSGPGDPTRVRDAIDTVKALSERLPIFGICLGQQIIALAFGARIYKMKFGHRGVNQPVKDLRSGTVSITSQNHGFTVDPDSVKGTDIEITQLNLNDGTPEGIEHRELPVFSVQYHPEAGPGPHDTVNIFDRLWMF

SEQ ID NO: 1193 - protein, 844 aa, Methanobacterium thermoautotrophicum
MFKMKWADMSLDEVLKELKTSRKGLSQDEASRRLEKYGKNELVEEKKAGPVKLFLSQFMDILIILLILAAVASYFVGDVLDSAVILFVVVVNATVGFIQEYRAERAMEKLKGLVSTEAVVIRDGETLRIPASELTLGDMVIIEEGDNVPADLRLIETYDLRIDESALTGESIPVRKTHENPEDERDVIAFMDSNVVSGRGKGAVIATGMETSMGKIARMIQEDEGKTPLQEKIISLGKNLGLIAVVVCALVFAIQFLRGLPLVDTFMTAVSLAVASVPEGLPAILTLTLALGMQRMARSNAIVRRLLAVETLGSCSVICTDKTGTLTHNRMTVRESELTSPEMALLVCALCNNATSSEGGVIGDPTDAAILSFAAEKGYLRDELERKYPRLAEIPLDSTRKRMSTINQLEDGRYLLVKGAPEIILRRCRYIDSGDGVKELTDEEVERWLSRLNDMTSRALRVLALAYRKLPDGDDEEKDLVFVGLVGMMDPPRREAADAIETCKRAGIKVVMITGDHRDTAVAIAHELGLMDNGMALTGRELDELSDEEFHEIVEDVRVYARVFPEQKVRIVEALQGRGHVVAMTGDGVNDAPALKKAAIGVAMGSGTDVARESSDMVLQDDNFATIVRAVKEGRTIFDNIRRFVKFQLSTNVGAILTIVSASLINLPVPFNPIQILWINIIMDGPPAQSLGVEPPESDIMLRGPERENILPGRNLLRIILAGAVMAAGTLGLYMYMLSSGAGIERAMTVAFTVFVVFQIFNVFNCKSRTGLSNRALILAVVASLALQILVIYLSPLEGIFRTVPLSVVDWVLIVLVASLILILEAVLRFSDGRNKVKENRANP

SEQ ID NO: 1194 - protein, 337 aa, Methanobacterium thermoautotrophicum
MISVAINGYGTIGKRVADAVAAQDDMKVAGVSKTKPDFEARVAIEKGYDLYVSIPEREKLFGEAGIPVSGTVEDMLEEADIVVDATPEGIGAKNLEMYREKGIKAIFQGGEKHDAIGLSFNSFANYDESLGADYTRVVSCNTTGLCRTLKPIDDLCGIKKVRAVMVRRGADPVQVKKGPINAIVPNPPTVPSHHGPDLKTVMKGVNIHTVALLVPTTLMHQHNIMVELEDPVEADEIKARLDETTRVMLVRASEGLASTAEIMEYAKELGRSRNDLFEIPVWEESINVVDGELFYMQAVHQESDAVPESVDAIRALLELEEDNMKSIMKTNRAMGIL

SEQ ID NO: 1195 - protein, 372 aa, Methanobacterium thermoautotrophicum
MVKFNNIIYDPQVSDKKFPVQASDPEREAKLVVLQPVGYPFVCNLMEAPRIDAVNKELFEIYARDQWEGFRAAEGSYLFDQKLLPDYAFKIIRAHPDGSKITRNTSIILLENDREEFHEVRSSITMDDVIGQEDAKIKCRIIMKYLEDPDRFRDWAPRNVLFHGSPGTGKTMLAKSLANELKVPLYLIKATSLIGEHVGDGARQIHELYELASKTAPSVIFIDEMDAIGLDRRYQSLRGDVSEVVNALLTEMDGINQNWGVVTIGATNNPELLDKAIRSRFEEEIEFKLPDDEERKLMLEKYIETMPLKVDFPVDKLVKLTREMSGRDIKDRVLKTALHRAIAEDSESVRAEHIEYALKERKVSGEPKHMFA

SEQ ID NO: 1196 - protein, 402 aa, Methanobacterium thermoautotrophicum
MLQVILNIRLDHKTSDVKTMESSHERMEAIVAELESSGTVMEKVPIRTCNRIEYYLSVQEIPPGFEFDGFTVEGDEDALRHILRLASGLESMIIGEDQILGQIKAARVQALREGTCGPVLDMVFTKAVHVGQTVRRKTQINRGSVSIGSAAVDLAESIHGDLKCRKVLAIGAGKMGTLVARALAEKHLSAIMVANRTYERAYQLACELGGDAIHFDRLNRALRDADVVISATGSPHYILTRERVRDAIPPERRSAVVMVDIANPRDIEESVRELGIRLFTIDDLRGVAEENRRRREAEAREAERIVEGELKLLLRSLKHMEVEPLLAEVRGNMESLRRREAERALNKIMNSSDPEGVIEALSRSIVDKIFHDIAISIRQAAERGDEEFLSMCAKLFNCKDLK

SEQ ID NO: 1197 - protein, 206 aa, Methanobacterium thermoautotrophicum
MKVLGIDEAGRGPVIGPLVVAGVMIPERKFSILRKMGVKDSKKLTPERRRFLARKIRRIARVFTVKISASDIDRMRERGFNLNEIEKIAIKRIIPEAQPDRVIIDSVDVKPERLEEEIRSHFGEIEVTAEHGADTRYYPVAAASIIAKVERDLEIESIQKKNRKLGDIGSGYPSDPRTREFLESFTYDELPDFVRRSWATVQKKKQ

SEQ ID NO: 1198 - protein, 365 aa, Methanobacterium thermoautotrophicum
MKFYEYSAKEIFRAEGISTPRGGVAETPEEAERIAAELGCDVAVKSQVLTGGRGKAGGIRFASPSGVAEVTGDLLSSEVRGETVEKVLIEEKIPIDRELYVSAVIDRTAKMPLIMASAEGGVDIEELAARSPEKIVRYHINPLDEFLPYEAREIARKMGLESELIPSVGGVIWKLYQLFRKYDARLAEINPLVISGDSVIAADAKLEVDDDSIYRHREFMEMEEYEPEEFAFVKLDGDIAVIGNGAGLTLTAMDLIKLNGEPATFLDIGGGASEDVIRRALDLVISHPSVRVVFLNVLGGITRADDVARGVVNALRDARRDVPLVIRLTGTNEEEGQRILREAGIPFETSLERAAEKAVEIAKNL

SEQ ID NO: 1199 - protein, 411 aa, Methanobacterium thermoautotrophicum
MMVIPVSFKFKTMDDIEVTGKTVLVRVDINSPVDPNDGTILDDTRMRLHAETIRELSDRGARTVVMAHQSRPGKNDFTTLEQHARALSGILRRPVKYVEDIFGSAARENISGLGDGEIILLENVRFYSEEVLKRDPEEQAETHLVRKLAPLLDYFINDAFAAAHRSQPSLVGFALRVPSAAGRVMERELRTLQGALENVERPCVYVLGGVKVDDSIMVMKNVLENGSADLVLTTGLVANIFLAGCGVKIGKVNMDFIKSRGYCDFIKVAKKLKKRFPERIVVPVDVAVCRDGKRVDVPVKKIPNHPIQDIGMETIKLYARRIREARTLFANGPAGVFENPDFSIGTEDILNAISSSEGFSIIGGGHLAAAAVKMGFEDSINHISSGGGASISLLAGEELPAVRVLEESRHP

SEQ ID NO: 1200 - protein, 603 aa, Methanobacterium thermoautotrophicum
MSKTKIYINGKLIGTCENPEEFVEEMRKKRRSGEVSPEMNITHYPENHEIYIFTDPGRARRPLIIVEDGEPLLTEEHLEKLETGEMSWDDLIAAGIIEYLDAEEEENAYIAMSPDEINDEHTHLEIDPSTMLGICAGIIPFANHNSSPRNTMEAGMTKQALGLYASNYDLRTDTRAHLLHHPQVPIVKTRIIDVTGYDERPSGQNFVVAVMSYEGYNMEDALILNKASLERGLARSSFFRSYEAAERRYPGGQEDRFEIPEKGVRGYRSESDYRHLDEDGIINPEAEVSSGDVLIGKTSPPRFLEEIDEFGTVAERRRETSVTVRHGEKGIVDAVLLTETVEGSRLAKIRVREQRQPELGDKFASRHGQKGVVGLIVSQEDMPFTEDGIVPDLIVNPHAIPSRMSVGQVLEMLAGKAACMEGRRVDGTPFTGEDEDDIKEALRANGFETAGVESLYNGITGERIEAEIFIGVAYYQKLHHMTTDKVYARSRGPVQVLTRQPTEGRAREGGLRFGEMERDCLIAHGAALALKERLLDESDKYEALVCADCGMIAVYDKIRDKKYCPICEDSESFPVEVSYAFKLLLDELKSLCIFPKLILEDKA

SEQ ID NO: 1201 - protein, 413 aa, Methanobacterium thermoautotrophicum
MAKEKEHMNLAFIGHVDHGKSTLVGHLLLQAGAIAEQQLAEGEDKFRFVMDRLSEERERGVTIDLAHAKFETDKYEFTIVDCPGHRDFVKNMITGASQADAAVLVVAVDDGVMPQTKEHVFLSRTLGINQLIVAINKMDLVNYDEEKFNALKDEVAALIKTVGYKPSDVEFIPLSAFEGDNITSKSENTPWYKGKTLVEALDDLEAPEKPVDLPLRIPIQDVYSITGVGTVPVGRVETGVLKKGENVIFEPAGVSGEVKSIEMHHEMIEQAEPGDNIGFNVRGVGKNDIRRGDVAGHLDNPPKVAKEFTAQIVVLQHPGVITVGYTPVFHCHTAQVACTFLELVQKMNPATGQVEEENPDFLKTGNAAVVKVKPTKPLVIEKIKDIPHMGRFAIRDMGQTVAAGMCIDLVPAK

SEQ ID NO: 1202 - protein, 312 aa, Methanobacterium thermoautotrophicum
MDHIIETEDIKKKYDEFLAVKGVNLRVPEGSIYGVLGPNGAGKTTLISMLCTILRPTGGRGTVNGYDIVRDARKVRESIGIVFQSRALDDILTGREHLEMHAALYGVPRDVRDRRIEEVLELIALGDKADEYVKTYSGGMKRRLEIGRGLIHHPRVLFLDEPTLGLDPQTRESIWRYIEKLNREEDVTVLLTTHYMEEADKLCDEVAIMSHGEIIKADSPGNLKRELGADTITVRVDRARGFHEILEKQDYVKEAYLMDDEVKVLVERGENLVPEIVNLAARNNYYVRAVELEHPTLEDVFIKYTGRGISEA

SEQ ID NO: 1203 - protein, 568 aa, Methanobacterium thermoautotrophicum
MKGIKVVETAFRDAHQSLLATRLRTRDMTPIAEEMDRVGFFSLEAWGGATFDTCIRYLNEDPWERLRELKEHVKRTPIQMLLRGQNLVGYKHYPDDIVRKFIEKSYENGVDVFRIFDALNDIRNMEYAIKVAREQEAHVQGVICYTISPYHTLESYVDFARELEALECDSVAIKDMAGLISPHDAYELVRALKEETDLMVNLHCHCTSGMTPMSYYAACEAGVDILDTAISPLSWGASQPPTESIVAALRDTPYDTGLDLEILKNIKKYFEEIRKKYSSILDPIAEQIDTDVLIYQIPGGMLSNLVAQLKEQNALDRYEEVLEEMPRVRKDMGYPPLVTPTSQIVGIQAVMNVLSGERYSMVTNEVKDYFRGLYGRPPAPLNEEVARKVIGDEKPIDCRPADILKPQYDECRRKGEEMGIIEKEEDILTLALYPAIAPKFLRGEIEEEPLEPPAEEMAPTGEVPTVFHVEVDGDEFEVKVVPTGYMTIEEAEPEPVDVEGAVKSTMQGMVVKLKVSEGDQVNAGDVVAVVEAMKMENDIQTPHGGVVEKIYTAEGEKVETGDIIMVIK

SEQ ID NO: 1204 - protein, 684 aa, Methanobacterium thermoautotrophicum
MTGARNWLNKPLIFFKFNNHHTASPGDKMVKYVAFFEELGKDDVGIAGGKGANLGELTQAGIPVPPGFVVTAATYDKFMTDTGLQPVVMEMLENLDVNDTKELQRVSAEIKDIITSTEVPEDIQTLIIESYNALCQRIGKDDVYVAIRSSATAEDLPEASFAGQQDTFLNIRGAEDVLDYVRRCWASLFEARAIFYREENNFDHSKVYIAVVVQEMVDAEKAGVMFTVHPSTGEDRILIEGSWGLGEAVVSGSVTPDTYWVDKGTGKLLEFTVGEKNIMFTREDGRTVKKEVPPELRNKRVLSDGEIAALAEMGRRIQDHYGSPQDTEWAIMDGDVYMLQSRPITTLGEATEETEVKSREILVKGLGASPGLASGRVKIIREIHELDKIQIGDILVTVMTTPDMVPAMKRASGIITDEGGVTCHAAIVSRELGIPCVVGTGNATEVLKENQVVSIDGNRGLVYEGSVIEGEKKEAEAETVTVESPLLTVTEVKVNVSMPEAARKAAATGADGVGLLRTEHMMLTTGVHPRKFIEEGREDELVNTLAENILKVADEFYPRPVWYRTLDAPTDEFKTLEGGENEPYEHNPMLGWRGIRRELDEPEILRAEFRAIKKLHEQGYTNIGIMIPLVQHPDELRKAKMIAEEAGLKPHRDVEFGIMVETPAAALIIEDFIEEGIDFVRLEP

SEQ ID NO: 1205 - protein, 210 aa, Methanobacterium thermoautotrophicum
MNDKNTLKGTTTVGITCKDGVVFATERRASMGNLIAHKATDKIFKIDEHIAATIAGSVADAQSLMKYLKAEAALYRMRNSEKISIEAAAALAANILHSSRFYPFIVQTLLGGVDENGAKIYSLDPSGGMIPDKFVSTGSGSPVAYGVLEDRYSDELYVDEAVDVAIRAIKSAMERDTYSGNGILVATVTEEEGFRMLSEEEIQKRIENLN

SEQ ID NO: 1206 - protein, 341 aa, Methanobacterium thermoautotrophicum
MRISPEEEVKIIKEILTAMNVPEESSDIVADVTLDADLKGFSSHGIGRFPQYVDGLRHGTIRADGDITIERETESTALINGNHIFGHVVAYRAMELAIEKARNTGVGLVGVHDSNHFGVAGYYSDMAVMNDMIGVVIANTEPAVAPIGGRKPILGTNPVAIGIPSNRYYVSVDMATSASARGKLLEAARKGESIPENVALDAEGKPTTDPEMALKGSILPFGGHKGYALSFMIEILAGPLVGAAFGTAVTGTANPEEMCTKGDLMMAIDPSKMVDPDEFRAQVDEFIEEVKSSGDVLIPGDIESMNIKRRRAEGIELDEKLLERILGIARELDINLEIKEL

SEQ ID NO: 1207 - protein, 303 aa, Methanobacterium thermoautotrophicum
MFFMLETSICNIELRNPTILAAGVMGSMASSLNRIYRGGAGAVVTKSFSLRPNPGYRNPTTVEVTGGVINAIGLSNPGVEAFREELKLVDEEVPLIASVYGASPEEFASAAASVEEYADMIELNVSCPHAMAGCGASIGQDPELTFRVVSAVKDAVDVPISTKLTPNVTDIVEIAGSAEEAGSDALTLINSLGPGMKIDIKTARPILSNAFGGMSGPAIKPVAVRCVYDVYRSVDIPIMGVGGVRDFQDAVEFLFAGARAVQVGTAIMYDGPEVFMKICRGLEAFMMAEGFSSVDEMVGLAHD

SEQ ID NO: 1208 - protein, 423 aa, Methanobacterium thermoautotrophicum
MNIGLIGFGTIGAGVVEIFNTNPDIIMKKTGMELRLRRVVDLDIETDRGVEIDPGILSTDADDILEDPEIDIVIELIGGYEPARSFILKAIENGKHVVTANKALLARHWDEIMDAAREHGVRVAFEASVGGGIPVLRALNESLAANRIESIYGIINGTANYILTRMASEGMEFDDVLREAQRLGYAERDPTFDIEGHDTAQKLIILTLLGFGVHVPEDELHVEGISSIRRDDIEYATAELGCSVKLLATARLNDGELELGVTPTLVPHHHLLSSVNGVFNGIYITGDFTGPVMFYGKGAGRRATASAVVADCMDIAVNPEGSMPTGPGIRVVESVRDFSRTSSRYYIRLDAVDRAGVLHEIAGAFSRHGISIESVTQKGAHEGETVPIYIVTHEASEGAIQGALSEISEIRWVRGEPLRLRIL

SEQ ID NO: 1209 - protein, 399 aa, Methanobacterium thermoautotrophicum
MKVIAVDKVVLAFSGGLDTSVCIKLLEEKYNMEVITACVDVGQPRDEIERPAMVAKELGNYRHYTVDARREFAEDYIFPAIKANAVYEGYPLSTALARPLIAKKIVEVAEKEGASAIAHGCTGKGNDQFRFEAVIRSTTDLDVIAPIRDLNLTRTEEMEYARSCGIPLPSDKLYSIDENLWGRAIEGDILEDPMVEPPEDAFEWTKPIHETPEDPEVIEIGFHGGVPVALNGEELEPVELIGLANEVAGKHGIGRVDIMEDRIIGMKSREIYETPAAFLLLEAHRGLEQLTLTRSELRFADIISSTYAELVYSGLWHDPLREDLDMAVNHMQRRVTGTVRVKLHRGSMRVIGRESPYSLYSEEIVSFEDKTLDQREMAGMVKNYALQAAIYSRVCRKEN

SEQ ID NO: 1210 - protein, 96 aa, Methanobacterium thermoautotrophicum
MVDEGILREVYRVLEDRRDRPIDSYTSRLMRDDDKMAEDKILEKIGEEAAEVIIASKNDENLVEEAADLIFHTLLLLVYKGVPLDSLLEEFAARRK

SEQ ID NO: 1211 - protein, 596 aa, Methanobacterium thermoautotrophicum
MAKKEKILGIDLGTSNSAAAVLIGGKPTIIPSAEGASQYGKSFPSCVAFTEDGQMLVGEPARRQAVTNPENTITAIKRSMGTDRKVKVHGKEYTPQEISAFILQKIKKDAEAFLGEEIKKAVITVPAYFDDNQRTATKDAGTIAGLDVVRLVNEPTAASLAYGLDKEDEDMVIMVFDLGGGTLDVTIMEFGGGVFEVRSTSGDTQLGGTDMDNAIMNYLAEEFKMETGIDLMEDDQAVQRLREAAEKAKIELSTTLTTEVNLPYITVAQDGPKHLIKTITRAKLEELVDPIVQKCAGPMEQALRDAGMTREDVDKIILVGGPTRMPIVQKFVEDFIGKPVERGIDPMECVAMGAAIQGGVLAGEIKDLVLLDVTPLSLGIETLGGVFTKLIERNTTIPTRKSQIFSTAADNQTSVDIHVLQGERPMAADNTSLGRFQLVGIPPAPRGVPQIEVTFDIDANGILNVSAKDLGTGKEQAITITAPNKLSEEEIKQKIEEAKKHAEEDRRKQEEIEIRNNADSMIYTAEKTLDELGDKVPAEKKEEVEKQVRELRELIAGDDIQAIKSKTEELTKTVQEIGVSYIPAGSTATSSTAAGR

SEQ ID NO: 1212 - protein, 376 aa, Methanobacterium thermoautotrophicum
MAKRDYYEILGVDRGADKKEIKKAYRRLARKYHPDVSDDPDAAEKFKEISEAYAVLSDDEKRARYDRFGHAGMDGFSQEDIFNNINFEDIFSGLGFDIGNIFDMFGFGGGRRHGPQRGADISYTLDISLEDAYNGLETDIRVPHTKKCPVCHGSRAEPGTGTRTCQTCGGSGQVRQVRNTILGQMMNITTCPDCQGEGTVVEKPCSNCNGKGVVRKTSTIHVKVPAGVETGSRLRVPGEGEMGLRGGEPGDLYVVIKVKPHSIFRREGANLYTEKPISFVQAALGDTVEVPTLDRPVKLRIPAGTQSGTTFRVKGHGMPHLKWNGYGNLYVKVKVVTPRKLSPRQKELLREFASISGDEIHEDKGFFDKVKDAIIH

SEQ ID NO: 1213 - protein, 244 aa, Methanobacterium thermoautotrophicum
MFKAELNDPNILRTSFDAISSIVDEVQIQLSAEGLRLDALDRSHITYVHLELKAELFDEYVCDEPERINVDTEELMKVLKRAKANDRVILSTDEGNLIIQFEGEAVRTFKIRLIDIEYETPSPPEIEYENEFEVPFQLLKDSIADIDIFSDKITFRVDEDRFIASAEGEFGDAQIEYLHGERIDKPARSIYSLDKIKEMLKADKFSETAIINLGDDMPLKLTLKMASKEGELSFLLAPRIEAEE

SEQ ID NO: 1214 - protein, 136 aa, Methanobacterium thermoautotrophicum
MTFSHNQNYYKCPCRKTLEIKKVSVSLTRRKKMEFCPKCGAVMFPSEGKFKCQCGYEKDITDKLKDKYRVSEEVEAKETIIFTGDDVNTLPTTRVECPKCGNMEAFWWLQQTRRADESETRFFRCTRCKHTWREYD

SEQ ID NO: 1215 - protein, 196 aa, Methanobacterium thermoautotrophicum
MIEMLDKLKESLRNSPVIKKGEYDYFVNPVTDGIPLTEPELLEEVAEEIVRRFRPEADKIICIEAMGIHHATVLSLKTGIPFVVVRKRRYGLPGEVAVHQMTGYSEGELYINGVDSGDRVVVIDDVVSTGGTLLAVLEALREMDVDVRDVITVIDKGEGSRVVRERTGFTVKSLVKVDVIDGRVKVEDIPAGGPHD

SEQ ID NO: 1216 - protein, 289 aa, Methanobacterium thermoautotrophicum
MTRMILFSKMHGLGNDYVVIDESAQECIPEDKKPEFVREVCTRGFSVGADGVIFVQPASGEGDIRFRIFNADGSEAEMCGNGIRCFSKFVYDNAIVRKRRLEVETLAGIKTVELEVEDGAVVSSRVDMGTATFKTDQIPMDVEEYEFIDRFLPVEGEDIKLTALSVGNPHAIIFVDDAEGVDLDRLGPAIENHPLFPERINVHFVEVVSPSEIIMVTWERGAGPTMACGTGATASVIAGVKLEKLDDSVLVHLPGGELKIDVYQDGTELGAYMEGDAVMVFDGILLRDP

SEQ ID NO: 1217 - protein, 428 aa, Methanobacterium thermoautotrophicum
MFPDIEVNDKGHLLIGGADAVELADEYGTPLYVIDEMRIRENYRRLYRAFSGEYSRFQVFYACKANTNLAVMRILEEEGSGIDAVSPGEIYTALMAGFDPDRILYTGNNVRDDELQFALDSGVRINVDSRSQLLRLSEIAPEGLRISFRVNPLVGAGHHEHCITGGEMSKFGVMEREAPEVYRMAMDLGFEPVGIHAHIGSGILDPEPFMLAVETLMDIAGRVHEATGVEFEFIDFGGGLGIPYTPEEEPLDIDEFASKITGLFKDKLSEYGLGRPMMCLEPGRYIVGDASYLLTRVNTIKESYRKFAGVDAGFNTLLRPAMYGSYHHILVAERPLDEPSEKMDVAGNVCESGDLFARDRQLPEINEGDVLAIMNAGAYSFSMSSQYNSRPRPAEVLVREGKVDVVRERETFSDLLRGQNVPARLLKR

SEQ ID NO: 1218 - protein, 390 aa, Methanobacterium thermoautotrophicum
MDSEEIIELERKFIMQTYTRQPIVLSHGKGATVWDIEGNSYIDCFAGVAVNSIGHAHPKVALAICHQAQRLIHSSNIYYTREQVELAKLLTAISPHDRVFFANSGAEANEGAIKLARKFTGKSEIIAAENSFHGRTLATVTATGQKKYSEPFRPLPEGFKHVPYGDIGAMADAVGDETAAIILEPVQGEGGVIIPPEGYLKDVQELARQNDVLLILDEVQTGFGRTGAMFASQLFGVEPDITTVAKAMGGGYPIGAVLANERVAMAFEPGDHGSTFGGNPWGCAAAIATIEVLMDEKLPERAAKMGSYFLGRLRQVLHGCDAVRDIRGVGLMIGIEIDGECAGVVDAAREMGVLINCTAGKVIRIVPPLVIKKEEIDAAVDVLGHVISDL

SEQ ID NO: 1219 - protein, 312 aa, Methanobacterium thermoautotrophicum
MRIPVGDFDLEMTQRSGQTSQPPWREVEGAFRELLIIEGVPCPVEVRNEAGVLRVRPYVDVPQKTLREKIEYIFDLKFDIEDFYTFLEDKNLSYTLDSSRGLRLFLAKDPFECVISSIASANCSVVRWTRSIEDIRRLWGQANTFNGETFHTFPSPHVLTGVAEGSLEDLQRAEDNLPSDFSFNDLRSCGVGYRAPYIRETSRILAEEMDIRRIDGMDYDDARELLLELSGVGPKVADCILLYGFRKTEAFPVDVWIRRIMNHIHPGRNFNDRSMVEFARREYGEMADYVQLYLFNHARRSGLLDRLRQGTG

SEQ ID NO: 1220 - protein, 301 aa, Methanobacterium thermoautotrophicum
MSSGLFQMRRNMFYVDSDTSELLMAIEMLAKRIIPCLDCDLQVPNGRVVKGVEFKQIRYAGDPVELATRYYEDGADEIVFLDITASHERRETMTHVIEATTENVFVPICVGGGIRKPEDYFKMLKAGADKCSTNTAAIKNPELINEASDLVGSQACVVAIDAKRRYIENPRESDERFIIEVDDGYCWYECSIYGGREFTGIDAVKWAMECQDRGAGEILLTSMDRDGTKMGYDIPLTRTMSENLDIPVIASGGVGEPEHIYEAFTDGKADAALAASIFHFNEYPVPAVKEYLRSRGVPIRL

SEQ ID NO: 1221 - protein, 1329 aa, Methanobacterium thermoautotrophicum
MRTSVIPVILLMTIMLAGGVSAADNSSNVTEGAIQQNSSHYSILIITGSTSSTKAIVEGYKLAGRDGYRFNLSMFTNDELLRNDPQIDMAALEAGRKADVILIQMISSPNTLAKVNPILNVTGASKIIAIGTGNTFKDDPRVGADNATVKYIWDQGGPENFRRMMLLLLRDAGMQLKNEENVTAIPAVKSFVYHPDAGEQFTAWDRYYSWYVQSGHYRAGKPWVGIITFDTYYRGSDMRMHTAILESLERKGYNVILGFAADTATKRNLIENFFLDGNRTPRISGLITCMGFNLYSGDPLNSTAILTELDLPAIAAVYASNLRAWNESISGLSSEVYWQIALPEIDGRIEPVMIGGGVEETDPQTGLRYTYYVPIPERIERLTERLINWIKLRELPNAEKKIALIYYNIGGGKDGISASYLNVPESISNILRALRSAGYNVEEKSTAEVINILLGPGLNVGSWAPGELEKVVRAGAVTVPVSEYLNWFSLLPETLRNNITATWGPAPGNVMVYNGSIVIPGVMLGNVFLGPQPMRGFGEDAADLIHSTTLPPHHQYLAFYLWLQKNFNAVIHLGTHGTLEWLPGKSVGLSSLDWPDVMIGDLPHIYPYIVNNPGEGTQAKRRGYAVLINHNIPPMVVSELYGDLSELEHKINLYHTSEDPQRKLIIAEEIRNLTVKLDLHRELNIDLNASFEEALDRIEHRLDELSATLIPYGLHVFGEPLSGELLDAMVEAIVSFDPASRNNTEFRNAVREKLATDQEITNLLRALEGRFVEPGRGADPIRIPDLLPTGRNSYSFDPRLAPDRAAWEIGKKMADDLIADYLSRNGRYPESVGVVLWAIETMRTSGQTIAMVLRLIGAEPVWDKSGRFTGISVTPLEVLGRPRIDVLVTISGLFRDTFAYSIDRMDEAIRLVMKLDEPVEGNYLRKHYLADLANYTARGLQAAETLAGARIFGSAPGSYGTGLPEVVESTAKWDNQSQLLETYLNHMGFIYGKDIYAIDAKEVFMKQLSNVDATVQVRDSVYGVLDNDDVYQYLGGLTMAARTISGRNVASYIANTRFTPRMETLADFIAAELRTRTYNPKWIEGMLNQGFSGAHQISKEIGHLFGWSAVTPDLVQDWMWQKVAETYVFDPQVSSRFKSLQPYSYASTVAWLLEASRRGLWSTDSATLQRLADEYIAAVNEYGVVCCHHTCANMVFNSWVVKLSSLNQAALRKFAAAMAAATGKSIDVPGSGDSQPGSVNGDGIGETGEPSSGSAGNAGGASGSSSDEALESSEVSENSGASEGSGKAYEVAASTNSTSSSTQTPIYAIIGVISLVCLLGVGYFFQGRY

SEQ ID NO: 1222 - protein, 319 aa, Methanobacterium thermoautotrophicum
MDEHDISTRDPCGPGGSMIEVESVSKSFGRIRALDNLSFSVAEGELMGIIGHNGAGKTTAIRIIAGILHPDSGTVRVGGHDVTEDPLSVKSMIGYLPEEPNLYERFRAGDLLRYFGELYGVPRDVLDDRIAELLELVGMTDRAMDPINTFSKGLRQRIGIARALIHDPPIIIFDEPTMGLDPATAFSIREFIRDLKGSKTMILCTHYMEEAEYLCDRVAIINQGRILDIGTPDELKSKIRGDLVLEVKVRDISSVGEGDLMMIPGVKSVEVDGSTLRVSLENRGAISGVIMELGANVSGVNTREATLNDVFIESLRGSG

SEQ ID NO: 1223 - protein, 311 aa, Methanobacterium thermoautotrophicum
MVELEDLPNVGAKTAQKLRDAGFGDMMRLATATAKELSVKAEIGEGVAEKVIEAARRAEKIDFETAFDVMERRKDVGRITTGSKALDELIGGGIETQAITEVFGEFGSGKSQLSHELAVTVQLPEERGGLDAEAVFIDTENTFRPERIEQIANAFELDLEEVLNKIHIARAFNSSHQILMAEKVNELIQEGKNIRLVIVDSLTAHFRAEYVGREALATRQQKLNQHLHTLQNIANTYNAAVFVTNQVQARPDAFFGSPTKAIGGHVLGHAATYRIWLKKGLAGKRIARLVDSPHLPEGECVFKITTAGIVD

SEQ ID NO: 1224 - protein, 419 aa, Methanobacterium thermoautotrophicum
MSMTVSEKILARASGKDRVEAGEIVMADIDVAMTHDLTGPLSVESFRAIGEDRVWDPEKIVVIFDHQVPADSIEAAQNHMIMRDFVEEQGIRNFYDVREGVCHQVLPEKGHVVPGEVVVGTDSHTCTHGALGAFATGIGSTDMAMVFATGKLWFRVPETLRFDVRGKLREHVYAKDVILNIIGRVGADGATYMACEFAGETVAEMSVSDRMVLSNMAIEMGGKTGIVEPDEKTLNYVRRRSGKPWRVFKTDPDAPSLSVMEVDVSDLEPQVACPHNVDNVKPVTEVEGTEIDQVFLGSCTNGRLSDLRDAAAILKNRKVSDSVRMLVIPASREVYRRALDEGLIEIFVDAGALVCNPCCGPCLGGHVGLVGPGEVSLSTSNRNFRGRQGSPEAEVYLSSAAVAAASAVKGSITHPGSLK

SEQ ID NO: 1225 - protein, 329 aa, Methanobacterium thermoautotrophicum
MKSMKIAVIPGDGIGVEVMEAALHILNTLDLDLEFIHADAGDACLKRTGTALPEETLEAVGEARATLFGAAGESAADVIVRLRREFDLFANLRPVKSLPGVPCLYPDLDFVIVRENTEDLYVGDEEYTPEGAVAKRIITRTASRRISQFAFQYAQKEGMQKVTAVHKANVLKKTDGIFRDEFYKVASEYPQMEATDYYVDATAMYLITQPQEFQTIVTTNLFGDILSDEAAGLIGGLGLAPSANIGEKNALFEPVHGSAPQIAGKNIANPTAMILTTTLMLKHLNKKQEAQKIEKALQKTLAEGLVTPDLGGKLGTMEMAAEIARHLED

SEQ ID NO: 1226 - protein, 312 aa, Methanobacterium thermoautotrophicum
MFENVISIKDFKREDIEFILREAEKMEPFASGEKSSSALRGKILGMMFYEPSTRTRLSFETAMKRLGGDVVGFADTGATSAVKGESLADTAMMLSAYSDAIVIRHNLEGAARYISDVVDVPVINAGDGAGQHPTQTLLDLYTMKRFFGRIGSLRVALVGDLKYGRTVHSLAYALAVFGASMSFVSPPVLRMPDNIIHDLRRAGVEVKETERLDDVIDEVDVLYVTRIQKERFPDPEEYSRIRGAYHIDGSTVADRDLIVMHPLPRIDEISPEVDSLPQAMYFRQAFYGVPVRMALLRLLISERRGSENQKIV

SEQ ID NO: 1227 - protein, 738 aa, Methanobacterium thermoautotrophicum
MARYIEHPLIKPEKIEARTYQQLLAADVIRKGNSMIVAPTALGKTVVAVLVAAERLRKYRGSKVLILSPSKPLAIQHEESFREFMLATCTSLTGSIKPEERKERWIKSQIISATPQTVESDILAGRYDLRDVSLIVFDECHRAVGSYSYVFLASNYIQNARHPLILGLTASPGADEDKIKTVCENLFMNEVVVKTEGDPDVRPYLKPIKIEWVKVRMTPELEDIRELLRKVLKNRLKMLKNLGVIDTISVGKKDLLKARGRVQNRIARSTSPPRACYRAISLLASCINVEHALELLETQGIRPLHQYLLRLKEKKTKAAKGLLADPDFTRAMHLTRRAMMSGVEHPKLDRLMEILKRELKGDEARIIVFTQFRDTLEEIYQRCKREGINAVKFYGQNSRSGEKGLTQKQQRDIIKSFRMGNHDVLLSTSVAEEGIDIPSVDLVVMYEPVPSEIRMIQRRGRTGRKRKGRMVVLITEKTRDEAYYYSSIRKERSMKENLRGGSVNVEVNPIMEPSGEGPFIYADSREVNSRVLRELKKIGVDFELKPLAVGDYQISEDTIIERKTTQDFIGSIIDKRLYKQAREMVKNFKRPVMIIEGDDLYSGFINPDAVRGALAAVAVDFGIPVIPTRSAEDTAAMIRRIAIREQREGRPDMRVRTDKKPLTLREKQLFIVESLPNIGSKYAERLLEAFGSVEGVMNASEKELRSVEGIGAKRASEIRRVIEAEFKGPDEATYQFKE

SEQ ID NO: 1228 - protein, 301 aa, Methanobacterium thermoautotrophicum
MKHLLSVCDMDNVVDLLDLADDYKEGKIREKILRGKTLAMIFEKSSTRTRVSFEVGAFQMGAQPLYLSASDLQLGRGEPIADTARTLSRYVDGIMIRAISHSDVVELAGEASVPVINGLTDLEHPCQALADMQTIREKLGGFDGRLVFVGDGNNVCHSLLLITATLGMDMDVACPPGYEPDPGIREMAGKIADETGSRIRVIHDPSEAVRGADVVYTDVWVSMGYEDEAEDRLEVFRPYQVNMELMELAAPEAIFMHCLPAVRGQETTAEVIDGPHSVVWDQAENRLHAQKAIMHWLMGDI

SEQ ID NO: 1229 - protein, 464 aa, Pyrococcus abyssi
MIDMEVGIVGGGLAGLVAAISLVEKGVDVSIIGPKSKDSNSYLAQAGIAFPLVEGDSIRIHVLDTIRAGKYINDEEVVWNVISKSTEAYSFLVSHGVTFTGNELEGGHSHPRVFTIKSETGKHVIPILEKHARELGVNFVRGFVEEIGIKNGKLAGVFLNGELLKFDAVVVATGGFSGLYRFTAGVKENIGLLIGDLALKGVPLRDMEFVQFHPTGFIGRRTYLITEAVRGAGAKLVTGDGERFVNELETRDVVARAIYLKMLEGKGVFLDARGIEDFKDRFPYVYSVLKKEGIDPGKDLIPVTPVAHYTMGGISVDIFYRTRIRGLYAIGEAASNGFHGANRLASNSLLECVVSGLEVARTILREEPKRGANDAPYNFDELGDVDSIREIMWNHAGIVRDKSSLLEGLKKLEGVEADQRLKVVAKAVLTLALEREESRGSHYRRDFPFMRKEFERPSFFHLNV

SEQ ID NO: 1230 - protein, 550 aa, Pyrococcus abyssi
MAQLAGQPILILPEGTQRYVGRDAQRMNILAARIIAETVRTTLGPKGMDKMLVDSLGDIVITNDGATILDEMDIQHPAAKMMVEVAKTQDKEAGDGTTTAVVIAGELLKKAEELLDQNIHPSIVIKGYMLAAEKAQEILDSIAKEVKPDDEEVLLKAAMTAITGKAAEEEREYLAKLAVEAVKLVAEEKDGKFKVDIDNIKFEKKEGGAVSDTKLIRGVVIDKEVVHPGMPKRVEKAKIALINDALEVKETETDAEIRITSPEQLQAFLEQEEKMLKEMVDKIKEVGANVVFVQKGIDDLAQHYLAKYGILAVRRVKKSDMEKLAKATGAKIVTNIRDLTPEDLGEAELVEERKVAGENMIFVEGCKNPKAVTILIRGGTEHVVDEVERALEDAVKVVKDILEDGKIIAGGGAAEIELSIKLDEYAKEVGGKEQLAIEAFAEALKVIPRTLAENAGLDPIETLVKVIAAHKEKGPTIGIDVYEGEPADMMERGVIEPVRVKKQAIKSASEAAIMILRIDDVIAAQKLEKEKEGEKGGGGSEDFSSSSDLD

SEQ ID NO: 1231 - protein, 279 aa, Pyrococcus abyssi
MVWKMAKVSDFKRIGDDKVTAIGMGTWGIGGKEFPDYSKDRESIEALRYGLELGINLIDTAEFYGAGHSEELVGKAIEGFNREEIFIVSKVWPTHFGYESAKKAARASAKRLGTYIDLYLLHWPGDTWKKIEETLHALEELVDEGLIRYIGVSNFDLELLRRSQEAMRKYEIVVNQVKYSLMDRTPEETGLLDYMKREGITLMAYTPLEKGILARNKCLAEIGKRYGKTSAQVALNYLIWEENVVAIPKASNKDHIKENFGAMGWRLSREDRERAKLCV

SEQ ID NO: 1232 - protein, 329 aa, Pyrococcus abyssi
MLKPVRFSTHHGGARRNEIKLIDFSASVNPYPPEWVDEMFKRAREISFSYPYYEELEDELSELLNEEITITAGITEGLYLLGILALRGRKVIIPRHTYGEYERVARIFNAKIIKGSNEPEKLAELVENNSVVFFCNPNNPDGRYYTPRELKPLIDAVEDRKALLVLDEAFIDFVKDAKSPEGENIVKLRTFTKSYGLPGIRVGYIIGFRDAFRSVRMPWSIGSTGVAFLEFLIEDNFEHLRKTMPLIWQEKERIEKALNVKSDANFFIKYVGDAKKAVEELKKRGILVRDCTSFGLPGYIRFSVRRAEENERLVQALKDLSPELLAPVH

SEQ ID NO: 1233 - protein, 330 aa, Pyrococcus abyssi
MHPKVDALLSRFPRITLIPWETPIQYLPRISRELGVDVYVKRDDLTGLGIGGNKIRKLEFLLGDALSRGCDTVITIGAVHSNHAFVTALAAKKLGLGAVLILRGEEVLKGNYLLDKLMGIETRIYEADNSWELMKVAEEVAEELKGEGKKPYIIPPGGASPVGTLGYIRGVGELYTQVKKLGLRIDTVVDAVGSGGTYAGLLLGSAIVNAEWSVVGIDVSSATEKAKERVKNLVEKTKELLGINVKVQEPRIYDYGFGAYGKIVKEVAKLIKSVGTMEGLLLDPVYTGKAFYGLMDLAKKGDLGESVLFIHTGGLPGIFHYGEEMLELLV

SEQ ID NO: 1234 - protein, 437 aa, Pyrococcus abyssi
MKVLLLGFEFLPVKVGGLAEALTAISEALASLGHEVLVFTPSHGRFQGEEIGKIRVFGEEVQVKVSYEERGNLRIYRIGGGLLDSEDVYGPGWDGLIRKAVTFGRASVLLLNDLLREEPLPDVVHFHDWHTVFAGALIKKYFKIPAVFTIHRLNKSKLPAFYFHEAGLSELAPYPDIDPEHTGGYIADIVTTVSRGYLIDEWGFFRNFEGKITYVFNGIDCSFWNESYLTGSRDERKKSLLSKFGMDEGVTFMFIGRFDRGQKGVDVLLKAIEILSSKKEFQEMRFIIIGKGDPELEGWARSLEEKHGNVKVITEMLSREFVRELYGSVDFVIIPSYFEPFGLVALEAMCLGAIPIASAVGGLRDIITNETGILVKAGDPGELANAILKALELSRSDLSKFRENCKKRAMSFSWEKSAERYVKAYTGSIDRAFDFIL

SEQ ID NO: 1235 - protein, 283 aa, Pyrococcus abyssi
MLLYTYRSFDMELPTVSIEEADYVIMGLPFDGTTSYKPGARFGPVLIRQATLNLESYILDYDVDIAELKIADAGDVALPVNVEDAIKVGIEAIKELRSVNRKALPIFLGGEHSMTYPPVAVLKPKSYVVFDAHLDLRDSYQGSRFNHACVARRIHENGVEVAIFGVRSGTREEVKYATENGIEWVHARDYNFDAFVDLVASLSEPIYVSIDIDVFDIPLVPETGTPEPGGLRFWDVVNALEWLTERKNVVGFDIMEVSGDKLGNVTSITAAKLLFHILGMSSR

SEQ ID NO: 1236 - protein, 819 aa, Pyrococcus abyssi
MAYRFIKWFEELRKEDVPLVGGKGANLGEMTNAGIPVPPGFCVTAEAYKYFVENVKISKEDVKRILGEKANKGTIAEVLAQAPDEPRPLQEWIMDIINRTNVDDSKQLQENTAVIRELIKSLDMPAEIADEIKQAYKELSQRFGKDEIYVAVRSSATAEDLPEASFAGQQETYLDVLGADDVIDKVKRCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGKGTVTVKVAEYLGPEWVEKQVLTDEQIIEVAKMGQKIEEHYGWPQDIEWAYDKDDGKLYIVQSRPVTTLKETTTEEVEEVEEAEVILKGLGASPGIGAGRVVVIFDASEIDKVKEGDVLVTTMTNPDMVPAMKRAAAIITDEGGRTSHAAIVSRELGIPAVVGTKEATKKLKTGDYVTVDGTRGLVYKGIVKSLVEKKKKEEAAAAPGAAVAAAPLVTGTLVKVNVSMPEVAERAAATGADGVGLLRAEHMILSIGQHPVKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIRKAKEIARSVGLEPHKDVAWGIMIEVPAAAIIIEDLIKEGIDFVSFGTNDLTQYTLAIDRDNERVAKLYDETHPAVLKLIKHVIKVCKRYGVETSICGQAGSDPKMARILVRLGIDSISANPDAVQLIRQVVAQEERKLMLEAARKRLFEEEEEEEEFLF

SEQ ID NO: 1237 - protein, 1437 aa, Pyrococcus abyssi
MRDMEEVREVKVLEKPWVEKYRPQKLEEIVGQEHIVKRLKHYVKTGSMPHLLFAGPPGVGKCLTGDAKVIANGELTTIGELVERISNGKLGPTPVRGLTVLGIDEDGKLVELPVEYVYKDKTSELVKIRTRLGRELKVTPYHPLLVNRRNGKIEWVKAEELKPGDRLAIPSFLPAMLNDNPLAEWLGYFFGNGYTDSEERVVFESKSKELRKRFMELTRKLFQDAEIKEDSGKVYVSSSEVKRLVKSLNKDSIPEQAWKGLRSFLRAYFDCNAEIKDKIIVSTAGKEIAEQISYALAGLGIVAEVDDKGSVIISDPENVSRFLDEIGFSVEEKKEEAKALIKKSTLNLGIYVDKELISYVREKLKLSFYENETMWSPEKAREIAWKLMKEIYYRLDELERFKKALSKSVIIDWSEVEKKKEEISEKTGISVNEILEYAKGKRKPSLEEYVKIAKALGVELKETLEAIFTFGKKYLGYVISDEIETLEEVRKEELKRLKELLNDEKLKKGVAYLIFLAQNELLWDEIIEVEKLKGDFVIYDLHVPKYHNFIGGNLPTVLHNTTAALALARELFGENWRHNFLELNASDERGINVIREKVKEFARTKPIGGASFKIIFLDEADALTQDAQQALRRTMEMFSSNVRFILSCVTGDTKVYTPDEREVKIRDFMNYFENGLIKEVSNRIGRDTVIAAVSFNSRIVGHPVYRLTLESGRIIEATGDHMFLTPEGWKQTYDIKEGSEVLVKPTLEGTPYEPDPRVIIDIKEFYNFLEKIEREHNLKPLKEAKTFRELITKDKEKILRRALELRAEIENGLTKREAEILELISADTWIPRAELEKKARISRTRLNQILQRLEKKGYIERRIEGRKQFVRKIRNGKILRNAMDIKRILEEEFGIKISYTTVKKLLSGNVDGMAYRILKEVKEKWLVRYDDEKAGILARVVGFILGDGHLARNGRIWFNSSKEELEMLANDLRKLGLKPSEIIERDSSSEIQGRKVKGRIYMLYVDNAAFHALLRFWKVEVGNKTKKGYTVPEWIKKGNLFVKREFLRGLFGADGTKPCGKRYNFNGIKLEIRAKKESLERTVEFLNDVADLLREFDVDSKITVSPTKEGFIIRLIVTPNDANYLNFLTRVGYAYAKDTYARLVGEYIRIKLAYKNIILPGIAEKAIELATVTNSTYAAKVLGVSRDFVVNRLKGTQIGITRDFMTFEEFMKERVLNGYVIEKVIKKEKLGYLDVYDVTCARDHSFISNGLVSHNCNYSSKIIEPIQSRCAIFRFRPLNDEDIAKRLRYIAENEGLELTEEGLQAILYIAEGDMRRAINILQAAAALDRKITDENVFLVASRARPEDIREMMLLALKGNFLKAREKLREILLKQGLSGEDVLVQMHREVFNLPIDEPMKVYLADKIGEYNFRLVEGANEMIQLEALLAQFTLIGKKK

SEQ ID NO: 1238 - protein, 239 aa, Pyrococcus abyssi
MRASKYEAKGMTLTTGVKGLDELLGGGVARGVILQVYGPFATGKTTFAMQVGLLNEGKVAYVDTEGGFSPERLKQMAESRGLDPEKALSKFIIFEPMDLNEQRRIISKLKTVVSDKFSLVVVDSLTAHYRAEGSRDHVELAKQLQVLQWLARKKNVAVIVVNQVYYDSNTNTLRPIAEHTLGYRTKDILRFEKFRVGVRLAVLERHRFRPEGGIVYFKITDKGIEDVLKAKPENGEENI

SEQ ID NO: 1239 - protein, 466 aa, Pyrococcus abyssi
MINMTKWDEIKKYTSKKVDENLKIVELDEEYLPRAIGFKYYPLVIERAKGSRVWDKDGNEYIDFLTSAAVFNVGHAHPKVVEAIKEQVDKFLNYTIGYLYTEPPVRLAELLSEMTPGDFEKKVTFGFSGSDAVDSSIKASRAYTKKVHIISFRHSYHGMTYGALSVTGIVDEKVKSIVQPMSNVHIVDYPDPYRNPWNIDGYENPSELANRALDEVEKKIKELNGDVAGIILEPIQGDAGVVIPPLEFIKGLKKLTDEYGMVFIDEEVQTGMGRTGKWWAIEHFEVVPDLLVSAKALGGGMPISAVVGRAEIMDSVPSPLFVFTHVGHAVNASAAIATIKVIKEEKLVERAKELGDYALKRFRELQEEYPIIGDVRGKGLMIGVDIVKEGTKDPNRELAQKICWRAWEKGLIIITFGKHGNVLRIAPPLTISKEDFDRGIEIIEEAIKDAINGKVPDDVIKFLRAW

SEQ ID NO: 1240 - protein, 393 aa, Pyrococcus abyssi
MKYDVVVVGSGVAGPTVARDVAKAGFSVLLVDKKAAIGTPKQCAEGITIEVFKEFDIPYDKRFINREIYGAKIYSPSGYTAELRYKHVSGVILERKVFDKMLAYYAAKAGAEVLARTEVVDVIRRNGKIVGVRAKHEGEPLEIEAKVIVAADGVESTIARKAGINTYAPPHEFDSGYEYEMLIEGYDPDLIHLFFGNEVAPRGYVWIFPKDEDRANVGIGIASDHPQTAKYYLDKWLKENNIPMRKILEVNVGLVPVGGFVKELVKDNVLVVGDAARQVNPVHGGGMKEAMKAASIAAKWIIKALEEENLELLKNYSEEWWRTEGPRMEKLLKLRKAMEKLTDEDLDVFVQLVSGTDLEKLAGGNYLEVVKALMKHPKVLMSRRRLEILKALL

SEQ ID NO: 1241 - protein, 464 aa, Pyrococcus horikoshii
MMEMRVGIVGGGLAGLTAAIALAEKGFDVSIIGPRSTDSNSYLAQAGIALPLLEGDSIRIHVLDTIKAGKYINDEEIVWNVISKSSEAHDFLTSHGVTFTGNELEGGHSYPRIFTIKSETGKHIIPILEKHARELDVNFIRGFVEEIGINNGKLAGVFLQGELLKFDAVVIAAGGFSGLYRFTAGVKNNIGLLIGDVALKGVPLRDMEFVQFHPTGFIGKRTYLITEAVRGAGAKLVTGDGERFVNELETRDIVARAIYMKMLEGKGVFLDARGIENFKDRFPYIYSVLRGEGINPEKDLIPITPVAHYTIGGISVDAFYRTRIKGLYAIGESACNGFHGANRLASNSLLECVVSGLEVARTISREKPKREVNDAPYSFNELGDVDSIREVLWNHAGIVRDEWSLREGLRKLKEIEVDERLKLVAKAVIISALKREESRGAHYRKDYPFMRKEFEHSSFFYPNV

SEQ ID NO: 1242 - protein, 549 aa, Pyrococcus horikoshii
MAQLAGQPILILPEGTQRYVGRDAQRMNILAARIIAETVRTTLGPKGMDKMLVDSLGDIVITNDGATILDEMDIQHPAAKMMVEVAKTQDKEAGDGTTTAVVIAGELLKKAEELLDQNIHPSIIIKGYTLASQKAQEILDSIAKEVKPDDEEVLLKAAMTAITGKAAEEEREYLAKLAVEAVKLVAEEKDGKLKVDIDNIKLEKKEGGAVRDTRLIRGVVIDKEVVHPGMPKRIENAKIALINDALEVKETETDAEIRITSPEQLQAFLEQEEKMLKEMVDKIKEVGANVVFVQKGIDDLAQHYLAKYGILAVRRVKKSDMEKLAKATGAKIVTNIRDLTPEDLGEAELVEERKVAGENMIFVEGCKNPKAVTILIRGGTEHVVDEVERALEDAIKVVKDILEDGKIIAGGGASEIELSIKLDEYAKEVGGKEQLAIEAFAEALKVIPRTLAENAGLDPIETLVKVIAAHKEKGQTIGIDVYEGEPADMMERGVIEPVRVKKQAIKSASEAAIMILRIDDVIAASKLEKEKEGEKGGGSEEFSGSSDLD

SEQ ID NO: 1243 - protein, 273 aa, Pyrococcus horikoshii
MRDVKLIGSDEVTAIGMGTWGIGGYEVPDYSRDRESIEVLRYGLELGINLIDTAEFYGAGHSEELVGKAIEGFNREEIFIISKVWPSHFGYEKAKKAAKASAKRLGTYIDLYLLHWPGDSWGKIEETLHALEDLVDEGLIRYIGVSNFDLELLKRSQEAMRRYEIVANEVKYSIRDRWPETSGLLDYMKREKIALIAYTPLEKGTLARDPCLTEIGRAYGKTAAQVALNYLIWEDNVIAIPKAGRKDHVDENFGAMGWRLSREDREKARRCFS

SEQ ID NO: 1244 - protein, 325 aa, Pyrococcus horikoshii
MKTLIEIKQTPDGIIKADKVFNKVKDKISLPNRILYLGCGSSHFLSKLLAMVTNMHGGLGIALPCSEFLYSKETYPIGEVELAVGISRSGETTEILLALEKINVKKLGITTRESSLTRMCDYSLVVPAIEESVVMTHSFTSFYFAYLQLLRYSYGLPPLNAGEISKATEKSLEYERYIREIVESFDFQNIIFLGSGLLYPVALEASLKMKEMSIFWSEAYPTFEVRHGFKAIADEKTLVVLMVEEPFEWHEKLVKEFKNQGAKVLVISNSPQDLGQDYSIELPRLSKDANPIPYLPIVQLLSYYKAVSRGLNPDNPRFLDKVVRW

SEQ ID NO: 1245 - protein, 425 aa, Pyrococcus horikoshii
MVNSMDCGRDYCVKDLSLADEGWKKIDWVSRFMPVLQHIRREFEEKKPFKGVRIAATLHLEMKTAFLLLTLKAGGAEVSAAASNPLSTQDDVVAALAKAGVKVYAIRGESKEQYYEFMHKALDIRPNIIIDDGADMISLVHKERQELLDEIWGGSEETTTGVIRLRAMERDGVLRFSVIAVNDSYMKYLFDNRYGTGQSTWDGVMRATNLLIAGKNVVVVGYGWCGRGIAMRARGLGATVIVVEVDPIKALEARMDGFLVMNMKEAAKIGDIFITATGDIKCIRREHFELMKDGAIMANAGHFDVEIWKPDLEELAVEISNPRPNVTEYKLKDGRRLYLLADGRLVNLVAADGHPAEIMDMSFALQAKAAEYIKDNHGKLEPRVYILPREIDEMVARIKLASMGIEIEELTEEQKKYLESWEHGT

SEQ ID NO: 1246 - protein, 478 aa, Pyrococcus horikoshii
MRRMKLPSHKTKIVATIGPATNSKKMIKKLIEAGMNVARINFSHGTFEEHAKIIEMVREQSQKLDRRVAILADLPGLKIRVGEIKGGYVELERGEKVTLTTKDIEGDETTIPVEYKDFPKLVSKGDVIYLSDGYIVLRVEDVKENEVEAVVISGGKLFSRKGINIPKAYLPVEAITPRDIEIMKFAIEHGVDAIGLSFVGNVYDVLKAKSFLERNGAGDTFVIAKIERPDAVRNFNEILNAADGIMIARGDLGVEMPIEQLPILQKRLIRKANMEGKPVITATQMLVSMTMEKVPTRAEVTDVANAILDGTDAVMLSEETAVGKFPIEAVEMMARIAKVTEEYRESFGITRMREFLEGTKRGTIKEAITRSIIDAICTIGIKFILTPTKTGRTARLISRFKPKQWILAFSTREKVCNNLMFSYGVYPFCMEEGFNENDIVRLIKGLGLVGSDDIVLMTEGKPIEKTVGTNSIKIFQIA

SEQ ID NO: 1247 - protein, 1108 aa, Pyrococcus horikoshii
MEREEIIERFLKFFREYAEEGEEPLYMGKIKDLLTITPKRSIVINWMHLNSYDPELAEEVIENPEECILAAEDAIQIILKEDFLREDVPKIHARFHNLPKTLMVKEVGAEHINKLIQVEGVVTRVTEIKPFVSVAVFVCKDCGHEMVVPQKPYEGFVAVKKCEQCGSKNVQLDVEKSKFVNFQMFRIQDRPESLRGGQMPRFIDGILLDDIVDTAMPGDRVIVVGILRVIQEKREKVPTFKKVIEVNHIEPISKELEELEISPEDEQKIRELAKRKDIVSAIVDSIAPAIYGYKEVKKGIALALFGGVSRTLPDGTRLRGDIHVLLVGDPGVAKCVDYDTEVLLGDGRKRKIGEIVEEAIKKAEKEGKLGRVDDGFYAPINLELYALDVRTLKVRKVKADIAWKRTTPEKMLRIRTKRGREIRVTPTHPFFTLEEGRIKTKKAYELKVGEKIATPREEAPEAEIFWDEVVEIEEYKPNNSWVYDLQVPEHHNFIANGIFVHNSQLLRYVANLAPRAIYTSGKSSSAAGLCVAPDTLINTDNGRVEIGKFVEEWMKEVGEISEEGISYAPCFRKVETFKDGKIVESPIRRVWKLRAPKKLVRIKTENGRSIALTRETKLLTINDGELSWVEAGEVKVGTYVGTVKSEKDVIPGAGKTIRDVSKLYNMEMEVKDYLTREEVRKAIEKLEEIMNPMNIKIPGVQESYEELLRKLETTNDERVRNETLILLSDVSDAHELAKEKIEKIKEIVNSEVHWEKVTEVGEVDGVEYVYDLTVEGSHNFVANGFIVHNTAAVVRDEFTGGWVLEAGALVLADGGYALIDELDKMSDRDRSVIHEALEQQTISLSKAGITATLNARTTVIAAANPKHGRFNRMKRVSEQIDLPPTLLSRFDLIFVLMDEPDEKVDSEIARHILKVRRGESEVVTPKIPHELLRKYIAYARKNIHPVISEEAMEEIEKYYVKMRRSAKKSSGDEIKPIPITARQLEALIRLSEAHARMRLSPIVTREDAREAIKLMEYTLKQIAVDEAGQLDVTILEVGQSARKLSKVERILDIVEKLERTSEKGAKIDDILEEAAKFGIEKSEAREILEKLLEKGQIYMPENGYYKTV

SEQ ID NO: 1248 - protein, 686 aa, Pyrococcus horikoshii
MILIIAEKPNVARKIAGALSERRPIKKSLFGVPYYEIFREGKKLIVASAVGHLYGLAPKRDVFGYPIFDIEWVPVYIAEKGKEYAREYIKALSVLAKRVREFIVACDYDTEGEVIGYTALKYACGVDPRVAKRMKFSALTKRDLLNAWRNLEPTINFGMANAGIARHILDWYWGVNLSRALTHAIKKASGKWVVLSTGRVQGPTLKFLVEREREIQSFVPRPYWVIKLIFEKNGQKFTANYEKDKIWEEEEGKRIVLEVKKSIPRVSNVEIKRQKRTPPHPFDLGTLQREAYSAFGFSPKKTLDIAQSLYEKGFSSYPRTESQKLPRNINFRMIIQNLAKMPQYRPYAHILLGLPELKPVEGKKEDPAHPAIYPTGEIPRPGDLTKDEEKLYDMIVRRFLAVFMEPAIRESVKVTIRAGPHKFFLSGGRTVKKGWLSVYGKYVKFEEVTLPEFFIGERIKVIQVKREKKKTKPPARYSPAAVIKKMEDLGLGTKATRAQILETLYQRGYIEGKKSIKVTPLGMKVIETLEKYVPEIISVELTREFEKKMELIMEGRLTKEEVIEEAKERLTKILEEFKKRELEIGIELAKIVVGEDEVKPLVVGKCPKCGGDLIVKYNKKTGKRFVGCSNWPKCDVTYPILQRGEIIPTNKTCCNGAPVVIIREEDGREFEICLDINCKDWKAKSH

SEQ ID NO: 1249 - protein, 348 aa, Pyrococcus horikoshii
MSEKMVAIMKTKPGYGAELVEVDVPKPGPGEVLIKVLATSICGTDLHIYEWNEWAQSRIKPPQIMGHEVAGEVVEIGPGVEGIEVGDYVSVETHIVCGKCYACRRGQYHVCQNTKIFGVDTDGVFAEYAVVPAQNIWKNPKSIPPEYATLQEPLGNAVDTVLAGPISGKSVLITGAGPLGLLGIAVAKASGAYPVIVSEPSDFRRELAKKVGADYVINPFEEDVVKEVMDITDGNGVDVFLEFSGAPKALEQGLQAVTPAGRVSLLGLYPGKVTIDFNNLIIFKALTIYGITGRHLWETWYTVSRLLQSGKLNLDPIITHKYKGFDKYEEAFELMRAGKTGKVVFMLK

SEQ ID NO: 1250 - protein, 110 aa, Pyrococcus horikoshii
MVKFCPRCGSIMIPDKKRGVFVCRKCGYEEPINPEDAKAYRRTEEIKHKPDEGVIVIEQDFSTLPTAKVTCPKCGYHEAWYWEVQTRAGDEPSTIFYKCKRCGYVWRSYE

SEQ ID NO: 1251 - protein, 249 aa, Pyrococcus horikoshii
MPFEIVFEGAKEFAQLIETASRLIDEAAFKVTEEGISMRAMDPSRVVLIDLNLPSSIFSKYEVDGEETIGVNMDHLKKVLKRGKAKDTLILRKGEENFLEISLQGTATRTFRLPLIDVEEIEVELPDLPYTAKVVVLGEVLKEAVKDASLVSDSIKFMAKENEFIMRAEGETQEVEVKLTLEDEGLLDIEVQEETKSAYGVSYLADMVKGIGKADEVTMRFGNEMPMQMEYYIRDEGRLTFLLAPRVEE

SEQ ID NO: 1252 - protein, 389 aa, Pyrococcus horikoshii
MNNKVIIVGVGMTPVGEHWRTSLRDLAVEAILKAMDDAGIDKVDSLYVGNMASGSFIEQENLGALIADWAGLGNIPAVKIEAACASGGAAVQEGVKAVLSGLEDVVLVVGVEKMTDAWPSDATRYLAYASDAEWELFHGVSFVALNALVMRYYMNTYGYTEEDLALFAVNAHANGAKNPYAMFKKPITVETVMKSPYIADPLKLFDASPVCDGAAAVIITTPEKAKELGVPKDKWVEVAGMGRAIDTINLANREDLLTLKAAKIAAEKAYKMAHVEPKDIDFFEVHDAFTIMAALSLEALGVAEKGKGAMLAKEGQIAIDGDYPIQTMGGLKARGHPVGATGVYQAVEATLQLRGEAPNGIQVPDAEVGLTQNIGGTGSNITVTIFRRV

SEQ ID NO: 1253 - protein, 840 aa, Pyrococcus horikoshii
MILGRSEPQKEEIKLRVAEALKRDVGRGIVRFDRRYQKMIGVEPGDIVEIEGERVTAAIVANSHPDDKGLDIIRMDGYIRKNAGVSIGDYVTIRRAQVKEAKKVVLAPAQKGVIVQIPGDIIKNNLLGRPVVKGDIVVASGRGDLYYSSGTPFDEIFRGFFEAMSVGFGELKFMVVNTIPKGIVQITYNTEVEVLPQAVEVREEKIPEVTYEDIGGLKEAIQKIREMVELPLKHPELFERLGIEPPKGVLLYGPPGTGKTLLAKAVANEANAYFIAINGPEIMSKYYGESEERLREIFKEAEENAPAIIFIDEIDAIAPKREEVVGEVEKRVVSQLLTLMDGLKGRGKVIVIGATNRPDALDPALRRPGRFDREIEVGVPDKQGRKEILQIHTRGMPIEPDFEKDAVIKVLKDLEKDERFEKEKIEKIIEKVSKANSEDEIKEILKEDGNVYVEVRNRLIDKLLEELAEVTHGFVGADLAALAREAAMVVLRRLINEGKINPEAESIPREVLEELKVTKRDFYEALKMVEPSALREVLIEVPNVHWDDIGGLEEVKQELREAVEWPLKYPKAFKKLGITPPKGVLLYGPPGTGKTLLAKAVATESEANFIAVRGPEVLSKWVGESEKRIREIFRKARQAAPAIIFIDEIDAIAPARGTSEGEKVTDRIINQLLTEMDGLVENSGVVVIAATNRPDILDPALLRPGRFDRLILVPAPDEEARFEIFKVHTRSMPLADDVDLRELARRTEGYTGADIAAVCREAALNALRRVVKSVPKEKLEEESEEFLNKLVVTRKDFEEALKKVKPSVSKYMMEYYRQFEEARKRVSGESVGREPDYFTG

SEQ ID NO: 1254 - protein, 641 aa, Pyrococcus horikoshii
MEELQYFPYEKFRPNQREFIEIVKEAVKRGENLIVEAPTGFGKTISVLAGVLPYAISLGYKVVYLARTHKQMDRVIEELRKIGEKSEVSGIEFRSRKDLCLHAYIQTFAQDAYTSMIVCKSLRKLGKCKYYENLKEKRDRVDEIVKFFLSFPPFPREVIEYSELLELCPYEITKKVGEKANVVVASYLYMISPPIRQAFLENLGVDYSDLIVIFDEAHNLPDQAISALSDRLSVRSIERAIKEAEEYGEKDIENFLSILLRGLEILYKEKLENYESEEIPIRPEEVFLHPASILGWRGRDIGMMLEDMIEVGDAIREDRIERNLPPRSYVGRVGEFLWNWLSLRDREDYLHLFTKEKGLALELVALDPSVALDFLEEVHSAIFMSGTLSPLEAFRDIIGVNARLKKFPRIVKRENAIVLVARDVSTRGIERSPPLYKRIAEYIFEAVKNTPKNVGVFTASYEVLEGVLSTNVHIKIEEEVGKKVFIEKKDAPSRENDEMIREFKEESKGKGAVLFGVMGGRNSEGQDYSGDEMNGVILVGIPYARPTPRVQAQTRYFEKKFPGKGRYYGYILPAHRKLAQAAGRVHRSENEKGSIVILDYRVLWKNVKKDLPDWMVETMIPVTLPTLRIKLRRFWRERLNE

SEQ ID NO: 1255 - protein, 160 aa, Pyrococcus horikoshii
MFQMSETERTLVIIKPDAVVRGLIGEIISRFEKKGLKIVGMKMIWIDRELAEKHYEEHREKPFFKALIDYITKTPVVVMVLEGRYAVEVVRKMAGATDPKDAAPGTIRGDFGLEVSDAICNVIHASDSKESAEREISLFFKPEELFEYPRAADWFYKKGI

SEQ ID NO: 1256 - protein, 308 aa, Pyrococcus horikoshii
MEWKGRDVISIRDFSKEDIEVVLSTAERLEKEMKEKGQLEYAKGKILATLFFEPSTRTRLSFESAMHRLGGSVIGFAEASTSSVKKGESLRDTIKTVEQYSDVIVIRHPKEGAARLAAEVADIPVINAGDGSNQHPTQTLLDLYTIKKEFGTIDGLKIGLLGDLKYGRTVHSLAEALAFYDVELYLISPELLRMPKHIVEELRERGMKIVETTKLEEVIGELDVLYVTRIQKERFPDEQEYLKVKGSYQVNLKILENVKDSLRIMHPLPRVDEIHPEVDKTKHAIYFKQVFNGVPVRMALLALVLGVI

SEQ ID NO: 1257 - protein, 152 aa, Pyrococcus horikoshii
MPELKVSAIKEGTVIDHIPAGKGLKVIEILGLSKLSNGGSVLLAMNVPSKKLGRKDIVKVEGKFLSEEEVNKIALVAPTATVNIIRNYKVVEKFKVEVPEVIEGILKCGNPNCITNYEYVTTKFYVISKNPLKVRCHYCERTMEEEEILANL

SEQ ID NO: 1258 - protein, 317 aa, Pyrococcus horikoshii
MVVSLKGRDLLCLQDYTPEEIWTILETAKMFKIWQKIGKPHRLLEGKTLAMIFQKPSTRTRVSFEVAMAHLGGHALYLNAQDLQLRRGETIADTARVLSRYVDAIMARVYAHKDVEDLAKYASVPVINGLSDFSHPCQALADYMTIWEKKGTIKGVKVVYVGDGNNVCHSLMIAGTKLGADVVVATPEGYEPDKKVIKWAEQNAAESGGSFELLHDPVKAVKDADVIYTDVWASMGQEAEAEERRKIFRPFQVNKDLVKHAKSDYMFMHCLPAHRGEEVTDDVIDSPNSVVWDEAENRLHAQKAVLALLLGGVKTGF

SEQ ID NO: 1259 - protein, 375 aa, Pyrococcus horikoshii
MTFFLKTTILMGRGSLENIKKLVSEGERVLVFSSKSMDRLGFLKEVIDYLDEAGATYESITGLPSEPSIENVEELLPKVKDFSPETFIALGGGSVIDISKALKVFYDAPELDFDSVAIFSRFKKAQPLPKLKTKLIAVPSTSGAGSEVSAATVIKKGDIKYTIVSPELCPNYAILDPRLPENMPREVARNSGLDVLVHAIEAYVSKASTPFSDAMAVKAARTILEKLEDSVNGDPTAREEVHYAATMAGIAFLNGRLGLVHAMSHKAAWIGPHGLINAILLPYVMEFNMEKAREKYDAMAKELGLSNAEELLQKVKELNERLNVPKLSEIVSEEDFTSRLDEMSRKAYEDPLVNFNPVEPSVDDIKNIYLRAFHD

SEQ ID NO: 1260 - protein, 391 aa, Pyrococcus horikoshii
MREKRKYFIAERVLLIKRSKIRELFERASKMEDVISLGIGEPDFDTPKNIKEAAKRALDEGWTHYTPNAGIPELREAVVEYYKKFYGIDIEVENVIITAGAYEGTYLAFESLLERGDEVIIPDPAFVSYAEDAKVAEAKPVRIPLREENNFLPDPNELLEKISKNTRMIVINYPNNPTGATLDKELAKTIADIAEDYNIYILSDEPYEHFIYEDAKHYPMIKFAPENTILANSFSKTFAMTGWRLGFVVAPSQVIKEMTKLHAYVIGNVASFVQIAGIEALRSEESWKAVEEMKKEYNERRKIVVKRLKNMPGIKVKEPKGAFYVFPNISGTGMSSEKFSEWLLEKARVVVIPGTAFGRMGEGYVRISYATSKEKLIEAMNRIEKALEGEK

SEQ ID NO: 1261 - protein, 474 aa, Pyrococcus horikoshii
MPFLPFSYYPFSLEVILMEYPKIVVKPPGPRAKELIEREKKVLSTGIGVKLFPLVPKRGFGPFIEDVDGNVFIDFLAGAAAASTGYAHPKLVKAVKEQVELIQHSMIGYTHSERAIRVAEKLVEISPIENSKVIFGLSGSDAVDMAIKVSKFSTRRPWILAFIGAYHGQTLGATSVASFQVSQKRGYSPLMPNVFWIPYPNPFRNIWGINGYEEPDELINRVLDYLEYYVFSHVVPPDEVAALFAEPIQGDAGIVVPPENFFKELKKLLEEYGILLVMDEVQTGIGRTGKWFASEWFNVKPDMIIFGKGVASGMGLSGVIGRKEIMDITSGSALLTPAANPVISAAAEATLEIIEEENLLKNALEVGEFIMGRLKEIKERFEIIGDVRGKGLMIGVEIVKENGRPDPEMTGKICWRAFELGLILPSYGMFGNVIRITPPLVLTKEVAEKALEIIERAIKDTLTGKVERKVVTWH

SEQ ID NO: 1262 - protein, 312 aa, Pyrococcus horikoshii
MIKMNVVIEAINLTKYYGNFPAVRGVTFSVNEGEVFGFLGPNGAGKTTTIRMLTGVLKPTSGQVRVLGYDMTREPEKLKARQRMGIVPEMANPYIDLTAMQNLKLMGELYGLPKWEIEKRSIELLKLFELYEKRNIKVRGFSKGMRQRLVLAMAMIADPELYFLDEPTSGLDVISARIIKDIIRDEKKAGKTIFLTTHNMNDANELCERIGIIRKGKLVAIDTPEGLKRLTKEHLSVEVSLKPMMFDPSVLSSALRVERLGDKVKIYTNDPDKTVKEIVEYAKERKLKIVSIRTLSPSLEDVFVEIIGGKND

SEQ ID NO: 1263 - protein, 571 aa, Pyrococcus horikoshii
MVEIIDTTFRDAHQSLIATRMSTKDMLPIAEKMDKIGFYSMEVWGGATFDVSLRFLREDPWERLKLLREHIRKTKLQMLLRGQNLVGYRHYPDDVVEKFVELAYKNGIDIFRVFDALNDVRNMKTAIKKAKEIGAEVQGAICYTTGPIFTIDYYLQKVDELIELDVDYITIKDMAGLADPQTAYELVKEIKERYGIKVNFHTHATSGLAVATYLKAVEAGVDYIDTSIYPLAGGTAQPAVQTMYYALPKGKRPKLNIKLIHEISKYLTNLLEKKYDHLLTKKAIHGDPNVLIHQIPGGMYSNLIKQLSELKALDKLEEVLEEVPRVREDLGYPPLVTPTSQIVGVQAVLNVLFGRYKQVTKETKDYVRGLYGRPPGKIKEEIKKLILGDEEPINVRPADLLEPMLEKAKKELKEKGYLEKEEDVVTYCLFPQVALEFFELRRQGRLRPVEEKPKGKPIKIYINGKEFEVFVEGIEFEPPKPKPQVQAIPSQPPKREVVAPSGSVVSAPMPGKVLRVLVRVGDRVRVGQGLLVLEAMKMENEIPSPRDGVVKRILVKEGEAVDTGQPLIELE

SEQ ID NO: 1264 - protein, 856 aa, Pyrococcus horikoshii
MTNPWKIFLVSYAHIDSEWLWKVDETVNICKLTFENTLKLMEKYNFLTFAHGPVFYYELMESHYPNIFRKIKEMVDRKQWKIIDGSYVEFDANIPSGESLIRQFLYGIKYLEEKFGVKPRTLYLPDSFGFPPTLPKILCEVGIENFATSKLNWNDTNPFPYHIFRWKSRSGEEVLAYSTPGSYSDYLSDIKRILWNVEQQREKQEIPVIMQVFGRGDHGGGPEEIEVQNVKKWMEEYKGRLELIASGMDEFFDYVREHYLKDLPIFEDELYLEFHRGIFTTGAWIKRFNRLNEHLILQVEKLYSLLKILYGIEYPWEGILNSWKAILLTQGHDALPASITKEVYDDVMRRSSNVYKGLLSFLRNGLKVIAEKEKARYIVFNPNSFPVSPYIRTWESVNGFYQRLKNGSKLVYLSELPPIGFKGYEEVGERPEDFVNIVEREKDFILENSYLRVTVSKRTGWITSIYDKKNKREILKEPIRPRIMLDYPMPFRGRFVPASMFDAWEVYYREGINKYFHRDLRAKEVFISERGPLYASISAKFHYKQFLGKASTMEFEIGLYADKPYVEVRFRAHWNTHHRFLKLLVPVAIDSDKAVFEVPYGIVERADACRSENPRERAKYEVLGHKWVDISDGSYGVAVINDSKYGFSWCNGVLRISLLRSPSQPLADFIMKFIRMNKKAQEKFQDIKLQKSGKLKREIINIIIWLMVLFNELRNKKKVTPIDRGYHIATVWVYPHEGNYVKGNVPMLATELNTLYILQKGSGSSSTIWNFINVEPQEKLQVVTVKPCENGDCFVLRLFNPTDERLKAILRFNVKVKSAAEATHDERFLRGLPVRDNSVEVSLGSYEVRTLLITVL

SEQ ID NO: 1265 - protein, 287 aa, Pyrococcus horikoshii
MEGVIVPLITPFKEDHSIDFEALEWLIKFLEEKGVHGIFINSTTGEFTSLSLEERKILAEKGREVTSRTYLVGTGSTSTFEVIELTKHAKEIGADGVVIVSPYYCRLKEDAIFKHFSMVAEKVDIPIILYAIPSCANPISLEVVRKLALEYSNVIGVKASVDSLTYLSGLIEIKEERKDFKVFTGLDQYFLPNLILGGDGGIMACANFVPEIHLEVWNAFKKGNLEKAMNSARKLVKITKIYSIASSFASAVKLAMVARGFPIKPILRPPYMMDGEEVFKKIKEIVS

SEQ ID NO: 1266 - protein, 450 aa, Pyrococcus horikoshii
MAVHPIDYRYGSEEMRKIWDEKNKLQKLLDVEAALARAHAKVGNIPEESAKVISERANTKWVKLERVKEIEAEIHHDIMAVVKALSEVCGEHGKYVHLGATSNDIIDTANALLIKESLEIVERDLKELRSILKQLAEKHIGTVCIGRTHGQHAVPTTYGMKFALWLDEIQRHIERLYQLKERVLVGKMRGAVGTAASFGEKAFEIERLVMEDLGLKPARITNQIVQRDVYAELLFFLALVASTLDKMGLEIRNLQRTEILEVSEPFGEKQVGSSTMPHKRNPIRTEKVCGLARVLYSNVIPALLNNPLWHERDLTNSSVERVILPESFVLLDEMLKTMKKVLTGLEFFPENIRRNLYLTKNLIMAEPLMLKLAEKGMGRQEAHEVVRQLAMKAFRENRDLLEVAKESREITKYLTERDLEELKPENYIGKAREIVKKVIEYVEEMERRGL

SEQ ID NO: 1267 - protein, 359 aa, Pyrococcus horikoshii
MVEKPVVIKFGGTSVRYAFEEALELVAKLHENMKIIVVVSALAGVTDCLLRLAKGDKSALLEIDEIHEELSQELNVQLEHLIHQLKKTINSKSSFPSEKAFIDEIASFGERFSAKLFSEGLKILGITARPVDSKDVLFVKGEFGNAEVEFKKSAQGVDVLYRMLRRGIVPVVTGYYGNLNGFRATFGRGGSDYSATSIASLVNAKAVLIMSDVEGIYTADPKLVPPARLIHYISYKEAKTAAKLGMKVLHPRAIDPVEGKIPVILGKTRDLKFGTLISHESQGIPIVTHKLLENHAEISVVSVKTNIPLPYEVYEEGDLYFKIKTSKDQFLEVLRDVHRRVVENENLHSSHDGELWTWV

SEQ ID NO: 1268 - protein, 656 aa, Pyrococcus horikoshii
MNIKSFINRLKELVEIEKEAEIEAMRLEMKRLSGVERERLGRAILNLNGKIAGEELGYFLVKYGRNREIKTEISVGDLVVISKRDPLKSDLLGTVVEKGKRFIVVALETVPEWALRDVRIDLYANDITFRRWLENLDRVKKAGKRALEFYLGLDEPSQGEEVSFEPFDKSLNSSQRKAIAKGLGSEDFFLIHGPFGTGKTRTLVELIRQEVKRGNKVLATAESNVAVDNLVERLAKDGVKIVRVGHPSRVSRHLHETTLAYLITQHELYGELRELRVIGQSLAEKRDTYTKPTPKFRRGLSDAEIIKLAERRRGIRGLSARLIKEMAEWIKLNRQVQKAFEDARKLEERIARDIIREADVILTTNSSAALEVVDATDYDVAIIDEATQATIPSILIPLNKVDRFILAGDHKQLPPTILSLEAQELSHTLFEGLIERYPWKSEMLTIQYRMNERIMEFPSKEFYDGRIVADERVKNITLGDLGIKVNATGIWRDILDPSNVLVFIDTCMLDNRFERQRRGSESRENPLEAKIVSKIVEKLLESGVKAEMIGVITPYDDQRDLISLNVPEEVEVKTVDGYQGREKEVIILSFVRSNKVGEIGFLKDLRRLNVSLTRAKRKLIMIGDSSTLSSHETYKRLIEHVREKGLYVVLTKDGIR

SEQ ID NO: 1269 - protein, 324 aa, Pyrococcus horikoshii
MNKVEAIIVENLVKKYGDFEAVRGISFKVRRGEIFAFLGPNGAGKTTTVHMLTTLLKPTSGRAIVAGHDVVKESREVRKKIGVVFQDPSVDRELTAWENMYIHGRIYGLKGQELKKKIEELLKFVELWEFKDRQVKYFSGGMQRRLEIARALIHEPEVLFLDEPTIGLDPQTRAHIWEYIKTMKEEHDMTIFLTTHYMDEAEQLADRIAIIDHGKIIAEGTAEELKKLVGNDIIYVKFEKPTCIQAEFIRGCKVLNNGRVALEVKNAAEALPLVFEKAREMELKILEVTYHRPTLNDVFLHLTGREIRDEASEKPTMPIRRWRR

SEQ ID NO: 1270 - protein, 455 aa, Pyrococcus horikoshii
MGKLFGTFGVRGIANEKITPEFAMKIGMAFGTLLKREGRKKPLVVVGRDTRVSGEMLKEALISGLLSVGCDVIDVGIAPTPAVQWATKHFNADGGAVITASHNPPEYNGIKLLEPNGMGLKKEREAIVEELFFKEDFDRAKWYEIGEVRREDIIKPYIEAIKSKVDVEAIKKRKPFVVVDTSNGAGSLTLPYLLRELGCKVITVNAQPDGYFPARNPEPNEENLKEFMEIVKALGADFGVAQDGDADRAVFIDENGRFIQGDKTFALVADAVLKEKGGGLLVTTVATSNLLDDIAKKHGAKVMRTKVGDLIVARALYENNGTIGGEENGGVIFPEHVLGRDGAMTVAKVVEIFAKSGKKFSELIDELPKYYQIKTKRHVEGDRHAIVNKVAEMARERGYTVDTTDGAKIIFEDGWVLVRASGTEPIIRIFSEAKSKEKAQEYLNLGIELLEKALS

SEQ ID NO: 1271 - protein, 879 aa, Pyrococcus horikoshii
MKIERVIVQNFRSHKNSEIEFKPGINLIIGQNGAGKSSLLDAILVGLYWSKRMRLRGLKKDEFTRTGTRGAIIEITFEEDGTKYKVLRDFARNVSYLKRLDGREWRHVTETSMESVSSFIDRIIPYNVFLNAIYVRQGQIDAILESDETRDKIVKEILNLDKLEKAYDNLGKIRKYIKYSIEEKEKFIMKTENIEDLIRTQEKSFTEVLNEIRNISSNLPRLRRELEGIKEEVKTLEATFNSITELKLRLGELNGKKGRLEERIRQLESGIEEKRKKSKELEEVVKELPELEKKETEYRRLIEFKDEYLVKKNELEKRLGILSNRLQEVKRKIKDAESKVARIRWIEERLKEIQEKIMKLEPRVREFEDAMRLKAQMESLKSKLGGLEPEKINEKLLYLENRKKELEEEIDKITRKIGELNQRSKDRRLAIIELKKARGKCPVCGRELTEEHKADLLRKYSLELSSIEKEIQEAKALERQLRAEFRKVENELSRLSSLKTIADQIIEIRERLSKINLEDLKRDKEEYELLKSESNKLKGEVESLKKEVNELNDYKNESTKLEIEIDKAKKELSEIEDRLLRLGFKTIDELSGRIRELEKFHNKYIEAKNAEKELRDILESLKDEREELDKAFEELAKIETDIEKVTSQLNELQRKFDQKKYEEKREKMMKLSMEIKGLETKLEELERRRDEIKSTIEKLKEERKERESAKMELEKLNIAIKRIEELRGKIKEYKALIKEEALNKIGEIASEIFSEFTDGKYSGIAIRAEDNKVKLFVIYDGVERPLTFLSGGERIALGLAFRLAMSMYLIGKVDLLILDEPTPFLDEERRRKLIEIMERHLRKISQVIIVSHDEELKDAADHVIRIRLEGGASKVEVVS

SEQ ID NO: 1272 - protein, 275 aa, Pyrococcus horikoshii
MPRKAREYPEEGEFVVATVKRIHNYGAFLELDEYPGKEAFMHISEVASTWVRNIRDYLKEGQKVVAKVIRVDPRKGHIDLSLRRVTQQQRKAKLQEFKRAQKAENLLRLAAEKLGKDFEAAWREVWVPLEEEWGEVYAAFEDAAKDGIEVLKGHVPDEWLPVLKEIVENYVEVPTVTIDAEFEITVPKPNGVEIIKEALIRARDRANKEKDIEVKFTYQGAPRYRIDITAPDYYKAEEVLEDIAEEILRVIKQAGGEATLLRKEKRIRKVKKRKK

SEQ ID NO: 1273 - protein, 191 aa, Pyrococcus horikoshii
MVDTSNVKLRIENIVASVDLFAQLDLEKVLDICPNSKYNPEEFPGIICRFDDPKVALLIFSSGKLVVTGAKSIQDIERAVAKLIQKLKGIGVKFKRAPLIDVQNMVFSGDIGREFNLDNVALTLPNCEYEPEQFPGVIYRVKEPRAVILLFSSGKIVCSGAKSEADAWEAVRKLLRELEKYGLIEEEEEEL

SEQ ID NO: 1274 - protein, 416 aa, Pyrococcus horikoshii
MNKMKAVILAGGFGTRLRPISSTRPKPMVPVLGKPNLQYILEALEKVKEIDEIILSVHYMRGEIREFIQEKMRDYPKDIRFVNDPMPLETGGALKNVEEYVSDDFLVIYGDVFTNFDYSELIEAHKKNDGLITVALTKVYDPERFGVVITDEEGKIVEFEEKPRKPKTNLVDAGIYMVNKDVLKEIPKNKEIYFEREILPKFVNQGLVYGYKMPKQYYWVDLGTPEDFFYAHQIALDELSKENGYMILGENVEIPDDVEVQGPVYIDDNAKIGHGVKIKAYTYIGPNTIIEDKAYFKRSILLGNDIIKERAELKDAILGEGVVVGKDVIIKENAVIGDYAKIYDNLVIYGAKVLPWKKVEEYEAYIKIKLDPTKVRPGQYPDHCPLGLPECIYKKFKAIAGEKPPCDECIENQWLF

SEQ ID NO: 1275 - protein, 320 aa, Pyrococcus horikoshii
MKSLSKEWGEKMIFDAHSDLPTYVYEEREKGRTRVLESNFEKFFTGISARVMSVWSRPEKKPIILRYALEAYNRLFKDVSESEKLVIVGTVKEMEDAIKDGKVALWLGMEGGEPIESLDILEIFHSIGLRVLTLTWSLRNQIGDGVFERTRGGLTNFGAEVVGKCEELGIIIDLSHINEQGFWDVLDITGFPVIASHSNAKSLCDNPRNLTDEQIKAIAERDGVIGAVAIPAFVDKDNPTLEKYVKHIEYMVDLVGYKHVGIGFDFVYYLPGWSGKSVEGLEDESKIPDLIKALEENFSEKEVKGITFENFKRVFERVVG

SEQ ID NO: 1276 - protein, 342 aa, Pyrococcus horikoshii
MEKYEELFARIKEKAKLIDEKIFELIPEKDPRVLYEAARHYPLAGGKRVRPFVVLTSTEAVGGDPLRAIYPAVAIELIHNYSLVHDDIMDMDETRRGKPTVHRIWGVNMAILAGDLLFSKAFEAVARAEIPPEKKARVLEVIVKASNELCEGQARDLEFEKKSTVTIEEYMEMISGKTGALFEASAKVGGIIGTDNEEYIKALSSWGRNVGIAFQIWDDVLDLIADEKKLGKPVGSDIRKGKKTLIVAHFFENADEKDKQRFLKIFGKYAGDVKGRGIIEEDIKSDVMEAIDLLKKYGSIDYAAEIAKDMIKKANEALRILPKSKARMDLELLAKFIVEREY

SEQ ID NO: 1277 - protein, 319 aa, Pyrococcus horikoshii
MKVNISIFGFGTVGRALAEIIAEKSRIFGVELNVISITDRSGTIWGDFDLLEAKEVKESTGKLSNIGDYEVYNFSPQELVEEVKPNILVDVSSWDEAHEMYKVALGEGISVVTSNKPPIANYYDELMNLAKENNAGIFFESTVMAGTPIIGVLRENLLGENIKRIDAVVNASTTFILTKMSEGKTLDDAIEEAKSLGILEEDPSKDIDGIDAYYKAKILHWVSYGEPPEEEERLGIREVRDARNVRLVAQVSKGKISVKPRKLSSDNPLLVEGVQNAAVIRTNNLGEVILKGPGGGGRVTASGVFTDIIKATLKFPNLR

SEQ ID NO: 1278 - protein, 334 aa, Pyrococcus horikoshii
MKVAVLGATGVVGRTFVKLLENHPWFKVEKLVASERSAGKRYGEIVEDSPEEFKDYTIIGLKEFLEDPGVDLVFNALPASISKEVEEKLAQEIPVFTNARSHRYDEDVPILVPEVNSDHLKLVEVQRKRRKWRGFIVTNPNCSTAILTVSLAPLRAFGIKKVRVATMQAISGAGFSGLSAYAIHDNVIPFINGEEWKIENESRKILGKFTGDKVEPAEIEVAAIATRVPVLHGHTEAVFVELEKFDIEEIREAFENFDPLRSLELPSYEKPIVYTEIPQPRLHRDRGKGLTVTVGRLQEISGGIKYVVLGHNLVRGAAGGSILNAELAYKLGII

SEQ ID NO: 1279 - protein, 1044 aa, Pyrococcus horikoshii
MSYVKRIRQPIIAVLGHVDHGKCLLPEERVILPDYGPITLEELFNMTKETVFKDEEKEVRKLGIRMPVAGVDGRVRLLEGPYVWKVRYKGKMLRVKLKDWHSVAVTPEHPFLTTRGWVRADQLKPGDYVAVPKILPGKDDKEKFLQYVHEKLKGKVHIKLPSSDEEWETFFYFAGTIFGRENSVNPEGLTHEVKALLELFKVLFEYPREVLRVLFMAPVRYVANFLRGFFDINGYVNGEELRVEVRGAPHEVLEELSLILLRLGIVSKIYPTSLAISGRRNLELFRRYIGFSEKQKAKELEGIIRRSENSESYPIFEELRRIRLLFGFTRAELSSTIPLYSKYESKEAPSYEILMKILNTIEKGSKDLNKKITILEGRVRDHEYIEEFKREGLIKDGKLTELGKELLEVWRNREFDSRDVNYLRNIIENFVFLPVEKIEEFEYDGYVYDVTTETHNFIANGILVHNTTLLDKIRKTNVAAKEAGGITQHIGATEVPIDVVKKIAGPLIKLWKAEIRLPGLLFIDTPGHEAFTSLRARGGSLADLAVLVIDVNEGFQPQTIESIEILRRYRTPFVVAANKIDRIRGWVIEEDEPFLMNIKRQDQRAIQELETKLWELIGKFYEFGFQANRFDRVQNFTRELAIVPISAKYGIGIAELLVLIAGLSQKYLEEKLKIEVEGPARGTILEVREEPGLGHTIDVIIYDGTLHKDDTIVVGGKDKAIVTKVRALLKPKPLDEIRDPRFRFDYVDEVTAAAGVKIAAPGLEEALAGSPVIAAPTPEDVERAKEEIMRQIESVVISTDKVGVIVKADTLGSLEALSKELQEKEIPIRKADVGNISKTDVMEALSVKEENPKYGVILGFNVKVNEDAKEVAKAKEVPIFVGNIIYKLIEDYEAWIKEEEEKRKRELLAKVTFPGVIKLYPDERYVFRRSNPAIVGIEVLEGRIKPGVTLIKQNGQKVGTIRSIKSRDEFLQEARKGQAVAIAIEGAIVGRHIHPGETLYVDLSRDDAIILLKHLRDVLEDTDIKALKMIAQVKAKEDPFWRAV

SEQ ID NO: 1280 - protein, 186 aa, Pyrococcus horikoshii
MKMKDELINLIINEGCIKFGHFVLTSGKESNYYIDIKSLITNPKALRIIAKLIKEKAEELNLNYDKIAGPELGAVPIATALSLETNKPLLIVRKKKKEHGTGKVIEGNVQKGDKVLLVEDVTTTGGSVIRAAKILREHGADVVGIFVVVDREEGAKENIEKEGFKFYPLVLVSELFKAAGISKDQS

SEQ ID NO: 1281 - protein, 458 aa, Pyrococcus horikoshii
MEGNTILKIVLICTILAGLFGQVVPVYAENTTYQTPTGIYYEVRGDTIYMINVTSGEETPIHLFGVNWFGFETPNHVVHGLWKRNWEDMLLQIKSLGFNAIRLPFCTESVKPGTQPIGIDYSKNPDLRGLDSLQIMEKIIKKAGDLGIFVLLDYHRIGCTHIEPLWYTEDFSEEDFINTWIEVAKRFGKYWNVIGADLKNEPHSVTSPPAAYTDGTGATWGMGNPATDWNLAAERIGKAILKVAPHWLIFVEGTQFTNPKTDSSYKWGYNAWWGGNLMAVKDYPVNLPRNKLVYSPHVYGPDVYNQPYFGPAKGFPDNLPDIWYHHFGYVKLELGYSVVIGEFGGKYGHGGDPRDVIWQNKLVDWMIENKFCDFFYWSWNPDSGDTGGILQDDWTTIWEDKYNNLKRLMDSCSKSSSSTQSVIRSTTPTKSNTSKKICGPAILIILAVFSLLLRRAPR

SEQ ID NO: 1282 - protein, 453 aa, Pyrococcus horikoshii
MRMGRYFGTSGIREVVNEKLTPELALKVGLALGTYLQEGKVVIGCDTRTSSVMLKNAVISGLLATGIDVIDIGLAPTPLTGFAIRLYNAEAGVTITASHNPPQYNGIKVWDRDGMAYTPDKEHELEKIIESGNFRRVPWNEVGTLKTANPRKEYIEAILREINLKGSYTVVIDAGNGAGSIVSPYLHRELGNRVITLNSDPSGFFVRELEPNKESLSMLEKTVKVLNADIGIAHDGDADRVGVVDENGEFVEYEVMLSLIAGYMLKKYGKGKIVTTVDAGFALDDYIRELGGEVVRTRVGDVAVAEELVKHGGVFGGEPSGTWIMPQWNLTPDGIFASALVLEMIDRLGPIGELAKDVPKYVTLRKKIPCSNELKNKVMNKIADLIPREFSYERIITIDGIRIENDDWWILFRPSGTEPIMRITLEAHTEEMAERLMKKAENLVKSVIKDLSS

SEQ ID NO: 1283 - protein, 216 aa, Pyrococcus horikoshii
MVVIGEKFPEVEVKTTHGVIKLPDYFTKQGKWFILFSHPADFTPVCTTEFYGMQKRVEEFRKLGVEPIGLSVDQVFSHIKWIEWIKDNLSVEIDFPVIADDRGELAEKLGMIPSGATITARAVFVVDDKGIIRAIVYYPAEVGRDWDEILRLVKALKISTEKGVALPHKWPNNELIGDKVIVPPASTIEEKKQREEAKAKGEIECYDWWFCYKKLE

SEQ ID NO: 1284 - protein, 410 aa, Pyrococcus horikoshii
MFRLEDFNFHNKTVFLRVDLNSPMKDGKIISDARFKAVLPTIRYLIESGAKVVIGTHQGKPYSEDYTTTEEHARVLSELLDQHVEYIEDIFGRYAREKIKELKSGEVAILENLRFSAEEVKNKPIEECEKTFLVKKLSKVIDYVVNDAFATAHRSQPSLVGFARIKPMIMGFLMEKEIEALMRAYYSKDSPKIYVLGGAKVEDSLKVVENVLRRERADLVLTGGLVANVFTLAKGFDLGRKNVEFMKKKGLLDYVKHAEEILDEFYPYIRTPVDFAVDYKGERVEIDLLSENRGLLHQYQIMDIGKRTAEKYREILMKARIIVANGPMGVFEREEFAIGTVEVFKAIADSPAFSVLGGGHSIASIQKYGITGITHISTGGGAMLSFFAGEELPVLRALQISYEKFKEVVK

SEQ ID NO: 1285 - protein, 253 aa, Pyrococcus horikoshii
MIIVENLRKKFGSKEVLKGINFTVNDGEIYGLLGPNGSGKSTTMRILSGIITDFEGKVMVAGVDVSRDPMKVKEIVGYVPETPALYESLTPAEFFSFIGGVRRIPQDILEERVKRLVDAFGIGKYMNQLIGTLSFGTKQKISLISALLHDPQVLILDEAMNGLDPKSARIFRELLFEFKEEGKSIVFSTHILALAEVMCDRIGIIYEGRIVAEGTIDELREIAREEKLEDIFLKLTQAKEEVSQIVSALKEAL

SEQ ID NO: 1286 - protein, 180 aa, Pyrococcus horikoshii
MLIAITGTPGVGKTTVAKLLAKKLNYEYVSLKDFALEKGCGRRVNDEVEVEIDELAYFIERELKGKNAVLDGHLSHLMPVDLVVVLRAHPKLIGERLRERGYDREKIGENVEAELVDAVLIEAIEEHENVIEVDTTNKSPEDVVEEIVSLINSGIKKRVGIVDWSEVYDEIIPYLRLGGE

SEQ ID NO: 1287 - protein, 192 aa, Pyrococcus horikoshii
MPKDKLVITVSGLAGSGTTTLSKKIAEHYGLKHVYAGLIFRQMAKEKGMSLEEFQKYAELHPEIDREVDRRQIEAAKEGNVVIEGRLAGWMVKNADLKIWLDAPIRVRAERVAKREGISVEEAFMKIAEREMQNRKRYLNLYGIDINDLSIYDLIINTSKWSPEGVFAIVKAAIDHLDPVGDAGSKKEKEVG

SEQ ID NO: 1288 - protein, 360 aa, Pyrococcus horikoshii
MFEKGYVDENYIRVPKDRLFSFIVRVLTKLGVPEEDAKIVADNLVMADLRGVESHGVQRLKRYVDGIISGGVNLHPKIRVIREGPSYALIDGDEGLGQVVGYRSMKLAIKKAKDTGIGIVIARNSNHYGIAGYYALMAAEEGMIGISMTNSRPLVAPTGGIERILGTNPIALAAPTKDKPFLLDMATSVVPIGKLEVYRRKGKDIPEGWAINREGNITTKVEEVFNGGALLPLGGFGELLGGHKGYGLSLMVDILSGILSGGTWSKYVKNTSEKGSNVCHFFMVIDIEHFIPLEEFKEKISQMIEEIKSSRKHPEFERIWIHGEKGFLTMETRLKLGIPIYRKVLEELNEIAKRVGVEGL

SEQ ID NO: 1289 - protein, 363 aa, Pyrococcus horikoshii
MHRLQILQVQKCHEEFEKAMALGQYDKARLIALRCSELLRNLASENLDLSHILLEEAKKWEDKARNIRKKKEARNEYFDRLKVLIKKSTVTWNDIGGLKEAKKLIAQAVGLSIAKSPIDPPQGILLFGPPGTGKSLLASATANSLNATFFSVKASDLLSKYFGESSKLVSALFSLARQLSPSVIFIDEVDSLTMKRSSLDDAARRMIGTLLAEIDGFKDKRRKVIVLTATNTPWDLDEAMLSRLPIRIYVPLPDIPSAVEIFRIHLRGIPHEVSLNKLAKEAVKKLYSGREIANVVKLATMKMLEEMNPELVDPLRVATLKGKDLTTRPLTMDDFRYAMAKIKSPITKSDVKKYEKWAKEFGI

SEQ ID NO: 1290 - protein, 314 aa, Pyrococcus horikoshii
MPERVVIALGGNALQQRGQKGTYDEMMENVRKTAKQIAEIIARGYEVVITHGNGPQVGTILLHMDAGQSLHGIPAQPMDVAGAMSQGWIGYMIQQALRNELRKRGIEKEVVTIITQTIVDKKDPAFQNPTKPVGPFYDEKTAKKLAKEKGWVVKEDAGRGWRRVVPSPDPKGHVEAETIRRLVESGIIVIASGGGGVPVIEENGEIKGVEAVIDKDLAGEKLAEEVNADILMILTDVNGAALYYGTEKETWLRNVKVEELEKYYQEGHFKAGSMGPKVLAAIRFIKNGGKRAIIAHLEKAVEALEGKTGTQVTP

SEQ ID NO: 1291 - protein, 425 aa, Pyrococcus horikoshii
MGLYRKYIEYPVLQKILIGLILGAIVGLILGHYGYADAVKTYVKPFGDLFVRLLKMLVMPIVFASLVVGAASISPARLGRVGVKIVVYYLLTSAFAVTLGIIMARLFNPGAGIHLAVGGQQFQPKQAPPLVKILLDIVPTNPFGALANGQVLPTIFFAIILGIAITYLMNSENEKVRKSAETLLDAINGLAEAMYKIVNGVMQYAPIGVFALIAYVMAEQGVKVVGELAKVTAAVYVGLTLQILLVYFVLLKIYGIDPISFIKKAKDAMLTAFVTRSSSGTLPVTMRVAKEMGISEGIYSFTLPLGATINMDGTALYQGVCTFFIANALGSHLTVGQQLTIVLTAVLASIGTAGVPGAGAIMLAMVLESVGLPLTDPNVAAAYAMILGIDAILDMGRTMVNVTGDLTGTAIVAKTEGELEKGVIA

SEQ ID NO: 1292 - protein, 386 aa, Pyrococcus horikoshii
MEIMEFEEAFKEVYEMVKPKYKLFTAGPVACFPEVLEIMKVQMFSHRSKEYRKVHMDTVERLREFLEVEKGEVLLVPSSGTGIMEASIRNGVSKGGKVLVTIIGAFGKRYKEVVESNGRKAVVLEYEPGKAVKPEDLDDALRKNPDVEAVTITYNETSTGVLNPLPELAKVAKEHDKLVFVDAVSAMGGADIKFDKWGLDVVFSSSQKAFGVPPGLAIGAFSERFLEIAEKMPERGWYFDIPLYVKYLKEKESTPSTPPMPQVFGINVALRIIEKMGGKEKWLEMYEKRAKMVREGVREIGLDILAEPGHESPTITAVLTPPGIKGDEVYEAMRKRGFELAKGYGSVKEKTFRIGHMGYMKFEDIQEMLDNLREVINELKKQKGIN

SEQ ID NO: 1293 - protein, 138 aa, Pyrococcus horikoshii
MVVVMIEVGEYKVKEGLYYTKDHEWAQVLEDGTVLVGITDYAQKELGDLAYVELPEVGKEVSKGDVLCEVESVKAVSEVYAPVSGEVIEVNEELSDSPEKINEDPYGAWIAKIKPKNLEEELKELMDAEKYAEYLKTL

SEQ ID NO: 1294 - protein, 401 aa, Pyrococcus horikoshii
MTLMIRASKRALSIEYAIRDVVLPARELEKKGIKVIRLNIGDPVKFDFQPPEHMKEAYCRAIQEGHNYYGDSEGLIELREAIVKREKEKNGVDITPDDVRVTAAVTEALQLIFGALLDPGDEILIPGPSYPPYTGLVKFYGGKPVEYRTIEEEGWQPDIDDLRKKISERTKAIAVINPNNPTGALYDKKTIEEIINVAGEHDLVVLSDEIYDLMTYEGKHISPGSLTKDVPVIVMNGLSKVYFATGWRLGYMYFVDPEGKLSEVREAIDKLARIRICPNTPGQFAAIAGLTGSMDYLKEYMKKLKERRDFIYKRLNEIPGISTTKPQGAFYIFPRIEEGPWKSDKEFVLDVLHNAHVLFVHGSGFGEYGKGHFRIVFLPPIEILEEAMDRFEKFMRERLSS

SEQ ID NO: 1295 - protein, 679 aa, Pyrococcus horikoshii
MLNGIGMGVRVVCPYCGFGCNLLIDPKSRRVKPYPGEPNRGKLCPKGLYALEHVFSKDRLKHPLKKEGESFRRISWEKAISEISTKLKEIIEDYGPGSIAFIASSKVTNEENYLIQKIARLLGTNNVDNCARLCHESSVHALKLTLGDGVQTNPYSDLERFGAIMIWGYNPAETHPVVMQYILGAKRRGGKIIVIDIRETLTMRFADYRLVIKPGTDITLANAIMNVIIEGNLYNKEFVESRTTGFSEIRMGVKKYTPEYAEKVTGVPAELIREVAEVFAKAGSGAIMWGMGITQQISGVENVLALVDIALLLGYFGEKGGLYPMRGQNNVQGAAYMGTLSEFLPGYIPLSDSKFRRKVAKMWGVEDLPTERGFYLTEYWDAILKGDLKALYIVGENPAVSDANALKVRKALTKLDLLVVQDLFLTKTARFAHYILPAAAFCEKEGSYMNSERRIQWSFKVCDPPGESKPDWEILVMLARALGLKGFDYSKVEDITREYFKLFPALRNRSIEELKARGIIIPAPRLYVDSFNTHDGKARFVAVEQIMPWEEPNGEYPLILTTVRLINHYNTGEMTRRSPSLAKMSGESVVFISREDAREYGIEDGDYVIVETRRGSLRLKAKIAKIQKGVIAIPFHFDANLLTNDALNKAGTPEFKFSAARIRKIEKENYGTKCDEGKG

SEQ ID NO: 1296 - protein, 639 aa, Pyrococcus horikoshii
MKYMFSACMRDCYDTCSIMSEIKNGKLIVRGNPDHPITQGFLCPKGALLPRWFHSNERLKSPLVREGKRGDEDFKEVSWGEALTLIKEKLQETIKEYGSESILVYKYAGDRGIVNYYFPMRLFHYLNASTIDSGICDRAGQEALKDIYGTAVGMDPEKIKEHKLLVYWGINAFWTNLHGFMLAKKGNVEIWTVDVVRTETAKRSDKFFQIRPDTDVLFALGVAKVIIEEELYDKDFVTKNVYGFEEFKNYVTRLSLNYVSQETGIKPERIKEFAREFTEKRGIIHIGYGFQRSLAGGEAVRAVAILPVLVGHKFGFIYDMKTIDKSYAEGKFLRTKPENKIPQMELTKVIESDDIKFLYIYNSNPLASYPNQNRLRRALKKSDVFVVTHDIFLTDTALFSDVVLPANTFFERLDIVDSYYHRYVLLNEPVAKGPGKSNSEVTRLIAKSLGIRVPYLYESDEDVIRKVLEANGISFEELKRRGFIKVPEGPRNWKTPSGKIEFYSQRAVSRGLGPFPEYKKFKGKYPLRLLTPTHRMTITSQYHTTHGIIDPNLYMNPEDAKVRGIKDGDKVGVFNENGRVITKVKITEDVPKGVVILYKAFWPKLLGWNANFLTTDEKVEKYGKGSAFHSTWVEVNPYG

SEQ ID NO: 1297 - protein, 308 aa, Pyrococcus horikoshii
MYAIEVEKLTKSYGKFKAIDNLSFVVDEGIVFGFLGPNGAGKTTTILSMLGIIIPDSGDVRILGYDIFKEPLKAKERLGFLPENATIYEELTAWRNLDFFASFYRMSKQEKEKRIEELLKLVGLWDVRYRKAKTFSKGMRQRLLLAQALINDPELLILDEPTSGLDPEGARLVKDIIREQRKQGKTVFFSSHILSEVEELADKVGIIVKGKLRTVGTLEEIKKQYMELEGYEIKIETKQPLPELEIPDIIRIEKTTENKAIIFAKSDIRESISEELAKKGITIISLEIEEPSLEDVFLKTIYRREGNE

SEQ ID NO: 1298 - protein, 389 aa, Pyrococcus horikoshii
MALSDRLELVSASEIRKLFDIAAGMKDVISLGIGEPDFDTPQHIKEYAKEALDKGLTHYGPNIGLLELREAIAEKLKKQNGIEADPKTEIMVLLGANQAFLMGLSAFLKDGEEVLIPTPAFVSYAPAVILAGGKPVEVPTYEEDEFRLNVDELKKYVTDKTRALIINSPCNPTGAVLTKKDLEEIADFVVEHDLIVISDEVYEHFIYDDARHYSIASLDGMFERTITVNGFSKTFAMTGWRLGFVAAPSWIIERMVKFQMYNATCPVTFIQYAAAKALKDERSWKAVEEMRKEYDRRRKLVWKRLNEMGLPTVKPKGAFYIFPRIRDTGLTSKKFSELMLKEARVAVVPGSAFGKAGEGYVRISYATAYEKLEEAMDRMERVLKERKLV

SEQ ID NO: 1299 - protein, 521 aa, Pyrococcus horikoshii
MDMEQRERWATKIGLILAMAGNAIGLGNFVRFPTQVAGNGGGAFMVPYFLALFLLGIPVMWVEWVQGRYGGKYGHGTLGPTFYLMARESLKPRSALWFGLIGGALAFATTTLLNSYYLHLIGWSAAYSWFSITGAYYGKNTAQFFSQYLSNHGLVFLFWGITVVLLGIAVGQGVSKGIERWVKVMMPLLYVFAIILVIYVFALGSPLGQPQWSTIKGFEFIWSPNWGYLKDHLWKVMLAASGQIFFTLSLGMGIIQNYASYLGPKDDVALSGLATVSLNEFAEVVLGGSIAVPLAVAYAPKIVPPDVLAKGSDAALAWISENFGLGFSYTSLPNIFVQMGTAGRFFGALWFLLLWFAGFTSAIAMYNYLTALLEEDLGIKRSVGTWVVFIIYFLLGIPVVYINGYLDQVDAWISFQLALLALFDIIVSVWLFKPDNFWRELHEGALINVPEFYKWITVIIAPIFIALPLFGTFTDLVSKTLGWPAKIAILTMLTIGAIEAYYAIKKKYGEELEKNEVIIKV

SEQ ID NO: 1300 - protein, 207 aa, Pyrococcus horikoshii
MLQLTEKFKGTTTVGIVCKDGVVLAADRRASLGNIIYARNVTKIHKIDEHLAIAGAGDVGDILNLVRLLRAEAKLYYSQSGKRMSVKALATLLANIMNGAKYFPYLAWFLVGGYDEKPKLYSVDMVGGITEDKYATAGSGMEFAYSILDSEYKDNLTLEEGIKLAVKAINTAIKRDVFSGDGILVVTITKEGYKELSDSELEATLKQ

SEQ ID NO: 1301 - protein, 343 aa, Pyrococcus horikoshii
MGVPIGDLVPRKEIDLENLYGKKIAIDALNAIYQFLSTIRQRDGTPLMDSKGRITSHLSGLFYRTINLMEAGIKPAYVFDGKPPEFKRKELEKRREAREEAELKWKEALAKGNLEEARKYAQRATKVNEMLIEDAKKLLQLMGIPIIQAPSEGEAQAAYMASKGDVYASASQDYDSLLFGAPRLIRNLTITGKRKMPGKDVYVEIKPELVVLDEVLKELKITREKLIELAILVGTDYNPGGVKGIGPKKALEIVRYSRDPLAKFQRQSDVDLYAIKEFFLNPPVTNEYSLSWKEPDEEGILKFLCDEHNFSEERVKNGIERLKKAIKAGRQSTLESWFVKKKP

SEQ ID NO: 1302 - protein, 454 aa, Pyrococcus horikoshii
MELKPNVKEIPGPKARKVIEEHHKYMATTTNDPNEYFLVIERAEGVYWIDVDGNVLLDFSSGIGVMNVGLRNPKVIEAIKKQLDLVLHAAGTDYYNPYQVELAKKLVEIAPGDIERKVFLSNSGTEANEAALKIAKWSTNRKMFIAFIGAFHGRTHGTMSLTASKPVQRSRMFPTMPGVVHVPYPNPYRNPWGIDGYENPDELINRVIDYIEEYLFEHYVPAEEVAGIFFEPIQGEGGYVVPPKNFFKELKKLADKHGILLIDDEVQMGMGRTGRMWAIEHFDIVPDIVTVAKALGGGIPIGATIFRADLDFGVSGVHSNTFGGNTVAAAAALAVIEELQNGLIENAQKLEPLFRERLEEMKEKYEIIGDVRGLGLAWGVEFVKDRKTKEYATKERGEIVVEALKRGLALLGCGKSAIRLIPPLIISEEEAKMGLDIFEEAIKVVSERHGYKIH

SEQ ID NO: 1303 - protein, 310 aa, Pyrococcus horikoshii
MNLVFGMIASIGELLIDLISVEEGDLKDVRLFEKHPGGAPANVAVGVSRLGVKSSLISKVGNDPFGEYLIEELSKENVDTRGIVKDEKKHTGIVFVQLKGASPSFLLYDDVAYFNMTLNDINWDIVEEAKIVNFGSVILARNPSRETVMKVIKKIKGSSLIAFDVNLRLDLWRGQEEEMIKVLEESIKLADIVKASEEEVLYLENQGVEVKGSMLTAITLGPKGCRLIKNETVVDVPSYNVNPLDTTGAGDAFMAALLVGILKLKGLDLLKLGKFANLVAALSTQKRGAWSTPRKDELLKYKEAREVLAP

SEQ ID NO: 1304 - protein, 351 aa, Pyrococcus horikoshii
MRRGKMHLMEFPREVILGKNLIQEINNVIKRLKLGSPGLVVYGPITKKIAGSNVEKIVKEEFEVYSITVKEAHINEVERVISKIRDKGIKWAIAVGGGSIIDVTKLASFKMGIPFISFPTTASHDGIASANASIKGLNVKTSIKAKPPIAVIADIDVIKTAPKRYLAAGVGDIVSNITAVRDWKLAHKLKGEYFSEYAASLSLMSAKMVIRDAEIIRLGQDEGIRKVVKALISSGVAMSIAGSSRPASGAEHLFSHALDMLLDKPALHGEQTGIGTIIMAYLHGINWKKIRDTLKIVGAPTTAYELGIDPEIIIEALTIAHTIRPERYTILGKEGITREAAEKAAKITGVI

SEQ ID NO: 1305 - protein, 120 aa, Pyrococcus horikoshii
MMRKLKTLPPTLRDKNRYIAFEIISDGDFTKDEVKELIWKSSLEVLGETGTAIVKPWLIKFDPNTKTGIVRCDREYVEYLRFALMLVSEFNGKRLIIRTLGVSGTIKRLKRKFLAKYGWK

SEQ ID NO: 1306 - protein, 300 aa, Pyrococcus horikoshii
MTKQKVCPVCGSTEFIYDPERGEIVCARCGYVIEENIIDMGPEWRAFDASQREKRSRTGAPESILLHDKGLSTDIGIDRSLTGLMREKMYRLRKWQSRLRVSDAAERNLAFALSELDRITAQLKLPKHVEEEAARLYREAVRKGLIRGRSIESVIAACVYAACRLLKVPRTLDEISDIARVEKKEIGRSYRFIARNLNLTPKKLFVKPTDYVNKFADELGLSEKVRRRAIEILEEAYRRGLTSGKSPAGLVAAALYIASLLEGEKRTQREVAEVARVTEVTVRNRYKELVEKLGIKVPIT

SEQ ID NO: 1307 - protein, 428 aa, Pyrococcus horikoshii
MPKEKPHVNIVFIGHVDHGKSTTIGRLLYDTGNIPETIIKKFEEMGEKGKSFKFAWVMDRLKEERERGITIDVAHTKFETPHRYITIIDAPGHRDFVKNMITGASQADAAVLVVAATDGVMPQTKEHAFLARTLGIKHIIVTINKMDMVNYDQKVFEKVKAQVEKLLKTLGYKDFPVIPTSAWNGDNVVKKSDKMPWYNGPTLIEALDQIPEPEKPIDKPLRIPIQDVYSIKGVGTVPVGRVETGKLKVGDVVIFEPASTIFHKPIQGEVKSIEMHHEPLQEALPGDNIGFNVRGVSKNDIKRGDVAGHTDKPPTVVRTKDTFKAQIIVLNHPTAITVGYSPVLHAHTAQIPVRFEQILAKVDPRTGNIVEENPQFIKTGDSAIVVLRPMKPVVLEPVKEIPQLGRFAIRDMGMTIAAGMVISIQKGE

SEQ ID NO: 1308 - protein, 438 aa, Pyrococcus horikoshii
MLILNNMKANDIIKRYSKVIAQANKMHYFPLVPVKAENAKVWDINGKEYIDFLSDAAVQNVGHNNPRVVKAVKEQVDKLMHASYIYAYPIEPLLLAEKLAEIAPIDNPKVSFGLTGGDANDAAIKFARAYTKRQTILSYMKSFYGSTYGAMSLTGLDFRVRAIVGELSGVHYLPYPYCYRCPFGKEPGSCKMECVEYIKEKFEGEVYAEGVAALFAEPIQGDSGIVVPPKNYFKKVTKILREHGILLVVDEIQSGMGRTGKWFAIEHFGVKPDIITVGKALGGGLPISATIGKAEIMDSLPPLSHAFTLSGNPTTSRAALAVIEEIEEKNLLRRAEKLGNYAMKRLREMMDKHELIGDVRGIGLMIGVELVKDRETKERAIEETSKVIERAFDLGLIVTHFSGNVLRIEPPLTIERETLDEGLDVLEKAIEDVEEGRV

SEQ ID NO: 1309 - protein, 303 aa, Pyrococcus horikoshii
MVKRMLEVKLFGIRFENPLILASGVVDMTPELLRRAHNEGAGGVVTKSIGKEPRKGYDNPTIVELPYGLINAMGLPNPGWEAFLNEFIDERFDFPVIVSIFGGTPEEFAFLAEKLEPVADAFELNLSCPHAKGYGMEIGQDPKNVYEVVKAVKDVTDKPVIAKLTPNVNDITKLGLAAERGGADGVSAINTVKAIAIDIYAKRPILSNKVGGYSGPGIKPIALRAVYDLAKVLDIPVIGIGGITSWRDAVEFLLAGASALQIGTAVYLRGFKVFKEISNGIIEYLKEEGFSSIRDIIGLALKV

SEQ ID NO: 1310 - protein, 1117 aa, Pyrococcus horikoshii
MRGPTVVEVTPDDLWIVMESYWEEKGLVRQHLDSYNAFIERGLQEVVDEFGGIKPDIPDFEVKFGKIRVGEPEFQEPHGQRKPLYPMDARIRNLTYSAPLYLEMIPVIRGIEQDPVEVRIGELPIMLKSKACRLYGLSDEELIKLGEDPKDPGGYFIINGSERVIVSIEDIAPNRTLVEKDERQEKYIAKVFSYRHGYRALVTVERKKDGILYVGIPNVPRPVKFVYVMRALGLERDKDIVDAVGNDPEVQQILFDNLEDASDITTQQEALEYIGKLVAPGQAREYRLKRAEYVIDNNLLPHMGVTPEDRIRKAYYLGMMALKVIELSLGKRDEDDKDHYANKRLRLAGDLLKDLFRVAFSQLIKDIQYQMTKTYQRRGEKYVFSNIHRFIRNSIRPDVLTERIEHALATGAWPGGRTGVSQLLDRTNYVSTLSHLRRVTSPLDREQPHFEARDLHGTHWGRICPTETPEGPNCGLVKNLALMAQITTAVPEEEVREYLMSLGIVPIEVRRPSPELWRVYLNGVLIGTVEDGKALVERIKKDRRSGKISDIINVAYYEDVKEVYVNSDDGRVRRPLIIVENGVPKLTKEHVQAIKEGRLKWSDLVRMGVIEYLDAEEEENAYVAMWPWEVTKEHTHLELMPAAILGLPASLIPYPEHNAAPRNTYGAGMAKQSLGLGWANFRIRVDTRGHLLHYPQIPLVNSRIMKAVGYEDRPAGQNFVVAVLAYHGYNMEDAIIINKASIERGLARSTFFRTYEAEEKKYLGGQTDRFEIPAPTVRGYRGEKYYRHLDEDGLIFPESKVEGKDVLIGRTSPPRFLEERGLGAVSLQERRETSVAVRPSEKGIVDKVIITETGDGTKLVKVTVRDLRIPEIGDKFASRHGQKGVIGLIVPQEDMPWTESGIVPDLIVNPHGIPSRMTVGQLLEAIGGKVAALKGRRVDGTAFIGEPEEKLRKELEELGFKHTGREIMYDGITGKRFEADIFIGIIYYQRLHHMVADKIHARSRGPVQVLTKQPTEGRAREGGLRFGEMERDVLVGHGAAMLLIERLLEESDKTEVWVCENCGHIAIEDKRRHKVYCPVCGEEERISKVEMSYAFKLLLDELKAMVIRPKLNLTERV

SEQ ID NO: 1311 - protein, 260 aa, Pyrococcus horikoshii
MAFVPPQAGYDRAITVFSPDGRLFQVNYAREAVKRGATAVGVKCNEGVVLAVEKRITSRLIEPESYEKIFQIDDHIAAASSGIIADARVLVNRARLEAQIHRLTYGEPAPLAVIVKKICDLKQMHTQYGGVRPFGAALLMAGVNEKPELYETDPSGAYFAWKAVAIGSGRNTAMAIFEEKYKDDMSLEEAIKLAIFALAKTMEKPSAENIEVAIITVKDKKFRKLSREEIEKYLNEVMKEVEEEEVKEKEEDYSELDSHY

SEQ ID NO: 1312 - protein, 422 aa, Pyrococcus horikoshii
MDMVEQDPFEIAVKQLERAAQHMKISEEALEFLKRPQRIVEVTIPVEMDDGSVKVFTGFRVQYNWARGPTKGGIRWHPEETLSTVKALAAWMTWKTAVMDLPYGGGKGGIIVDPKKLSDREKERLARGYIRAVYDIISPYEDIPAPDVYTNPQIMAWMMDEYETIARRKTPAFGIITGKPLSIGGSLGRNEATARGASYTIREAAKVLGWDGLKGKTIAIQGYGNAGYYLAKIMSEDYGMKVVAVSDSKGGIYNPDGLNADEVLKWKREHGSVKDFPGATNISNEELLELDVDVLAPAAIEEVITKKNADNIKAKIVAEVANGPVTPEADEILFEKGILQIPDFLCNAGGVTVSYFEWVQNITGYYWTLEEVRERLDKKMTKAFYDVYNTAKEKNIHMRDAAYVVAVQRVYQAMLDRGWVKH

SEQ ID NO: 1313 - protein, 418 aa, Pyrococcus horikoshii
MRIAVLGLGYIGLPTAIMFASSGYDVVGYDIRSEVIKKINSGVAHIIEPEIDRRLKEVLSLGKLKVTDRVEDLKGSNVFIICVQTPLSGDDPDLSYLERAIRTVAEVMDRGALVIIESTIPPGTTEKMARLLENLTGLREGVDFYVAHAPERVMPGRIFKELVYNSRIIGGVSEKAANLAEKLYRSFVKGRIFLTNATTAEMVKLMENTFRDVNIALANEFALLAHQYGVNVYEAIELANTHPRVKIHTPGIGVGGHCLPKDPYLLLSNAKEDFGLIRIARRINERMPAFAAGLLFEALEKANIKPSEAIIAVLGLAYKGGTDDTRNSPALKFVEIIRNSVKEVRTYDPYVRGTHDSLEKVVEGADAIVIATDHPEFKSVNWESIGKSMRHKIIIDGRNIIKEPPVGFIFRGIGRGDV

SEQ ID NO: 1314 - protein, 559 aa, Pyrococcus horikoshii
MKYIELAQLYQKLEKTTMKLIKTRLVADFLKRVPEDHLDFIPYLILGDVFPEWDERELGVGEKLLIKAVSMATGVDPKEIENSVKDTGDLGESIALAIKRRKQKSFFSQPLTIKRVYQTLVKIAETTGEGSQEKKMKYLANLFMDAEPLEAKYLARTVLGTMRTGVAEGLLRDAIALAFHVKVELVERAYMLTSDFGFVAKIAKAEGNEGLEKVTIQLGKPIKPMLAQQAANIKEALLEMGGEAEFEIKYDGARVQVHKDGEKVIIYSRRLENVTRAIPEIVEAIKEAIEPEKVIVEGELVAIGEEGRPLPFQYVLRRFRRKHNIEEMMKKIPLELNLFDVLYVDGKSFVDTKFIERRKKLEEIVKPNGKIKVAENLITKNAEEAEKFYKRALEMGHEGLMAKRLDAVYEPGNRGKKWLKIKPTMENLDLVIIGAEWGEGRRAHLFGSFILGAYDPETGEFLEVGKVGSGFTDDDLVEFTKMLKPLIVKEEGKRVVIQPKIVIEVTYQEIQKSPKYRSGFALRFPRYVALRDDKGPEDADTIERIAQLYELQERIKGKV

SEQ ID NO: 1315 - protein, 335 aa, Pyrococcus horikoshii
MVKYVLASAPAKVILFGEHSVVYGKPAIASAIELRTYVRAQFNDSGNIKIEAHDIKTPGLIVSFSEDKIYFETDYGKAAEVLSYVRYAIELALEESDKRVGIDVSITSQIPVGAGLGSSAAVAVATIGAVSRLLGLELSKEEIAKLGHKVELLVQGASSGIDPTVSAVGGFLYYKQGKFEPLPFMELPIVVGYTGSTGSTKELVAMVRKRYEEMPELVEPILEAMGKLVDKAKEIILSKLDEEEKLTKLGELMNINHGLLDALGVSTKKLGELVYAARTAGAIGAKLTGAGGGGCMYALAPGRQREVATAIKIAGGIPMITRVSREGLRIEEVSR

SEQ ID NO: 1316 - protein, 341 aa, Pyrococcus horikoshii
MSVIQNIIGRIAVLRGGKYSVEVDVATDEGFGRFTSPIDDNPMLHIAEARRAVSEVDEIIGPELIGFDASEQELIDSYLWEIDGTEDFSHIGANTALAVSTAIAKAAANSRDMPLYSYIGGTFATELPVPVLSFAQDDMFDYYLVVKDLLEVTDIIDATNKIREIVKEINLENLSKASEDVGVELGLEVALGIGMKKEMDIEKVLNLVEDYNVAYIKPIGPPELFLELIAGTHGVFIDGEYLFRTNSVLDRRYYNALSIKPINLGTLTDLYNFVNDVKAEKITPILAEAKYEPADETFPHIALGLRCPAMLISWSSIEKINELNRIAEELGERGRIITFEE

SEQ ID NO: 1317 - protein, 220 aa, Pyrococcus horikoshii
MKVAGVDEAGRGPVIGPLVIGVAVIDEKNIERLRDIGVKDSKQLTPGQREKLFSKLIDILDDYYVLLVTPKEIDERHHSMNELEAEKFVVALNSLRIKPQKIYVDSADVDPKRFASLIKAGLKYEATVIAEHKADAKYEIVSAASIIAKVTRDREIEKLKQKYGEFGSGYPSDPRTKEWLEEYYKQYGDFPPIVRRTWETARKIEERFRKNQLTLDKFLK

SEQ ID NO: 1318 - protein, 387 aa, Pyrococcus horikoshii
MPTNVTAEYLAAEEEYRNAKTIPEKIRALEKMYALVPKHKGTEKLRLQIKRRLAELRRELEKQRQQRKGGGYSLAVKKEGAAQIVLVGLPNVGKSELLRALTGVDVESADYPFTTTEPVPAMMNYKDVQIQLVEVPGLLEGAALGKGMGPQLLAVIRNADAIAIVIDLSEDPIKQMEILLREFERAGIKVNKRRPRVEIRKTPSGGIVINGAENIKGDLSEVMRMLREEKIHSAEITVKEPVTLEEFADALDDSLVWKKAIIIANKGDSPGSKENYHKLINKYGEKFKIVPVSAKKRINLEAVKEAIYDVAEIIRVFTKSPGEEPAYPPIALKRGATVMDVAERIHKDLVKNFRYARVWGKSVKFPGQRVGPDHVLEDGDIVEIHAK

SEQ ID NO: 1319 - protein, 570 aa, Pyrococcus horikoshii
MDVEKIALKHALINAIEHGGKANLKAVIGKVLGENPELRPRAKEIIPIINKVVEEVNSLARDEQLEKLKDIYPEYFEKKEEKKEKKGLPLLPKAEKGKVVTRFAPNPDGAFHLGNARAAILSYEYAKMYGGKFILRFDDTDPKVKRPEPIFYKMIIEDLEWLGIKPDEIVYASDRLEIYYKYAEELIKMGKAYVCTCPPEKFRELRDKGIPCPHRDEPVEVQLERWKKMLNGEYKEGEAVVRIKTDLNHPNPAVRDWPALRIIDNPNHPRTGNKYRVWPLYNFASAIDDHELGVTHIFRGQEHAENETRQRYIYEYFGWEYPVTIHHGRLSIEGVVLSKSKTRKGIEEGKYLGWDDPRLGTIRALRRRGILPEAIKELIIEVGLKKSDATISWENLAAINRKLVDPIANRYFFVADPIPMEVEGAPEFIAEIPLHPDHPERGVRRLKFTPERPVYVSKDDLNLLKPGNFVRLKDLFNVEILEVGDKIRARFYSFEYEIAKKNRWKMVHWVTEGRPCEVIIPEGDELVVRKGLLEKDAKVQVNEIVQFERFGFVRIDRIEGDKVIAIYAHK

SEQ ID NO: 1320 - protein, 205 aa, Pyrococcus horikoshii [sequence omitted]

SEQ ID NO: 1321 - protein, 361 aa, Pyrococcus horikoshii
MQAVLLAGGKGTRLLPLTVYRPKPMIPFFNKPLMEYMLMNLIGIGVEEIIVLVGYLKEKIIEYFGRGDKFGVEIKYSNGENIKLGTAGALKKAEKFIDDTFIVASSDVLTNLSFDSFIRFHREKGGIATMALTKVEDPTPYGVAVLDNENRILYFKEKPKREEAPSNLVNAGIYIFEPEILDLIPRGKAFDFSLDLFPKMLEEGIPIYGFPFDEYWNDVGRPSTYLQATEDVFLGKLRLPQINVGRDKGNIERGGSLFTGSKCLIRNPKIVGFAVLGNNVKVGRDVKIERSVIFSNVTIEDEVEIREAIIGENVYIGRGAVIEPGSVIGDNSVIEEYSKIGANVKIWTDSKVGRESIVLPD

SEQ ID NO: 1322 - protein, 411 aa, Pyrococcus horikoshii
MGERRKTRQAEVNIGMVGHVDHGKTTLTKALTGVWTDTHSEELRRGITIKIGFADAEIRRCPNCGRYSTSPVCPYCGHETEFVRRVSFIDAPGHEALMTTMLAGASLMDGAILVIAANEPCPRPQTREHLMALQIIGQKNIIIAQNKIELVDKEKALENYRQIKEFIKGTVAENAPIIPISALHGANIDVLVKAIEDFIPTPKRDPNKPPKMLVLRSFDVNKPGTPPEKLVGGVLGGSIVQGKLKVGDEIEIRPGIPYEEHGRIRYEPITTEIVSLQAGGQFVEEAYPGGLVGVGTKLDPYLTKGDLMAGNVVGKPGKLPPVWDSLRLEVHLLERVVGTEQELRVEPIKRKEVLLLNVGTARTMGLVTNLGKDEIEVKLQIPVCAEPGDRVAISRQIGSRWRLIGYGIIKE

SEQ ID NO: 1323 - protein, 366 aa, Pyrococcus horikoshii
MSLYRKRLKIIKGEGIYVWDDQGRRYVDLIAGIGVAILGHNHPEWVEGIREQLNKLVIAGPMFNHEEKEEMLEELSKFVNFEYLYMGNSGTEAVEAALKFARLYTGRKEIIAMVNAFHGRTMGALSATWKPKYKKDFEPLVPGFKHIPFNDVEAAKEAISKETAAVIVEPIQGESGVIPAKKEFMKALRDLTEDVGALLIVDEVQTGLRTGKFLAVEHYKIEPDIVTMGKGIGNGIPVGLTLTNFDVERGKHGSTFGGNPLACKAVAITLRILRKERLIEKAKNKFIQIDADEVVTTRGKGLMIGIVFKTTIGKYVEELQNRGYLVHTAGQRVMRLLPPLIISKETMQDVKLAIEGVINDLRGGEN

SEQ ID NO: 1324 - protein, 249 aa, Pyrococcus horikoshii
MRWVSMRVIKVGGSVLENLEKVFKPEIFRDAVVVHGGSRYVDELAKKLGLNVEKLTSPSGVTFRRTTRKVLDVYIAAVMKANRELVSFLRRQGIEAIGVSGVKEVIIGRRKKLIKAVINGKIMAIRDDYSGIIKEVNVEMIRNYMKVGVPVIAPIAYDPVENVPLNVDGDKVAYHVALALKSRELYFLSDTAFLINGEVIDKIPRNRIEEYFPYSSGGMRKKLLMAKKAIESGVERVIIEGLNGRTVIS

SEQ ID NO: 1325 - protein, 330 aa, Pyrococcus horikoshii
MIKVAIVGGSGYIGGELIRLLAMHPEVEIVAVTSREYAGKKVHKVHPNLRGLNLRFTSDYNFDADVIFLAVPHGVSMKLINEFLGSAKIIDLSADFRVRKELYEKYYGKHERPELIEDFVYGLPEIHRKEIKKAELVANPGCNATAVILALYPFKDLTKEVLVDLKVSSSAGGRRENLPSIHPERSNVVRVYKPYHHRHEAEVLQETGVRAMFTVHSVDIVRGLLATIYFTFEGNEKDLLKRMLIYKDEPFIRLVVDKGGLQRYPDPKYVLGSNFVDLGLAYDEENSRVIVFSALDNLIKGGAGQAVQNMNIMFGLDETLGLGYYPLYPV

SEQ ID NO: 1326 - protein, 323 aa, Pyrococcus horikoshii
MVKSVTDKIKFYEFEGGLSVFKKYGVPIREEDLEEIRKMDAILFGATTTPFDVPRYKSLIITLRKELDLYANLRIIPNFKLRKEIIIVRENSEGLYSGEGAYDSNKVVDFRIITRKGAERIAKFAVKLAKDRSTFLTFVHKANILESDRFFRKIVLDIARKEDVKVREEIVDSFTIKLVKDPWNLGIILSENMFGDILSDLATIHAGSIGIVPSGNYGEDIALFEPIHGSAPDIAGKGIANPIGAILSAAMMLDYLGLDGSIIWKAVGRYVRRGNLTPDMEGRATTLEVTNGIISEIYRLDEYEIDEVWRDEVRLGRILLEIS

SEQ ID NO: 1327 - protein, 582 aa, Pyrococcus horikoshii
MRNMRNNESSFSLLIRFIREALSEKKTLVVVIISIVGSAIANLASPYVLHIAIDNYIVPGKYGELWFVTLLYLLSLIGQWFFMTLQTYYTEVFGQGVLKRLRSKLHEKILISNLDFFKEKSTGDLVSRIINDTNIVNDVLVSGLLGGLGSLLSLAGIIIAMFLLDVKLTLVTLASVPLMVLVAYYFGGKMRRAYRETRQKIAKISSVVEESVAGIETIRAFGKERDVEREFSKVSLETIKAYLRVAVYMGVFWPLMNITSLLSVIAVIAYGGYLAYKGAVSIGVVVAFIQYAQRFRGPINNVVSMYDSLQSALAALERIYEILDDENVEDYNGINVERLNGEIEFRNVWFEYERGRPVLKDINLLIPSGSKVAIVGKTGAGKTTLANLIMRFYDPTKGDIFYDGIEGRKISRKSLRRRIGYVPQETYLFPGTIMENILMANPEAREEDVIRVCKELGIHEFIMKLPNGYKTSAGEAGKLLSLGERQLISLARALLKDPDIVILDEALSSVDPKTEQLVQNAMLKLMEGRTSIIIAHRLSITRFADKVIVVKDGRIIEEGPPKLLLEKKGYFYRLYTSQVQEV

SEQ ID NO: 1328 - protein, 580 aa, Pyrococcus horikoshii
MDGSLRQLERLLSYLREYRWHFIGGIGLVLLMSYTNGVIPVLIRNAIDKGIVTKKYSVAFNYGLLILLVAVFNGIFSFTGRYLLVKSAQHAVYYIRMDAFKAIQRHRMEFFDKTFSGQLISRITNDTERITRFLSFRIRMFVYSIFLIAVSLYYMIRMNVFLSLVALGTIAVVVLLNTTYATKVRPIYDKIRHQTGVIASIATGTIAGIKTIKSLSVEENIQEKFSKENENLYSLNIDAIKITALYGNAPFLILGLAMSAMLYYGGKAIIAKTLTVGELVAFLTYMLTMMWPLRALGFTIGDIQRSLAAAARLFEVIDSAPKAIDAPDAVEINDPKGEVEFRDVWLTYHTGRTVLRGVNLKVSPGEKVLIVGPPGSGKSSILKLIARFYVPDKGEVLIDGVNVKKIKTESLRRIVAYVPQEPFIFNRSIRENIALAKPDAKMDEIIRAAKIAKIHDFISSLPNGYDTIVGEKGVTLSGGQRQRIALARALLLDPKIILLDDPVSNLDAETEKRLVEDLKEILKGRTALIVSQRLSLVKLTDRVIVIKDGRIIEEGKPSELVKKGGAFSEMIRAIGEEYEK

SEQ ID NO: 1329 - protein, 306 aa, Pyrococcus horikoshii
MKNKLIVITGGAGFIGSHLAEALKDENDVIIIDNLYSGRIENIPEGVKFIRADVRDYESIAEVISEADYVFHEAAQISVKESIEDPVFTEEVNVIGTINVLRALSQGDGKLIFASSAAVYGEPKELPITEDTLTNPISPYGITKLAAEHYCRVYQSLYGIPVVILRYFNVYGPRQSSAYAGVISIFLERAIKGEPLIIFGDGKQTRDFIYVKDVVEANILVAKKRSANGRIFNVATGKETTILELAMKIIDMTSSSSSILFYPPRPGDIRRSVAKIERIKKLGFKPRYSLEEGLKETFKWFTSRTQ

SEQ ID NO: 1330 - protein, 1179 aa, Pyrococcus horikoshii
MPYIERLELKGFKSYGNKKVVILFSRGFTAIVGANGSGKSNIGDAILFVLGGLSAKAMRASRISDLIFAGSKREPPAKYAEVTIYFNNEDRGFPIDEDEVIIKRRVYPDGRSHYWLNGRRATRSEILDLLSAAMISPEGYNIILQGDITKFIKMSPLERRLIIDDISGIAEYDAKKERALQELKQAEENLAKVDILIGEVKKQLDKLEKERNDALRYLDLKEKLEKARVGLVLGEIRKIESEIRNNDERIGNIEREIERMEKRLEEIAKEIVEKENELRRIEEMIERESSSEALRLTREIGEVNSKINLARRNIEIARRELDESQLRLAKVKDELKKVMSEIEKSKGAIIRWGRRREALIKQISEKEEERNHLVVRLGEIDRTFAVAREEFDSVVKELENARRLMYEGEAEIKRLDAEKEKLRSRIAVLKAKLPGIRDEILKLRDTLDEKKAELSEIENKLSSVSNKRMKVEEEVEKKTLELQKVSKELEDAERELIRIEAQNETKSNRAVEELKRSGIPGIYGTLLELIRVRDEKYSIAVEVALGNRADNVVVEDEIVAEKAIEFLKRNKLGRLTFLPLNKIKARHVNGDVGIPVVSVIEYDPKIENAVSFALGDTVIVSSMEEARSYIGKVRMVTLKGELYERSGAITGGHYRPRGLLLDTKELKEKVENLRIMKESLEGEVNSLRVKLKALENQSFELRIRMSDVEKEISLISKDLEKLIKEEESLRSEIEDSERKIAEIDETISKKKDEVAKLKGRIERLEKRRDKLKKALENPEAREVTEKIREVEREIAKLREELSRVEGKLESLNSRLNDELIPRKASLEEEIEGLVNKINALKANINENEEALKSLTEKLEKLKKEEGEIYSRIEEQKKKKEELERKVAELREEKEKISRRIQELRIEVNTLKVRNSQLKSLLMEKNSQLKHFSKEVIKSIRDIPSDLEGLKKEIEKMEEEIKALEPVNMKAIEDFEVVERRYLELKSKRERLEAEKDSIIEFINEIEKEKKNVFMKTFDAIAKNFSELFARLSPGGSARLILENPDDPFSGGLEIEAKPAGKDVKRIEAMSGGEKALTALAFIFAIQKFKPAPFYLFDEIDAHLDDANVKRVADLIKESSKESQFIVITLRDVMMANAEKIIGVSMRDGVSKVVSLSLEKAMRILEDIRRRGEYGGNYPS

SEQ ID NO: 1331 - protein, 341 aa, Pyrococcus horikoshii
MIGVVQIPMGVAGPLKINGEYAKGEFYIPLATTEGALVASVNRGCSALTEAGGVVTTLIDDKMTRAPLIRCPNARRAREVAKWVEENLDYLQEKAVSKVTRHGKLRGVKPFIVGNNLYLRFEFETGDAMGMNMVTIASEEIMKVIEEEFPDVRYLALSGNLCVDKKPNAVNFILGRGKTVIAEAVVPRKIVEKKLKTTPELIAEVNYFKNLVGSAQAGSYGFNAHFANIVGAIFLATGQDEAQITEGAHGITIAEVTPDGDLYISITMPSLEIGTVGGGTRVPSQREALEIMGVAGGGDPPGINAKKFAEIVAGAVLAGELSLLAAIAAKHLARAHKMLGR

SEQ ID NO: 1332 - protein, 261 aa, Pyrococcus horikoshii
MNMKVLITASSRGIGFNLAKELLNKGHEVTITSSNIRNIENAYKELRELGTVHYFQADLSSKEDIKRMVKDAWDAMGRIEALIWNAPNVKCEPCMVHEARYRDWLEAALLHLVSPGYITTLLIQAWLEKKIKGVLIYLSSASVLEPMPPLLLADTARAGLVQLTKGITRAYGGKGIRAYVVLLGSFDTPGARENLAKIAEERGMSLEEIWRKEVIERTPLKRTGKWSELGALIDFLLSENAEYMMGSTILFDGAMTRGVNL

SEQ ID NO: 1333 - protein, 798 aa, Pyrococcus horikoshii
MMLMVEKKEIKLKVASAYQRDVGRGIVRIDRRSMRELGVSPGDVVEIIGTKNTAAIVWPAYPEDEGLGIIRMDGTIRKNAGVGLGDEVTIRKADVKEARKVVLAPTEPIRFGRDFVEWLHERLVGRPVVRGDYIKIGVLGQELTFVVTTTQPSGVVQITEYTDFDISEKPVKEVEKRMTTGVTYEDIGGLKDVIEKIREMIELPLKHPELFEKLGIEPPKGVLLYGPPGTGKTLLAKAVANEANAYFIAINGPEIMSKYYGESEERLREVFKEAEENAPSIIFIDEIDAIAPKRSEVTGEVEKRVVAQLLALMDGLKGRGKVIVIGATNRPDALDPALRRPGRFDREIEVGVPDKQGRKEILQIHTRGMPIEPDFRKEDVLKILEGLKKEGKFRDVIDKAIDRVMKVSEDDIPKVLKELNGELYEEVRTRLVDLLLEELAEVTHGFVGADLAALAREAAMAALRRLIKEGKIDFEAETIPREVLDELKVTRKDFYEALKMVEPSALREVLIEVPNVHWDDIGGLEEVKQELREAVEWPLKYPEAFRAYGITPPKGVLLYGPPGTGKTLLAKAVATESEANFIAVRGPEVLSKWVGESEKNIREIFRKARQAAPTVIFIDEIDAIAPRRGTDVNRVTDRLINQLLTEMDGIQENTGVVVIAATNRPDILDPALLRPGRFDRLILVPAPDEEARFEIFKVHTRSMPLADDVDLRELARRTEGYTGADIAAVCREAAMIAMRKALEKGIIKPGMKADEIKQKAKVTMKDFEEALKKIGPSVSKETMEYYRKIQEQFKQARG

SEQ ID NO: 1334 - protein, 381 aa, Pyrococcus horikoshii
MVGMKIALVSDWYYPKIGGVATHMHNLAIKLRERGHEVGIVTNNRPTGKEEELKRYGIELIKIPGIISPFLDVNLTYGLKSSEELNEFLKDFDIIHSHHAFTPLSLKALKAGKNMEKGTLLTTHSISFAHESKLWDTLGFTIPLFKSYLKYSHRIIAVSKAAKSFIEHFTSVPVLIVPNGVDDERFFPARDKEKIKAKFGLEGNVVLYVSRMSYRKGPHVLLNAFSKIEDATLVMVGNGEMLPFLKAQTKFLGIENKVVFMGYVPDDILPEVFRMADVFVLPSISSEAFGIVILEAMASGVPIIATDVGGIPEVIKENSAGLLVPPGNELKLREAIEKLLKNEELRKWYGNNGRRSVEEKYSWNKIVVKIERIYNEVLQEV

SEQ ID NO: 1335 - protein, 296 aa, Pyrococcus horikoshii
MRLDVICMGNLNYDITFILERFPEFHEKVNAKEVYTGLGGSAGNTATWLSLLGLKVGFIGSVGNDDFGRLHLEFFKKIGVDTRGIKVVDEPTGVAVMMVIGEDKRIVKYPGANRFKEVREDYLKLARHLHLSSNPLSLVEKAVTLAKNLGLTVSFDPGEMEVPKNIEEKVDILMMNEDEFKRKYGDLKNITKVKSRIAIATLNGGGALVRDQNGKVYEVRGLSAKAVDTTGGGDSFNAGFIYGFLNGWDVVSSAKLGMLLAYLTVQKVGARSAVIPLEEVKKKANELNLDLPFNSS

SEQ ID NO: 1336 - protein, 318 aa, Pyrococcus horikoshii
MNVIEVRNLRKLYPKKIPLPFRKVEWFEALKGITFRVKKGELFGLLGPNGAGKTTTIKILTTLLEPSSGEAKVLGLDVVKDAREIRKRINLVAEGERTLYWRLTAYENLRYFASIYYIPRREAEKRIEELLKMVGLWDRRNDLVMNYSRGMKQRLAIAKALINDPEVLFLDEPTLGLDVQSAVFVRELVRRLVDEEGKTVLLTTHYMNEAEELCDRIAIIDHGKIIALNTPEGLKRMVRNDTIVEVRVRNYPGVNPFGLVKVDDRNGVVILRGSLEEEEIPKLVEFLVKSNAKVLSVEVKEPTLEDVFIKLTGRGLRD

SEQ ID NO: 1337 - protein, 272 aa, Pyrococcus horikoshii
MLMLLFFANSTKSSLTESVTFLFNARLCTEYVNSSVRCERMVIHLYLLTFHLMMDEKELYEKWKRTVEMLKAEGIIKSEKVERAFLKCPRYLFVEDRYKKYAHVDEPLPIPAGQTISAPHMVAIMLEIADLKPGMNVLEVGTGSGWNAALIAEIVKGDVYSIERIPELVEFAKRNLERAGVKNVHVILGDGSKGFPPKSPYDAIIVTAGAPEIPKPLVEQLKPGGKLIIPVGSYHLWQELLEVIKREDGSIKIKNHGGVAFVPLIGEHGWRE

SEQ ID NO: 1338 - protein, 650 aa, Pyrococcus horikoshii
MNLMYIRKDLLQPRLYQELIYAKCKERNCLIVLPTGLGKTIIAMMIADYRLDKYGGKVLMLAPTKPLVLQHAETFRKFFTLPPEKIVALTGEISPNERVRAWARAKVVIATPQTIENDLLVGRISLEDVTLIIFDEAHRAVGNYAYVYIAKEYLKQAKNPHVIGLTASPGSTPEKIMEVLRNLGIEHIEYRSENSPDVKPYVQGIKFEWVKVELPELYKEVRKLLRDMLRDSLKPLAEAGLLDSTSADIPKKEILRAGQIINEEMAKGNHDLRKLLLFHAMALKLHHAIELLETQGLSALRVYLKRLYEEAKAGSTRASKELFLDKRMKKALALLIQAKELGIDHPKMEVLKGLIREQLKRKENSKIIVFTNYRETAKKVVEELMKDGIKARRFVGQASRENDRGMSQKEQKLILDAFARSEFNVLVATSVGEEGLDVPEVDLVIFYEPVPSAIRSVQRRGRTGRQKPGRVVILMAQGTRDEAYYWSSRQKEKIMRETIRMVSQMVRKERQLSLESYVKREVNEEIKEEKKETGGIKVVIDSRELRSEVVKKLKTLGIKIEVRTLDVGDYIVSEDVAIERKSANDFIQSIIDGRLFDQVKRLKEAYPRPVIIIEGQLYGIRNVHPNAIRGAIASIVLDFGVPVIFSSSSD

SEQ ID NO: 1339 - protein, 282 aa, Pyrococcus horikoshii
MNPYQNLLAHNEAFYWGLEMLRIDLSGKLAFTTASSKGIGFGVARVLARAGADVIILSRNEENLKRAKEKIKSESNVEVHYIVADLTKMEDLERTIKELKDIGDPDIFFFSTGGPKPGYFMEMSMEDWEGAVKLLLYPAVYLTKALVPGMERKGFGRIVYSTSVAIKEPIPNIALSNVVRIAMAGLVRTLAKELGPKGITVNGIMPGIIRTDRVIQLAQDRAKREGKSVEEALKEYAKPIPLGRLGEPEEIGYLVAFLASELGSYINGAMIPVDGGRLNSVF

SEQ ID NO: 1340 - protein, 287 aa, Pyrococcus horikoshii
MNKVFVIGSGAKHLEEEISKNAKILKTEIKKFPDGEKYVRILEHGEEVIVVQSTYRPQDEHLIETIIIGDALKEAGFEKLKLVVPYLAYSRQDRVTKEGEPISVRAIMKMLGLYYDELYVFDIHNPKTLDFFPGKAVNIYPAKVIAEYFRDKLENGLVLAPDRGALERAKEVANILGLEYSHFEKERISPTEVKMTPVDVNVKGRNVLIVDDIISTGGTMIRAAEILKDLGAEKVFVVATHGVFAEGAIERVSKAVDELAVTNTIPTKVSKISIVPEIMRSILEVKS

SEQ ID NO: 1341 - protein, 217 aa, Pyrococcus horikoshii
MVKAVLFDIDGTLLSEKPLIMFILPQVYDELANKLNISRMEARRIFLSEIEKRKGKYEWHDWNFFFRLFSLPFKYEDFIMKYPTKIEVFPGVVEVLKYLKERGYRLGIVTSGPRYQVLKLKVSGIYRYFDVVVTRDDVGSIKPEPRIFLAALEKLKISPKDAVMVGDSLEQDILGAKGVGMKSVWINVGGENGYNLPDFEISSILQLPEVIEDESDI

SEQ ID NO: 1342 - protein, 428 aa, Pyrococcus horikoshii
MENPYEITAIVAREILDSRGNPTVEVDVHTPIAMGRAAVPSGASTGTHEAVELRDGGKRYHGKGVRRAVENVNKIIAPELIGMDVRWQREIDKLLIELDGTENKSNLGANAILAVSLAVAKAAANSLELPLYQYLGGVNAYVLPVPLSNVINGGVHAGNELDFQEFMIMPIGASSFREAIRWVSETYHVLKRVIMGKYGKNAVNVGDEGGFAPPMKEVTEPLDALIKAIEEAGYKPGDEIALAIDAASSEFFKDGKYIVGGKEYTREELLDLYKELVSTYPIVSIEDPFHEEDWEGFVMITNELGKKIQIVGDDLFVTNPRRLKKGIELGAANALLLKVNQIGTLTEAMDAAYTAFRAGYSVIVSHRSGETEDTTIADLAVALNAGQIKTGAPARSDRNAKYNQLIRIEEELEGIAVYAGKNFRKVFF

SEQ ID NO: 1343 - protein, 1235 aa, Pyrococcus horikoshii
MILDADYITEDGKPIIRIFKKENGEFKVEYDRNFRPYIYALLRDDSAIDEIKKITAQRHGKVVRIVETEKIQRKFLGRPIEVWKLYLEHPQDVPAIRDKIREHPAVVDIFEYDIPFAKRYLIDKGLTPMEGNEKLTFLAVDIETLYHEGEEFGKGPVIMISYADEEGAKVITWKKIDLPYVEVVSSEREMIKRLIRVIKEKDPDVIITYNGDNFDFPYLLKRAEKLGIKLLLGRDNSEPKMQKMGDSLAVEIKGRIHFDLFPVIRRTINLPTYTLEAVYEAIFGKPKEKVYADEIAKAWETGEGLERVAKYSMEDAKVTYELGREFFPMEAQLARLVGQPVWDVSRSSTGNLVEWFLLRKAYERNELAPNKPDEKEYERRLRESYEGGYVKEPEKGLWEGIVSLDFRSLYPSIIITHNVSPDTLNREGCEEYDVAPKVGHRFCKDFPGFIPSLLGQLLEERQKIKKRMKESKDPVEKKLLDYRQRAIKILANSILPDEWLPIVENEKVRFVKIGDFIDREIEENAERVKRDGETEILEVKDLKALSFNRETKKSELKKVKALIRHRYSGKVYSIKLKSGRRIKITSGHSLFSVKNGKLVKVRGDELKPGDLVVVPGRLKLPESKQVLNLVELLLKLPEEETSNIVMMIPVKGRKNFFKGMLKTLYWIFGEGERPRTAGRYLKHLERLGYVKLKRRGCEVLDWESLKRYRKLYETLIKNLKYNGNSRAYMVEFNSLRDVVSLMPIEELKEWIIGEPRGPKIGTFIDVDDSFAKLLGYYISSGDVEKDRVKFHSKDQNVLEDIAKLAEKLFGKVRRGRGYIEVSGKISHAIFRVLAEGKRIPEFIFTSPMDIKVAFLKGLNGNAEELTFSTKSELLVNQLILLLNSIGVSDIKIEHEKGVYRVYINKKESSNGDIVLDSVESIEVEKYEGYVYDLSVEDNENFLVGFGLLYAHNSYYGYYGYAKARWYCKECAESVTAWGRQYIDLVRRELEARGFKVLYIDTDGLYATIPGVKDWEEVKRRALEFVDYINSKLPGVLELEYEGFYARGFFVTKKKYALIDEEGKIVTRGLEIVRRDWSEIAKETQARVLEAILKHGNVEEAVKIVKDVTEKLTNYEVPPEKLVIYEQITRPINEYKAIGPHVAVAKRLMARGIKVKPGMVIGYIVLRGDGPISKRAISIEEFDPRKHKYDAEYYIENQVLPAVERILKAFGYKREDLRWQKTKQVGLGAWIKVKKS

SEQ ID NO: 1344 - protein, 322 aa, Pyrococcus horikoshii
MVGMGKKILEVKNLKMYYFTSRGPVKAVDDVTFDLEKGEVLGLAGESGCGKSSIGFTLMGMPQPPGRIVGGSIKIDGREIVGLPEDVLRREIRWQKISMIFQGAMNALNPVYTVGYQMIEPLIYHKGMDREDALDRAMKYLELVGLDPEIVYRYPHELSGGMKQRVVIAMALLLEPDIVIADEPTTALDVVVQAQIINLMKRLKKKLGLSMIFITHDLSILAEISDRVAVMYAGKLVEIGPSEKIYYEPAHPYTQKLLAAIPRLHEDVEKLEFIPGSPPNLINPPSGCRFHPRCPYAMDKCKEEEPKMVEVDKDHYAACWLL

SEQ ID NO: 1345 - protein, 214 aa, Pyrococcus horikoshii
MPEILKIKPTRMELLKLKRRVKLAERGHKLLKEKQDALIMEFFTIYDEALSLRRELIRKMEEAFNSLRRAQVDVGALRLKEIAIGVKPNKEIEIKTRNIMGVRVPLIEVPELKRKASERGYAFVSTTSTVDMAAEKFEEVLELAIRLAEVEESLKRLGKEIEKTKRRVNALEYIIIPRMENTIKFIEQHLDEMERENFFRLKRVKAILEARQSM

SEQ ID NO: 1346 - protein, 465 aa, Pyrococcus horikoshii
MMKMSKEYSTISKIYGPLMIVEGVKGVAYGEVVEIETESGEKRKGQVLDARENMAIVQVFEGTRDLDIKTTSVRFTGETLKVPVSMDMLGRIFNGIGKPIDGGPEIIPEDRRDVHGAPLNPVARAYPRDFIQTGISAIDGMNTLVRGQKLPIFSGSGLPHNQLAAQIARQAKVLGEEESFAVVFAAMGITYEEANFFKKSFEETGAIERAVLFLNLADDPAIERIITPRMALTVAEYLAFDYDMHVLVILTDMTNYCEALREISAAREEVPGRRGYPGYMYTDLATIYERAGRIRGRKGSITQMPILTMPDDDITHPIPDLTGYITEGQIVLSRELHRKGIYPPIDVLPSLSRLMKDGIGKGKTREDHPQLAQQLYAAYAEGRSLRDLVAVVGEEALSETDKKYLEFADRFEREFVAQGYYEDRSIEETLDLGWELLSILPESELKRVKKEMIMKYHPKYRKRSS

SEQ ID NO: 1347 - protein, 964 aa, Pyrococcus horikoshii
MVAKGRIIRVTGPLVVADGMKGAKMYEVVRVGELGLIGEIIRLEGDKAVIQVYEETAGVRPGEPVVGTGASLSVELGPGLLTSIYDGIQRPLEVIREKTGDFIARGVTAPALPRDKKWHFIPKAKVGDKVVGGDIIGEVPETSIIVHKIMVPPGIEGEIVEIAEEGDYTIEEVIAKVKTPSGEIKELKMYQRWPVRVKRPYKEKLPPEVPLITGQRVIDTFFPQAKGGTAAIPGPFGSGKCVDGDTLVLTKEFGLIKIKELYEKLDGKGRKIVEGNEEWTELEKPITVYGYKDGKIVEIKATHVYKGVSSGMVEIRTRTGRKIKVTPIHRLFTGRVTKDGLILKEVMAMHVKPGDRIAVVKKIDGGEYIKLDSSNVGEIKVPEILNEELAEFLGYLMANGTLKSGIIEIYCDDESLLERVNSLSLKLFGVGGRIVQKVDGKALVIQSKPLVDVLRRLGVPEDKKVENWKVPRELLLSPSNVVRAFVNAYIKGKEEVEITLASEEGAYELSYLFAKLGIYVTISKSGEYYKVRVSRRGNLDTIPVEVNGMPKVLPYEDFRKFAKSIGLEEVAENHLQHIIFDEVIDVRYIPEPQEVYDVTTETHNFVGGNMPTLLHNTVTQHQLAKWSDAQVVIYIGCGERGNEMTDVLEEFPKLKDPKTGKPLMERTVLIANTSNMPVAAREASIYTGITIAEYFRDMGYDVALMADSTSRWAEALREISGRLEEMPGEEGYPAYLASKLAEFYERAGRVVTLGSDYRVGSVSVIGAVSPPGGDFSEPVVQNTLRVVKVFWALDADLARRRHFPAINWLTSYSLYVDAVKDWWHKNIDPEWKAMRDKAMALLQKESELQEIVRIVGPDALPERERAILLVARMLREDYLQQDAFDEVDTYCPPEKQVTMMRVLLNFYDKTMEAINRGVPLEEIAKLPVREEIGRMKFERDVSKIRSLIDKTNEQFEELFKKYGA

SEQ ID NO: 1348 - protein, 103 aa, Pyrococcus horikoshii
MKVVIMGDSDTVVGFRLAGIHEAYEFDLSELSIERARNKLKELVERDDVGIILITERLAQKIGELPQVNLPIILQIPDKFGSIYGEELLREIVRRAVGIEVKR

SEQ ID NO: 1349 - protein, 198 aa, Pyrococcus horikoshii
MNGAELIIQEINKEAERKIEYILNEARQQAEKIKEEARRNAEAKAEWIIRRAKTQAELEKQRIIANARLEVRRKRLAIQEEIISSVLEEVKRRLETMSEDEYFESVKALLKEAIKELNEKKVRVMSNEKTLGLIASRIEEIKSELGDVSIELGETVDTMGGVIVETEDGRIRIDNTFEARMERFEGEIRSTIAKVLFG

SEQ ID NO: 1350 - protein, 593 aa, Saccharomyces cerevisiae
MYSIVKEIIVDPYKRLKWGFIPVKRQVEDLPDDLNSTEIVTISNSIQSHETAENFITTTSEKDQLHFETSSYSEHKDNVNVTRSYEYRDEADRPWWRFFDEQEYRINEKERSHNKWYSWFKQGTSFKEKKLLIKLDVLLAFYSCIAYWVKYLDTVNINNAYVSGMKEDLGFQGNDLVHTQVMYTVGNIIFQLPFLIYLNKLPLNYVLPSLDLCWSLLTVGAAYVNSVPHLKAIRFFIGAFEAPSYLAYQYLFGSFYKHDEMVRRSAFYYLGQYIGILSAGGIQSAVYSSLNGVNGLEGWRWNFIIDAIVSVVVGLIGFYSLPGDPYNCYSIFLTDDEIRLARKRLKENQTGKSDFETKVFDIKLWKTIFSDWKIYILTLWNIFCWNDSNVSSGAYLLWLKSLKRYSIPKLNQLSMITPGLGMVYLMLTGIIADKLHSRWFAIIFTQVFNIIGNSILAAWDVAEGAKWFAFMLQCFGWAMAPVLYSWQNDICRRDAQTRAITLVTMNIMAQSSTAWISVLVWKTEEAPRYLKGFTFTACSAFCLSIWTFVVLYFYKRDERNNAKKNGIVLYNSKHGVEKPTSKDVETLSVSDEK

SEQ ID NO: 1351 - protein, 102 aa, Saccharomyces cerevisiae
MLSLVKRSILHSIPITRHILPIQLILVKMNHVQIRNIKLYHFISYGFMLTKLTVFLFNLFFYRLRILCRLTLLILSLPVQIYIKEIQTKMLEKHTASDTSCI

SEQ ID NO: 1352 - protein, 108 aa, Saccharomyces cerevisiae
MRYTATFRPLQRFVMNPFASLEGQDNISSVFFLHMQQFESQVKDRFRFPIFRLERKTFGNSCYQVETLKVKCRPRHAKSCNLLTLLFKSRTQSVLVPNFGFLILNSEP

SEQ ID NO: 1353 - protein, 1322 aa, Saccharomyces cerevisiae
MSLAHYCLLLAIVTLLGLTNVVSATTAACLPANSRKNGMNVNFYQYSLRDSSTYSNAAYMAYGYASKTKLGSVGGQTDISIDYNIPCVSSSGTFPCPQEDLYGNWGCKGIGACSNNPIIAYWSTDLFGFYTTPTNVTLEMTGYFLPPQTGSYTFKFATVDDSAILSVGGSIAFECCAQEQPPITSTNFTINGIKPWNGSPPDNITGTVYMYAGFYYPMKIVYSNAVAWGTLPISVTLPDGTTVSDDFEGYVYTFDNNLSQPNCTIPDPSNYTVSTTITTTEPWTGTFTSTSTEMTTVTGTNGVPTDETVIVIRTPTTASTIITTTEPWNSTFTSTSTELTTVTGTNGVRTDETIIVIRTPTTATTAITTTEPWNSTFTSTSTELTTVTGTNGLPTDETIIVIRTPTTATTAMTTTQPWNDTFTSTSTELTTVTGTNGLPTDETIIVIRTPTTATTAMTTTQPWNDTFTSTSTELTTVTGTNGLPTDETIIVIRTPTTATTAMTTTQPWNDTFTSTSTEITTVTGTNGLPTDETIIVIRTPTTATTAMTTTQPWNDTFTSTSTEMTTVTGTNGLPTDETIIVIRTPTTATTAITTTEPWNSTFTSTSTEMTTVTGTNGLPTDETIIVIRTPTTATTAITTTQPWNDTFTSTSTEMTTVTGTNGLPTDETIIVIRTPTTATTAMTTTQPWNDTFTSTSTEITTVTGTNGLPTDETIIVIRTPTTATTAMTTTQPWNDTFTSTSTEMTTVTGTNGVPTDETVIVIRTPTSEGLISTTTEPWTGTFTSTSTEMTTVTGTNGQPTDETVIVIRTPTSEGLVTTTTEPWTGTFTSTSTEMTTITGTNGQPTDETVIIVKTPTTAISSSLSSSSGQITSFITSARPIITPFYPSNGTSVISSSVISSSDTSSLVISSSVTSSLVTSSPVISSSFISSPVISSTTTSASILSESSKSSVIPTSSSTSGSSESETGSASSASSSSSISSESPKSTYSSSSLPPVTSATTSQEITSSLPPVTTTKTSEQTTLVTVTSCESHVCTESISSAIVSTATVTVSGATTEYTTWCPISTTEITKQTTETTKQTKGTTEQTTETTKQTTVVTISSCESDVCSKTASPAIVSTSTATINGVTTEYTTWCPISTTESKQQTTLVTVTSCGSGVCSETTSPAIVSTATATVNDVVTVYSTWRPQTTNEQSVSSKMNSATSETTTNTGAAETTTSTGAAETKTVVTSSISRFNHAETQTASATDVIGHSSSVVSVSETGNTKSLTSSGLSTMSQQPRSTPASSMVGSSTASLEISTYAGSANSLLAGSGLSVFIASLLLAII

SEQ ID NO: 1354 - protein, 457 aa, Saccharomyces cerevisiae
MTSEPEFQQAYDEIVSSVEDSKIFEKFPQYKKVLPIVSVPERIIQFRVTWENDNGEQEVAQGYRVQFNSAKGPYKGGLRFHPSVNLSILKFLGFEQIFKNALTGLDMGGGKGGLCVDLKGKSDNEIRRICYAFMRELSRHIGKDTDVPAGDIGVGGREIGYLFGAYRSYKNSWEGVLTGKGLNWGGSLIRPEATGFGLVYYTQAMIDYATNGKESFEGKRVTISGSGNVAQYAALKVIELGGIVVSLSDSKGCIISETGITSEQIHDIASAKIRFKSLEEIVDEYSTFSESKMKYVAGARPWTHVSNVDIALPCATQNEVSGDEAKALVASGVKFVAEGANMGSTPEAISVFETARSTATNAKDAVWFGPPKAANLGGVAVSGLEMAQNSQKVTWTAERVDQELKKIMINCFNDCIQAAQEYSTEKNTNTLPSLVKGANIASFVMVADAMLDQGDVF

SEQ ID NO: 1355 - protein, 417 aa, Saccharomyces cerevisiae
MRALAYFGKGNIRFTNHLKEPHIVAPDELVIDIEWCGICGTDLHEYTDGPIFFPEDGHTHEISHNPLPQAMGHEMAGTVLEVGPGVKNLKVGDKVVVEPTGTCRDRYRWPLSPNVDKEWCAACKKGYYNICSYLGLCGAGVQSGGFAERVVMNESHCYKVPDFVPLDVAALIQPLAVCWHAIRVCEFKAGSTALIIGAGPIGLGTILALNAAGCKDIVVSEPAKVRRELAEKMGARVYDPTAHAAKESIDYLRSIADGGDGFDYTFDCSGLEVTLNAAIQCLTFRGTAVNLAMWGHHKIQFSPMDITLHERKYTGSMCYTHHDFEAVIEALEEGRIDIDRARHMITGRVNIEDGLDGAIMKLINEKESTIKIILTPNNHGELNREADNEKKEISELSSRKDQERLRESINEAKLRHT

SEQ ID NO: 1356 - protein, 382 aa, Saccharomyces cerevisiae
MRALAYFKKGDIHFTNDIPRPEIQTDDEVIIDVSWCGICGSDLHEYLDGPIFMPKDGECHKLSNAALPLAMGHEMSGIVSKVGPKVTKVKVGDHVVVDAASSCADLHCWPHSKFYNSKPCDACQRGSENLCTHAGFVGLGVISGGFAEQVVVSQHHIIPVPKEIPLDVAALVEPLSVTWHAVKISGFKKGSSALVLGAGPIGLCTILVLKGMGASKIVVSEIAERRIEMAKKLGVEVFNPSKHGHKSIEILRGLTKSHDGFDYSYDCSGIQVTFETSLKALTFKGTATNIAVWGPKPVPFQPMDVTLQEKVMTGSIGYVVEAFEEVVRAIHNGDIAMEDCKQLITGKQRIEDGWEKGFQELMDHKESNVKILLTPNNHGEMK

SEQ ID NO: 1357 - protein, 212 aa, Saccharomyces cerevisiae
MWEQRRQKVVFSLTILVRYRLKQSMAKKISKNSRAARQSDALEPEVKDLSELPRAEKTDLTNILIRTAAKNEALLEAKISKKANKSKRGKKLNKKALEDKLDNSISSMDRDRLVKALNFTNRLDGKIAKSISRAKYIQNTRKAGWDSTNETIKKELAFLNGGLSVQAKSASEGNAEKEDEEIPEVFDSLAEDNTVQKTPTNRFGVLPDDVEE

SEQ ID NO: 1358 - protein, 502 aa, Saccharomyces cerevisiae
MKFSAYLWWLFLNLALVKGTSLLSNVTLAEDSFWEHFQAYTNTKHLNQEWITSEAVNNEGSKIYGAQWRLSQGRLQGSAWDKGIAVRTGNAAAMIGHLLETPINVSETDTLVVQYEIKLDNSLTCGGAFIKLMSGFMNVEALKHYAPDTEGVELVFGPDYCAPEINGVQFAINKVDKITHESKLRYLQEMPLSKLTDTSQSHLYTLIIDESAQSFQILIDGKTVMVREHIEDKKKVNFEPPITPPLMIPDVSVAKPHDWDDRIRIPDPEAVKLSDRDERDPLMIPHPDGTEPPEWNSSIPEYILDPNAQKPSWWKELEHGEWIPPMIKNPLCTAERGCGQQIPGLINNAKYKGPGELNEIINPNYMGEWHPPEIENPLYYEEQHPLRIENVISGVILEFWSGSPNMLISNIYVGKNVTEAQIIGNKTWLMRDRAFRGSDGPTERKFMNSRLGNLQTTFHNERESPNPFDRIIDRILEQPLKFVLTAAVVLLTTSVLCCVVFT

SEQ ID NO: 1359 - protein, 847 aa, Saccharomyces cerevisiae
MEISSSPWNDGGYSPYERNRVAVSPFSSALEGEERIETSRSLGDHCFEPLPYVTNYLSIFALFGKEIFGDKGNVSSRNEYLLKKYYSLKKPFVLRHNGHALKNPDMPLQRNDILQTNFMVDKFLNRTVRSVNFNNFKIISDMQSKSGRGTKSGTNQNQSADAIQNICLPSIPSALPYFQYYRKLLTVNTKEWDILKLHSLWVPKLRKDFKDFSLYGDKNSLKPIDSHYDEDNTMKKNLFFERSPSRQTLDGKGCASKGYDISSGNMIIPSLFSEDKLPALTYHCSVELNGNIYIFGGLMPCYSYEEDAPMLNDFFVDGIKNLPPPLLPQVINNPSMVNNPHLYVASIPSCRFSKPKMGGYIPPPLLCVQGSKLTDRHIFFYGGFEIRTETRGDENGKYHLKKRLYVNNTGYILDIMSFKFTKIDIIVQPSKYNAYPTMSSRFGHLQISIDNPNRRASVHSSSMNEIHKMGSASMKQGSSITSGRLEKAAVLSSLPHNTVHTVIIFGGYRQTGDDRYEAMNDLWKIEIPVIRRGKKGYCKFSETANAILLTPSEKDKSDWPEERAFSAFSVHGTSLMDRSSLDMRLLNNLKNHFVLKPSYISQDRVVSPKPVFPMMVHGTHQDLFNSGSAAQESPKAGASASSASAASFDPDMDDNLENYIINPGRKSSSIPMTAIGRQRLILSQEKPVGKTVVLHGGSNGLNVLDDMWLMDLECETWTPIETFAKADSSEDGDEKLDSVNVGLVGHRMESIGRICVCIGGMVQEDVDQFYSENDDEPPRKRKVDTLPLGGNFLNTIDLSTQFWEEHKITLSKKAADEDRQDSENEDTNSNIVVGVGGTSFNVTKVLF

SEQ ID NO: 1360 - protein, 180 aa, Saccharomyces cerevisiae
MPPPSRSRINKTRTLGIVGTAIAVLVTSYYIYQKVTSAKEDNGARPPEGDSVKENKKARKSKCIIMSKSIQGLPIKWEEYAADEVVLLVPTSHTDGSMKQAIGDAFRKTKNEHKIIYCDSMDGLWSCVRRLGKFQCILNSRDFTSSGGSDAAVVPEDIGRFVKFVVDSDVEDVLIDTLCN

SEQ ID NO: 1361 - protein, 713 aa, Saccharomyces cerevisiae
MSPSAVQSSKLEEQSSEIDKLKAKMSQSAATAQQKKEHEYEHLTSVKIVPQRPISDRLQPAIATHYSPHLDGLQDYQRLHKESIEDPAKFFGSKATQFLNWSKPFDKVFIPDPKTGRPSFQNNAWFLNGQLNACYNCVDRHALKTPNKKAIIFEGDEPGQGYSITYKELLEEVCQVAQVLTYSMGVRKGDTVAVYMPMVPEAIITLLAISRIGAIHSVVFAGFSSNSLRDRINDGDSKVVITTDESNRGGKVIETKRIVDDALRETPGVRHVLVYRKTNNPSVAFHAPRDLDWATEKKKYKTYYPCTPVDSEDPLFLLYTSGSTGAPKGVQHSTAGYLLGALLTMRYTFDTHQEDVFFTAGDIGWITGHTYVVYGPLLYGCATLVFEGTPAYPNYSRYWDIIDEHKVTQFYVAPTALRLLKRAGDSYIENHSLKSLRCLGSVGEPIAAEVWEWYSEKIGKNEIPIVDTYWQTESGSHLVTPLAGGVTPMKPGSASFPFFGIDAVVLDPNTGEELNTSHAEGVLAVKAAWPSFARTIWKNHDRYLDTYLNPYPGYYFTGDGAAKDKDGYIWILGRVDDVVNVSGHRLSTAEIEAAIIEDPIVAECAVVGFNDDLTGQAVAAFVVLKNKSSWSTATDDELQDIKKHLVFTVRKDIGPFAAPKLIILVDDLPKTRSGKIMRRILRKILAGESDQLGDVSTLSNPGIVRHLIDSVKL

SEQ ID NO: 1362 - protein, 783 aa, Saccharomyces cerevisiae
MIFLNTFARCLLTCFVLCSGTARSSDTNDTTPASAKHLQTTSLLTCMDNSQLTASFFDVKFYPDNNTVIFDIDATTTLNGNVTVKAELLTYGLKVLDKTFDLCSLGQVSLSPLSAGRIDVMSTQVIESSITKQFPGIAYTIPDLDAQVRVVAYAQNDTEFETPLACVQAILSNGKTVQTKYAAWPIAAISGVGVLTSGFVSVIGYSATAAHIASNSISLFIYFQNLAITAMMGVSRVPPIAAAWTQNFQWSMGIINTNFMQKIFDWYVQATNGVSNVVVANKDVLSISVQKRAISMASSSDYNFDTILDDSDLYTTSEKDPSNYSAKILVLRGIERVAYLANIELSNFFLTGIVFFLFFLFVVVVSLIFFKALLEVLTRARILKETSNFFQYRKNWGSIIKGTLFRLSIIAFPQVSLLAIWEFTQVNSPAIVVDAVVILLIITGLLVYGTIRVFIKGRESLRLYKNPAYLLYSDTYFLNKFGFLYVQFKADKFWWLLPLLSYAFLRSLFVAVLQNQGKAQAMIIFVIELAYFVCLCWIRPYLDKRTNVFNIAIHLVNLINAFFFLFFSNLFKQPAVVSSVMAVILFVLNAVFALFLLLFTIVTCTLALLHRNPDVRYQPMKDDRVSFIPKIQNDFDGKNKIDPELFELRKAVMDTNENEEEKMFRDDTFGKNLNANTNTARLFDDETSSSSFKQNSSPFDASEVTEQPVQPTSAVMGTGGSFLSPQYQRASSASRTNLAPNNTSTSSLMKPESSLYLGNSNKSYSHFNNNGSNENARNNNPYL

SEQ ID NO: 1363 - protein, 1062 aa, Saccharomyces cerevisiae
MVENSTQKAPHAGNDDNSSTKPYSEAFFLGFNNPTPGLEAEHSSTSPAPENSETHNRKRNRILFVCQACWKSKTKCDREKPECGRCVKHGLKCVYDVSKQPAPRIPSKDAIISRLEKDMFYWKDKAMKLLTEREVNESGKRSASPINTNNASGDSPDTKKQHKMEPIYEQSGNGDINNGTRNDIEINLYRSHPTMIMSKVMKREVKPLSENYIIIQDCFLKILVTSVFLDTSKNTMIPALTANANITRAQPSVANNLLKLKEMLIRQCQTEDEKNRVNEFTDRILQNTNSNRNLKIGMLLSMLYNSVGYQYLEDHCPQGGEYSDLLRNLINECEAILPSYEIIERYKNHFYEYVYPSLPFIELEIFEESLSQTIFPDPNNPSKVQIRMGSTHLRAKVENLSLLLVILKLSYMSIRFLDHSTADSSFYLSKEIIDKYPIPNDFILLSPRCLASENWCACANENIISCLLYIWSFFAFSPEEGDFFLEHPTDVISSLIMMLSTSIGLHRDPSDFPQLISPSTSDKRTLNHRRILWLSIVTVCSFEASLKGRHSVSPISLMALFLNIKDPDSLTVYMNRVRGDLSDINNHTLLRIHKFTFKRAQLALLLSDLDNLTMTYYGSFHLHSIEFIREKIEIFVEENFPIVPLKSVAQDKSDLDDMNVISEMNILSSENSSSFHNRIMNKLLMLRTSMAVFLHFETLITKDKSIFPFYKKYFMVSCMDALSLINYFNKFFNGEYRHAISSLTSFNVTKFIQLALSSTIFSLLGIILRIGLAIHMLSSEVQKLSGTTDPRIKELNTKVEKFSTLQRDLESALEGIYCSASEHLRFTYFPVFKMLALFDVIVQRMRKGELWHGIFTMIQMEQMHSRIIKTLSITLGVKLDKKDRLLEELMACNHVANFSVEDIDELNRNIKKEIQISSGLKPPVNTIDLTNGEPFGNAVPTFTKTWSSSLDNLEKLSSAAAVGQSLDYNSGLRQGPLAGGGSKEQTPIAGMNNLNNSINATPIVDNSSGSQLPNGFDRGQANNTPFPGYFGGLDLFDYDFLVWAMTLLKNFLSKLLPIHFIN

SEQ ID NO: 1364 - protein, 246 aa, Saccharomyces cerevisiae
MASNQPGKCCFEGVCHDGTPKGRREEIFGLDTYAAGSTSPKEKVIVILTDVYGNKFNNVLLTADKFASAGYMVFVPDILFGDAISSDKPIDRDAWFQRHSPEVTKKIVDGFMKLLKLEYDPKFIGVVGYCFGAKFAVQHISGDGGLANAAAIAHPSFVSIEEIEAIDSKKPILISAAEEDHIFPANLRHLTEEKLKDNHATYQLDLFSGVAHGFAARGDISIPAVKYAKEKVLLDQIYWFNHFSNV

SEQ ID NO: 1365 - protein, 662 aa, Saccharomyces cerevisiae
MTKETIRVVICGDEGVGKSSLIVSLTKAEFIPTIQDVLPPISIPRDFSSSPTYSPKNTVLIDTSDSDLIALDHELKSADVIWLVYCDHESYDHVSLFWLPHFRSLGLNIPVILCKNKCDSISNVNANAMVVSENSDDDIDTKVEDEEFIPILMEFKEIDTCIKTSAKTQFDLNQAFYLCQRAITHPISPLFDAMVGELKPLAVMALKRIFLLSDLNQDSYLDDNEILGLQKKCFNKSIDVNELNFIKDLLLDISKHDQEYINRKLYVPGKGITKDGFLVLNKIYAERGRHETTWAILRTFHYTDSLCINDKILHPRLVVPDTSSVELSPKGYRFLVDIFLKFDIDNDGGLNNQELHRLFKCTPGLPKLWTSTNFPFSTVVNNKGCITLQGWLAQWSMTTFLNYSTTTAYLVYFGFQEDARLALQVTKPRKMRRRSGKLYRSNINDRKVFNCFVIGKPCCGKSSLLEAFLGRSFSEEYSPTIKPRIAVNSLELKGGKQYYLILQELGEQEYAILENKDKLKECDVICLTYDSSDPESFSYLVSLLDKFTHLQDLPLVFVASKADLDKQQQRCQIQPDELADELFVNHPLHISSRWLSSLNELFIKITEAALDPGKNTPGLPEETAAKDVDYRQTALIFGSTVGFVALCSFTLMKLFKSSKFSK

SEQ ID NO: 1366 - protein, 622 aa, Saccharomyces cerevisiae
MVRRWIPSGRHLRNNDNTGDDDDSEFTNSMDSGMSIPSLRDSMTTRSSHNDPIKPALMNDSNKVKNLEKELTNAKIKIQVLYEYIRRIPNKDGNAPSLGNDTDFRNSIIEGLNLEINKLKQDLKAKEVEYQDTLQFVQENLENSESIVNTINHLLSFILTHFNEQDENAHLLDKEERETLEETLELSSDYVLEKMDTLSKFIIQFLQDFLHSKSRAESKQDKEEFLSLAQSSPAGSQLESRDSPSSKEENTDGGYQNDEIHDSNNHIDTENVMANSTSLPISAVESRFEKTLDTQLEIVIEILHKEYDQFINSIRLKFEKSQKLEKIIASKLNEQSHLLDSLELEENSSSVIEKQDHLISQLKEKIESQSVLINNLEKLKEDIIKMKQNEKVLTKELETQTKINKLKENNWDSYINDLEKQINDLQIDKSEEFHVIQNQLDKLDLENYQLKNQLNTLDNQKLILSQYESNFIKFNQNLLLHLDSIFNILQKILQESSIAQFDRKMKSIKSVPNALKNLNLIQPKLESLYTFIETALESIINSYISSLISMETPEQPHQQGNELTATPNKELTLRIEELQRRWISERERRKLDANASEARIKALEQENESLRSKLFNLSINNP

SEQ ID NO: 1367 - protein, 118 aa, Saccharomyces cerevisiae
MKLPQTMLRSISVKHVRWPRILTGSKLWYSTQMAMTPEEKMITDKLQQELEPEVCKVQDVSGGCGSMFAINITSKKFNGLSLIKQHQLVNRILRDDISRWHGLQLTTKKSTGKGPASS

SEQ ID NO: 1368 - protein, 102 aa, Saccharomyces cerevisiae
MDTVRLSHLVLQEGINHTMALWKFQAFELFTDHLNPEMCLSRDISLYTSMALMLVRIVVEAKRKVLVIWKAAFQSLQDGTCHGTICAHCSLEHYSLSTFVCC

SEQ ID NO: 1369 - protein, 177 aa, Saccharomyces cerevisiae
MKHTTSTMLRTTRLWTTRMPAVSKLFLRNSSGNALNKNKLPFLYSSQGPQAVRYTSQHEWIAVHQDKTAFVGITKYATDSLGDATYVELPEVGTEISQGESLGSIESVKSASEIYQPADGTVEEINTNLEENPGVVNEDPMGDGWLVKMKLGEGVNVEQVEGLMSLEQYEKTLVHDD

SEQ ID NO: 1370 - protein, 785 aa, Saccharomyces cerevisiae [sequence omitted]

SEQ ID NO: 1371 - protein, 415 aa, Saccharomyces cerevisiae
MKRSTLLSLDAFAKTEEDVRVRTRAGGLITLSCILTTLFLLVNEWGQFNSVVTRPQLVVDRDRHAKLELNMDVTFPSMPCDLVNLDIMDDSGEMQLDILDAGFTMSRLNSEGRPVGDATELHVGGNGDGTAPVNNDPNYCGPCYGAKDQSQNENLAQEEKVCCQDCDAVRSAYLEAGWAFFDGKNIEQCEREGYVSKINEHLNEGCRIKGSAQINRIQGNLHFAPGKPYQNAYGHFHDTSLYDKTSNLNFNHIINHLSFGKPIQSHSKLLGNDKRHGGAVVATSPLDGRQVFPDRNTHFHQFSYFAKIVPTRYEYLDNVVIETAQFSATFHSRPLAGGRDKDHPNTLHVRGGIPGMFVFFEMSPLKVINKEQHGQTWSGFILNCITSIGGVLAVGTVMDKLFYKAQRSIWGKKSQ

SEQ ID NO: 1372 - protein, 854 aa, Saccharomyces cerevisiae
MAIQTRFASGTSLSDLKPKPSATSISIPMQNVMNKPVTEQDSLFHICANIRKRLEVLPQLKPFLQLAYQSSEVLSERQSLLLSQKQHQELLKSNGANRDSSDLAPTLRSSSISTATSLMSMEGISYTNSNPSATPNMEDTLLTFSMGILPITMDCDPVTQLSQLFQQGAPLCILFNSVKPQFKLPVIASDDLKVCKKSIYDFILGCKKHFAFNDEELFTISDVFANSTSQLVKVLEVVETLMNSSPTIFPSKSKTQQIMNAENQHRHQPQQSSKKHNEYVKIIKEFVATERKYVHDLEILDKYRQQLLDSNLITSEELYMLFPNLGDAIDFQRRFLISLEINALVEPSKQRIGALFMHSKHFFKLYEPWSIGQNAAIEFLSSTLHKMRVDESQRFIINNKLELQSFLYKPVQRLCRYPLLVKELLAESSDDNNTKELEAALDISKNIARSINENQRRTENHQVVKKLYGRVVNWKGYRISKFGELLYFDKVFISTTNSSSEPEREFEVYLFEKIIILFSEVVTKKSASSLILKKKSSTSASISASNITDNNGSPHHSYHKRHSNSSSSNNIHLSSSSAAAIIHSSTNSSDNNSNNSSSSSLFKLSANEPKLDLRGRIMIMNLNQIIPQNNRSLNITWESIKEQGNFLLKFKNEETRDNWSSCLQQLIHDLKNEQFKARHHSSTSTTSSTAKSSSMMSPTTTMNTPNHHNSRQTHDSMASFSSSHMKRVSDVLPKRRTTSSSFESEIKSISENFKNSIPESSILFRISYNNNSNNTSSSEIFTLLVEKVWNFDDLIMAINSKISNTHNNNISPITKIKYQDEDGDFVVLGSDEDWNVAKEMLAENNEKFLNIRLY

SEQ ID NO: 1373 - protein, 580 aa, Saccharomyces cerevisiae
MAILKDTIIRYANARYATASGTSTATAASVSAASCPNLPLLLQKRRAIASAKSKNPNLVKRELQAHHSAISEYNNDQLDHYFRLSHTERPLYNLTNFNSQPQVNPKMRFLIFDFIMYCHTRLNLSTSTLFLTFTILDKYSSRFIIKSYNYQLLSLTALWISSKFWDSKNRMATLKVLQNLCCNQYSIKQFTTMEMHLFKSLDWSICQSATFDSYIDIFLFQSTSPLSPGVVLSAPLEAFIQQKLALLNNAAGTAINKSSSSQGPSLNINEIKLGAIMLCELASFNLELSFKYDRSLIALGAINLIKLSLNYYNSNLWENINLALEENCQDLDIKLSEISNTLLDIAMDQNSFPSSFKSKYLNSNKTSLAKSLLDALQNYCIQLKLEEFYRSQELETMYNTIFAQSFDSDSLTCVYSNATTPKSATVSSAATDYFSDHTHLRRLTKDSISPPFAFTPTSSSSSPSPFNSPYKTSSSMTTPDSASHHSHSGSFSSTQNSFKRSLSIPQNSSIFWPSPLTPTTPSLMSNRKLLQNLSVRSKRLFPVRPMATAHPCSAPTQLKKRSTSSVDCDFNDSSNLKKTR

SEQ ID NO: 1374 - protein, 269 aa, Saccharomyces cerevisiae
MGWFWADQKTTGKDIGGAAVSSMSGCPVMHESSSSSPPSSECPVMQGDNDRINPLNNMPELAASKQPGQKMDLPVDRTISSIPKSPDSNEFWEYPSPQQMYNAMVRKGKIGGSGEVAEDAVESMVQVHNFLNEGCWQEVLEWEKPHTDESHVQPKLLKFMGKPGVLSPRARWMHLCGLLFPSHFSQELPFDRHDWIVLRGERKAEQQPPTFKEVRYVLDFYGGPDDENGMPTFHVDVRPALDSLDNAKDRMTRFLDRMISGPSSSSSAP

SEQ ID NO: 1375 - protein, 500 aa, Saccharomyces cerevisiae
MSRLERLTSLNVVAGSDLRRTSIIGTIGPKTNNPETLVALRKAGLNIVRMNFSHGSYEYHKSVIDNARKSEELYPGRPLAIALDTKGPEIRTGTTTNDVDYPIPPNHEMIFTTDDKYAKACDDKIMYVDYKNITKVISAGRIIYVDDGVLSFQVLEVVDDKTLKVKALNAGKICSHKGVNLPGTDVDLPALSEKDKEDLRFGVKNGVHMVFASFIRTANDVLTIREVLGEQGKDVKIIVKIENQQGVNNFDEILKVTDGVMVARGDLGIEIPAPEVLAVQKKLIAKSNLAGKPVICATQMLESMTYNPRPTRAEVSDVGNAILDGADCVMLSGETAKGNYPINAVTTMAETAVIAEQAIAYLPNYDDMRNCTPKPTSTTETVAASAVAAVFEQKAKAIIVLSTSGTTPRLVSKYRPNCPIILVTRCPRAARFSHLYRGVFPFVFEKEPVSDWTDDVEARINFGIEKAKEFGILKKGDTYVSIQGFKAGAGHSNTLQVSTV

SEQ ID NO: 1376 - protein, 267 aa, Saccharomyces cerevisiae
MDMEIEDSSPIDDLKLQKLDTNVYFGPCEILTQPILLQYENIKFIIGVNLSTEKIASFYTQYFRNSNSVVVNLCSPTTAAVATKKAAIDLYIRNNTILLQKFVGQYLQMGKKIKTSLTQAQTDTIQSLPQFCNSNVLSGEPLVQYQAFNDLLALFKSFSHFGNILVISSHSYDCALLKFLISRVMTYYPLVTIQDSLQYMKATLNISISTSDEFDILNDKELWEFGQTQEILKRRQTSSVKRRCVNLPENSTIDNRMLMGTTKRGRF

SEQ ID NO: 1377 - protein, 369 aa, Saccharomyces cerevisiae
MSTTVEKIKAIEDEMARTQKNKATSFHLGQLKAKLAKLRRELLTSASSGSGGGAGIGFDVARTGVASVGFVGFPSVGKSTLLSKLTGTESEAAEYEFTTLVTVPGVIRYKGAKIQMLDLPGIIDGAKDGRGRGKQVIAVARTCNLLFIILDVNKPLHHKQIIEKELEGVGIRLNKTPPDILIKKKEKGGISITNTVPLTHLGNDEIRAVMSEYRINSAEIAFRCDATVDDLIDVLEASSRRYMPAIYVLNKIDSLSIEELELLYRIPNAVPISSGQDWNLDELLQVMWDRLNLVRIYTKPKGQIPDFTDPVVLRSDRCSVKDFCNQIHKSLVDDFRNALVYGSSVKHQPQYVGLSHILEDEDVVTILKK

SEQ ID NO: 1378 - protein, 1002 aa, Saccharomyces cerevisiae
MAKKSKKNQQNYWDEEFEEDAAQNEEISATPTPNPESSAGADDTSREASASAEGAEAIEGDFMSTLKQSKKKQEKKVIEEKKDGKPILKSKKEKEKEKKEKEKQKKKEQAARKKAQQQAQKEKNKELNKQNVEKAAAEKAAAEKSQKSKGESDKPSASAKKPAKKVPAGLAALRRQLELKKQLEEQEKLEREEEERLEKEEEERLANEEKMKEEAKAAKKEKEKAKREKRKAEGKLLTRKQKEEKKLLERRRAALLSSGNVKVAGLAKKDGEENKPKKVVYSKKKKRTTQENASEAIKSDSKKDSEVVPDDELKESEDVLIDDWENLALGDDDEEGTNEETQESTASHENEDQNQGEEEEEGEEEEEEEEERAHVHEVAKSTPAATPAATPTPSSASPNKKDLRSPICCILGHVDTGKTKLLDKIRQTNVQGGEAGGITQQIGATYFPIDAIKAKTKVMAEYEKQTFDVPGLLVIDTPGHESFSNLRSRGSSLCNIAILVIDIMHGLEQQTIESIKLLRDRKAPFVVALNKIDRLYDWKAIPNNSFRDSFAKQSRAVQEEFQSRYSKIQLELAEQGLNSELYFQNKNMSKYVSIVPTSAVTGEGVPDLLWLLLELTQKRMSKQLMYLSHVEATILEVKVVEGFGTTIDVILSNGYLREGDRIVLCGMNGPIVTNIRALLTPQPLRELRLKSEYVHHKEVKAALGVKIAANDLEKAVSGSRLLVVGPEDDEDELMDDVMDDLTGLLDSVDTTGKGVVVQASTLGSLEALLDFLKDMKIPVMSIGLGPVYKRDVMKASTMLEKAPEYAVMLCFDVKVDKEAEQYAEQEGIKIFNADVIYHLFDSFTAYQEKLLEERRKDFLDYAIFPCVLQTLQIINKRGPMIIGVDVLEGTLRVGTPICAVKTDPTTKERQTLILGKVISLEINHQPVQEVKKGQTAAGVAVRLEDPSGQQPIWGRHVDENDTLYSLVSRRSIDTLKDKAFRDQVARSDWLLLKKLKVVFGIE

SEQ ID NO: 1379 - protein, 289 aa, Saccharomyces cerevisiae
MSAPTMRSTSILTEHLGYPPISLVDDIINAVNEIMYKCTAAMEKYLLSKSKIGEEDYGEEIKSGVAKLESLLENSVDKNFDKLELYVLRNVLRIPEEYLDANVFRLENQKDLVIVDENELKKSEEKLREKVNDVELAFKKNEMLLKRVTKVKRLLFTIRGFKQKLNELLKCKDDVQLQKILESLKPIDDTMTLLTDSLRKLYVDSESTSSTEEVEALLQRLKTNGKQNNKDFRTRYIDIRTNNVLRKLGLLGDKEDEKQSAKPDARTQAGDIVSIDIEEPQLDLLDDVL

SEQ ID NO: 1380 - protein, 463 aa, Saccharomyces cerevisiae
MRCRGLSRTPFFLREPLIKVATWFITSPLWLIHWASINRIFAHRNIYRGNMGLYSPESEKSQLNMNYIGKDDSQSIFRRLNQNLKASNNNNDSNKNGLNMSDYSNNSPYGRSYDVRINQNSQNNGNGCFSGSIDSLVDEHIIPSPPLSPKLESKISHNGSPRMASSVLVGSTPKGAVENVLFVKPVWPNGLSRKRYRYATYGFLSQYKIFSNLAQPYSKNIINRYNNLAYNARHKYSKYNDDMTPPPLPSSSSRLPSPLASPNLNRQARYNMRKQALYNNNLGKFESDTEWIPRKRKVYSPQRRTMTTSPHRAKKFSPSASTPHTNIASIEAIHDAPQYIPNVSWKKLPDYSPPLSTLPTDSNKSLKIEWKGSPMDLSTDPLRNELHPAELVLAQTLRLPCDLYLDSKRRLFLEKVYRLKKGLPFRRTDAQKACRIDVNKASRLFQAFEKVGWLQDSNFTKYL

SEQ ID NO: 1381 - protein, 173 aa, Saccharomyces cerevisiae
MVRLKSRYILFEIIFPPTDTNVEESVSKADILLSHHRASPADVSIKSILQEIRRSLSLNLGDYGSAKCNSLLQLKYFSNKTSTGIIRCHREDCDLVIMALMLMSKIGDVDGLIVNPVKVSGTIKKIEQFAMRRNSKILNIIKCSQSSHLSDNDFIINDFKKIGRENENENEDD

SEQ ID NO: 1382 - protein, 379 aa, Saccharomyces cerevisiae
MFSNRLPPPKHSQGRVSTALSSDRVEPAILTDQIAKNVKLDDFIPKRQSNFELSVPLPTKAEIQECTARTKSYIQRLVNAKLANSNNRASSRYVTETHQAPANLLLNNSHHIEVVSKQMDPLLPRFVGKKARKVVAPTENDEVVPVLHMDGSNDRGEADPNEWKIPAAVSNWKNPNGYTVALERRVGKALDNENNTINDGFMKLSEALENADKKARQEIRSKMELKRLAMEQEMLAKESKLKELSQRARYHNGTPQTGAIVKPKKQTSTVARLKELAYSQGRDVSEKIILGAAKRSEQPDLQYDSRFFTRGANASAKRHEDQVYDNPLFVQQDIESIYKTNYEKLDEAVNVKSEGASGSHGPIQFTKAESDDKSDNYGA

SEQ ID NO: 1383 - protein, 760 aa, Saccharomyces cerevisiae
MVDVQKRKKLLAKAAASASIPAIKGSVPLDSYDIKIIQYKNALYKLNELNRLLNVLVPHLKKKRDNDESYKIIPLVNFILSLCEGPIFNVSPVLAKRYHLLCRFQLIKLSEVQQRLSTNFIDVEGWMFPEEVPLDHYKSCIYNNSLQWKILNSLSCIAQNAIKIYNAKLRQILLERDAYKARSLPFDTSIIEDLLNPVEMTLILDLAVLINDPVRDKSTHSFYKLQWQVMEKLNSCVHSKIFPILRTYYNQLQKFSETRPTSLSNLQKDLPHWEWTLHRIYTFHLRVFSVLCVIISFSRQIFLPNKQHFLDIKTRLSSENVYHYDLIICELMALLSPECDDVTALFELQENLKFWTQTARTDNNSSRTPIFHLQPGLVVELFNNHICKIIPKLRSIMGLLSNWMDCWKYIEKNYKTFDETNDLRENLKEKLERDKALYLEVKNAKSKLKKKPSITKLPASSSPSPSPTSSASPSRQASLESIRTRARAHLASNSSRSPSVSPVRTTFNNKNAETKKSVVSPEKRKLINGRRPRSSSLQSYTNKQQTSYLNSTRHPSIAPPSKLNNQRSNSLQSSTMTLNQKIVQDTVRHLMNKSASTPNPSASSSLAPSPKVSSINNTSSGKSSSTLIANSSDTLAIETLTLDPESNSSELSIKRVRFAGVPPMTEAENPKPTKVGWYKKPAVLHYPPIPASAMIKPLQHKSKYNTLRQEEGFTFRKSLRDGLEWENGESGSETTMMPFGIEIKESTGHRIASKIRSKLR

SEQ ID NO: 1384 - protein, 117 aa, Saccharomyces cerevisiae
MSSSTPFDPYALSEHDEERPQNVQSKSRTAELQAEIDDTVGIMRDNINKVAERGERLTSIEDKADNLAVSAQGFKRGANRVRKAMWYKDLKMKMCLALVIIILLVVIIVPIAVHFSR

SEQ ID NO: 1385 - protein, 1471 aa, Saccharomyces cerevisiae
MSFEVGTKCWYPHKEQGWIGGEVTKNDFFEGTFHLELKLEDGETVSIETNSFENDDDHPTLPVLRNPPILESTDDLTTLSYLNEPAVLHAIKKRYMNGQIYTYSGIVLIAANPFDKVDHLYSREMIQNYSSKRKDELEPHLFAIAEEAYRFMVHEKANQTVVVSGESGAGKTVSAKYIMRYFASVQESNNREGEVEMSQIESQILATNPIMEAFGNAKTTRNDNSSRFGKYLQILFDENTTIRGSKIRTYLLEKSRLVYQPETERNYHIFYQILEGLPEPVKQELHLSSPKDYHYTNQGGQPNIAGIDEAREYKITTDALSLVGINHETQLGIFKILAGLLHIGNIEMKMTRNDASLSSEEQNLQIACELLGIDPFNFAKWIVKKQIVTRSEKIVTNLNYNQALIARDSVAKFIYSTLFDWLVDNINKTLYDPELDQQDHVFSFIGILDIYGFEHFEKNSFEQFCINYANEKLQQEFNQHVFKLEQEEYVKEEIEWSFIEFSDNQPCIDLIENKLGILSLLDEESRLPSGSDESWASKLYSAFNKPPSNEVFSKPRFGQTKFIVSHYAVDVEYEVEGFIEKNRDSVSLGHLDVFKATTNPIFKQILDNRELRSDDAPEEQNTEKKIMIPARLSQKKPTLGSMFKKSLGELMAIINSTNVHYIRCIKPNSEKKPWEFDNLMVLSQLRACGVLETIRISCAGFPSRWTFDEFVQRYFLLTDYSLWSGILYNPDLPKEAIVNFCQSILDATISDSAKYQIGNTKIFFKAGMLAFLEKLRTNKMNEICIIIQKKIRARYYRLQYLQTMESIKKCQSQIRSLLVRTRVDHELKTRAAILLQTNIRALWKREYYRAAIGQIIKLQCTCKRKLILDSVNRKFMLMAAVIIQSYIRSYGHKTDYRTLKRSSILVQSAMRMQLARRRYIVLQKEVEERNIRASYGIGLLEEAIEFKNSFILNLEMLNDSYTRLTQLLQGDLSNIPSKQRQEYETIVNGYNDKISKLKTLQVEIMNTLNKKNALKERKKKQSSLIQSHMQSLAAIKGNKPSRLSDEVKSMKQELAFIENVIAQDFTTTYSANKNDKVKGLGIAGQQVKPKLVNVIRRESGNPDLLELLMDLNCYTLEVTEGYLKKVNVTEVNGDNVLGPIHVITTVVSSLVRNGLLIQSSKFISKVLLTVESIVMSLPKDETMLGGIFWLSNLSRLPAFAANQKTLYEANGGDEKDKLTLIYLNDLENETLKVFDKIYSTWLVKFMKHASAHIEIFDMVLNEKLFKNSGDEKFAKLFTFLNEFDAVLCKFQVVDSMHTKIFNDTLKYLNVMLFNDLITKCPALNWKYGYEVDRNIERLVSWFEPRIEDVRPNLIQIIQAVKILQLKISNLNEFKLLFDFWYALNPAQIQAILLKYKPANKGEAGVPNEILNYLANVIKRENLSLPGKMEIMLSAQFDSAKNHLRYDTSAITQNSNTEGLATVSKIIKLDRK

SEQ ID NO: 1386 - protein, 528 aa, Saccharomyces cerevisiae
MQNAQIKSSSKGSGIDGTDRNSKDGVEKRPLEDVKQMIDAGTPDVGHKSTVETKPNVGWQASHSNLAALHEKEQKYEMEHHHARHKLHRQVIPDYTSASTAMFSDCMFNAAPDKVRSLSTMKSSGLSPKHPFNVVATFKGPFPQHSVESKPLDGGYSAKDHFPSFKMLQAQQHPAHRHYKDNDKYGLKSPSRSFVKDKKRLVHRFLKSMEPSSSGQSKDSSALAPAFDPILPNVISKPSKRPTHHSHSSDGSSSTQTDISLQSLLYHDLESSPKKHVSPSRPPSVASESSPAVANPIGLSPKDACNASFSQSSSSSLSSSSSSSSSTSFSQSVAVDPLEPPGNITYSSSNLSLNSDELDYYQRHIGLQLQQTEALLKHSLKDEVLKDENDLVKNIANFDKIVKELRDLRSRTIGWKELVEEDYLMNLKQDFDKENPESFEARLSDTINTNVAKLQDLEKRMASCKDRLASRKEVMRKMESLLSLENSLMISKKNVTFASKYRNEALDIVFLIIIIVICYTFKHLVSHK

SEQ ID NO: 1387 - protein, 261 aa, Saccharomyces cerevisiae
MAPSIATVKIARDMVLPLRIFVNRKQILQTNDKTSNKSNATIFEAPLLSNNSIICLKSPNTRIYLSQQDKKNLCDEIKEDLLLIVYELASPEIISSVLSKIRVGHSTDFQINVLPKLFAGADTDNAVTSHIQSVTRLAKFKYKLHYKHKWELDIFINSIKKIANLRHYLMFQTLTLNGFSLNAGPKTLLARKIEKQPQVPNLLIENGDADALDTPVEEDIKPVIEFMYKPVINLGEIIDVHVLHRPRRHKVRTQSKQPQEE

SEQ ID NO: 1388 - protein, 1355 aa, Saccharomyces cerevisiae
MNDDRETPPKRKPGEDDTLFDIDFLDDTTSHSGSRSKVTNSHANGYYIPPSHVLPEETIDLDADDDNIENDVHENLFMSNNHDDQTSWNANRFDSDAYQPQSLRAVKPPGLFARFGNGLKNAFTFKRKKGPESFEMNHYNAVTNNELDDNYLDSRNKFNIKILFNRYILRKNVGDAEGNGEPRVIHINDSLANSSFGYSDNHISTTKYNFATFLPKFLFQEFSKYANLFFLCTSAIQQVPHVSPTNRYTTIGTLLVVLIVSAMKECIEDIKRANSDKELNNSTAEIFSEAHDDFVEKRWIDIRVGDIIRVKSEEPIPADTIILSSSEPEGLCYIETANLDGETNLKIKQSRVETAKFIDVKTLKNMNGKVVSEQPNSSLYTYEGTMTLNDRQIPLSPDQMILRGATLRNTAWIFGLVIFTGHETKLLRNATATPIKRTAVEKIINRQIIRLFTVLIVLILISSIGNVIMSTADAKHLSYLYLEGTNKAGLFFKDFLTFWILFSNLVPISLFVTVELIKYYQAFMIGSDLDLYYEKTDTPTVVRTSSLVEELGQIEYIFSDKTGTLTRNIMEFKSCSIAGHCYIDKIPEDKTATVEDGIEVGYRKFDDLKKKLNDPSDEDSPIINDFLTLLATCHTVIPEFQSDGSIKYQAASPDEGALVQGGADLGYKFIIRKGNSVTVLLEETGEEKEYQLLNICEFNSTRKRMSAIFRFPDGSIKLFCKGADTVILERLDDEANQYVEATMRHLEDYASEGLRTLCLAMRDISEGEYEEWNSIYNEAATTLDNRAEKLDEAANLIEKNLILIGATAIEDKLQDGVPETIHTLQEAGIKIWVLTGDRQETAINIGMSCRLLSEDMNLLIINEETRDDTERNLLEKINALNEHQLSTHDMKSLALVIDGKSLGFALEPELEDYLLTVAKLCKAVICCRVSPLQKALVVKMVKRKSSSLLLAIASGANDVSMIQAAHVGVGISGMEGMQAARSADIALGQFKFLKKLLLVHGSWSYQRISVAILYSFYKNTALYMTQFWYVFANAFSGQSIMESWTMSFYNLFFTVWPPFVIGVFDQFVSSRLLERYPQLYKLGQKGQFFSVYIFWGWIINGFFHSAIVFIGTILIYRYGFALNMHGELADHWSWGVTVYTTSVIIVLGKAALVTNQWTKFTLIAIPGSLLFWLIFFPIYASIFPHANISREYYGVVKHTYGSGVFWLTLIVLPIFALVRDFLWKYYKRMYEPETYHVIQEMQKYNISDSRPHVQQFQNAIRKVRQVQRMKKQRGFAFSQAEEGGQEKIVRMYDTTQKRGKYGELQDASANPFNDNNGLGSNDFESAEPFIENPFADGNQNSNRFSSSRDDISFDI

SEQ ID NO: 1389 - protein, 306 aa, Saccharomyces cerevisiae
MSDEIVWQVINQSFCSHRIKAPNGQNFCRNEYNVTGLCTRQSCPLANSKYATVKCDNGKLYLYMKTPERAHTPAKLWERIKLSKNYTKALQQIDEHLLHWSKFFRHKCKQRFTKLTQVMITERRLALREEERHYVGVAPKVKRREQNRERKALVAAKIEKAIEKELMDRLKSGAYGDKPLNVDEKVWKKIMGQMEEENSQDEEEDWDEEEESDDGEVEYVADDGEGEYVDVDDLEKWLADSDREASSASQSESDSESESDSDSDEENKNSAKRRKKGTSAKTKRPKVEIEYEEEHEVQNAEQEVAQ

SEQ ID NO: 1390 - protein, 1435 aa, Saccharomyces cerevisiae
MEIFSQKDYYPTPSSNVISYESDCVSKPVNSADLPALIVHLSSPLEGVDYNASADFFLIYRNFITPQDLHDLLIYRFRWCIREITTNAAKAKRRRIGEVALVRTFVLLRHSILNYFVQDFLPNITLRLRLIEFLNDKHIEQYPKIISSCIINLKKNWVHCSKLVWENIELNEPDKLDFDAWLHYSLKDFTQLESLHKRGSRLSIYARQSFASPDFRNQSVLSLYKTSDVFRLPEKLQSSNSSKNQRSPSMLLFPDNTSNVYSKHRIAKEPSVDNESEDMSDSKQKISHLSKVTLVSTLMKGVDYPSSYAVDKIMPPTPAKKVEFILNSLYIPEDLNEQSGTLQGTSTTSSLDNNSNSNSRSNTSSMSVLHRSAIGLLAKWMKNHNRHDSSNDKKFMSAIKPANQKPEMDAFVKYVVSISSLNRKSSKEEEEEFLNSDSSKFDILSARTIDEVESLLHLQNQLIEKVQTHSNNNRGPTVNVDCERREHIHDIKILQQNSFKPSNDNFSAMDNLDLYQTVSSIAQSVISLTNTLNKQLQNNESNMQPSPSYDALQRRKVKSLTTAYYNKMHGSYSAESMRLFDKDNSSSRTDENGPQRLLFHETDKTNSEAITNMTPRRKNHSQSQKSMTSSPLKNVLPDLKESSPLNDSREDTESITYSYDSELSSSSPPRDTVTKKSRKVRNIVNNTDSPTLKTKTGFLNLREFTFEDTKSLDEKKSTIDGLEKNYDNKENQESEYESTKKLDNSLDASSEANNYDITTRKKHSSCNHKIKQAVVRPASGRISISRVQSIAITPTKELSIVDPEQNKSNSVIEEISEIEPLNLEYNKKSALYSDTSSTVISISTSKLFESAQNSPLKQTQNPQREFPNGTSVSETNRIRLSIAPTIESVVSDLNSITTGSTVETFETSRDLPVPHQRIINLREEYQRGNQDIISNTSSLHELKTIDLSDSNNDLESPSTHAKNNKYFFSPDDGSIDVASPMKNVEELKSKFLKNESETNSNISGSVLTMDDIDINDTSSARNTRRANSESAFTGSLNKKNLNEIANMLDDSINDDPITVALMKLEGTYEKIPEKPENTKSSDAIGIKTSKLADEVEMLNLNNLPSFQNSPAEKRKSLLIERRRQTIMNIPFTPDQSEKEGFTSSSPEKIDVSANVDVAVQAAQIQELIGQYRIHDSRLMISNNESHVPFILMYDSLSVAQQMTLIEKEILGEIDWKDLLDLKMKHEGPQVISWLQLLVRNETLSGIDLAISRFNLTVDWIISEILLTKSSKMKRNVIQRFIHVADHCRTFQNFNTLMEIILALSSSVVQKFTDAWRLIEPGDLLTWEELKKIPSLDRNYSTIRNLLNSVNPLVGCVPFIVVYLSDLSANAEKKDWILEDKVVNYNKFDTNVQIVKNFIQRVQWSKFYTFKVNHELLSKCVYISTLTQEEINELST

SEQ ID NO: 1391 - protein, 635 aa, Saccharomyces cerevisiae
MSGARSTTAGAVPSAATTSTTSTTSNSKDSDSNESLYPLALLMDELKHDDIANRVEAMKKLDTIALALGPERTRNELIPFLTEVAQDDEDEVFAVLAEQLGKFVPYIGGPQYATILLPVLEILASAEETLVREKAVDSLNNVAQELSQEQLFSDFVPLIEHLATADWFSSKVSACGLFKSVIVRIKDDSLRKNILALYLQLAQDDTPMVKRAVGKNLPILIDLLTQNLGLSTDEDWDYISNIFQKIINDNQDSVKFLAVDCLISILKFFNAKGDESHTQDLLNSAVKLIGDEAWRVRYMAADRFSDLASQFSSNQAYIDELVQPFLNLCEDNEGDVREAVAKQVSGFAKFLNDPSIILNKILPAVQNLSMDESETVRSALASKITNIVLLLNKDQVINNFLPILLNMLRDEFPDVRLNIIASLKVVNDVIGIELLSDSLLPAITELAKDVNWRVRMAIIEYIPILAEQLGMQFFDQQLSDLCLSWLWDTVYSIREAAVNNLKRLTEIFGSDWCRDEIISRLLKFDLQLLENFVSRFTILSALTTLVPVVSLDVVTEQLLPFISHLADDGVPNIRFNVAKSYAVIVKVLIKDEAKYDALIKNTILPSLQTLCQDEDVDVKYFAKKSLAECQELLKN

SEQ ID NO: 1392 - protein, 399 aa, Saccharomyces cerevisiae
MQKISKYSSMAILRKRPLVKTETGPESELLPEKRTKIKQEEVVPQPVDIDWVKSLPNKQYFEWIVVRNGNVPNRWATPLDPSILVTPASTKVPYKFQETYARMRVLRSKILAPVDIIGGSSIPVTVASKCGISKEQISPRDYRLQVLLGVMLSSQTKDEVTAMAMLNIMRYCIDELHSEEGMTLEAVLQINETKLDELIHSVGFHTRKAKYILSTCKILQDQFSSDVPATINELLGLPGVGPKMAYLTLQKAWGKIEGICVDVHVDRLTKLWKWVDAQKCKTPDQTRTQLQNWLPKGLWTEINGLLVGFGQIITKSRNLGDMLQFLPPDDPRSSLDWDLQSQLYKEIQQNIMSYPKWVKYLEGKRELNVEAEINVKHEEKTVEETMVKLENDISVKVED

SEQ ID NO: 1393 - protein, 394 aa, Saccharomyces cerevisiae
MTLQESDKFATKAIHAGEHVDVHGSVIEPISLSTTFKQSSPANPIGTYEYSRSQNPNRENLERAVAALENAQYGLAFSSGSATTATILQSLPQGSHAVSIGDVYGGTHRYFTKVANAHGVETSFTNDLLNDLPQLIKENTKLVWIETPTNPTLKVTDIQKVADLIKKHAAGQDVILVVDNTFLSPYISNPLNFGADIVVHSATKYINGHSDVVLGVLATNNKPLYERLQFLQNAIGAIPSPFDAWLTHRGLKTLHLRVRQAALSANKIAEFLAADKENVVAVNYPGLKTHPNYDVVLKQHRDALGGGMISFRIKGGAEAASKFASSTRLFTLAESLGGIESLLEVPAVMTHGGIPKEAREASGVFDDLVRISVGIEDTDDLLEDIKQALKQATN

SEQ ID NO: 1394 - protein, 642 aa, Saccharomyces cerevisiae
MSKAVGIDLGTTYSCVAHFANDRVDIIANDQGNRTTPSFVAFTDTERLIGDAAKNQAAMNPSNTVFDAKRLIGRNFNDPEVQADMKHFPFKLIDVDGKPQIQVEFKGETKNFTPEQISSMVLGKMKETAESYLGAKVNDAVVTVPAYFNDSQRQATKDAGTIAGLNVLRIINEPTAAAIAYGLDKKGKEEHVLIFDLGGGTFDVSLLFIEDGIFEVKATAGDTHLGGEDFDNRLVNHFIQEFKRKNKKDLSTNQRALRRLRTACERAKRTLSSSAQTSVEIDSLFEGIDFYTSITRARFEELCADLFRSTLDPVEKVLRDAKLDKSQVDEIVLVGGSTRIPKVQKLVTDYFNGKEPNRSINPDEAVAYGAAVQAAILTGDESSKTQDLLLLDVAPLSLGIETAGGVMTKLIPRNSTISTKKFEIFSTYADNQPGVLIQVFEGERAKTKDNNLLGKFELSGIPPAPRGVPQIEVTFDVDSNGILNVSAVEKGTGKSNKITITNDKGRLSKEDIEKMVAEAEKFKEEDEKESQRIASKNQLESIAYSLKNTISEAGDKLEQADKDTVTKKAEETISWLDSNTTASKEEFDDKLKELQDIANPIMSKLYQAGGAPGGAAGGAPGGFPGGAPPAPEAEGPTVEEVD

SEQ ID NO: 1395 - protein, 621 aa, Saccharomyces cerevisiae
MSSVQLSRGDFHSIFTNKQRYDNPTGGVYQVYNTRKSDGANSNRKNLIMISDGIYHMKALLRNQAASKFQSMELQRGDIIRVIIAEPAIVRERKKYVLLVDDFELVQSRADMVNQTSTFLDNYFSEHPNETLKDEDITDSGNVANQTNASNAGVPDMLHSNSNLNANERKFANENPNSQKTRPIFAIEQLSPYQNVWTIKARVSYKGEIKTWHNQRGDGKLFNVNFLDTSGEIRATAFNDFATKFNEILQEGKVYYVSKAKLQPAKPQFTNLTHPYELNLDRDTVIEECFDESNVPKTHFNFIKLDAIQNQEVNSNVDVLGIIQTINPHFELTSRAGKKFDRRDITIVDDSGFSISVGLWNQQALDFNLPEGSVAAIKGVRVTDFGGKSLSMGFSSTLIPNPEIPEAYALKGWYDSKGRNANFITLKQEPGMGGQSAASLTKFIAQRITIARAQAENLGRSEKGDFFSVKAAISFLKVDNFAYPACSNENCNKKVLEQPDGTWRCEKCDTNNARPNWRYILTISIIDETNQLWLTLFDDQAKQLLGVDANTLMSLKEEDPNEFTKITQSIQMNEYDFRIRAREDTYNDQSRIRYTVANLHSLNYRAEADYLADELSKALLA

SEQ ID NO: 1396 - protein, 435 aa, Saccharomyces cerevisiae
MHRRQFFQEYRSPQQQQGHPPRSEYQVLEEIGRGSFGSVRKVIHIPTKKLLVRKDIKYGHMNSKERQQLIAECSILSQLKHENIVEFYNWDFDEQKEVLYLYMEYCSRGDLSQMIKHYKQEHKYIPEKIVWGILAQLLTALYKCHYGVELPTLTTIYDRMKPPVKGKNIVIHRDLKPGNIFLSYDDSDYNINEQVDGHEEVNSNYYRDHRVNSGKRGSPMDYSQVVVKLGDFGLAKSLETSIQFATTYVGTPYYMSPEVLMDQPYSPLSDIWSLGCVIFEMCSLHPPFQAKNYLELQTKIKNGKCDTVPEYYSRGLNAIIHSMIDVNLRTRPSTFELLQDIQIRTARKSLQLERFERKLLDYENELTNIEKILEKQAIEYERELSQLKEQFTQAVEERAREVISGKKVGKVPESINGYYGKKFAKPAYHWQTRYR

SEQ ID NO: 1397 - protein, 687 aa, Saccharomyces cerevisiae
MPNLKRLPIPPLQDTLNRYLARVEPLQDERQNRRTRRTVLSAENLDALNTLHERLLEYDARLAESNPESSYIEQFWYDAYLLYDATVVLNVNPYFQLQDDPTIKDTPETAAQGPYGAHTVQVRRAARLTTSILKFIRQIRHGTLRTDTVRGKTPLSMDQYERLFGSSRIPPGPGEPSCHLQTDATSHHVVAMYRGQFYWFDVLDTRNEPIFATPEQLEWNLYSIIMDAESAGSGSAPFGVFTTESRRVWSNIRDYLFHADDCTNWRNLKLIDSALFVVCLDDVAFAADQQDELTRSMLCGTSTINLDPHQHQPPLNVQTGTCLNRWYDKLQLIVTKNGKAGINFEHTGVDGHTVLRLATDIYTDSILSFARGVTKNVVDIFSDDDGKPSSSSLASAAHSANLITIPRKLEWRTDNFLQSSLHFAETRISDLISQYEFVNLDFSNYGASHIKTVFKCSPDAFVQQVFQVAYFALYGRFETVYEPAMTKAFQNGRTEAIRSVTGQSKLFVKSLLDQDASDATKIQLLHDACTAHSQITRECSQGLGQDRHLYALYCLWNQWYKDKLELPPIFRDKSWTTMQNNVLSTSNCGNPCLKSFGFGPVTANGFGIGYIIRDHSVSVVVSSRHRQTARFASLMEKSLLEIDRIFKRQQARAAKPAARTTASANTKSEDMKYLLSGYDYFDVSVSG

SEQ ID NO: 1398 - protein, 1537 aa, Saccharomyces cerevisiae
MTMPHRYMFLAVFTLLALTSVASGATEACLPAGQRKSGMNINFYQYSLKDSSTYSNAAYMAYGYASKTKLGSVGGQTDISIDYNIPCVSSSGTFPCPQEDSYGNWGCKGMGACSNSQGIAYWSTDLFGFYTTPTNVTLEMTGYFLPPQTGSYTFKFATVDDSAILSVGGATAFNCCAQQQPPITSTNFTIDGIKPWGGSLPPNIEGTVYMYAGYYYPMKVVYSNAVSWGTLPISVTLPDGTTVSDDFEGYVYSFDDDLSQSNCTVPDPSNYAVSTTTTTTEPWTGTFTSTSTEMTTVTGTNGVPTDETVIVIRTPTTASTIITTTEPWNSTFTSTSTELTTVTGTNGVRTDETIIVIRTPTTATTAITTTEPWNSTFTSTSTELTTVTGTNGLPTDETIIVIRTPTTATTAMTTTQPWNDTFTSTSTELTTVTGTNGLPTDETIIVIRTPTTATTAMTTTQPWNDTFTSTSTELTTVTGTNGLPTDETIIVIRTPTTATTAMTTTQPWNDTFTSTSTEITTVTGTNGLPTDETIIVIRTPTTATTAMTTPQPWNDTFTSTSTEMTTVTGTNGLPTDETIIVIRTPTTATTAITTTEPWNSTFTSTSTEMTTVTGTNGLPTDETIIVIRTPTTATTAITTTQPWNDTFTSTSTEMTTVTGTNGLPTDETIIVIRTPTTATTAMTTTQPWNDTFTSTSTEITTVTGTTGLPTDETIIVIRTPTTATTAMTTTQPWNDTFTSTSTEMTTVTGTNGVPTDETVIVIRTPTSEGLISTTTEPWTGTFTSTSTEMTTVTGTNGQPTDETVIVIRTPTSEGLVTTTTEPWTGTFTSTSTEMTTITGTNGVPTDETVIVIRTPTSEGLISTTTEPWTGTFTSTSTEMTTITGTNGQPTDETVIVIRTPTSEGLISTTTEPWTGTFTSTSTEMTHVTGTNGVPTDETVIVIRTPTSEGLISTTTEPWTGTFTSTSTEVTTITGTNGQPTDETVIVIRTPTSEGLISTTTEPWTGTFTSTSTEMTTVTGTNGQPTDETVIVIRTPTSEGLVTTTTEPWTGTFTSTSTEMSTVTGTNGLPTDETVIVVKTPTTAISSSLSSSSSGQITSSITSSRPIITPFYPSNGTSVISSSVISSSVTSSLFTSSPVISSSVISSSTTTSTSIFSESSKSSVIPTSSSTSGSSESETSSAGSVSSSSFISSESSKSPTYSSSSLPLVTSATTSQETASSLPPATTTKTSEQTTLVTVTSCESHVCTESISPAIVSTATVTVSGVTTEYTTWCPISTTETTKQTKGTTEQTTETTKQTTVVTISSCESDVCSKTASPAIVSTSTATINGVTTEYTTWCPISTTESRQQTTLVTVTSCESGVCSETASPAIVSTATATVNDVVTVYPTWRPQTANEESVSSKMNSATGETTTNTLAAETTTNTVAAETITNTGAAETKTVVTSSLSRSNHAETQTASATDVIGHSSSVVSVSETGNTKSLTSSGLSTMSQQPRSTPASSMVGYSTASLEISTYAGSANSLLAGSGLSVFIASLLLAII

SEQ ID NO: 1399 - protein, 126 aa, Saccharomyces cerevisiae
MAGEAVSEHTPDSQEVTVTSVVCCLDSVVEIGHHVVYSVVTPLIVAVLVDTMAGEAVLEHTSDSQEEIVTTVVCFVVSVVCSVVPLVCFVVSVVEIGHHVVYSVVTPLTVTVAVETIAGEMDSVHT

SEQ ID NO: 1400 - protein, 198 aa, Saccharomyces cerevisiae
MTGYFLPPQTSSYTFRFAKVDDSAILSVGGNVAFECCAQEQPPITSTDFTINGIKPWQGSLPDNIGGTVYMYAGYYYPLKVVYSNAVSWGTLPISVELPDGTTVSDDFEGYVYSFDDDLSQSNCTIPDPSKHTTSIVTTTTELWTGTFTSTSTEMTTVTGTNGQPTDETVIVAKAPTTATSSSLSSSSSEQITSSITS

SEQ ID NO: 1401 - protein, 467 aa, Saccharomyces cerevisiae
MLKSAVYSILAASLVNAGTIPLGKLSDIDKIGTQTEIFPFLGGSGPYYSFPGDYGISRDLPESCEMKQVQMVGRHGERYPTVSKAKSIMTTWYKLSNYTGQFSGALSFLNDDYEFFIRDTKNLEMETTLANSVNVLNPYTGEMNAKRHARDFLAQYGYMVENQTSFAVFTSNSNRCHDTAQYFIDGLGDKFNISLQTISEAESAGANTLSAHHSCPAWDDDVNDDILKKYDTKYLSGIAKRLNKENKGLNLTSSDANTFFAWCAYEINARGYSDICNIFTKDELVRFSYGQDLETYYQTGPGYDVVRSVGANLFNASVKLLKESEVQDQKVWLSFTHDTDILNYLTTIGIIDDKNNLTAEHVPFMENTFHRSWYVPQGARVYTEKFQCSNDTYVRYVINDAVVPIETCSTGPGFSCEINDFYDYAEKRVAGTDFLKVCNVSSVSNSTELTFFWDWNTKHYNDTLLKQ

SEQ ID NO: 1402 - protein, 403 aa, Saccharomyces cerevisiae
MAAIRDYKTALDLTKSLPRPDGLSVQELMDSKIRGGLAYNDFLILPGLVDFASSEVSLQTKLTRNITLNIPLVSSPMDTVTESEMATFMALLDGIGFIHHNCTPEDQADMVRRVKNYENGFINNPIVISPTTTVGEAKSMKEKYGFAGFPVTADGKRNAKLVGAITSRDIQFVEDNSLLVQDVMTKNPVTGAQGITLSEGNEILKKIKKGRLLVVDEKGNLVSMLSRTDLMKNQKYPLASKSANTKQLLWGASIGTMDADKERLRLLVKAGLDVVILDSSQGNSIFQLNMIKWIKETFPDLEIIAGNVVTKEQAANLIAAGADGLRIGMGTGSICITQKVMACGRPQGTAVYNVCEFANQFGVPCMADGGVQKHWSYYYQSFGSWFFYCYDGWYVGRYYRITR

SEQ ID NO: 1403 - protein, 1151 aa, Saccharomyces cerevisiae
MSFSQLEQNIKKKIAVEENIIRGASALKKKTSNVMVIQKCNTNIREARQNLEYLEDSLKKLRLKTAQQSQGENGSEDNERFNSKEYGFLSTKSPNEHIFSRLDLVKYDCPSLAQRIQYMLQQLEFKLQVEKQYQEANTKLTKLYQIDGDQRSSSAAEGGAMESKYRIQMLNKALKKYQAINVDFDQFKHQPNDIMDNQQPKFRRKQLTGVLTIGITAARDVDHIQSPMFARKPESYVTIKIDDTIKARTKPSRNDRWSEDFQIPVEKGNEIEITVYDKVNDSLIPVAIMWLLLSDIAEEIRKKKAGQTNEQQGWVNASNINGGSSLASEEGSTLTSTYSNSAIQSTSAKNVQGENTSTSQISTNSWFVLEPSGQILLTLGFHKSSQIERKQLMGGLHRHGAIINRKEEIFEQHGHHFVQKSFYNIMCCAYCGDFLRYTGFQCQDCKFLCHKKCYTNVVTKCIAKTSTDTDPDEAKLNHRIPHRFLPTSNRGTKWCCHCGYILPWGRHKVRKCSECGIMCHAQCAHLVPDFCGMSMEMANKILKTIQDTKRNQEKKKRTVPSAQLGSSIGTANGSDLSPSKLAERANAPLPPQPRKHDKTPSPQKVGRDSPTKQHDPIIDKKISLQTHGREKLNKFIDENEAYLNFTEGAQQTAEFSSPEKTLDPTSNRRSLGLTDLSIEHSQTWESKDDLMRDELELWKAQREEMELEIKQDSGEIQEDLEVDHIDLETKQKLDWENKNDFREADLTIDSTHTNPFRDMNSETFQIEQDHASKEVLQETVSLAPTSTHPSRTTDQQSPQKSQTSTSAKHKKRAAKRRKVSLDNFVLLKVLGKGNFGKVILSKSKNTDRLCAIKVLKKDNIIQNHDIESARAEKKVFLLATKTKHPFLTNLYCSFQTENRIYFAMEFIGGGDLMWHVQNQRLSVRRAKFYAAEVLLALKYFHDNGVIYRDLKLENILLTPEGHIKIADYGLCKDEMWYGNRTSTFCGTPEFMAPEILKEQEYTKAVDWWAFGVLLYQMLLCQSPFSGDDEDEVFNAILTDEPLYPIDMAGEIVQIFQGLLTKDPEKRLGAGPRDADEVMEEPFFRNINFDDILNLRVKPPYIPEIKSPEDTSYFEQEFTSAPPTLTPLPSVLTTSQQEEFRGFSFMPDDLDL

SEQ ID NO: 1404 - protein, 545 aa, Saccharomyces cerevisiae
MLARTAAIRSLSRTLINSTKAARPAAAALASTRRLASTKAQPTEVSSILEERIKGVSDEANLNETGRVLAVGDGIARVFGLNNIQAEELVEFSSGVKGMALNLEPGQVGIVLFGSDRLVKEGELVKRTGNIVDVPVGPGLLGRVVDALGNPIDGKGPIDAAGRSRAQVKAPGILPRRSVHEPVQTGLKAVDALVPIGRGQRELIIGDRQTGKTAVALDTILNQKRWNNGSDESKKLYCVYVAVGQKRSTVAQLVQTLEQHDAMKYSIIVAATASEAAPLQYLAPFTAASIGEWFRDNGKHALIVYDDLSKQAVAYRQLSLLLRRPPGREAYPGDVFYLHPRLLERAAKLSEKEGSGSLTALPVIETQGGDVSAYIPTNVISITDGQIFLEAELFYKGIRPAINVGLSVSRVGSAAQVKALKQVAGSLKLFLAQYREVAAFAQFGSDLDASTKQTLVRGERLTQLLKQNQYSPLATEEQVPLIYAGVNGHLDGIELSRIGEFESSFLSYLKSNHNELLTEIREKGELSKELLASLKSATESFVATF

SEQ ID NO: 1405 - protein, 728 aa, Saccharomyces cerevisiae
MMANFEEWIKMATDNKINSRNSWNFALIDYFYDLDVLKDGENNINFQKASATLDGCIKIYSSRVDSVTTETGKLLSGLAQRKTNGASNGDDSNGGNGEGLGGDSDEANIEIDPLTGMPISNDPDVNNTRRRVYNRVLETTLVEFETIKMKELDQELIIDPLFKKALVDFDEGGAKSLLLNTLNIDNTARVIFDASIKDTQNVGQGKLQRKEEELIERDSLVDDENEPSQSLISTRNDSTVNDSVISAPSMEDEILSLGMDFIKFDQIAVCEISGSIEQLRNVVEDINQAKDFIENVNNRFDNFLTEEELQAAVPDNAEDDSDGFDMGMQQELCYPDENHDNTSHDEQDDDNVNSTTGSIFEKDLMAYFDENLNRNWRGREHWKVRNFKKANLVNKESDLLEETRTTIGDTTDKNTTDDKSMDTKKKHKQKKVLEIDFFKTDDSFEDKVFASKGRTKIDMPIKNRKNDTHYLLPDDFHFSTDRITRLFIKPAQKMSLFSHRKHTRGDVSSGLFEKSTVSANHSNNDIPTIADEHFWADNYERKEQEEKEKEQSKEVGDVVGGALDNPFEDDMDGVDFNQAFEGTDDNEEASVKLDLQDDEDHKFPIRENKVTYSRVSKKVDVRRLKKNVWRSINNLIQEHDSRKNREQSSNDSETHTEDESTKELKFSDIIQGISKMYSDDTLKDISTSFCFICLLHLANEHGLQITHTENYNDLIVNYEDLATTQAAS

SEQ ID NO: 1406 - protein, 980 aa, Saccharomyces cerevisiae
MSLEGNTLGKGAKSFPLYIAVNQYSKRMEDELNMKPGDKIKVITDDGEYNDGWYYGRNLRTKEEGLYPAVFTKRIAIEKPENLHKSPTQESGNSGVKYGNLNDSASNIGKVSSHQQENRYTSLKSTMSDIDKALEELRSGSVEQEVSKSPTRVPEVSTPQLQDEQTLIQEKTRNEENTTHDSLFSSTADLNLSSESLKNISKSNISTKSLEPSSESVRQLDLKMAKSWSPEEVTDYFSLVGFDQSTCNKFKEHQVSGKILLELELEHLKELEINSFGIRFQIFKEIRNIKSAIDSSSNKLDADYSTFAFENQAAQLMPAATVNRDEIQQQISSKCNKLSSESSDRKSSSVTTELQRPSSVVVNPNFKLHDPAEQILDMTEVPNLFADKDIFESPGRAPKPPSYPSPVQPPQSPSFNNRYTNNNARFPPQTTYPPKNKNPTVYSNGLIPNSSTSSDNSTGKFKFPAMNGHDSNSRKTTLTSATIPSINTVNTDESLPAISNISSNATSHHPNRNSVVYNNHKRTESGSSFVDLFNRISMLSPVKSSFDEEETKQPSKASRAVFDSARRKSSYGHSRDASLSEMKKHRRNSSILSFFSSKSQSNPTSPTKQTFTIDPAKMTSHSRSQSNSYSHARSQSYSHSRKHSLVTSPLKTSLSPINSKSNIALAHSETPTSSNNKEAVSQPSEGKHKHKHKHKSKHKHKNSSSKDGSSEEKSKKKLFSSTKESFVGSKEFKRSPSELTQKSTKSILPRSNAKKQQTSAFTEGIRSITAKESMQTADCSGWMSKKGTGAMGTWKQRFFTLHGTRLSYFTNTNDEKERGLIDITAHRVLPASDDDRLISLYAASLGKGKYCFKLVPPQPGSKKGLTFTEPRVHYFAVENKSEMKAWLSAIIKATIDIDTSVPVISSYATPTIPLSKAQTLLEEARLQTQLRDAEEEEGRDQFGWDDTQNKRNSNYPIEQDQFETSDYLESSAFEYPGGRL

SEQ ID NO: 1407 - protein, 758 aa, Saccharomyces cerevisiae
MAVNPELAPFTLSRGIPSFDDQALSTIIQLQDCIQQAIQQLNYSTAEFLAELLYAECSILDKSSVYWSDAVYLYALSLFLNKSYHTAFQISKEFKEYHLGIAYIFGRCALQLSQGVNEAILTLLSIINVFSSNSSNTRINMVLNSNLVHIPDLATLNCLLGNLYMKLDHSKEGAFYHSEALAINPYLWESYEAICKMRATVDLKRVFFDIAGKKSNSHNNNAASSFPSTSLSHFEPRSQPSLYSKTNKNGNNNINNNVNTLFQSSNSPPSTSASSFSSIQHFSRSQQQQANTSIRTCQNKNTQTPKNPAINSKTSSALPNNISMNLVSPSSKQPTISSLAKVYNRNKLLTTPPSKLLNNDRNHQNNNNNNNNNNNNNNNNNNNNNNNNIINKTTFKTPRNLYSSTGRLTTSKKNPRSLIISNSILTSDYQITLPEIMYNFALILRSSSQYNSFKAIRLFESQIPSHIKDTMPWCLVQLGKLHFEIINYDMSLKYFNRLKDLQPARVKDMEIFSTLLWHLHDKVKSSNLANGLMDTMPNKPETWCCIGNLLSLQKDHDAAIKAFEKATQLDPNFAYAYTLQGHEHSSNDSSDSAKTCYRKALACDPQHYNAYYGLGTSAMKLGQYEEALLYFEKARSINPVNVVLICCCGGSLEKLGYKEKALQYYELACHLQPTSSLSKYKMGQLLYSMTRYNVALQTFEELVKLVPDDATAHYLLGQTYRIVGRKKDAIKELTVAMNLDPKGNQVIIDELQKCHMQE

SEQ ID NO: 1408 - protein, 458 aa, Saccharomyces cerevisiae
MEGEQSPQGEKSLQRKQFVRPPLDLWQDLKDGVRYVIFDCRANLIVMPLLILFESMLCKIIIKKVAYTEIDYKAYMEQIEMIQLDGMLDYSQVSGGTGPLVYPAGHVLIYKMMYWLTEGMDHVERGQVFFRYLYLLTLALQMACYYLLHLPPWCVVLACLSKRLHSIYVLRLFNDCFTTLFMVVTVLGAIVASRCHQRPKLKKSLALVISATYSMAVSIKMNALLYFPAMMISLFILNDANVILTLLDLVAMIAWQVAVAVPFLRSFPQQYLHCAFNFGRKFMYQWSINWQMMDEEAFNDKRFHLALLISHLIALTTLFVTRYPRILPDLWSSLCHPLRKNAVLNANPAKTIPFVLIASNFIGVLFSRSLHYQFLSWYHWTLPILIFWSGMPFFVGPIWYVLHEWCWNSYPPNSQASTLLLALNTVLLLLLALTQLSGSVALAKSHLRTTSSMEKKLN

SEQ ID NO: 1409 - protein, 649 aa, Saccharomyces cerevisiae
MSRAVGIDLGTTYSCVAHFSNDRVEIIANDQGNRTTPSYVAFTDTERLIGDAAKNQAAINPHNTVFDAKRLIGRKFDDPEVTTDAKHFPFKVISRDGKPVVQVEYKGETKTFTPEEISSMVLSKMKETAENYLGTTVNDAVVTVPAYFNDSQRQATKDAGTIAGMNVLRIINEPTAAAIAYGLDKKGRAEHNVLIFDLGGGTFDVSLLSIDEGVFEVKATAGDTHLGGEDFDNRLVNHLATEFKRKTKKDISNNQRSLRRLRTAAERAKRALSSSSQTSIEIDSLFEGMDFYTSLTRARFEELCADLFRSTLEPVEKVLKDSKLDKSQIDEIVLVGGSTRIPKIQKLVSDFFNGKEPNRSINPDEAVAYGAAVQAAILTGDQSTKTQDLLLLDVAPLSLGIETAGGIMTKLIPRNSTIPTKKSETFSTYADNQPGVLIQVFEGERTRTKDNNLLGKFELSGIPPAPRGVPQIDVTFDIDANGILNVSALEKGTGKSNKITITNDKGRLSKDDIDRMVSEAEKYRADDEREAERVQAKNQLESYAFTLKNTINEASFKEKVGEDDAKRLETASQETIDWLDASQAASTDEYKDRQKELEGIANPIMTKFYGAGAGAGPGAGESGGFPGSMPNSGATGGGEDTGPTVEEVD

SEQ ID NO: 1410 - protein, 355 aa, Saccharomyces cerevisiae
MVIDLEHVVDYIMHIDSQLQLHKASPAKMNSESREDMAINSIKLLAGNSHPDLAEQISKKLGIPLSKVGVYQYSNKETSVTIGESLRDEDVYIIQTGIGEQEINDFLMELLILIHACQIASARKITTVIPNFPYARQDKKDKSRAPITAKLVANLLQTAGADHVITMDLHASQIQGFFHIPVDNLYAEPSVLNYIRARKTDFDNAILVSPDAGGAKRVAALADKLDLNFALIHKERQKANEVSKMVLVGDVTNKSCLLVDDMADTCGTLVKACDTLMEHGAKEVIAIVTHGIFSGSAREKLRNSRLSRIVCTNTVPVDLDLPIADQIDISPTFAEAIRRLHNGESVSYLFTHAPV

SEQ ID NO: 1411 - protein, 688 aa, Saccharomyces cerevisiae
MIRRWLTISKSGKKKKAVNDTITEEVEKVDFKPVNHDINDELCYSESSDNPSSSLFVSNLDTKETFLNEDNNLQISSGLDYSSETCNQGSNYSQDGIFYISNAKAINAYGGIITQGPEAPILAMKVSDSMPYGDGSNKVFGYENFGNTCYCNSVLQCLYNLSSLRENILQFPKKSRESDHPRKKEMRGKKPRIFTEASFEKSIAGTNGHLPNPKPQSVDDGKPTPVNSVNSNTAGPSEKKSKFFKSFSAKHVQDNNKKEGSPAILTTGKPSSRPQDAPPLIVETPNEPGAPSRLSFENVTDRPPDVPRKIIVGRVLNYENPSRGSSNSNNLDLKGESNSSLSTPLDKKDTRRSSSSSQISPEHRKKSALIRGPVLNIDHSLNGSDKATLYSSLRDIFECITENTYLTGVVSPSSFVDVLKRENVLFNTTMHQDAHEFFNFLLNELSEYIERENKKIAASDINSDSEPSKSKNFISDLFQGTLTNQIKCLTCDNITSRDEPFLDFPIEVQGDEETDIQEILKSYHQREMLNGSNKFYCDECCGLQEAERLVGLKQLPDTLTLHLKRFKYSEKQNCNIKLFNNIHYPLTLNVCSSINSKVCQKYELAGIVVHMGGGPQHGHYVSLCKHEKFGWLLFDDETVEAVKEETVLEFTGESPNMATAYVCFIKRCIQTLLKRMIVKIWQKNKMII

SEQ ID NO: 1412 - protein, 261 aa, Saccharomyces cerevisiae
MFSRICSAQLKRTAWTLPKQAHLQSQTIKTFATAPILCKQFKQSDQPRLRINSDAPNFDADTTVGKINFYDYLGDSWGVLFSHPADFTPVCTTEVSAFAKLKPEFDKRNVKLIGLSVEDVESHEKWIQDIKEIAKVKNVGFPIIGDTFRNVAFLYDMVDAEGFKNINDGSLKTVRSVFVIDPKKKIRLIFTYPSTVGRNTSEVLRVIDALQLTDKEGVVTPINWQPADDVIIPPSVSNDEAKAKFGQFNEIKPYLRFTKSK

SEQ ID NO: 1413 - protein, 1111 aa, Saccharomyces cerevisiae
MARSSLPNRRTAQFEANKRRTIAHAPSPSLSNGMHTLTPPTCNNGAATSDSNIHVYVRCRSRNKREIEEKSSVVISTLGPQGKEIILSNGSHQSYSSSKKTYQFDQVFGAESDQETVFNATAKNYIKEMLHGYNCTIFAYGQTGTGKTYTMSGDINILGDVQSTDNLLLGEHAGIIPRVLVDLFKELSSLNKEYSVKISFLELYNENLKDLLSDSEDDDPAVNDPKRQIRIFDNNNNNSSIMVKGMQEIFINSAHEGLNLLMQGSLKRKVAATKCNDLSSRSHTVFTITTNIVEQDSKDHGQNKNFVKIGKLNLVDLAGSENINRSGAENKRAQEAGLINKSLLTLGRVINALVDHSNHIPYRESKLTRLLQDSLGGMTKTCIIATISPAKISMEETASTLEYATRAKSIKNTPQVNQSLSKDTCLKDYIQEIEKLRNDLKNSRNKQGIFITQDQLDLYESNSILIDEQNLKIHNLREQIKKFKENYLNQLDINNLLQSEKEKLIAIIQNFNVDFSNFYSEIQKIHHTNLELMNEVIQQRDFSLENSQKQYNTNQNMQLKISQQVLQTLNTLQGSLNNYNSKCSEVIKGVTEELTRNVNTHKAKHDSTLKSLLNITTNLLMNQMNELVRSISTSLEIFQSDSTSHYRKDLNEIYQSHQQFLKNLQNDIKSCLDSIGSSILTSINEISQNCTTNLNSMNVLIENQQSGSSKLIKEQDLEIKKLKNDLINERRISNQFNQQLAEMKRYFQDHVSRTRSEFHDELNKCIDNLKDKQSKLDQDIWQKTASIFNETDIVVNKIHSDSIASLAHNAENTLKTVSQNNESFTNDLISLSRGMNMDISSKLRSLPINEFLNKISQTICETCGDDNTIASNPVLTSIKKFQNIICSDIALTNEKIMSLIDEIQSQIETISNENNINLIAINENFNSLCNFILTDYDENIMQISKTQDEVLSEHCEKLQSLKILGMDIFTAHSIEKPLHEHTRPEASVIKALPLLDYPKQFQIYRDAENKSKDDTSNSRTCIPNLSTNENFPLSQFSPKTPVPVPDQPLPKVLIPKSINSAKSNRSKTLPNTEGTGRESQNNLKRRFTTEPILKGEETENNDILQNKKLHQ

SEQ ID NO: 1414 - protein, 696 aa, Saccharomyces cerevisiae
MASSPQVHPYKKHLMQSQHINFDNRGLQFQNSSLKVGQDFSDNKENRENRDNEDFSTADLPKRSANQPLINEHLRAASVPLLSNDIGNSQEEDFVPVPPPQLHLNNSNNTSLSSLGSTPTNSPSPGALRQTNSSTSLTKEQIKKRTRSVDLSHMYLLNGSSDTQLTATNESVADLSHQMISRYLGGKNNTSLVPRLKTIEMYRQNVKKSKDPEVLFQYAQYMLQTALTIESSNALVQDSDKEGNVSQSDLKLQFLKEAQSYLKKLSIKGYSDAQYLLADGYSSGAFGKIENKEAFVLFQAAAKHGHIESAYRASHCLEEGLGTTRDSRKSVNFLKFAASRNHPSAMYKLGLYSFYGRMGLPTDVNTKLNGVKWLSRAAARANELTAAAPYELAKIYHEGFLDVVIPDEKYAMELYIQAASLGHVPSATLLAQIYETGNDTVGQDTSLSVHYYTQAALKGDSVAMLGLCAWYLLGAEPAFEKDENEAFQWALRAANAGLPKAQFTLGYFYEHGKGCDRNMEYAWKWYEKAAGNEDKRAINKLRSRDGGLASIGKKQHKKNKSISTLNLFSTVDSQTSNVGSNSRVSSKSETFFTGNPKRDREPQGLQINMNSNTNRNGIKTGSDTSIRKSSSSAKGMSREVAEQSMAAKQEVSLSNMGSSNMIRKDFPAVKTESKKPTSLKNKKDKQGKKKKDCVIM

SEQ ID NO: 1415 - protein, 423 aa, Saccharomyces cerevisiae
MAEIPDETIQQFMALTNVSHNIAVQYLSEFGDLNEALNSYYASQTDDQKDRREEAHWNRQQEKALKQEAFSTNSSNKAINTEHVGGLCPKPGSSQGSNEYLKRKGSTSPEPTKGSSRSGSGNNSRFMSFSDMVRGQADDDDEDQPRNTFAGGETSGLEVTDPSDPNSLLKDLLEKARRGGQMGAENGFRDDEDHEMGANRFTGRGFRLGSTIDAADEVVEDNTSQSQRRPEKVTREITFWKEGFQVADGPLYRYDDPANSFYLSELNQGRAPLKLLDVQFGQEVEVNVYKKLDESYKAPTRKLGGFSGQGQRLGSPIPGESSPAEVPKNETPAAQEQPMPDNEPKQGDTSIQIRYANGKREVLHCNSTDTVKFLYEHVTSNANTDPSRNFTLNYAFPIKPISNDETTLKDADLLNSVVVQRWA

SEQ ID NO: 1416 - protein, 468 aa, Saccharomyces cerevisiae
MGQILSNPIIDKEHHSGTDCLTAFGLCAMQGWRMSMEDAHIVEPNLLAESDEEHLAFYGIFDGHGGSSVAEFCGSKMISILKKQESFKSGMLEQCLIDTFLATDVELLKDEKLKDDHSGCTATVILVSQLKKLLICANSGDSRTVLSTGGNSKAMSFDHKPTLLSEKSRIVAADGFVEMDRVNGNLALSRAIGDFEFKSNTKLGPHEQVVTCVPDIICHNLNYDEDEFVILACDGIWDCLTSQECVDLVHYGISQGNMTLSDISSRIVDVCCSPTTEGSGIGCDNMSISIVALLKENESESQWFERMRSKNYNIQTSFVQRRKSIFDFHDFSDDDNEVFAITTKKLQDRLNRSKDNDDMEIDDLDTELDSSATPSKLSGEDRTGPIDLFSLEALLEAGIQIRQRPSSDSDGNTSYFHGASLSDMLASLSNAAAGETEPNDADDNDDNDGEENGKNENAKKGSKIEEIE

SEQ ID NO: 1417 - protein, 1381 aa, Saccharomyces cerevisiae
MASITFRTPLSSQEQAFYNQKFHQLDTEDLGVVTGEAVRPLFASSGLPGQLLSQVWATVDIDNKGFLNLNEFSAALRMIAQLQNAPNQPISAALYESTPTQLASFSINQNPAPMQSGSATGNTNNTDIPALSSNDIAKFSQLFDRTAKGAQTVAGDKAKDIFLKARLPNQTLGEIWALCDRDASGVLDKSEFIMAMYLIQLCMSHHPSMNTPPAVLPTQLWDSIRLEPVVVNQPNRTTPLSANSTGVSSLTRHSTISRLSTGAFSNAASDWSLSFEKKQQFDAIFDSLDKQHAGSLSSAVLVPFFLSSRLNQETLATIWDLADIHNNAEFTKLEFAIAMFLIQKKNAGVELPDVIPNELLQSPALGLYPPNPLPQQQSAPQIAIPSRASKPSLQDMPHQVSAPAVNTQPTVPQVLPQNSNNGSLNDLLALNPSFSSPSPTKAQTVVQNNTNNSFSYDNNNGQATLQQQQPQQPPPLTHSSSGLKKFTPTSNFGQSIIKEEPEEQEQLRESSDTFSAQPPPVPKHASSPVKRTASTTLPQVPNFSVFSMPAGAATSAATGAAVGAAVGAAALGASAFSRSSNNAFKNQDLFADGEASAQLSNATTEMANLSNQVNSLSKQASITNDKKSRATQELKRVTEMKNSIQIKLNNLRSTHDQNVKQTEQLEAQVLQVNKENETLAQQLAVSEANYHAAESKLNELTTDLQESQTKNAELKEQITNLNSMTASLQSQLNEKQQQVKQERSMVDVNSKQLELNQVTVANLQKEIDGLGEKISVYLTKQKELNDYQKTVEEQHAQLQAKYQDLSNKDTDLTDREKQLEERNRQIEEQENLYHQHVSKLQEMFDDLSQRKASFEKADQELKERNIEYANNVRELSERQMNLAMGQLPEDAKDIIAKSASNTDTTTKEATSRGNVHEDTVSKFVETTVENSNLNVNRVKDDEEKTERTESDVFDRDVPTLGSQSDSENANTNNGTQSGNETANPNLTETLSDRFDGDLNEYGIPRSQSLTSSVANNAPQSVRDDVELPETLEERDTINNTANRDNTGNLSHIPGEWEATPATASTDVLSNETTEVIEDGSTTKRANSNEDGESVSSIQESPKISAQPKAKTINEEFPPIQELHIDESDSSSSDDDEFEDTREIPSATVKTLQTPYNAQPTSSLEIHTEQVIKYPAPGTSPSHNEGNSKKASTNSILPVKDEFDDEFAGLEQAAVEEDNGADSESEFENVANAGSMEQFETIDHKDLDDELQMNAFTGTLTSSSNPTIPKPQVQQQSTSDPAQVSNDEWDEIFAGFGNSKAEPTKVATPSIPQQPIPLKNDPIVDASLSKGPIVNRGVATTPKSLAVEELSGMGFTEEEAHNALEKCNWDLEAATNFLLDSA

SEQ ID NO: 1418 - protein, 457 aa, Saccharomyces cerevisiae
MLRTVTSKTVSNQFKRSLATAVATPKAEVTQLSNGIVVATEHNPSAHTASVGVVFGSGAANENPYNNGVSNLWKNIFLSKENSAVAAKEGLALSSNISRDFQSYIVSSLPGSTDKSLDFLNQSFIQQKANLLSSSNFEATKKSVLKQVQDFEENDHPNRVLEHLHSTAFQNTPLSLPTRGTLESLENLVVADLESFANNHFLNSNAVVVGTGNIKHEDLVNSIESKNLSLQTGTKPVLKKKAAFLGSEVRLRDDTLPKAWISLAVEGEPVNSPNYFVAKLAAQIFGSYNAFEPASRLQGIKLLDNIQEYQLCDNFNHFSLSYKDSGLWGFSTATRNVTMIDDLIHFTLKQWNRLTISVTDTEVERAKSLLKLQLGQLYESGNPVNDANLLGAEVLIKGSKLSLGEAFKKIDAITVKDVKAWAGKRLWDQDIAIAGTGQIEGLLDYMRIRSDMSMMRW

SEQ ID NO: 1419 - protein, 241 aa, Saccharomyces cerevisiae
MATIASEYSSEASNTPIEHQFNPYGDNGGTILGIAGEDFAVLAGDTRNITDYSINSRYEPKVFDCGDNIVMSANGFAADGDALVKRFKNSVKWYHFDHNDKKLSINSAARNIQHLLYGKRFFPYYVHTIIAGLDEDGKGAVYSFDPVGSYEREQCRAGGAAASLIMPFLDNQVNFKNQYEPGTNGKVKKPLKYLSVEEVIKLVRDSFTSATERHIQVGDGLEILIVTKDGVRKEFYELKRD

SEQ ID NO: 1420 - protein, 705 aa, Saccharomyces cerevisiae
MSGSIDVITHFGPDADKPEIITALENLTKLHALSVEDLYIKWEQFSNQRRQTHTDLTSKNIDEFKQFLQLQMEKRANQISSSSKVNTSTKKPVIKKSLNSSPLFGLSIPKTPTLKKRKLHGPFSLSDSKQTYNVGSEAETNEKGNSSLKLEFTPGMAEDAVGDSAPLSHAKSSDAKTPGSSTFQTPTTNTPTTSRQNVPAGEILDSLNPENIEISSGNPNVGLLSTEEPSYNQVKVEPFYDAKKYKFRTMRQNLQEASDVLDDQIESFTKIIQNHYKLSPNDFADPTIQSQSEIYAVGRIVPDSPTYDKFLNPESLSLETSRMGGVGRRVRLDLSQVNELSFFLGQIVAFKGKNANGDYFTVNSILPLPYPNSPVSTSQELQEFQANLEGSSLKVIVTCGPYFANDNFSLELLQEFIDSINNEVKPHVLIMFGPFIDITHPLIASGKLPNFPQFKTQPKTLDELFLKLFTPILKTISPHIQTVLIPSTKDAISNHAAYPQASLIRKALQLPKRNFKCMANPSSFQINEIYFGCSNVDTFKDLKEVIKGGTTSSRYRLDRVSEHILQQRRYYPIFPGSIRTRIKPKDVSTKKETNDMESKEEKVYEHISGADLDVSYLGLTEFVGGFSPDIMIIPSELQHFARVVQNVVVINPGRFIRATGNRGSYAQITVQCPDLEDGKLTLVEGEEPVYLHNVWKRARVDLIAS

SEQ ID NO: 1421 - protein, 318 aa, Saccharomyces cerevisiae
MSSNAQVKTPLPPAPAPKKESNFLIDFLMGGVSAAVAKTAASPIERVKLLIQNQDEMLKQGTLDRKYAGILDCFKRTATQEGVISFWRGNTANVIRYFPTQALNFAFKDKIKAMFGFKKEEGYAKWFAGNLASGGAAGALSLLFVYSLDYARTRLAADSKSSKKGGARQFNGLIDVYKKTLKSDGVAGLYRGFLPSVVGIVVYRGLYFGMYDSLKPLLLTGSLEGSFLASFLLGWVVTTGASTCSYPLDTVRRRMMMTSGQAVKYDGAFDCLRKIVAAEGVGSLFKGCGANILRGVAGAGVISMYDQLQMILFGKKFK

SEQ ID NO: 1422 - protein, 868 aa, Saccharomyces cerevisiae
MSDNRRRRREEDDSDSENELPPSSPQQHFRGGMNPVSSPIGSPDMINPEGDDNEVDDVPDIDEVEEQMNEVDLMDDNMYEDYAADHNRDRYDPDQVDDREQQELSLSERRRIDAQLNERDRLLRNVAYIDDEDEEQEGAAQLDEMGLPVQRRRRRRQYEDLENSDDDLLSDMDIDPLREELTLESLSNVKANSYSEWITQPNVSRTIARELKSFLLEYTDETGRSVYGARIRTLGEMNSESLEVNYRHLAESKAILALFLAKCPEEMLKIFDLVAMEATELHYPDYARIHSEIHVRISDFPTIYSLRELRESNLSSLVRVTGVVTRRTGVFPQLKYVKFNCLKCGSILGPFFQDSNEEIRISFCTNCKSKGPFRVNGEKTVYRNYQRVTLQEAPGTVPPGRLPRHREVILLADLVDVSKPGEEVEVTGIYKNNYDGNLNAKNGFPVFATIIEANSIKRREGNTANEGEEGLDVFSWTEEEEREFRKISRDRGIIDKIISSMAPSIYGHRDIKTAVACSLFGGVPKNVNGKHSIRGDINVLLLGDPGTAKSQILKYVEKTAHRAVFATGQGASAVGLTASVRKDPITKEWTLEGGALVLADKGVCLIDEFDKMNDQDRTSIHEAMEQQSISISKAGIVTTLQARCSIIAAANPNGGRYNSTLPLAQNVSLTEPILSRFDILCVVRDLVDEEADERLATFVVDSHVRSHPENDEDREGEELKNNGESAIEQGEDEINEQLNARQRRLQRQRKKEEEISPIPQELLMKYIHYARTKIYPKLHQMDMDKVSRVYADLRRESISTGSFPITVRHLESILRIAESFAKMRLSEFVSSYDLDRAIKVVVDSFVDAQKVSVRRQLRRSFAIYTLGH

SEQ ID NO: 1423 - protein, 1133 aa, Saccharomyces cerevisiae
MLRTRTTKTLSTVARTTRAIQYYRSIAKTAAVSQRRFASTLTVRDVENIKPSHIIKSPTWQEFQHQLKDPRYMEHFAQLDAQFARHFMATNSGKSILAKDDSTSQKKDEDVKIVPDEKDTDNDVEPTRDDEIVNKDQEGEASKNSRSSASGGGQSSSSRSDSGDGSSKQKPPKDVPEVYPQMLALPIARRPLFPGFYKAVVISDERVMKAIKEMLDRQQPYIGAFMLKNSEEDTDVITDKNDVYDVGVLAQITSAFPSKDEKTGTETMTALLYPHRRIKIDELFPPNEEKEKSKEQAKDTDTETTVVEDANNPEDQESTSPATPKLEDIVVERIPDSELQHHKRVEATEEESEELDDIQEGEDINPTEFLKNYNVSLVNVLNLEDEPFDRKSPVINALTSEILKVFKEISQLNTMFREQIATFSASIQSATTNIFEEPARLADFAAAVSAGEEDELQDILSSLNIEHRLEKSLLVLKKELMNAELQNKISKDVETKIQKRQREYYLMEQLKGIKRELGIDDGRDKLIDTYKERIKSLKLPDSVQKIFDDEITKLSTLETSMSEFGVIRNYLDWLTSIPWGKHSKEQYSIPRAKKILDEDHYGMVDVKDRILEFIAVGKLLGKVDGKIICFVGPPGVGKTSIGKSIARALNRKFFRFSVGGMTDVAEIKGHRRTYIGALPGRVVQALKKCQTQNPLILIDEIDKIGHGGIHGDPSAALLEVLDPEQNNSFLDNYLDIPIDLSKVLFVCTANSLETIPRPLLDRMEVIELTGYVAEDKVKIAEQYLVPSAKKSAGLENSHVDMTEDAITALMKYYCRESGVRNLKKHIEKIYRKAALQVVKKLSIEDSPTSSADSKPKESVSSEEKAENNAKSSSEKTKDNNSEKTSDDIEALKTSEKINVSISQKNLKDYVGPPVYTTDRLYETTPPGVVMGLAWTNMGGCSLYVESVLEQPLHNCKHPTFERTGQLGDVMKESSRLAYSFAKMYLAQKFPENRFFEKASIHLHCPEGATPKDGPSAGVTMATSFLSLALNKSIDPTVAMTGELTLTGKVLRIGGLREKAVAAKRSGAKTIIFPKDNLNDWEELPDNVKEGLEPLAADWYNDIFQKLFKDVNTKEGNSVWKAEFEILDAKKEKD

SEQ ID NO: 1424 - protein, 353 aa, Saccharomyces cerevisiae
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEYVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHYKEALTTKDLKKLIWNEIFS

SEQ ID NO: 1425 - protein, 1244 aa, Saccharomyces cerevisiae [sequence omitted]

SEQ ID NO: 1426 - protein, 780 aa, Saccharomyces cerevisiae
MVDFLPKVTEINPPSEGNDGEDNIKPLSSGSEQRPLKEEGQQGGRRHHRRLSSMHEYFDPFSNAEVYYGPITDPRKQSKIHRLNRTRTMSVFNKVSDFKNGMKDYTLKRRGSEDDSFLSSQGNRRFYIDNVDLALDELLASEDTDKNHQITIEDTGPKVIKVGTANSNGFKHVNVRGTYMLSNLLQELTIAKSFGRHQIFLDEARINENPVDRLSRLITTQFWTSLTRRVDLYNIAEIARDSKIDTPGAKNPRIYVPYNCPEQYEFYIQASQMNPSLKLEVEYLPKDITAEYVKSLNDTPGLLALAMEEHVNPSTGERSLVGYPYAVPGGRFNELYGWDSYLMALGLIESNKVDVARGMVEHFIFEIDHYSKILNANRSYYLCRSQPPFLTDMALLVFEKIGGKNNPNAIQLLKRAFRAAIKEYKEVWMSSPRLDSLTGLSCYHSDGIGIPPETEPDHFDTILLPYAEKYNVTLEKLRYLYNEGMIKEPKLDAFFLHDRAVRESGHDTTYRFEGVCAYLATIDLNSLLYKYEKDIAFVIKEYFGNEYKDENDGTVTDSEHWEELAELRKTRINKYMWDEDSGFFFYYNTKLKCRTSYESATTFWSLWAGLATEEQAKITVEKALPQLEMLGGLVACTEKSRGPISIDRPIRQWDYPFGWAPHQILAWKGLSAYGYQQVATRLAYRWLYMITKSFVDYNGMVVEKYDVTRGTDPHRVDAEYGNQGADFKGVATEGFGWVNTSYLLGLKYMNNHARRALAACSPPLPFFNSLKPSEKKLYYL

SEQ ID NO: 1427 - protein, 473 aa, Saccharomyces cerevisiae
MFQRSGAAHHIKLISSRRCRFKSSFAVALNAASKLVTPKILWNNPISLVSKEMNTLAKNIVALIGSGHPVLNKVTSYYFETEGKKVRPLLVLLLSRALSEIPMTERNHLKIDKSDVPEDPIYSKPSQNQLFQRPASSISPLHILHGIKPLNPLTKGPEPLPEETFDKQRGILPKQRRLAEIVEMIHTASLLHDDVIDHSDTRRGRPSGNAAFTNKMAVLAGDFLLGRATVSISRLHNPEVVELMSNSIANLVEGEFMQLKNTSIDADIDTIENGHKLLPVPSKKLEVKEHDFRVPSRQQGLQLSHDQIIETAFEYYIHKTYLKTAALISKSCRCAAILSGASPAVIDECYDFGRNLGICFQLVDDMLDFTVSGKDLGKPSGADLKLGIATAPVLFAWKEDPSLGPLISRNFSERGDVEKTIDSVRLHNGIAKTKILAEEYRDKALQNLRDSLPESDARSALEFLTNSILTRRK

SEQ ID NO: 1428 - protein, 435 aa, Saccharomyces cerevisiae
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNT

SEQ ID NO: 1429 - protein, 366 aa, Saccharomyces cerevisiae
MTAEEFDFSSHSHRRYNPLTDSWILVSPHRAKRPWLGQQEAAYKPTAPLYDPKCYLCPGNKRATGNLNPRYESTYIFPNDYAAVRLDQPILPQNDSNEDNLKNRLLKVQSVRGNCFVICFSPNHNLTIPQMKQSDLVHIVNSWQALTDDLSREARENHKPFKYVQIFENKGTAMGCSNLHPHGQAWCLESIPSEVSQELKSFDKYKREHNTDLFADYVKLESREKSRVVVENESFIVVVPYWAIWPFETLVISKKKLASISQFNQMVKEDLASILKQLTIKYDNLFETSFPYSMGIHQAPLNATGDELSNSWFHMHFYPPLLRSATVRKFLVGFELLGEPQRDLTSEQAAEKLRNLDGQIHYLQRL

SEQ ID NO: 1430 - protein, 699 aa, Saccharomyces cerevisiae
MTAQLQSESTSKIVLVTGGAGYIGSHTVVELIENGYDCVVADNLSNSTYDSVARLEVLTKHHIPFYEVDLCDRKGLEKVFKEYKIDSVIHFAGLKAVGESTQIPLRYYHNNILGTVVLLELMQQYNVSKFVFSSSATVYGDATRFPNMIPIPEECPLGPTNPYGHTKYAIENILNDLYNSDKKSWKFAILRYFNPIGAHPSGLIGEDPLGIPNNLLPYMAQVAVGRREKLYIFGDDYDSRDGTPIRDYIHVVDLAKGHIAALQYLEAYNENEGLCREWNLGSGKGSTVFEVYHAFCKASGIDLPYKVTGRRAGDVLNLTAKPDRAKRELKWQTELQVEDSCKDLWKWTTENPFGYQLRGVEARFSAEDMRYDARFVTIGAGTRFQATFANLGASIVDLKVNGQSVVLGYENEEGYLNPDSAYIGATIGRYANRISKGKFSLCNKDYQLTVNNGVNANHSSIGSFHRKRFLGPIIQNPSKDVFTAEYMLIDNEKDTEFPGDLLVTIQYTVNVAQKSLEMVYKGKLTAGEATPINLTNHSYFNLNKPYGDTIEGTEIMVRSKKSVDVDKNMIPTGNIVDREIATFNSTKPTVLGPKNPQFDCCFVVDENAKPSQINTLNNELTLIVKAFHPDSNITLEVLSTEPTYQFYTGDFLSAGYEARQGFAIEPGRYIDAINQENWKDCVTLKNGETYGSKIVYRFS

SEQ ID NO: 1431 - protein, 528 aa, Saccharomyces cerevisiae
MTKSHSEEVIVPEFNSSAKELPRPLAEKCPSIIKKFISAYDAKPDFVARSPGRVNLIGEHIDYCDFSVLPLAIDFDMLCAVKVLNEKNPSITLINADPKFAQRKFDLPLDGSYVTIDPSVSDWSNYFKCGLHVAHSFLKKLAPERFASAPLAGLQVFCEGDVPTGSGLSSSAAFICAVALAVVKANMGPGYHMSKQNLMRITVVAEHYVGVNNGGMDQAASVCGEEDHALYVEFKPQLKATPFKFPQLKNHEISFVIANTLVVSNKFETAPTNYNLRVVEVTTAANVLAATYGVVLLSGKEGSSTNKGNLRDFMNVYYARYHNISTPWNGDIESGIERLTKMLVLVEESLANKKQGFSVDDVAQSLNCSREEFTRDYLTTSPVRFQVLKLYQRAKHVYSESLRVLKAVKLMTTASFTADEDFFKQFGALMNESQASCDKLYECSCPEIDKICSIALSNGSYGSRLTGAGWGGCTVHLVPGGPNGNIEKVKEALANEFYKVKYPKITDAELENAIIVSKPALGSCLYEL

SEQ ID NO: 1432 - protein, 1165 aa, Saccharomyces cerevisiae
MTGLNGDDPDDYYLNLNQDEESLLRSRHSVGSGAPHRQGSLVRPERSRLNNPDNPHFYYAQKTQEQMNHLDVLPSSTGVNPNATRRSGSLRSKGSVRSKFSGRETDSYLLQDMNTTDKKASVKISDEGVAEDEFDKDGDVDNFEESSTQPINKSIKPLRKETNDTLSFWQMYCYFITFWAPAPILAFCGMPKKERQMAWREKVALISVILYIGAIVAFLTFGFTKTVCSSSKLRLKNNEVSTEFVVINGKAYELDTSSRSGIQDVEVDSDTLYGPWSDAGKDASFLFQNVNGNCHNLITPKSNSSIPHDDDNNLAWYFPCKLKNQDGSSKPNFTVENYAGWNCHTSKEDRDAFYGLKSKADVYFTWDGIKNSSRNLIVYNGDVLDLDLLDWLEKDDVDYPVVFDDLKTSNLQGYDLSLVLSNGHERKIARCLSEIIKVGEVDSKTVGCIASDVVLYVSLVFILSVVIIKFIIACYFRWTVARKQGAYIVDNKTMDKHTNDIEDWSNNIQTKAPLKEVDPHLRPKKYSKKSLGHKRASTFDLLKKHSSKMFQFNESVIDLDTSMSSSLQSSGSYRGMTTMTTQNAWKLSNENKAVHSRNPSTLLPTSSMFWNKATSSPVPGSSLIQSLDSTIIHPDIVQQPPLDFMPYGFPLIHTICFVTCYSEDEEGLRTTLDSLSTTDYPNSHKLLMVVCDGLIKGSGNDKTTPEIALGMMDDFVTPPDEVKPYSYVAVASGSKRHNMAKIYAGFYKYDDSTIPPENQQRVPIITIVKCGTPAEQGAAKPGNRGKRDSQIILMSFLEKITFDERMTQLEFQLLKNIWQITGLMADFYETVLMVDADTKVFPDALTHMVAEMVKDPLIMGLCGETKIANKAQSWVTAIQVFEYYISHHQAKAFESVFGSVTCLPGCFSMYRIKSPKGSDGYWVPVLANPDIVERYSDNVTNTLHKKNLLLLGEDRFLSSLMLKTFPKRKQVFVPKAACKTIAPDKFKVLLSQRRRWINSTVHNLFELVLIRDLCGTFCFSMQFVIGIELIGTMVLPLAICFTIYVIIFAIVSKPTPVITLVLLAIILGLPGLIVVITATRWSYLWWMCVYICALPIWNFVLPSYAYWKFDDFSWGDTRTIAGGNKKAQDENEGEFDHSKIKMRTWREFEREDILNRKEESDSFVA

SEQ ID NO: 1433 - protein, 525 aa, Saccharomyces cerevisiae
MIFSLDEELHRVSLDDKKNDIKVDYSSAIYNDINHEQGSSITYEESINHLSVHSNAIPLNGMSPAHRMRRRSSAYSKFPILTPPNTRRFSITGSDAMRTNTNRLSITPQDIISSNIGENELSRNLHDFKPVRVLGQGAYGKVLLVKDVNTSKLYAMKQLRKAEILISQTATDSKREDEDKNDGNNNDNDDGLSKRLERTFAERSILSEIEHPNIVKLFYSFHDNSKLYLLLQYIPGGELFYHLKEHGTLDETTVSFYAAEISCALRFLHTKGVVYRDLKPENCLLNQRGHLVLTDFGLSKKSANDSAVDEEDPENVNALYSIIGTPEYCAPEILLGKAYSQNCDWYSLGCLLYDMLVGKPPYTGSNHKVIINKIQQNKQGPKIPFYLSEGMKDILNALLKKETAKRWNVDKYWAKTGANNKPTKSKKKKSGAARTSLFTEHFIFRKIDWKLLESGQLQKTTLGPIVPVITDLELAENFDTEFTSMSYEETYTDSKPININSVSKSPDMFKGFSYKASGSYLEKYF

SEQ ID NO: 1434 - protein, 457 aa, Saccharomyces cerevisiae
MSDNPEMKPHGTSKEIVESVTDATSKAIDKLQEELHKDASESVTPVTKESTAATKESRKYNFFIRTVWTFVMISGFFITLASGHAWCIVLILGCQIATFKECIAVTSASGREKNLPLTKTLNWYLLFTTIYYLDGKSLFKFFQATFYEYPVLNFIVTNHKFICYCLYLMGFVLFVCSLRKGFLKFQFGSLCVTHMVLLLVVFQAHLIIKNVLNGLFWFLLPCGLVIVNDIFAYLCGITFGKTKLIEISPKKTLEGFLGAWFFTALASIILTRILSPYTYLTCPVEDLHTNFFSNLTCELNPVFLPQVYRLPPIFFDKVQINSITVKPIYFHALNLATFASLFAPFGGFFASGLKRTFKVKDFGHSIPGHGGITDRVDCQFIMGSFANLYYETFISEHRITVDTVLSTILMNLNDKQIIELIDILIRFLSKKGIISAKNFEKLADIFNVTKKSLTNHS

SEQ ID NO: 1435 - protein, 919 aa, Saccharomyces cerevisiae
MSHHVPNLYGTPIRDPHERKRNSASMGEVNQSVSSRNCERGSEKGTKQRKKASHACDQCRRKRIKCRFDKHTGVCQGCLEVGEKCQFIRVPLKRGPAKKRGSVVSIEKFSSDNDPLQYRPRTHSYPMNSGNNYLPSLARNSSFPSISSLFVPSITAQSQQFVKVPYDDIKRRSSLAILGSDSSISTEFGGNYRLDENLNVRQEGKDIVAKGMITPVEEMGACSSNVRRQGSQSLPIQEQRASPYINPFISGRSRLSSLSYTSEATTSEGNTQGKNQCMLTPNSVRSIEKERLNSLTAGFPNKKLGTDGRSDKWDKNSTWKPVYRSSNPSHPSTEKNVSLNQEASAKPLMLGTYRQFDATSFYKVLGIYYNFFHINFPVIPINKSKFTDMLDPEKPNVIDEIRQINNEIIQCFKTALEVLVFCKIKQRRSSKSTKSWSRDSLCDFQKGLYYIQNFNKCIADCFQSLITIKPVLKQNSSVIPSRIKFIYFSTIIVLNFILILAGEESSLLLGPSVGVFNEFQAHKLFLPFQNTSPMLLLNSNEESGDEILDYAVLFKRLYILLNILDTLQSFRLGQPKLINLNFGSAIETYFSDKTGHNQVVEKAPVALDNILRNLKLGEFITYFVLNRKSLQVNVPHHLLFTNQTDYGEFAVEKGEHDNIAGKFETLLKKKEILIRKLLNIEQKNDHILENCCNSDAEMKNIGELVCSMITLVSGILDSITNMNAENSVDLDSKPLPNAYFAQDSEEELMSPTQSITSNLASEENTRCTTKDLMGTVSIFMLPMVEECYNIISLIGPIPTTLISLYIRNGNMAKGINDRIMTLSTALNELVQITALFNTLEPFRKNAHDRAKRYYVSATSSTGCYESVMKSMYSGKCAASNASNVAPSEEENKKILKKFADIGWKLMDDSELGCCCCFFN

SEQ ID NO: 1436 - protein, 963 aa, Saccharomyces cerevisiae
MTRNPFMVEPSNGSPNRRGASNLSKFYANANSNSRWANPSEESLEDSYDQSNVFQGLPASPSRAALRYSPDRRHRTQFYRDSAHNSPVAPNRYAANLQESPKRAGEAVIHLSEGSNLYPRDNADLPVDPYHLSPQQQPSNNLFGSGRLYSQSSKYTMSTTSTTAPSLAEADDEKEKYLTSTTSYDDQSTIFSADTFNETKFELNHPTRQQYVRRANSESKRRMVSDLPPPSKKKALLKLDNPIPKGLLDTLPRRNSPEFTEMRYTACTVEPDDFLREGYTLRFAEMNRECQIAICITMYNEDKYSLARTIHSIMKNVAHLCKREKSHVWGPNGWKKVSVILISDGRAKVNQGSLDYLAALGVYQEDMAKASVNGDPVKAHIFELTTQVSINADLDYVSKDIVPVQLVFCLKEENKKKINSHRWLFNAFCPVLQPTVVTLVDVGTRLNNTAIYRLWKVFDMDSNVAGAAGQIKTMKGKWGLKLFNPLVASQNFEYKISNILDKPLESVFGYISVLPGALSAYRYRALKNHEDGTGPLRSYFLGETQEGRDHDVFTANMYLAEDRILCWELVAKRDAKWVLKYVKEATGETDVPEDVSEFISQRRRWLNGAMFAAIYAQLHFYQIWKTKHSVVRKFFLHVEFLYQFIQMLFSWFSIANFVLTFYYLAGSMNLVIKHGEALFIFFKYLIFCDLASLFIISMGNRPQGAKHLFITSMVILSICATYSLICGFVFAFKSLASGTESHKIFVDIVISLLSTYGLYFFSSLMYLDPWHMFTSSIQYFLTLPAFTCTLQIFAFCNTHDVSWGTKGSTQESKQLSKAIVVQGPDGKQIVETDWPQEVDKKFLEIKSRLKEPEFEESSGNEKQSKNDYYRDIRTRIVMIWMLSNLILIMSIIQVFTPQDTDNGYLIFILWSVAALAAFRVVGSMAFLFMKYLRIIVSYRNKVEGSGSWEVSKLDLPNVFHKKG

SEQ ID NO: 1437 - protein, 311 aa, Saccharomyces cerevisiae
MLSRIVSNNATRSVMCHQAQVGILYKTNPVRTYATLKEVEMRLKSIKNIEKITKTMKIVASTRLSKAEKAKISAKKMDEAEQLFYKNAETKNLDVEATETGAPKELIVAITSDKGLCGSIHSQLAKAVRRHLNDQPNADIVTIGDKIKMQLLRTHPNNIKLSINGIGKDAPTFQESALIADKLLSVMKAGTYPKISIFYNDPVSSLSFEPSEKPIFNAKTIEQSPSFGKFEIDTDANVPRDLFEYTLANQMLTAMAQGYAAEISARRNAMDNASKNAGDMINRYSILYNRTRQAVITNELVDIITGASSLG

SEQ ID NO: 1438 - protein, 623 aa, Saccharomyces cerevisiae
MSPIQVVVFALSRIFLLLFRLIKLIITPIQKSLGYLFGNYFDELDRKYRYKEDWYIIPYFLKSVFCYIIDVRRHRFQNWYLFIKQVQQNGDHLAISYTRPMAEKGEFQLETFTYIETYNIVLRLSHILHFDYNVQAGDYVAIDCTNKPLFVFLWLSLWNIGAIPAFLNYNTKGTPLVHSLKISNITQVFIDPDASNPIRESEEEIKNALPDVKLNYLEEQDLMHELLNSQSPEFLQQDNVRTPLGLTDFKPSMLIYTSGTTGLPKSAIMSWRKSSVGCQVFGHVLHMTNESTVFTAMPLFHSTAALLGACAILSHGGCLALSHKFSASTFWKQVYLTGATHIQYVGEVCRYLLHTPISKYEKMHKVKVAYGNGLRPDIWQDFRKRFNIEVIGEFYAATEAPFATTTFQKGDFGIGACRNYGTIIQWFLSFQQTLVRMDPNDDSVIYRNSKGFCEVAPVGEPGEMLMRIFFPKKPETSFQGYLGNAKETKSKVVRDVFRRGDAWYRCGDLLKADEYGLWYFLDRMGDTFRWKSENVSTTEVEDQLTASNKEQYAQVLVVGIKVPKYEGRAGFAVIKLTDNSLDITAKTKLLNDSLSRLNLPSYAMPLFVKFVDEIKMTDNLIKF

SEQ ID NO: 1439 - protein, 573 aa, Saccharomyces cerevisiae
MLRNCLRKLGNHQTKCSVKTLHTPIYRTKNLQVLRDTLSGIKLLEKIITSSSYNKTLIYEPKYKSKPQVVSSHDTMRLHNVMRELLDSLQVDEATNTRLQSNRPRKLGRVGLQLFMDCIQDNLTATSTSLTCSLLEHYFKYPEKEVTNGIKAGLRYIRDFLAKNKIIVKSQNDVDALVEQLTMSSSDSQSIKRVLKAINYELFSDDIVRVINGNKTYDEVDVSKGWKYPAGILDSNEAYLRSLELPTKKLVSIDKDMLVLMYDGTLRDANKILPTITYARKLRKSVLLIVNGDCTGDALTSVTINNNRNKRENNESRIVVLKYSKKANNDLAPQENLDFIKFLRLPCGYDSIYSPEYSPLVPSKMCADKYYGSIESIKATTGEAFLYNSIDAEAIPNKVPKSFLQNTVTLSIGGHNEIEIDRRRNAIDNCLNNVLCHGLAKGFIPGYGISLLKAIPGLNELKANEPNFMTKVGINAVLSAVILPSEVAFKNAYGYNYYEINSLIAGAINEKSFPMAKFSPNSEPVNTVKDGNLEPWSKMDSCLAGVETFIELLTSCNTIITCVYKSLNGTKPR

SEQ ID NO: 1440 - protein, 344 aa, Saccharomyces cerevisiae
MSDYVELLKRGGNEAIKINPPTGADFHITSRGSDWLFTVFCVNLLFGVILVPLMFRKPVKDRFVYYTAIAPNLFMSIAYFTMASNLGWIPVRAKYNHVQTSTQKEHPGYRQIFYARYVGWFLAFPWPIIQMSLLGGTPLWQIAFNVGMTEIFTVCWLIAACVHSTYKWGYYTIGIGAAIVVCISLMTTTFNLVKARGKDVSNVFITFMSVIMFLWLIAYPTCFGITDGGNVLQPDSATIFYGIIDLLILSILPVLFMPLANYLGIERLGLIFDEEPAEHVGPVAEKKMPSPASFKSSDSDSSIKEKLKLKKKHKKDKKKAKKAKKAKKAKKAQEEEEDVATDSE

SEQ ID NO: 1441 - protein, 803 aa, Saccharomyces cerevisiae
MAVEMTGKFIQKESPKSFSHSEMAEAVLENVNVPAVVSKDECIYCFESPYNEPLALNASPKHSLNICLNCFQATCNRHVPLHIRVTEYACDTIHSNYLTIAKVEKPKQENVEENNNNKKIKLQVIETSEDDTHNTIWSLQRFNGENVPRTVLSKSTDSDISSTALEKIEKILKAKSQDFEDKKNSWVLEISTCPHTENFQIPSKPENTVNLNQCSSCDLTQNLWLCLHCGNIGCGREQIGIDGHSHALDHYRSNNNHPLAIKLGSLSSSTYDLYCYACDDETRFPDNVNLGSALQIYGINIQEKIADEKTLVQLQVEQNENWQFRMVDSSGKEFEKLSASKNYGCGLINLGNSCYLNSVIQSLVNGGVPNWSLDFLGSKFPLDVVYPDNNLKCQWIKLLNAMKCEPELYPNGIKPTTFKKCIGQNHQEFSSNRQQDAMEFLTFLLDLLDKKFFSSSSSGIPNPNDLVRFMMEDRLQCNICGKVKYSYEPTEAIQIPLEENDEPQDMLERIKAYFEGQTIEFKCANCKEKVTANKKPGFKSLPQTLILNPIRIRLQNWIPVKTSNELSLPGLIDRDDMLDVSSYLSQGFDPQTENLLPDEDENRSSFTPNQCSISQLIEMGFTQNASVRALFNTGNQDAESAMNWLFQHMDDPDLNDPFVPPPNVPKKDKREVDEVSLTSMLSMGLNPNLCRKALILNNGDVNRSVEWVFNNMDDDGTFPEPEVPNEEQQQKKDLGYSTAKPYALTAVICHKGNSVHSGHYVVFIRKLVADKWKWVLYNDEKLVAADSIEDMKKNGYIYFYTRC

SEQ ID NO: 1442 - protein, 620 aa, Saccharomyces cerevisiae
MLNGEDFVEHNDILSSPAKSRNVTPKRVDPHGERQLRRIHSSKKNLLERISLVGNERKNTSPDPALKPKTPSKAPRKRGRPRKIQEELTDRIKKDEKDTISSKKKRKLDKDTSGNVNEESKTSNNKQVMEKTGIKEKREREKIQVATTTYEDNVTPQTDDNFVSNSPEPPEPATPSKKSLTTNHDFTSPLKQIIMNNLKEYKDSTSPGKLTLSRNFTPTPVPKNKKLYQTSETKSASSFLDTFEGYFDQRKIVRTNAKSRHTMSMAPDVTREEFSLVSNFFNENFQKRPRQKLFEIQKKMFPQYWFELTQGFSLLFYGVGSKRNFLEEFAIDYLSPKIAYSQLAYENELQQNKPVNSIPCLILNGYNPSCNYRDVFKEITDLLVPAELTRSETKYWGNHVILQIQKMIDFYKNQPLDIKLILVVHNLDGPSIRKNTFQTMLSFLSVIRQIAIVASTDHIYAPLLWDNMKAQNYNFVFHDISNFEPSTVESTFQDVMKMGKSDTSSGAEGAKYVLQSLTVNSKKMYKLLIETQMQNMGNLSANTGPKRGTQRTGVELKLFNHLCAADFIASNEIALRSMLREFIEHKMANITKNNSGMEIIWVPYTYAELEKLLKTVLNTL

SEQ ID NO: 1443 - protein, 609 aa, Saccharomyces cerevisiae
MLSSEDFGSSGKKETSPDSISIRSFSAGNNFQSSSSEKTYSKQKSGSDKLIHRFADSFKRAEGSTTRTKQINENTSDLEDGVESITSDSKLKKSMKSRHVVMMSLGTGIGTGLLVANAKGLHYGGPAALIIGYILVSFETYFMIQAAGEMAVTYPTLPANFNAYSSIFISKSFGFATVWLYCFQWLTVLPLELITASMTIQFGNDKINPDIYILIFYVFLVFIHFFGVKAYGETEFIFNCCKILMIAGFIILSIVINCGGAGNDGYIGATYWHNPGAFAGDTSIGRFKNVCYILVTAYFSFGGMELFALSVQEQSNPRKSTPVAAKRSIYRIVVIYLLTMILIGFNVPYNDDQLMGAGGSATHASPYVLAASIHGVKIVPHIINAVILISVVSVANSSLYAGPRLICSLAQQGYAPKFLDYVDREGRPLRALIVCCVFGVIAFVAASSKEEIVFTWLAAIAGLSELFTWTSIMLSHLRFRQAMKVQGRSLDELGYKATTGIWGSIYGVFFNILVFVAQFWVALAPLGNGGKCDAESFFQNYLAFPIWLAFYFGYMVYNRDFTLLNPLDKIDLDFHRRIYDPELMRQEDEENKEKLRNMSLMRKAYHFWC

SEQ ID NO: 1444 - protein, 619 aa, Saccharomyces cerevisiae
MDDSVSFIAKEASPAQYSHSLHERTHSEKQKRDFTITEKQDEVSGQTAEPRRTDSKSILQRKCKEFFDSFKRQLPPDRNSELESQEKNNLTKSIKSRHLVMISLGTGIGTGLLVGNGQVLGTAGPAGLVLGYGIASIMLYCIIQAAGELGLCYAGLTGNYTRYPSILVDPSLGFAVSVVYTIQWLTVLPLQLVTAAMTVKYWTSVNADIFVAVVFVFVIIINLFGSRGYAEAEFIFNSCKILMVIGFVILAIIINCGGAGDRRYIGAEYWHNPGPFAHGFKGVCTVFCYAAFSYGGIEVLLLSAAEQENPTKSIPNACKKVVYRILLIYMLTTILVCFLVPYNSDELLGSSDSSGSHASPFVIAVASHGVKVVPHFINAVILISVISVANSSLYSGPRLLLSLAEQGVLPKCLAYVDRNGRPLLCFFVSLVFGCIGFVATSDAEEQVFTWLLAISSLSQLFIWMSMSLSHIRFRDAMAKQGRSMNEVGYKAQTGYWGSWLAVLIAIFFLVCQFWVAIAPVNEHGKLNVKVFFQNYLAMPIVLFAYFGHKIYFKSWSFWIPAEKIDLDSHRNIFVSPSLTEIDKVDDNDDLKEYENSESSENPNSSRSRKFFKRMTNFWC

SEQ ID NO: 1445 - protein, 214 aa, Saccharomyces cerevisiae
MSFNSPFFDFFDNINNEVDAFNRLLGEGGLRGYAPRRQLANTPAKDSTGKEVARPNNYAGALYDPRDETLDDWFDNDLSLFPSGFGFPRSVAVPVDILDHDNNYELKVVVPGVKSKKDIDIEYHQNKNQILVSGEIPSTLNEESKDKVKVKESSSGKFKRVITLPDYPGVDADNIKADYANGVLTLTVPKLKPQKDGKNHVKKIEVSSQESWGN

SEQ ID NO: 1446 - protein, 958 aa, Saccharomyces cerevisiae
MAVISVKPRRREKILQEVKNSSVYQTVFDSGTTQMQIPKYENKPFKPPRRVGSNKYTQLKPTATAVTTAPISKAKVTVNLKRSISAGPTLNLAKKPNNLSSNENTRYFTIMYRKPTTKKHKTWSGDGYATLKASSDKLCFYNEAGKFLGSSMLPSDSDSLFETLFKAGSNEVQLDYELKENAEIRSAKEALSQNMGNPSPPTTSTTETVPSTKNDGGKYQMPLSQLFSLNTVKRFKSVTKQTNEHMTTVPKTSQNSKAKKYYPVFDVNKIDNPIVMNKNAAAEVDVIVDPLLGKFLRPHQREGVKFMYDCLMGLARPTIENPDIDCTTKSLVLENDSDISGCLLADDMGLGKTLMSITLIWTLIRQTPFASKVSCSQSGIPLTGLCKKILVVCPVTLIGNWKREFGKWLNLSRIGVLTLSSRNSPDMDKMAVRNFLKVQRTYQVLIIGYEKLLSVSEELEKNKHLIDMLVCDEGHRLKNGASKILNTLKSLDIRRKLLLTGTPIQNDLNEFFTIIDFINPGILGSFASFKRRFIIPITRARDTANRYNEELLEKGEERSKEMIEITKRFILRRTNAILEKYLPPKTDIILFCKPYSQQILAFKDILQGARLDFGQLTFSSSLGLITLLKKVCNSPGLVGSDPYYKSHIKDTQSQDSYSRSLNSGKLKVLMTLLEGIRKGTKEKVVVVSNYTQTLDIIENLMNMAGMSHCRLDGSIPAKQRDSIVTSFNRNPAIFGFLLSAKSGGVGLNLVGRSRLILFDNDWNPSVDLQAMSRIHRDGQKKPCFIYRLVTTGCIDEKILQRQLMKNSLSQKFLGDSEMRNKESSNDDLFNKEDLKDLFSVHTDTKSNTHDLICSCDGLGEEIEYPETNQQQNTVELRKRSTTTWTSALDLQKKMNEAATNDDAKKSQYIRQCLVHYKHIDPARQDELFDEVITDSFTELKDSITFAFVKPGEICLREQ

SEQ ID NO: 1447 - protein, 758 aa, Saccharomyces cerevisiae
MFKIPGFGKAAANHTPPDMTNMDTRTRHLKVSNCPNNSYALANVAAVSPNDFPNNIYIIIDNLFVFTTRHSNDIPPGTIGFNGNQRTWGGWSLNQDVQAKAFDLFKYSGKQSYLGSIDIDISFRARGKAVSTVFDQDELAKQFVRCYESQIFSPTQYLIMEFQGHFFDLKIRNVQAIDLGDIEPTSAVATGIETKGILTKQTQINFFKGRDGLVNLKSSNSLRPRSNAVIRPDFKFEDLGVGGLDKEFTKIFRRAFASRIFPPSVIEKLGISHVKGLLLYGPPGTGKTLIARKIGTMLNAKEPKIVNGPEILSKYVGSSEENIRNLFKDAEAEYRAKGEESSLHIIIFDELDSVFKQRGSRGDGTGVGDNVVNQLLAKMDGVDQLNNILVIGMTNRKDLIDSALLRPGRFEVQVEIHLPDEKGRLQIFDIQTKKMRENNMMSDDVNLAELAALTKNFSGAEIEGLVKSASSFAINKTVNIGKGATKLNTKDIAKLKVTREDFLNALNDVTPAFGISEEDLKTCVEGGMMLYSERVNSILKNGARYVRQVRESDKSRLVSLLIHGPAGSGKTALAAEIALKSGFPFIRLISPNELSGMSESAKIAYIDNTFRDAYKSPLNILVIDSLETLVDWVPIGPRFSNNILQMLKVALKRKPPQDRRLLIMTTTSAYSVLQQMDILSCFDNEIAVPNMTNLDELNNVMIESNFLDDAGRVKVINELSRSCPNFNVGIKKTLTNIETARHDEDPVNELVELMTQSA

SEQ ID NO: 1448 - protein, 148 aa, Saccharomyces cerevisiae
MSSSKRIAKELSDLERDPPTSCSAGPVGDDLYHWQASIMGPADSPYAGGVFFLSIHFPTDYPFKPPKISFTTKIYHPNINANGNICLDILKDQWSPALTLSKVLLSICSLLTDANPDDPLVPEIAHIYKTDRPKYEATAREWTKKYAV

SEQ ID NO: 1449 - protein, 486 aa, Saccharomyces cerevisiae
MSLKEDDFGKDNSRNIESYTGRIFDVYIQKDSYSQSALDDMFPEAVVSTAACVKNEAEDNINLIDTHPQFELVNTGLGAKSDDLKSPSAKATFTDKQRKNEVPNISVSNYFPGQSSETSSTTESWTIGCDKWSEKVEEAFLEALRLIMKNGTTKIKIRNANFGRNELISLYIKHKTNEFRTKKQISSHIQVWKKTIQNKIKDSLTLSSKEKELLHLIEHGAEQTTENSNLFYDIFEEIIDSLPSVSDSGSLTPKNLYVSNNSSGLSVHSKLLTPITASNEKKIENFIKTNAASQAKTPLIYAKHIYENIDGYKCVPSKRPLEQLSPTELHQGDRPNKASFSNKKAILESAKKIEIEQRKIINKYQRISRIQEHESNPEFSSNSNSGSEYESEEEVVPRSATVTQLQSRPVPYYKNNGMPYSLSKVRGRPMYPRPAEDAYNANYIQGLPQYQTSYFSQLLLSSPQHYEHSPHQRNFTPSNQSHGNFY

SEQ ID NO: 1450 - protein, 307 aa, Saccharomyces cerevisiae
MSSDAKQQETNFAINFLMGGVSAAIAKTAASPIERVKILIQNQDEMIKQGTLDKKYSGIVDCFKRTAKQEGLISFWRGNTANVIRYFPTQALNFAFKDKIKLMFGFKKEEGYGKWFAGNLASGGAAGALSLLFVYSLDFARTRLAADAKSSKKGGARQFNGLTDVYKKTLKSDGIAGLYRGFMPSVVGIVVYRGLYFGMFDSLKPLVLTGSLDGSFLASFLLGWVVTTGASTCSYPLDTVRRRMMMTSGQAVKYNGAIDCLKKIVASEGVGSLFKGCGANILRSVAGAGVISMYDQLQMILFGKKFK

SEQ ID NO: 1451 - protein, 354 aa, Saccharomyces cerevisiae
MSLWVDKYRPKSLNALSHNEELTNFLKSLSDQPRDLPHLLLYGPNGTGKKTRCMALLESIFGPGVYRLKIDVRQFVTASNRKLELNVVSSPYHLEITPSDMGNNDRIVIQELLKEVAQMEQVDFQDSKDGLAHRYKCVIINEANSLTKDAQAALRRTMEKYSKNIRLIMVCDSMSPIIAPIKSRCLLIRCPAPSDSEISTILSDVVTNERIQLETKDILKRIAQASNGNLRVSLLMLESMALNNELALKSSSPIIKPDWIIVIHKLTRKIVKERSVNSLIECRAVLYDLLAHCIPANIILKELTFSLLDVETLNTTNKSSIIEYSSVFDERLSLGNKAIFHLEGFIAKVMCCLD

SEQ ID NO: 1452 - protein, 258 aa, Saccharomyces cerevisiae
MLEAKFEEASLFKRIIDGFKDCVQLVNFQCKEDGIIAQAVDDSRVLLVSLEIGVEAFQEYRCDHPVTLGMDLTSLSKILRCGNNTDTLTLIADNTPDSIILLFEDTKKDRIAEYSLKLMDIDADFLKIEELQYDSTLSLPSSEFSKIVRDLSQLSDSINIMITKETIKFVADGDIGSGSVIIKPFVDMEHPETSIKLEMDQPVDLTFGAKYLLDIIKGSSLSDRVGIRLSSEAPALFQFDLKSGFLQFFLAPKFNDEE

SEQ ID NO: 1453 - protein, 467 aa, Saccharomyces cerevisiae
MFKSVVYSVLAAALVNAGTIPLGELADVAKIGTQEDIFPFLGGAGPYFSFPGDYGISRDLPEGCEMKQLQMLARHGERYPTYSKGATIMKTWYKLSNYTRQFNGSLSFLNDDYEFFIRDDDDLEMETTFANSDNVLNPYTGEMDAKRHAREFLAQYGYMFENQTSFPIFAASSERVHDTAQYFIDGLGDQFNISLQTVSEAMSAGANTLSAGNACPGWDEDANDDILDKYDTTYLDDIAKRLNKENKGLNLTSKDANTLFAWCAYELNARGYSDVCDIFTEDELVRYSYGQDLVSFYQDGPGYDMIRSVGANLFNATLKLLKQSETQDLKVWLSFTHDTDILNYLTTAGIIDDKNNLTAEYVPFMGNTFHKSWYVPQGARVYTEKFQCSNDTYVRYVINDAVVPIETCSTGPGFSCEINDFYDYAEKRVAGTDFLKVCNVSSVSNVTELTFYWDWNTTHYNDTLLKQ

SEQ ID NO: 1454 - protein, 467 aa, Saccharomyces cerevisiae
MFKSVVYSILAASLANAGTIPLGKLADVDKIGTQKDIFPFLGGAGPYYSFPGDYGISRDLPEGCEMKQLQMVGRHGERYPTVSLAKTIKSTWYKLSNYTRQFNGSLSFLNDDYEFFIRDDDDLEMETTFANSDDVLNPYTGEMNAKRHARDFLAQYGYMVENQTSFAVFTSNSKRCHDTAQYFIDGLGDQFNITLQTVSEAESAGANTLSACNSCPAWDYDANDDIVNEYDTTYLDDIAKRLNKENKGLNLTSTDASTLFSWCAFEVNAKGYSDVCDIFTKDELVHYSYYQDLHTYYHEGPGYDIIKSVGSNLFNASVKLLKQSEIQDQKVWLSFTHDTDILNFLTTAGIIDDKNNLTAEYVPFMGNTFHRSWYVPQGARVYTEKFQCSNDTYVRYVINDAVVPIETCSTGPGFSCEINDFYDYAEKRVAGTDFLKVCNVSSVSNSTELTFYWDWNTTHYNASLLRQ

SEQ ID NO: 1455 - protein, 453 aa, Saccharomyces cerevisiae
MTASPAKKRLRNKYLSCCFLLIEMTIRSSMKNNAELESKSVLANESNIISTFTRRIIKEKSGNYQVLKRSLDGKLIYPEATGISSNRGNKLLQRSEVVTRRDLNNSKPMIEQTVFYNGSEHRLLQTNIVTDSRRKRIKFTPDINVEPVLVGDENDIDGSEKEDENITDEYYGEEDDDDLSKLVNVKEILTPILSLGDIINHKTISRTFSSPILKNLALQIILMIEKEQMSVVRYSQFLEVFLGDHPEPIYESNLNLPSYNHNLTLPEDRGASDEDDINNKNNINEVNSNSLSTEAGHINNGMEEFGEEDPFFALPRLEQSNALLSLLPSSSGSASISTLTAAEQQQLNEEIESARQLSQIALQRNKEFIRNLQKIRKSVIKANRIRGRILNWSREYLGISDDDITIPVALRVVKRGLISATTNKTTNFEEEIENTMEDGVVDDNEPDEEANRA

SEQ ID NO: 1456 - protein, 471 aa, Saccharomyces cerevisiae
MSQIVDFVEDKDSRNDASIQIIDGPSNVEIIALSESMDQDECKRAHVSSAEMIPSSPQRKSVSNDVENVDLNKSIELSAPFFQDISISKLDDFSTTVNSIIDSSLRNENNAKGNAKKLLDDLISDEWSADLESSGKKHNKSQYNLRDIAEKWGVQSLKNPEPIAVDCEYKTQGIGKTNSDISDSPKSQIGAADILFDFPLSPVKHENPTEEKHNSIANENSSPDNSLKPAGKQNHGEDGTSMAKRVYNKGEDEQEHLPKGKKRTIALSRTLINSTKLPDTVELNLSKFLDSSDSITTDVLSTPAKGSNIVRTGSQPIFSNANCFQEAKRSKTLTAEDPKCTKNTAREVSQLENYIAYGQYYTREDSKNKIRHLLKENKNAFKRVNQIYRDNIKARSQMIIEFSPSLLQLFKKGDSDLQQQLAPAVVQSSYNDSMPLLRFLRKCDSIYDFSNDFYYPCDPKIVEENRFDSIL

SEQ ID NO: 1457 - protein, 753 aa, Saccharomyces cerevisiae
MVEFSLKKARNNWKHVKKSASSPAKQKTPPSPAKPKQKTKKNPYSDLKDPATSYTLPTINARERSRVATSMQRRLSIHNTNYAPPTLDYSMPLPDMPNMIVPNDNVDSSHNNSSFTTENESVSSKGPSNSLNLSTADLSLNDSSYNKVPARSAMRNTVNPSGSNDPFNNSTSLRKMLANPHFNAKDFVHDKLGNASAITIDKFTSNLTDLSIQVQEEVKLNINKSYNEIMTVNNDLNVAMLELKRVRANINDLNEVLDQCTKIAEKRLQLQDQIDQERQGNFNNVESHSNSPALLPPLKAGQNGNLMRRDRSSVLILEKFWDTELDQLFKNVEGAQKFINSTKGRHILMNSANWMELNTTTGKPLQMVQIFILNDLVLIADKSRDKQNDFIVSQCYPLKDVTVTQEEFSTKRLLFKFSNSNSSLYECRDADECSRLLDVIRKAKDDLCDIFHVEEENSKRIRESFRYLQSTQQTPGRENNRSPNKNKRRSMGGSITPGRNVTGAMDQYLLQNLTLSMHSRPRSRDMSSTAQRLKFLDEGVEEIDIELARLRFESAVETLLDIESQLEDLSERISDEELMLLNLISLKIEQRREAISSKLSQSILSSNEIVHLKSGTENMIKLGLPEQALDLFLQNRSNFIQDLILQIGSVDNPTNYLTQLAVIRFQTIKKTVEDFQDIFKELGAKISSILVDWCSDEVDNHFKLIDKQLLNDEMLSPGSIKSSRKQIDGLKAVGLDFVYKLDEFIKKNSDKIR

SEQ ID NO: 1458 - protein, 329 aa, Saccharomyces cerevisiae
MSEEFPTPQLLDELEDQQKVTTPNEKRELSSNRVLKDIFAGTIGGIAQVLVGQPFDTTKVRLQTATTRTTTLEVLRNLVKNEGVFAFYKGALTPLLGVGICVSVQFGVNEAMKRFFQNYNASKNPNMSSQDVDLSRSNTLPLSQYYVCGLTGGVVNSFLASPIEQIRIRLQTQTSNGGDREFKGPWDCIKKLKAQGGLMRGLFPTMIRAGHGLGTYFLVYEALVAREIGTGLTRNEIPPWKLCLFGAFSGTMLWLTVYPLDVVKSIIQNDDLRKPKYKNSISYVAKTIYAKEGIRAFFKGFGPTMVRSAPVNGATFLTFELVMRFLGEE

SEQ ID NO: 1459 - protein, 147 aa, Saccharomyces cerevisiae
MSSNLTEEQIAEFKEAFALFDKDNNGSISSSELATVMRSLGLSPSEAEVNDLMNEIDVDGNHQIEFSEFLALMSRQLKSNDSEQELLEAFKVFDKNGDGLISAAELKHVLTSIGEKLTDAEVDDMLREVSDGSGEINIQQFAALLSK

SEQ ID NO: 1460 - protein, 790 aa, Saccharomyces cerevisiae
MQEGGFIRRRRTRSTKKSVNYNELSDDDTAVKNSKTLQLKGNSENVNDSQDEEYRDDATLVKSPDDDDKDFIIDLTGSDKERTATDENTHAIKNDNDEIIEIKEERDVSDDDEPLTKKRKTTARKKKKKTSTKKKSPKVTPYERNTLRLYEHHPELRNVFTDLKNAPPYVPQRSKQPDGMTIKLLPFQLEGLHWLISQEESIYAGGVLADEMGMGKTIQTIALLMNDLTKSPSLVVAPTVALMQWKNEIEQHTKGQLKIYIYHGASRTTDIKDLQGYDVVLTTYAVLESVFRKQNYGFRRKNGLFKQPSVLHNIDFYRVILDEAHNIKDRQSNTARAVNNLKTQKRWCLSGTPLQNRIGEMYSLIRFLNINPFTKYFCTKCDCASKDWKFTDRMHCDHCSHVIMQHTNFFNHFMLKNIQKFGVEGPGLESFNNIQTLLKNIMLRRTKVERADDLGLPPRIVTVRRDFFNEEEKDLYRSLYTDSKRKYNSFVEEGVVLNNYANIFTLITRMRQLADHPDLVLKRLNNFPGDDIGVVICQLCNDEAEEPIESKCHHKFCRLCIKEYVESFMENNNKLTCPVCHIGLSIDLSQPALEVDLDSFKKQSIVSRLNMSGKWQSSTKIEALVEELYKLRSNKRTIKSIVFSQFTSMLDLVEWRLKRAGFQTVKLQGSMSPTQRDETIKYFMNNIQCEVFLVSLKAGGVALNLCEASQVFILDPWWNPSVEWQSGDRVHRIGQYRPVKITRFCIEDSIEARIIELQEKKANMIHATINQDEAAISRLTPADLQFLFNN

SEQ ID NO: 1461 - protein, 458 aa, Saccharomyces cerevisiae
MGKEKSHINVVVIGHVDSGKSTTTGHLIYKCGGIDKRTIEKFEKEAAELGKGSFKYAWVLDKLKAERERGITIDIALWKFETPKYQVTVIDAPGHRDFIKNMITGTSQADCAILIIAGGVGEFEAGISKDGQTREHALLAFTLGVRQLIVAVNKMDSVKWDESRFQEIVKETSNFIKKVGYNPKTVPFVPISGWNGDNMIEATTNAPWYKGWEKETKAGVVKGKTLLEAIDAIEQPSRPTDKPLRLPLQDVYKIGGIGTVPVGRVETGVIKPGMVVTFAPAGVTTEVKSVEMHHEQLEQGVPGDNVGFNVKNVSVKEIRRGNVCGDAKNDPPKGCASFNATVIVLNHPGQISAGYSPVLDCHTAHIACRFDELLEKNDRRSGKKLEDHPKFLKSGDAALVKFVPSKPMCVEAFSEYPPLGRFAVRDMRQTVAVGVIKSVDKTEKAAKVTKAAQKAAKK

SEQ ID NO: 1462 - protein, 393 aa, Saccharomyces cerevisiae
MGQLLSHPLTEKTIEYNEYKNNQASTGIVPRFYNCVGSMQGYRLTQEDAHLIRNENSVVYVRFFNPFIDKYETLSLNVFAVFDGHGGDDCSKFLSGGRHHRDGNGSSNGNGEPNAGLIKWIAYSFENHHYTSTTNNDSSKFKRSFNTLEGLVSQIFKDAFILQDEELYRHFANSSCGSTAVVACIINEESLYVANCGDSRCILSSKSNGIKTMSFDHKPQHIGELIRINDNGGTVSLGRVGGVLALSRAFSDFQFKRGVTYPHRRTKLTNITQNLTYGTPPQEAQVTVEPDVLMHKIDYSKDEFLVLACDGIWDIYNNKQLIHFIKYHLVSGTKLDTIITKLLDHGIAQANSNTGVGFDNMTAIIVVLNRKGETLQDWFNKMKTRLERERGLV

SEQ ID NO: 1463 - protein, 495 aa, Saccharomyces cerevisiae
MTTDNAKAQLTSSSGGNIIVVSNRLPVTITKNSSTGQYEYAMSSGGLVTALEGLKKTYTFKWFGWPGLEIPDDEKDQVRKDLLEKFNAVPIFLSDEIADLHYNGFSNSILWPLFHYHPGEINFDENAWLAYNEANQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVGVDRLDYIKGVPQKLHAMEVFLNEHPEWRGKVVLVQVAVPSRGDVEEYQYLRSVVNELVGRINGQFGTVEFVPIHFMHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATKN

SEQ ID NO: 1464 - protein, 517 aa, Saccharomyces cerevisiae
MVLSDKELFAINKKAVEQGFNVKPRLNYNTVSGVNGPLVILEKVKFPRYNEIVNLTLPDGTVRQGQVLEIRGDRAIVQVFEGTSGIDVKKTTVEFTGESLRIPVSEDMLGRIFDGSGRPIDNGPKVFAEDYLDINGSPINPYARIYPEEMISTGVSAIDTMNSIARGQKIPIFSASGLPHNEIAAQICRQAGLVRPTKDVHDGHEENFSIVFAAMGVNLETARFFKQDFEENGSLERTSLFLNLANDPTIERIITPRLALTTAEYLAYQTERHVLTILTDMSSYADALREVSAAREEVPGRRGYPGYMYTDLSTIYERAGRVEGRNGSITQIPILTMPNDDITHPIPDLTGYITEGQIFVDRQLHNKGIYPPINVLPSLSRLMKSAIGEGMTRKDHGDVSNQLYAKYAIGKDAAAMKAVVGEEALSIEDKLSLEFLEKFEKTFITQGAYEDRTVFESLDQAWSLLRIYPKEMLNRISPKILDEFYDRARDDADEDEEDPDTRSSGKKKDASQEESLI

SEQ ID NO: 1465 - protein, 596 aa, Saccharomyces cerevisiae
MTKERMTIDYENDGDFEYDKNKYKTITTRIKSIEPSEGWLEPSGSVGHINTIPEAGDVHVDEHEDRGSSIDDDSRTYLLYFTETRRKLENRHVQLIAISGVIGTALFVAIGKALYRGGPASLLLAFALWCVPILCITVSTAEMVCFFPVSSPFLRLATKCVDDSLAVMASWNFWFLECVQIPFEIVSVNTIIHYWRDDYSAGIPLAVQVVLYLLISICAVKYYGEMEFWLASFKIILALGLFTFTFITMLGGNPEHDRYGFRNYGESPFKKYFPDGNDVGKSSGYFQGFLACLIQASFTIAGGEYISMLAGEVKRPRKVLPKAFKQVFVRLTFLFLGSCLCVGIVCSPNDPDLTAAINEARPGAGSSPYVIAMNNLKIRILPDIVNIALITAAFSAGNAYTYCSSRTFYGMALDGYAPKIFTRCNRHGVPIYSVAISLVWALVSLLQLNSNSAVVLNWLINLITASQLINFVVLCIVYLFFRRAYHVQQDSLPKLPFRSWGQPYTAIIGLVSCSAMILIQGYTVFFPKLWNTQDFLFSYLMVFINIGIYVGYKFIWKRGKDHFKNPHEIDFSKELTEIENHEIESSFEKFQYYSKA

SEQ ID NO: 1466 - protein, 827 aa, Saccharomyces cerevisiae
MHSNVFVGVKPGFNHKQHSKKSRFLENVSSHSPELPSNYDYVLLPITTPRYKEIVGQVFKDFQRQSIQNWKPLQIPEPQLQDICIPPFNVKKLDNDDTPSYIGLLSSWLELESRDPNVRDLGLKVLLNECKYARFVGINKLILAPPRDLSNLQLYGQMIYRLLQNRIVFAAPALTISISLPLYEDSDPLATWELWNTVRKQCEYHPSLTISLALPRTRTPSYVLNRWLAEPVSCLLVSSSIFASNQYDYPVLHKFNQNLILKFQKVNGDSQILGNELCVILHGMEKYANNVKGGESAYLEYINYLLKKGDKVLNSNSNHQFLLQEDSRIMPPLKPHSDNLLNSTYLTFEKDLVKYDLYESAILEALQDLAPRASAKRPLVILVAGAGRGPLVDRTFKIISMLFMDSKVSIIAIEKNPQAYLYLQKRNFDCWDNRVKLIKEDMTKWQINEPSEKRIQIDLCISELLGSFGCNELSPECLWSIEKYHSHNDTIFIPRSYSSYIAPISSPLFYQKLSQTNRSLEAPWIVHRVPYCILSSRVNEVWRFEHPMAQKDTVQDEDDFTVEFSQSSLNEFKIKHRGEIHGFIGFFSANLYNNIFLSTLPNDSTVRLKFSEETLMNTRREENLIKKCDHTPNMTSWSPIIFPLKQPISFIDDSELSVLMSRIHSDTEQKVWYEWSLESFIYLMLSNYTSAVTAASMTIPRSIVTDDTKTLAHNRHYSATTNQKLDNQIDLDQDIENEEEQGFLSNLETGWQSVQDIHGLSETAKPDHLDSINKPMFDLKSTKALEPSNELPRHEDLEEDVPEVHVRVKTSVSTLHNVCGRAFSLPL

SEQ ID NO: 1467 - protein, 150 aa, Saccharomyces cerevisiae
MYHHYHAFQGRKLTDQERARVLEFQDSIHYSPRYSDDNYEYRHVMLPKAMLKVIPSDYFNSEVGTLRILTEDEWRGLGITQSLGWEHYECHAPEPHILLFKRPLNYEAELRAATAAAQQQQQQQQQQQQQQQQHQTQSISNDMQVPPQIS

SEQ ID NO: 1468 - protein, 2368 aa, Saccharomyces cerevisiae
MESHVKYLDELILAIKDLNSGVDSKVQIKKVPTDPSSSQEYAKSLKILNTLIRNLKDQRRNNIMKNDTIFSKTVSALALLLEYNPFLLVMKDSNGNFEIQRLIDDFLNISVLNYDNYHRIWFMRRKLGSWCKACVEFYGKPAKFQLTAHFENTMNLYEQALTEVLLGKTELLKFYDTLKGLYILLYWFTSEYSTFGNSIAFLDSSLGFTKFDFNFQRLIRIVLYVFDSCELAALEYAEIQLKYISLVVDYVCNRTISTALDAPALVCCEQLKFVLTTMHHFLDNKYGLLDNDPTMAKGILRLYSLCISNDFSKCFVDHFPIDQWADFSQSEHFPFTQLTNKALSIVYFDLKRRSLPVEALKYDNKFNIWVYQSEPDSSLKNVTSPFDDRYKQLEKLRLLVLKKFNKTERGTLLKYRVNQLSPGFFQRAGNDFKLILNEASVSIQTCFKTNNITRLTSWTVILGRLACLESEKFSGTLPNSTKDMDNWYVCHLCDIEKTGNPFVRINPNRPEAAGKSEIFRILHSNFLSHPNIDEFSESLLSGILFSLHRIFSHFQPPKLTDGNGQINKSFKLVQKCFMNSNRYLRLLSTRIIPLFNISDSHNSEDEHTATLIKFLQSQKLPVVKENLVIAWTQLTLTTSNDVFDTLLLKLIDIFNSDDYSLRIMMTLQIKNMAKILKKTPYQLLSPILPVLLRQLGKNLVERKVGFQNLIELLGYSSKTILDIFQRYIIPYAIIQYKSDVLSEIAKIMCDGDTSLINQMKVNLLKKNSRQIFAVALVKHGLFSLDILETLFLNRAPTFDKGYITAYLPDYKTLAEITKLYKNSVTKDASDSENANMILCSLRFLITNFEKDKRHGSKYKNINNWTDDQEQAFQKKLQDNILGIFQVFSSDIHDVEGRTTYYEKLRVINGISFLIIYAPKKSIISALAQISICLQTGLGLKEVRYEAFRCWHLLVRHLNDEELSTVIDSLIAFILQKWSEFNGKLRNIVYSILDTLIKEKSDLILKLKPYTTLALVGKPELGILARDGQFARMVNKIRSTTDLIPIFANNLKSSNKYVINQNLDDIEVYLRRKQTERSIDFTPKKVGQTSDITLVLGALLDTSHKFRNLDKDLCEKCAKCISMIGVLDVTKHEFKRTTYSENEVYDLNDSVQTIKFLIWVINDILVPAFWQSENPSKQLFVALVIQESLKYCGLSSESWDMNHKELYPNEAKLWEKFNSVSKTTIYPLLSSLYLAQSWKEYVPLKYPSNNFKEGYKIWVKRFTLDLLKTGTTENHPLHVFSSLIREDDGSLSNFLLPYISLDIIIKAEKGTPYADILNGIIIEFDSIFTCNLEGMNNLQVDSLRMCYESIFRVFEYCKKWATEFKQNYSKLHGTFIIKDTKTTNMLLRIDEFLRTTPSDLLAQRSLETDSFERSALYLEQCYRQNPHDKNQNGQLLKNLQITYEEIGDIDSLDGVLRTFATGNLVSKIEELQYSENWKLAQDCFNVLGKFSDDPKTTTRMLKSMYDHQLYSQIISNSSFHSSDGKISLSPDVKEWYSIGLEAANLEGNVQTLKNWVEQIESLRNIDDREVLLQYNIAKALIAISNEDPLRTQKYIHNSFRLIGTNFITSSKETTLLKKQNLLMKLHSLYDLSFLSSAKDKFEYKSNTTILDYRMERIGADFVPNHYILSMRKSFDQLKMNEQADADLGKTFFTLAQLARNNARLDIASESLMHCLERRLPQAELEFAEILWKQGENDRALKIVQEIHEKYQENSSVNARDRAAVLLKFTEWLDLSNNSASEQIIKQYQDIFQIDSKWDKPYYSIGLYYSRLLERKKAEGYITNGRFEYRAISYFLLAFEKNTAKVRENLPKVITFWLDIAAASISEAPGNRKEMLSKATEDICSHVEEALQHCPTYIWYFVLTQLLSRLLHSHQSSAQIIMHILLSLAVEYPSHILWYITALVNSNSSKRVLRGKHILEKYRQHSQNPHDLVSSALDLTKALTRVCLQDVKSITSRSGKSLEKDFKFDMNVAPSAMVVPVRKNLDIISPLESNSMRGYQPFRPVVSIIRFGSSYKVFSSLKKPKQLNIIGSDGNIYGIMCKKEDVRQDNQYMQFATTMDFLLSKDIASRKRSLGINIYSVLSLREDCGILEMVPNVVTLRSILSTKYESLKIKYSLKSLHDRWQHTAVDGKLEFYMEQVDKFPPILYQWFLENFPDPINWFNARNTYARSYAVMAMVGHILGLGDRHCENILLDIQTGKVLHVDFDCLFEKGKRLPVPEIVPFRLTPNLLDALGIIGTEGTFKKSSEVTLALMRKNEVALMNVIETIMYDRNMDHSIQKALKVLRNKIRGIDPQDGLVLSVAGQTETLIQEATSEDNLSKMYIGWLPFW

SEQ ID NO: 1469 - protein, 508 aa, Saccharomyces cerevisiae
MKYLNLVFVLQLLISIKYASFGRAFSLFEDDTTFANLDKQLKLPQNTQQTLKLDRLNHDDPLFTTFISSVDTDYSLRLRTVDPSKLGIDTVKQWSGYMDYKDSKHFFYWFFESRNDPANDPIILWLNGGPGCSSFTGLLFELGPSSIGADMKPIHNPYSWNNNASMIFLEQPLGVGFSYGDEKVSSTKLAGKDAYIFLELFFEAFPHLRSNDFHIAGESYAGHYIPQIAHEIVVKNPERTFNLTSVMIGNGITDPLIQADYYEPMACGKGGYHPVLSSEECEKMSKAAGRCRRLNKLCYASKSSLPCIVATAYCDSALLEPYINTGLNVYDIRGPCEDNSTDGMCYTGLRYVDQYMNFPEVQETLGSDVHNYSGCDNDVFTGFLFTGDGSKPFQQYIAELLNHNIPVLIYAGDKDYICNWLGNHAWSNELEWINKRRYQRRMLRPWVSKETGEELGQVKNYGPFTFLRIYDAGHMVPYDQPEASLEMVNSWISGNRAFSDLSTLENAS

SEQ ID NO: 1470 - protein, 3092 aa, Saccharomyces cerevisiae
MNQSDPQDKKNFPMEYSLTKHLFFDRLLLVLPIESNLKTYADVEADSVFNSCRSIILNIAITKDLNPIIENTLGLIDLIVQDEEITSDNITDDIAHSILVLLRLLSDVFEYYWDQNNDFKKIRNDNYKPGFSSHRPNFHTSRPKHTRINPALATMLLCKISKLKFNTRTLKVLQNMSHHLSGSATISKSSILPDSQEFLQKRNYPAYTEKIDLTIDYIQRFISASNHVEFTKCVKTKVVAPLLISHTSTELGVVNHLDLFGCEYLTDKNLLAYLDILQHLSSYMKRTIFHSLLLYYASKAFLFWIMARPKEYVKIYNNLISSDYNSPSSSSDNGGSNNSDKTSISQLVSLLFDDVYSTFSVSSLLTNVNNDHHYHLHHSSSSSKTTNTNSPNSISKTSIKQSSVNASGNVSPSQFSTGNDASPTSPMASLSSPLNTNILGYPLSPITSTLGQANTSTSTTAATTKTDADTPSTMNTNNNNNNNNSANLNNIPQRIFSLDDISSFNSSRKSLNLDDSNSLFLWDTSQHSNASMTNTNMHAGVNNSQSQNDQSSLNYMENIMELYSNYTGSELSSHTAILRFLVVLTLLDSEVYDEMNSNSYRKISEPIMNINPKDSNTSSWGSASKNPSIRHLTHGLKKLTLQQGRKRNVKFLTYLIRNLNGGQFVSDVSLIDSIRSILFLMTMTSSISQIDSNIASVIFSKRFYNLLGQNLEVGTNWNSATANTFISHCVERNPLTHRRLQLEFFASGLQLDSDLFLRHLQLEKELNHIDLPKISLYTEGFRVFFHLVSTKKLHEDIAEKTSSVLKRLFCIIADILLKATPYFDDNVTKIIASILDGHILDQFDAARTLSNDDHVSFDAATSVYTEPTEIIHNSSDASLVSSLSQSPLSINSGSNITNTRTWDIQSILPTLSNRSSASDLSLSNILTNPLEAQQNNNANLLAHRLSGVPTTKRYASPNDSERSRQSPYSSPPQLQQSDLPSPLSVLSSSAGFSSNHSITATPTILKNIKSPKPNKTKKIADDKQLKQPSYSRVILSDNDEARKIMMNIFSIFKRMTNWFIRPDANTEFPKTFTDIIKPLFVSILDSNQRLQVTARAFIEIPLSYIATFEDIDNDLDPRVLNDHYLLCTYAVTLFASSLFDLKLENAKREMLLDIIVKFQRVRSYLSNLAEKHNLVQAIITTERLTLPLLVGAVGSGIFISLYCSRGNTPRLIKISCCEFLRSLRFYQKYVGALDQYSIYNIDFIDAMAQDNFTASGSVALQRRLRNNILTYIKGSDSILLDSMDVIYKKWFYFSCSKSVTQEELVDFRSLAGILASMSGILSDMQELEKSKSAPDNEGDSLSFESRNPAYEVHKSLKLELTKKMNFFISKQCQWLNNPNLLTRENSRDILSIELHPLSFNLLFNNLGLKIDELMSIDLSKSHEDSSFVLLEQIIIIIRTILKRDDDEKIMLLFSTDLLDAVDKLIEIVEKISIKSSKYYKGIIQMSKMFRAFEHSEKNLGISNHFHLKNKWLKLVIGWFKLSINKDYDFENLSRPLREMDLQKRDEDFLYIDTSIESAKALAYLTHNVPLEIPPSSSKEDWNRSSTVSFGNHFTILLKGLEKSADLNQFPVSLRHKISILNENVIIALTNLSNANVNVSLKFTLPMGYSPNKDIRIAFLRVFIDIVTNYPVNPEKHEMDKMLAIDDFLKYIIKNPILAFFGSLACSPADVDLYAGGFLNAFDTRNASHILVTELLKQEIKRAARSDDILRRNSCATRALSLYTRSRGNKYLIKTLRPVLQGIVDNKESFEIDKMKPGSENSEKMLDLFEKYMTRLIDAITSSIDDFPIELVDICKTIYNAASVNFPEYAYIAVGSFVFLRFIGPALVSPDSENIIIVTHAHDRKPFITLAKVIQSLANGRENIFKKDILVSKEEFLKTCSDKIFNFLSELCKIPTNNFTVNVREDPTPISFDYSFLHKFFYLNEFTIRKEIINESKLPGEFSFLKNTVMLNDKILGVLGQPSMEIKNEIPPFVVENREKYPSLYEFMSRYAFKKVDMKEEEEDNAPFVHEAMTLDGIQIIVVTFTNCEYNNFVMDSLVYKVLQIYARMWCSKHYVVIDCTTFYGGKANFQKLTTLFFSLIPEQASSNCMGCYYFNVNKSFMDQWASSYTVENPYLVTTIPRCFINSNTDQSLIKSLGLSGRSLEVLKDVRVTLHDITLYDKEKKKFCPVSLKIGNKYFQVLHEIPQLYKVTVSNRTFSIKFNNVYKISNLISVDVSNTTGVSSEFTLSLDNEEKLVFCSPKYLEIVKMFYYAQLKMEEDFGTDFSNDISFSTSSSAVNASYCNVKEVGEIISHLSLVILVGLFNEDDLVKNISYNLLVATQEAFNLDFGTRLHKSPETYVPDDTTTFLALIFKAFSESSTELTPYIWKYMLDGLENDVIPQEHIPTVVCSLSYWVPNLYEHVYLANDEEGPEAISRIIYSLIRLTVKEPNFTTAYLQQIWFLLALDGRLTNVIVEEIVSHALDRDSENRDWMKAVSILTSFPTTEIACQVIEKLINMIKSFLPSLAVEASAHSWSELTILSKISVSIFFESPLLSQMYLPEILFAVSLLIDVGPSEIRVSLYELLMNVCHSLTNNESLPERNRKNLDIVCATFARQKLNFISGFSQEKGRVLPNFAASSFSSKFGTLDLFTKNIMLLMEYGSISEGAQWEAKYKKYLMDAIFGHRSFFSARAMMILGIMSKSHTSLFLCKELLVETMKVFAEPVVDDEQMFIIIAHVFTYSKIVEGLDPSSELMKELFWLATICVESPHPLLFEGGLLFMVNCLKRLYTVHLQLGFDGKSLAKKLMESRNFAATLLAKLESYNGCIWNEDNFPHIILGFIANGLSIPVVKGAALDCLQALFKNTYYERKSNPKSSDYLCYLFLLHLVLSPEQLSTLLLEVGFEDELVPLNNTLKVPLTLINWLSSDSDKSNIVLYQGALLFSCVMSDEPCKFRFALLMRYLLKVNPICVFRFYTLTRKEFRRLSTLEQSSEAVAVSFELIGMLVTHSEFNYLEEFNDEMVELLKKRGLSVVKPLDIFDQEHIEKLKGEGEHQVAIYERKRLATMILARMSCS

SEQ ID NO: 1471 - protein, 773 aa, Saccharomyces cerevisiae
MGKKRAPQKGKTVTKPQEIIVDESKLNWKPVDIPDTLDDFGGFYGLEEIDGVDVKVVDGKVTFVTKKDSKVLKDSNKEKVGDDQESVENESGSDSESELLEFKNLDDIKEGELSAASYSSSDEDEQGNIESSKLTDPSEDVDEDVDEDVLKENVFNKDINIDDISPVNLPEWTNLAPLSMTILQSLQNLNFLRPTEIQKKSIPVIMQGVDVMGKASTGSGKTLAYGIPIVEKLISNFSQKNKKPISLIFTPTRELAHQVTDHLKKICEPVLAKSQYSILSLTGGLSIQKQQRLLKYDNSGQIVIATPGRFLELLEKDNTLIKRFSKVNTLILDEADRLLQDGHFDEFEKIIKHLLVERRKNRENSEGSSKIWQTLIFSATFSIDLFDKLSSSRQVKDRRFKNNEDELNAVIQHLMSKIHFNSKPVIIDTNPESKVSSQIKESLIECPPLERDLYCYYFLTMFPGTTLIFCNAIDSVKKLTVYLNNLGIPAFQIHSSMTQKNRLKSLERFKQQSAKQKTINHSNPDSVQLSTVLIASDVAARGLDIPGVQHVIHYHLPRSTDIYIHRSGRTARAGSEGVSAMICSPQESMGPLRKLRKTLATKNSVSTDLNSRSTNRKPIKWQNTVPLLPIETDILSQLRERSRLAGELADHEIASNSLRKDDNWLKKAADELGIDVDSDEDDISKSNSDTFLLKNKNKKMQKTINKDKVKAMRATLNELLSVPIRKDRRQKYLTGGLVNLADNLVKKRGHNSIIGHEKTNALETLKKKKKRNN

SEQ ID NO: 1472 - protein, 351 aa, Saccharomyces cerevisiae
MPSQVIPEKQKAIVFYETDGKLEYKDVTVPEPKPNEILVHVKYSGVCHSDLHAWHGDWPFQLKFPLIGGHEGAGVVVKLGSNVKGWKVGDFAGIKWLNGTCMSCEYCEVGNESQCPYLDGTGFTHDGTFQEYATADAVQAAHIPPNVNLAEVAPILCAGITVYKALKRANVIPGQWVTISGACGGLGSLAIQYALAMGYRVIGIDGGNAKRKLFEQLGGEIFIDFTEEKDIVGAIIKATNGGSHGVINVSVSEAAIEASTRYCRPNGTVVLVGMPAHAYCNSDVFNQVVKSISIVGSCVGNRADTREALDFFARGLIKSPIHLAGLSDVPEIFAKMEKGEIVGRYVVETSK

SEQ ID NO: 1473 - protein, 344 aa, Saccharomyces cerevisiae
MSSSVASTENIVENMLHPKTTEIYFSLNNGVRIPALGLGTANPHEKLAETKQAVKAAIKAGYRHIDTAWAYETEPFVGEAIKELLEDGSIKREDLFITTKVWPVLWDEVDRSLNESLKALGLEYVDLLLQHWPLCFEKIKDPKGISGLVKTPVDDSGKTMYAADGDYLETYKQLEKIYLDPNDHRVRAIGVSNFSIEYLERLIKECRVKPTVNQVETHPHLPQMELRKFCFMHDILLTAYSPLGSHGAPNLKIPLVKKLAEKYNVTGNDLLISYHIRQGTIVIPRSLNPVRISSSIEFASLTKDELQELNDFGEKYPVRFIDEPFAAILPEFTGNGPNLDNLKY

SEQ ID NO: 1474 - protein, 347 aa, Saccharomyces cerevisiae
MTFMQQLQEAGERFRCINGLLWVVFGLGVLKCTTLSLRFLALIFDLFLLPAVNFDKYGAKTGKYCAITGASDGIGKEFARQMAKRGFNLVLISRTQSKLEALQKELEDQHHVVVKILAIDIAEDKESNYESIKELCAQLPITVLVNNVGQSHSIPVPFLETEEKELRNIITINNTATLLITQIIAPKIVETVKAENKKSGTRGLILTMGSFGGLIPTPLLATYSGSKSFLQGWSNSLAGELSKDAIDVELIISYLVTSSMSKIRRSSLMIPNPQQFVKSTLRSVGRRCGSQERYATMTPYWAHAVYQFVITETFGVYSKIVNSINYSFHKSIRIRALKKAARQVKKE

SEQ ID NO: 1475 - protein, 298 aa, Saccharomyces cerevisiae
MSGELANYKRLEKVGEGTYGVVYKALDLRPGQGQRVVALKKIRLESEDEGVPSTAIREISLLKELKDDNIVRLYDIVHSDAHKLYLVFEFLDLDLKRYMEGIPKDQPLGADIVKKFMMQLCKGIAYCHSHRILHRDLKPQNLLINKDGNLKLGDFGLARAFGVPLRAYTHEIVTLWYRAPEVLLGGKQYSTGVDTWSIGCIFAEMCNRKPIFSGDSEIDQIFKIFRVLGTPNEAIWPDIVYLPDFKPSFPQWRRKDLSQVVPSLDPRGIDLLDKLLAYDPINRISARRAAIHPYFQES

SEQ ID NO: 1476 - protein, 376 aa, Saccharomyces cerevisiae
MKKELKILIIANIALLISIIHYTFDLLTLCIDDTSKDALTDEQLNPPNGFNSTFYESPPQLIPKIIHQTYKTNDIPEQWVKGRQKCIDLHPDYTYILWTDEMSDTFIKQEYPWFLDTFRSYEYPIERADAIRYFILSHYGGIYIDLDDGCERRLDPLLKVPAFLRKTSPTGVSNDVMGSVPRHPFFLKVIKSLKHYKKNWYIPYMTIMGSTGPLFISVVWKQYKRWSNTAENGAVRILQPADYKMHNNSFFSISKGSSWHTGDANFMKTLENHILSCVVTGFIFGFFILYGEFTFYTWLCSGPFNNKRYYIQWLSDKFKLHKWKLTSSYKNKEKRRNPTRHEYNSRGKRLRKDSNIPYDSVFLDIEKNHAKFTDLT

SEQ ID NO: 1477 - protein, 183 aa, Saccharomyces cerevisiae
MGNIFSSMFDKLWGSNKELRILILGLDGAGKTTILYRLQIGEVVTTKPTIGFNVETLSYKNLKLNVWDLGGQTSIRPYWRCYYADTAAVIFVVDSTDKDRMSTASKELHLMLQEEELQDAALLVFANKQDQPGALSASEVSKELNLVELKDRSWSIVASSAIKGEGITEGLDWLIDVIKEEQL

SEQ ID NO: 1478 - protein, 452 aa, Saccharomyces cerevisiae
MVSEDKIEQWKATKVIGIIGLGDMGLLYANKFTDAGWGVICCDREEYYDELKEKYASAKFELVKNGHLVSRQSDYIIYSVEASNISKIVATYGPSSKVGTIVGGQTSCKLPEIEAFEKYLPKDCDIITVHSLHGPKVNTEGQPLVIINHRSQYPESFEFVNSVMACLKSKQVYLTYEEHDKITADTQAVTHAAFLSMGSAWAKIKIYPWTLGVNKWYGGLENVKVNISLRIYSNKWHVYAGLAITNPSAHQQILQYATSATELFSLMIDNKEQELTDRLLKAKQFVFGKHTGLLLLDDTILEKYSLSKSSIGNSNNCKPVPNSHLSLLAIVDSWFQLGIDPYDHMICSTPLFRIFLGVSEYLFLKPGLLEQTIDAAIHDKSFIKDDLEFVISAREWSSVVSFANFDIYKKQFQSVQKFFEPMLPEANLIGNEMIKTILSHSSDRSAAEKRNT

SEQ ID NO: 1479 - protein, 693 aa, Saccharomyces cerevisiae
MSTPFGLDLGNNNSVLAVARNRGIDVVVNEVSNRSTPSLVGFGPRNRYLGESGKTKQTSNVKNTVENLKRIIGLKFKDPEFDIENKFFTSKLVQLKNGKVGVEVEFGGKTHVFSATQLTAMFIDKVKHTVQEETKSSITDVCLAVPVWYSEEQRYNIADAARIAGLNPVRIVNDVTAAAVSYGVFKNDLPGPEEKPRIIGLVDIGHSTYTCSIMAFRKGEMKVLGTAYDKHFGGRDFDRAITEHFADQFKDKYKIDIRKNPKAYNRILIAAEKLKKVLSANTTAPFSVESVMDDIDVSSQLSREELEELVEPLLKRVTYPITNALAQAKLTVNDIDFVEIIGGTTRIPVLKKSISDVFGKPLSSTLNQDEAVAKGAAFICAIHSPTLRVRPFKFEDIDPYSVSYTWDKQVDDEDRLEVFPANSSYPSTKLITLHRTGDFSMKAVYTHPSKLPKGTSTTIAKWSFTGVKVPKDQDFIPVKVKLRCDPSGLHIIENAYTTEDITVQEPVPLPEDAPEDAEPQFKEVTKTIKKDVLGMTAKTFALNPVELNDLIEKENELRNQDKLVAETEDRKNALEEYIYTLRAKLDDEYSDFASDAEKEKLKNMLATTENWLYGDGDDSTKAKYIAKYEELASLGNIIRGRYLAKEEEKRQALRANQETSKMNDIAEKLAEQRRARAASDDSDDNNDENMDLD

SEQ ID NO: 1480 - protein, 206 aa, Saccharomyces cerevisiae
MSEFNETKFSNNGTFFETEEPIVETKSISVYTPLIYVFILVVSLVMFASSYRKKQAKKISEQPSIFDENDAHDLYFQIKEMSENEKIHEKVLKAALLNRGAESVRRSLKLKELAPQINLLYKNGSIGEDYWKRFETEVKLIELEFKDTLQEAERLQPGWVQLFVMVCKEICFNQALSRRYQSILKRKEVCIKEWELKINNDGRLVN

SEQ ID NO: 1481 - protein, 855 aa, Saccharomyces cerevisiae
MSEGKQQFKDSNKPHKDSTDQDDDAATIVPQTLTYSRNEGHFLGSNFHGVTDDRTTLFDGEEGRREDDLLPSLRSSNSKAHLISSQLSQWNYNNNRVLLKRSILKTQAFMDQLQEENNIRPIFIAANDEREKLHVLQLNIKLDGQYNTKEKNGFNIEKKALSKLFHSQIVSVTNHLNALKKRVDDVSSKVFITGDVNTGKSALCNSLLKQRLLPEDQLPCTNVFSEILEARENDGIEEVHAIPLNIAPTLKEAIDMYSIQNPKTYEIHTLKELPDLVPQNGKYALLKIYIKDDKRPASTSLLRNGTVDISLIDSPGLNMDSLQTAEVMSRQEEIDLVIFVVNAENQLTLSAKEFISLASREKKLMFFVVKKFDKIRDKQRCKELILKQIRDLSPETYKRAADFVHFVSKNGDELPHYHNENDNEDHGDRKPDDDPYSSSDPDPDFDSLEDSLRNFVLKKRSLSKLLPAKTYLSKLLSDIIMISKSNMKMYSEEEIKINEQLETLRPEILSARAKCNDLTTSVDQMAEQTITMTYNNTKEALLNALDVPLHEYPKYQGLGQIYDFIFSTEAFIANQIDESIGSSELFAKQKTDLLVKKIYEIGKNELGDDFMCERVFRSELMFRKRKHLIGKRLKVSLSITDLFAPTWKGFLSYLSWQKPVTAPLPDIEGQTNEGQIGLMKYLGLKNYPLTQYWSRPSLLFTSKIPTLTLYFLGSTKVVGNIILNGIKLSSWSSLKKLSVPVIVVGSLLGLTYLIHDLPRALPMNLSIKYKRKLQELDYIHLNAQRTSNEVRDVLRVPTREILRSCEIIMDKKQITKKELENKKESNLLSIKFFQSLYEGTVAQKLMVEEINLDID

SEQ ID NO: 1482 - protein, 377 aa, Saccharomyces cerevisiae
MPKKSIEEWEEDAIESVPYLASDEKGSNYKEATQIPLNLKQSEIENHPTVKPWVHFVAGGIGGMAGAVVTCPFDLVKTRLQSDIFLKAYKSQAVNISKGSTRPKSINYVIQAGTHFKETLGIIGNVYKQEGFRSLFKGLGPNLVGVIPARSINFFTYGTTKDMYAKAFNNGQETPMIHLMAAATAGWATATATNPIWLIKTRVQLDKAGKTSVRQYKNSWDCLKSVIRNEGFTGLYKGLSASYLGSVEGILQWLLYEQMKRLIKERSIEKFGYQAEGTKSTSEKVKEWCQRSGSAGLAKFVASIATYPHEVVRTRLRQTPKENGKRKYTGLVQSFKVIIKEEGLFSMYSGLTPHLMRTVPNSIIMFGTWEIVIRLLS

SEQ ID NO: 1483 - protein, 422 aa, Saccharomyces cerevisiae
MNQCAKDITHEASSIPIDLQERYSHWKKNTKLLYDYLNTNSTKWPSLTCQFFPDLDTTSDEHRILLSSFTSSQKPEDETIYISKISTLGHIKWSSLNNFDMDEMEFKPENSTRFPSKHLVNDISIFFPNGECNRARYLPQNPDIIAGASSDGAIYIFDRTKHGSTRIRQSKISHPFETKLFGSHGVIQDVEAMDTSSADINEATSLAWNLQQEALLLSSHSNGQVQVWDIKQYSHENPIIDLPLVSINSDGTAVNDVTWMPTHDSLFAACTEGNAVSLLDLRTKKEKLQSNREKHDGGVNSCRFNYKNSLILASADSNGRLNLWDIRNMNKSPIATMEHGTSVSTLEWSPNFDTVLATAGQEDGLVKLWDTSCEETIFTHGGHMLGVNDISWDAHDPWLMCSVANDNSVHIWKPAGNLVGHS

SEQ ID NO: 1484 - protein, 554 aa, Saccharomyces cerevisiae
MSNNSFTNFKLATELPAWSKLQKIYESQGKTLSVKQEFQKDAKRFEKLNKTFTNYDGSKILFDYSKNLVNDEIIAALIELAKEANVTGLRDAMFKGEHINSTEDRAVYHVALRNRANKPMYVDGVNVAPEVDSVLKHMKEFSEQVRSGEWKGYTGKKITDVVNIGIGGSDLGPVMVTEALKHYAGVLDVHFVSNIDGTHIAETLKVVDPETTLFLIASKTFTTAETITNANTAKNWFLSKTGNDPSHIAKHFAALSTNETEVAKFGIDTKNMFGFESWVGGRYSVWSAIGLSVALYIGYDNFEAFLKGAEAVDNHFTQTPLEDNIPLLGGLLSVWYNNFFGAQTHLVAPFDQYLHRFPAYLQQLSMESNGKSVTRGNVFTDYSTGSILFGEPATNAQHSFFQLVHQGTKLIPSDFILAAQSHNPIENKLHQKMLASNFFAQAEALMVGKDEEQVKAEGATGGLVPHKVFSGNRPTTSILAQKITPATLGALIAYYEHVTFTEGAIWNINSFDQWGVELGKVLAKVIGKELDNSSTISTHDASTNGLINQFKEWM

SEQ ID NO: 1485 - protein, 798 aa, Saccharomyces cerevisiae [sequence omitted]

SEQ ID NO: 1486 - protein, 464 aa, Saccharomyces cerevisiae
MRFLSKRILKPVLSVIILISIAVTVVLYFLTANENYLQAVKDSAKSQYASLRESYKSITGKTESADELPDHDAEVLDSIMDRLHEPLYEKDTFDPNEVLAENKQLYEEFLLQEISEPKVDNLVRSGDPLAGKAKGTILSLVRNSDLEDIISSIQQLEEEYNKNFGYPYTFLNDEEFTDEFKDGIKSILPKDRVVEFGTIGPDNWNMPDSIDRERYDQEMDKMSKENIQYAEVESYHNMCRFYSKEFYHHPLLSKYKYVWRLEPNVNFYCKINYDVFQFMNKNDKIYGFVLNLYDSPQTIETLWTSTMDFVEEHPNYLNVNGAFAWLKDNSQNPKNYDYTQGYSTCHFWTNFEIVDLDFLRSEPYEKYMQYLEEKGGFYYERWGDAPVRSLALALFADKSSIHWFRDIGYHHTPYTNCPTCPADSDRCNGNCVPGKFTPWSDLDNQNCQATWIRHSMSEEELEMY

SEQ ID NO: 1487 - protein, 845 aa, Saccharomyces cerevisiae
MSAALPSIQLPVDYNNLFNEITDFLVTFKQDTLSSDATRNENEDENLDAENIEQHLLEKGPKYMAMLQKVANRELNSVIIDLDDILQYQNEKFLQGTQADDLVSAIQQNANHFTELFCRAIDNNMPLPTKEIDYKDDVLDVILNQRRLRNERMLSDRTNEIRSENLMDTTMDPPSSMNDALREVVEDETELFPPNLTRRYFLYFKPLSQNCARRYRKKAISSKPLSVRQIKGDFLGQLITVRGIITRVSDVKPAVEVIAYTCDQCGYEVFQEVNSRTFTPLSECTSEECSQNQTKGQLFMSTRASKFSAFQECKIQELSQQVPVGHIPRSLNIHVNGTLVRSLSPGDIVDVTGIFLPAPYTGFKALKAGLLTETYLEAQFVRQHKKKFASFSLTSDVEERVMELITSGDVYNRLAKSIAPEIYGNLDVKKALLLLLVGGVDKRVGDGMKIRGDINVCLMGDPGVAKSQLLKAICKISPRGVYTTGKGSSGVGLTAAVMKDPVTDEMILEGGALVLADNGICCIDEFDKMDESDRTAIHEVMEQQTISISKAVINTNPGARTSILAAANPLYGRINPRLSPLDNINLPAALLSRFDILFLMLDIPSRDDDEKLAEHVTYVHMHNKQPDLDFTPVEPSKMREYIAYAKTKRPVMSEAVNDYVVQAYIRLRQDSKREMDSKFSFGQATPRTLLGIIRLSQALAKLRLADMVDIDDVEEALRLVRVSKESLYQETNKSKEDESPTTKIFTIIKKMLQETGKNTLSYENIVKTVRLRGFTMLQLSNCIQEYSYLNVWHLINEGNTLKFVDDGTMDTDQEDSLVSTPKLAPQTTASANVSAQDSDIDLQDA

SEQ ID NO: 1488 - protein, 404 aa, Saccharomyces cerevisiae
MSVHHKKKLMPKSALLIRKYQKGIRSSFIGLIIVLSFLFFMSGSRSPEVPIAQGTSVSRVASKDYLMPFTDKSQGVIHPVDDGKKEKGVMVTLARNSDLWNLVKSIRHVEDRFNNRYHYDWVFLNDQPFSDEFKRVTSALVSGKAKYGTIPKDHWSIPSWIDTEKFDEKRLAMGKLDIPYGSSVPYRHMCRFQSGFIWRHPLLEEYEWFWRVDTDITLFCDIQYDIFKFLKVNNKKYGFILSVSEYERTIPTLWETTKKFIKKNPKFLHKNNLMKFISNDDGDTYNMCHFWTNFEIGSLDFFRSDAYREYFDYLDSSGGFFYERWGDAPVHSIAASLFLDKSEIHFFDGLGFHHPDFTSCPIEQKIRLQNKCICEPSKDVTWTPDYFCTRKYFSAGNYKLPPGI

SEQ ID NO: 1489 - protein, 1835 aa, Saccharomyces cerevisiae
MTVSSDTTAEISLGWSIQDWIDFHKSSSSQASLRLLESLLDSQNVAPVDNAWISLISKENLLHQFQILKSRENKETLPLYGVPIAVKDNIDVRGLPTTAACPSFAYEPSKDSKVVELLRNAGAIIVGKTNLDQFATGLVGTRSPYGKTPCAFSKEHVSGGSSAGSASVVARGIVPIALGTDTAGSGRVPAALNNLIGLKPTKGVFSCQGVVPACKSLDCVSIFALNLSDAERCFRIMCQPDPDNDEYSRPYVSNPLKKFSSNVTIAIPKNIPWYGETKNPVLFSNAVENLSRTGANVIEIDFEPLLELARCLYEGTWVAERYQAIQSFLDSKPPKESLDPTVISIIEGAKKYSAVDCFSFEYKRQGILQKVRRLLESVDVLCVPTCPLNPTMQQVADEPVLVNSRQGTWTNFVNLADLAALAVPAGFRDDGLPNGITLIGKKFTDYALLELANRYFQNIFPNGSRTYGTFTSSSVKPANDQLVGPDYDPSTSIKLAVVGAHLKGLPLHWQLEKVNATYLCTTKTSKAYQLFALPKNGPVLKPGLRRVQDSNGSQIELEVYSVPKELFGAFISMVPEPLGIGSVELESGEWIKSFICEESGYKAKGTVDITKYGGFRAYFEMLKKKESQKKKLFDTVLIANRGEIAVRIIKTLKKLGIRSVAVYSDPDKYSQHVTDADVSVPLHGTTAAQTYLDMNKIIDAAKQTNAQAIIPGYGFLSENADFSDACTSAGITFVGPSGDIIRGLGLKHSARQIAQKAGVPLVPGSLLITSVEEAKKVAAELEYPVMVKSTAGGGGIGLQKVDSEEDIEHIFETVKHQGETFFGDAGVFLERFIENARHVEVQLMGDGFGKAIALGERDCSLQRRNQKVIEETPAPNLPEKTRLALRKAAESLGSLLNYKCAGTVEFIYDEKKDEFYFLEVNTRLQVEHPITEMVTGLDLVEWMIRIAANDAPDFDSTKVEVNGVSMEARLYAENPLKNFRPSPGLLVDVKFPDWARVDTWVKKGTNISPEYDPTLAKIIVHGKDRDDAISKLNQALEETKVYGCITNIDYLKSIITSDFFAKAKVSTNILNSYQYEPTAIEITLPGAHTSIQDYPGRVGYWRIGVPPSGPMDAYSFRLANRIVGNDYRTPAIEVTLTGPSIVFHCETVIAITGGTALCTLDGQEIPQHKPVEVKRGSTLSIGKLTSGCRAYLGIRGGIDVPKYLGSYSTFTLGNVGGYNGRVLKLGDVLFLPSNEENKSVECLPQNIPQSLIPQISETKEWRIGVTCGPHGSPDFFKPESIEEFFSEKWKVHYNSNRFGVRLIGPKPKWARSNGGEGGMHPSNTHDYVYSLGAINFTGDEPVIITCDGPSLGGFVCQAVVPEAELWKVGQVKPGDSIQFVPLSYESSRSLKESQDVAIKSLDGTKLRRLDSVSILPSFETPILAQMEKVNELSPKVVYRQAGDRYVLVEYGDNEMNFNISYRIECLISLVKKNKTIGIVEMSQGVRSVLIEFDGYKVTQKELLKVLVAYETEIQFDENWKITSNIIRLPMAFEDSKTLACVQRYQETIRSSAPWLPNNVDFIANVNGISRNEVYDMLYSARFMVLGLGDVFLGSPCAVPLDPRHRFLGSKYNPSRTYTERGAVGIGGMYMCIYAANSPGGYQLVGRTIPIWDKLCLAASSEVPWLMNPFDQVEFYPVSEEDLDKMTEDCDNGVYKVNIEKSVFDHQEYLRWINANKDSITAFQEGQLGERAEEFAKLIQNANSELKESVTVKPDEEEDFPEGAEIVYSEYSGRFWKSIASVGDVIEAGQGLLIIEAMKAEMIISAPKSGKIIKICHGNGDMVDSGDIVAVIETLA

SEQ ID NO: 1490 - protein, 142 aa, Saccharomyces cerevisiae
MSGTGLSLFVTGLILNCLNSICQIYFTILYGDLEADYINSIELCKRVNRLSVPEAILQAFISALFLFNGYWFVFLLNVPVLAYNASKVYKKTHLLDATDIFRKLGRCKIECFLKLGFYLLIFFFYFYRMVTALLENDANLIS

SEQ ID NO: 1491 - protein, 1180 aa, Saccharomyces cerevisiae
MSSSKKLAGLRDNFSLLGEKNKILVANRGEIPIRIFRSAHELSMRTIAIYSHEDRLSMHRLKADEAYVIGEEGQYTPVGAYLAMDEIIEIAKKHKVDFIHPGYGFLSENSEFADKVVKAGITWIGPPAEVIDSVGDKVSARHLAARANVPTVPGTPGPIETVQEALDFVNEYGYPVIIKAAFGGGGRGMRVVREGDDVADAFQRATSEARTAFGNGTCFVERFLDKPKHIEVQLLADNHGNVVHLFERDCSVQRRHQKVVEVAPAKTLPREVRDAILTDAVKLAKVCGYRNAGTAEFLVDNQNRHYFIEINPRIQVEHTITEEITGIDIVSAQIQIAAGATLTQLGLLQDKITTRGFSIQCRITTEDPSKNFQPDTGRLEVYRSAGGNGVRLDGGNAYAGATISPHYDSMLVKCSCSGSTYEIVRRKMIRALIEFRIRGVKTNIPFLLTLLTNPVFIEGTYWTTFIDDTPQLFQMVSSQNRAQKLLHYLADLAVNGSSIKGQIGLPKLKSNPSVPHLHDAQGNVINVTKSAPPSGWRQVLLEKGPSEFAKQVRQFNGTLLMDTTWRDAHQSLLATRVRTHDLATIAPTTAHALAGAFALECWGGATFDVAMRFLHEDPWERLRKLRSLVPNIPFQMLLRGANGVAYSSLPDNAIDHFVKQAKDNGVDIFRVFDALNDLEQLKVGVNAVKKAGGVVEATVCYSGDMLQPGKKYNLDYYLEVVEKIVQMGTHILGIKDMAGTMKPAAAKLLIGSLRTRYPDLPIHVHSHDSAGTAVASMTACALAGADVVDVAINSMSGLTSQPSINALLASLEGNIDTGINVEHVRELDAYWAEMRLLYSCFEADLKGPDPEVYQHEIPGGQLTNLLFQAQQLGLGEQWAETKRAYREANYLLGDIVKVTPTSKVVGDLAQFMVSNKLTSDDIRRLANSLDFPDSVMDFFEGLIGQPYGGFPEPLRSDVLRNKRRKLTCRPGLELEPFDLEKIREDLQNRFGDIDECDVASYNMYPRVYEDFQKIRETYGDLSVLPTKNFLAPAEPDEEIEVTIEQGKTLIIKLQAVGDLNKKTGQREVYFELNGELRKIRVADKSQNIQSVAKPKADVHDTHQIGAPMAGVIIEVKVHKGSLVKKGESIAVLSAMKMEMVVSSPADGQVKDVFIKDGESVDASDLLVVLEEETLPPSQKK

SEQ ID NO: 1492 - protein, 366 aa, Saccharomyces cerevisiae
MFSRLPTSLARNVARRAPTSFVRPSAAAAALRFSSTKTMTVREALNSAMAEELDRDDDVFLIGEEVAQYNGAYKVSKGLLDRFGERRVVDTPITEYGFTGLAVGAALKGLKPIVEFMSFNFSMQAIDHVVNSAAKTHYMSGGTQKCQMVFRGPNGAAVGVGAQHSQDFSPWYGSIPGLKVLVPYSAEDARGLLKAAIRDPNPVVFLENELLYGESFEISEEALSPEFTLPYKAKIEREGTDISIVTYTRNVQFSLEAAEILQKKYGVSAEVINLRSIRPLDTEAIIKTVKKTNHLITVESTFPSFGVGAEIVAQVMESEAFDYLDAPIQRVTGADVPTPYAKELEDFAFPDTPTIVKAVKEVLSIE

SEQ ID NO: 1493 - protein, 543 aa, Saccharomyces cerevisiae
MTSAATVTASFNDTFSVSDNVAVIVPETDTQVTYRDLSHMVGHFQTMFTNPNSPLYGAVFRQDTVAISMRNGLEFIVAFLGATMDAKIGAPLNPNYKEKEFNFYLNDLKSKAICVPKGTTKLQSSEILKSASTFGCFIVELAFDATRFRVEYDIYSPEDNYKRVIYRSLNNAKFVNTNPVKFPGFARSSDVALILHTSGTTSTPKTVPLLHLNIVRSTLNIANTYKLTPLDRSYVVMPLFHVHGLIGVLLSTFRTQGSVVVPDGFHPKLFWDQFVKYNCNWFSCVPTISMIMLNMPKPNPFPHIRFIRSCSSALAPATFHKLEKEFNAPVLEAYAMTEASHQMTSNNLPPGKRKPGTVGQPQGVTVVILDDNDNVLPPGKVGEVSIRGENVTLGYANNPKANKENFTKRENYFRTGDQGYFDPEGFLVLTGRIKELINRGGEKISPIELDGIMLSHPKIDEAVAFGVPDDMYGQVVQAAIVLKKGEKMTYEELVNFLKKHLASFKIPTKVYFVDKLPKTATGKIQRRVIAETFAKSSRNKSKL

SEQ ID NO: 1494 - protein, 954 aa, Saccharomyces cerevisiae
MVLLKWLVCQLVFFTAFSHAFTDYLLKKCAQSGFCHRNRVYAENIAKSHHCYYKVDAESIAHDPLENVLHATIIKTIPRLEGDDIAVQFPFSLSFLQDHSVRFTINEKERMPTNSSGLLISSQRFNETWKYAFDKKFQEEANRTSIPQFHFLKQKQTVNSFWSKISSFLSLSNSTADTFHLRNGDVSVEIFAEPFQLKVYWQNALKLIVNEQNFLNIEHHRTKQENFAHVLPEETTFNMFKDNFLYSKHDSMPLGPESVALDFSFMGSTNVYGIPEHATSLRLMDTSGGKEPYRLFNVDVFEYNIGTSQPMYGSIPFMFSSSSTSIFWVNAADTWVDIKYDTSKNKTMTHWISENGVIDVVMSLGPDIPTIIDKFTDLTGRPFLPPISSIGYHQCRWNYNDEMDVLTVDSQMDAHMIPYDFIWLDLEYTNDKKYFTWKQHSFPNPKRLLSKLKKLGRNLVVLIDPHLKKDYEISDRVINENVAVKDHNGNDYVGHCWPGNSIWIDTISKYGQKIWKSFFERFMDLPADLTNLFIWNDMNEPSIFDGPETTAPKDLIHDNYIEERSVHNIYGLSVHEATYDAIKSIYSPSDKRPFLLTRAFFAGSQRTAATWTGDNVANWDYLKISIPMVLSNNIAGMPFIGADIAGFAEDPTPELIARWYQAGLWYPFFRAHAHIDTKRREPYLFNEPLKSIVRDIIQLRYFLLPTLYTMFHKSSVTGFPIMNPMFIEHPEFAELYHIDNQFYWSNSGLLVKPVTEPGQSETEMVFPPGIFYEFASLHSFINNGTDLIEKNISAPLDKIPLFIEGGHIITMKDKYRRSSMLMKNDPYVIVIAPDTEGRAVGDLYVDDGETFGYQRGEYVETQFIFENNTLKNVRSHIPENLTGIHHNTLRNTNIEKIIIAKNNLQHNITLKDSIKVKKNGEESSLPTRSSYENDNKITILNLSLDITEDWEVIF

SEQ ID NO: 1495 - protein, 1120 aa, Saccharomyces cerevisiae
MVSRFYQIPGTHRPSSAISSSNESSSLLSARRISQTYFNYQATPECQKVSSKYDPDNPNKDKLGTYDGVFVPTALNVLSILMFLRFGFILGQLGIICTIGLLLLSYTINLLTTLSISAISTNGTVRGGGAYYMISRSLGPEFGGSIGLVFFLGQVFNAGMNAVGIIEPLLYNLGYSAQGEPPAALGELLPRGHWHEFTYATVILFLCFSVAFVGSQTVSRAGNILFLVLAASIFSIPLSALIRSPFTEGGISYTGPSWQTFHDNLLPHLTKGAAGSLLKGKETFNDLFGVFFPATAGIFAGAGMSSELRKPSKSIPKGTLWGLLFTFICYAVVVFSMGCSIPRRSLYDEVQIIQTISSVQWVIFMGEMATSLFSIIVGMLGAAYVLEAIAKDNIIPGLEIFAHSPLYSLIFTWILTQLCLFSDVNKIATFITMTFLMTFVVMNLACFLLGISSAPNFRPSFKYFNRYTTAIGALLSVVAMLIVDGISASVLFLAMILLFLFIHYFSPPKSWGDVSQSLIYHQVRKYLLRLRQDNIKYWRPQILLFVDNPRTSWNLIRFCNHLKKGGLYILGHVAVTADFPKQLNELKTQQKAWMKIRDMAAIKAFVQVGTGPSLIWGIRNVFIGSGLGGMKPNITVVGFFDLESYRKHIPQSRSQNNLQKQVEIKATVPRSTCSDVKINVPLPTDECKNETKVNVQQWVQIVEDLSLMQSNIAIAHGFKNLEIPNKRDSCFPKKTIDLYPIQMCGKVEAKGDQPAAITTNFDTYTLILQLAAILVTVPEWKRTHSLRVILFVEQEYHRTNETQRMKKLLQVLRIDAEVLVVSLDQFRVYNTIVKGDPIVFDYVNSKLADNEWWKDLVEARDTLKPKRRFSTIEPQTIAKQFTQSRKYTSGVQKLGVSFTMNTRMPTNRIDTPCESEDSDLDTDLTSIRDAFSASTNISVGKDLTTKSKTGSDRTNLLVKNLQSDVSTQSLRPVFSSNTLPRTRVVEDGTGEQPTLIPIAEPDLSNGNGTGSGIGNGNKLKKPVLPELSPCCSKDSLVTAMQNLGFNDLPSTAQHLVLNDVMTQMSKSSDLIFSTLPVPALGTHEDHDASLQYVEDLDIWLEGLPPCMLINSQTMTVTTAL

SEQ ID NO: 1496 - protein, 849 aa, Saccharomyces cerevisiae
METIDSKQNINRESLLEERRKKLAKWKQKKAQFDAQKEHQTSRNDIVTNSLEGKQTTEKFTERQERVKEELRKRKNEFRKSDEPVSVKPSKKKSKRSKVKKKISFDFSDDDDSEIGVSFRSKEHIQKAPEHDNEKDPLDEFMTSLKEEKMSNSKGMYDRGDILDVEDQLFELGGTDDEDVEDNTDNSNIAKIAKLKAKKRVKQIYYSPEELEPFQKNFYIESETVSSMSEMEVEELRLSLDNIKIKGTGCPKPVTKWSQLGLSTDTMVLITEKLHFGSLTPIQSQALPAIMSGRDVIGISKTGSGKTISYLLPLLRQVKAQRPLSKHETGPMGLILAPTRELALQIHEEVTKFTEADTSIRSVCCTGGSEMKKQITDLKRGTEIVVATPGRFIDILTLNDGKLLSTKRITFVVMDEADRLFDLGFEPQITQIMKTVRPDKQCVLFSATFPNKLRSFAVRVLHSPISITINSKGMVNENVKQKFRICHSEDEKFDNLVQLIHERSEFFDEVQSENDGQSSDVEEVDAKAIIFVSSQNICDFISKKLLNAGIVTCAIHAGKPYQERLMNLEKFKREKNSILLCTEVLSRGLNVPEVSLVIIYNAVKTFAQYVHTTGRTARGSRSGTAITLLLHDELSGAYILSKAMRDEEIKALDPLQAKELQEMSAKFESGMKKGKFRLSKGFGGKGLENIKSKREEAQNKDLELKKNDKRSDDLEKKISNPREGHDSVSESSALIPRLNYELFKESTDGSIIFYAKVYINDLPQIVRWEATKNTTLLFIKHETGCSITNKGKFYPEGKEPKNENDEPKLYLLIEGQDEKDIQLSIELLEQKVKEGVVKAASLSLKSTKY

SEQ ID NO: 1497 - protein, 488 aa, Saccharomyces cerevisiae
MAETERLMPNGGSRETKPLITGHLILGTIVACLGSIQYGYHIAELNAPQEFLSCSRFEAPDENISYDDTWVGQHGLKQCIALTDSQYGAITSIFSIGGLFGSYYAGNWANRYGRKYVSMGASAMCMVSSLLLFFSNSYLQLLFGRFLVGMSCGTAIVITPLFINEIAPVEWRGAMGSMNQVSINLGILLTQTLALKYADSYNWRWLLFSGSVIAVANILAWLKVDESPRWLVSHGFVSEAETALFKLRPGTYQQAKQEIQDWQRSHGHNRDPESSEETHSGPTLWQYVTDPSYKKPRTVILAILSCQQFCGINSIIFYGVKVIGKILPDYSIQVNFAISILNVVVTLAASAIIDHVGRRPLLLASTTVMTAMSLLISVGLTLSVSFLLVTATFVYIAAFAIGLGPIPFLIIGELSYPQDAATAQSFGTVCNWLATFIVGYLFPIGHGLMGGYVFAIFAAIAAMFATYVYKRVPETKGKTTYSEVWAGY

SEQ ID NO: 1498 - protein, 448 aa, Saccharomyces cerevisiae
MLRLFSLALITCLIYYSKNQGPSALVAAVGFGIAGYLATDMLIPRVGKSFIKIGLFGKDLSKPGRPVLPETIGAIPAAVYLFVMFIYIPFIFYKYMVITTSGGGHRDVSVVEDNGMNSNIFPHDKLSEYLSAILCLESTVLLGIADDLFDLRWRHKFFLPAIAAIPLLMVYYVDFGVTHVLIPGFMERWLKKTSVDLGLWYYVYMASMAIFCPNSINILAGVNGLEVGQCIVLAILALLNDLLYFSMGPLATRDSHRFSAVLIIPFLGVSLALWKWNRWPATVFVGDTYCYFAGMVFAVVGILGHFSKTMLLLFIPQIVNFIYSCPQLFKLVPCPRHRLPKFNEKDGLMYPSRANLKEEPPKSIFKPILKLLYCLHLIDLEFDENNEIISTSNMTLINLTLVWFGPMREDKLCNTILKLQFCIGILALLGRHAIGAIIFGHDNLWTVR

SEQ ID NO: 1499 - protein, 1143 aa, Saccharomyces cerevisiae
MQKPARGGCRNTLLWPNMLAIANFHFFKFYTRMRKKHENNSCNEKDKDENLFKIILAIFLQEKKKYDCISSGSIMTASEEYLENLKPFQVGLPPHDPESNKKRYLLKDANGKKFDLEGTTKRFEHLLSLSGLFKHFIESKAAKDPKFRQVLDVLEENKANGKGKGKHQDVRRRKTEHEEDAELLKEEDSDDDESIEFQFRESPAYVNGQLRPYQIQGVNWLVSLHKNKIAGILADEMGLGKTLQTISFLGYLRYIEKIPGPFLVIAPKSTLNNWLREINRWTPDVNAFILQGDKEERAELIQKKLLGCDFDVVIASYEIIIREKSPLKKINWEYIIIDEAHRIKNEESMLSQVLREFTSRNRLLITGTPLQNNLHELWALLNFLLPDIFSDAQDFDDWFSSESTEEDQDKIVKQLHTVLQPFLLRRIKSDVETSLLPKKELNLYVGMSSMQKKWYKKILEKDLDAVNGSNGSKESKTRLLNIMMQLRKCCNHPYLFDGAEPGPPYTTDEHLVYNAAKLQVLDKLLKKLKEEGSRVLIFSQMSRLLDILEDYCYFRNYEYCRIDGSTAHEDRIQAIDDYNAPDSKKFVFLLTTRAGGLGINLTSADVVVLYDSDWNPQADLQAMDRAHRIGQKKQVKVFRLVTDNSVEEKILERATQKLRLDQLVIQQNRTSLKKKENKADSKDALLSMIQHGAADVFKSGTSTGSAGTPEPGSGEKGDDIDLDELLLKSENKTKSLNAKYETLGLDDLQKFNQDSAYEWNGQDFKKKIQRDIISPLLLNPTKRERKENYSIDNYYKDVLNTGRSSTPSHPRMPKPHVFHSHQLQPPQLKVLYEKERMWTAKKTGYVPTMDDVKAAYGDISDEEEKKQKLELLKLSVNNSQPLTEEEEKMKADWESEGFTNWNKLEFRKFITVSGKYGRNSIQAIARELAPGKTLEEVRAYAKAFWSNIERIEDYEKYLKIIENEEEKIKRVKMQQEALRRKLSEYKNPFFDLKLKHPPSSNNKRTYSEEEDRFILLMLFKYGLDRDDVYELVRDEIRDCPLFELDFYFRSRTPVELARRGNTLLQCLEKEFNAGIVLDDATKDRMKKEDENGKRIREEFADQTANEKENVDGVESKKAKIEDTSNVGTEQLVAEKIPENETTH

SEQ ID NO: 1500 - protein, 552 aa, Saccharomyces cerevisiae
MPVVHVIDVESGNLQSLTNAIEHLGYEVQLVKSPKDFNISGTSRLILPGVGNYGHFVDNLFNRGFEKPIREYIESGKPIMGICVGLQALFAGSVESPKSTGLNYIDFKLSRFDDSEKPVPEIGWNSCIPSENLFFGLDPYKRYYFVHSFAAILNSEKKKNLENDGWKIAKAKYGSEEFIAAVNKNNIFATQFHPEKSGKAGLNVIENFLKQQSPPIPNYSAEEKELLMNDYSNYGLTRRIIACLDVRTNDQGDLVVTKGDQYDVREKSDGKGVRNLGKPVQLAQKYYQQGADEVTFLNITSFRDCPLKDTPMLEVLKQAAKTVFVPLTVGGGIKDIVDVDGTKIPALEVASLYFRSGADKVSIGTDAVYAAEKYYELGNRGDGTSPIETISKAYGAQAVVISVDPKRVYVNSQADTKNKVFETEYPGPNGEKYCWYQCTIKGGRESRDLGVWELTRACEALGAGEILLNCIDKDGSNSGYDLELIEHVKDAVKIPVIASSGAGVPEHFEEAFLKTRADACLGAGMFHRGEFTVNDVKEYLLEHGLKVRMDEE

SEQ ID NO: 1501 - protein, 370 aa, Saccharomyces cerevisiae
MSESPMFAANGMPKVNQGAEEDVRILGYDPLASPALLQVQIPATPTSLETAKRGRREAIDIITGKDDRVLVIVGPCSIHDLEAAQEYALRLKKLSDELKGDLSIIMRAYLEKPRTTVGWKGLINDPDVNNTFNINKGLQSARQLFVNLTNIGLPIGSEMLDTISPQYLADLVSFGAIGARTTESQLHRELASGLSFPVGFKNGTDGTLNVAVDACQAAAHSHHFMGVTKHGVAAITTTKGNEHCFVILRGGKKGTNYDAKSVAEAKAQLPAGSNGLMIDYSHGNSNKDFRNQPKVNDVVCEQIANGENAITGVMIESNINEGNQGIPAEGKAGLKYGVSITDACIGWETTEDVLRKLAAAVRQRREVNKK

SEQ ID NO: 1502 - protein, 218 aa, Saccharomyces cerevisiae
MIVKLLQEIQVAQNTEEYDMEATIKVVLLGDSSVGKTSIVTRLKSGKFLAKHAATIGAAFITKTIEVPSNDSSTEKRIHMEIWDTAGQERYKSLVPMYYRDANIALIVFELGDVSSLQCAKTWFQDLQDRAQGTQVIIVGNKYDLVCEEHSGEVTIPAELQGLPYVAVSAKTGYNFDTLNKIIISLVPESQFKTLSKNNEQGNILEINKKKSGSGCIC

SEQ ID NO: 1503 - protein, 527 aa, Saccharomyces cerevisiae
MSLSQVSPLPHIKDVVLGDTVGQGAFACVKNAHLQMDPSIILAVKFIHVPTCKKMGLSDKDITKEVVLQSKCSKHPNVLRLIDCNVSKEYMWIILEMADGGDLFDKIEPDVGVDSDVAQFYFQQLVSAINYLHVECGVAHRDIKPENILLDKNGNLKLADFGLASQFRRKDGTLRVSMDQRGSPPYMAPEVLYSEEGYYADRTDIWSIGILLFVLLTGQTPWELPSLENEDFVFFIENDGNLNWGPWSKIEFTHLNLLRKILQPDPNKRVTLKALKLHPWVLRRASFSGDDGLCNDPELLAKKLFSHLKVSLSNENYLKFTQDTNSNNRYISTQPIGNELAELEHDSMHFQTVSNTQRAFTSYDSNTNYNSGTGMTQEAKWTQFISYDIAALQFHSDENDCNELVKRHLQFNPNKLTKFYTLQPMDVLLPILEKALNLSQIRVKPDLFANFERLCELLGYDNVFPLIINIKTKSNGGYQLCGSISIIKIEEELKSVGFERKTGDPLEWRRLFKKISTICRDIILIPN

SEQ ID NO: 1504 - protein, 299 aa, Saccharomyces cerevisiae
MSSKATKSDVDPLHSFLAGSLAGAAEACITYPFEFAKTRLQLIDKASKASRNPLVLIYKTAKTQGIGSIYVGCPAFIIGNTAKAGIRFLGFDTIKDMLRDSETGELSGTRGVIAGLGAGLLESVAAVTPFEAIKTALIDDKQSATPKYHNNGRGVVRNYSSLVRDKGFSGLYRGVLPVSMRQAANQAVRLGCYNKIKTLIQDYTDSPKDKPLSSGLTFLVGAFSGIVTVYSTMPLDTVKTRMQSLDSTKYSSTMNCFATIFKEEGLKTFWKGATPRLGRLVLSGGIVFTIYEKVLVMLA

SEQ ID NO: 1505 - protein, 1216 aa, Saccharomyces cerevisiae
MKPEKLFSGLGTSDGEYGVVNSENISIDAMQDNRGECHRRSIEMHANDNLGLVSQRDCTNRPKITPQECLSETEQICHHGENRTKAGLDVDDAETGGDHTNESRVDECCAEKVNDTETGLDVDSCCGDAQTGGDHTNESCVDGCCVRDSSVMVEEVTGSCEAVSSKEQLLTSFEVVPSKSEGLQSIHDIRETTRCNTNSNQHTGKGRLCIESSDSTLKKRSCKVSRQKIEVSSKPECCNISCVERIASRSCEKRTFKGSTNVGISGSSSTDSLSEKFFSEQYSRMYNRYSSILKNLGCICNYLRTLGKESCCLPKVRFCSGEGASKKTKYSYRNSSGCLTKKKTHGDKERLSNDNGHADFVCSKSCCTKMKDCAVTSTISGTSSSEISRIVSMEPIENHLNLEAGSTGTEHIVLSVSGMSCTGCESKLKKSFGALKCVHGLKTSLILSQAEFNLDLAQGSVKDVIKHLSKTTEFKYEQISNHGSTIDVVVPYAAKDFINEEWPQGVTELKIVERNIIRIYFDPKVIGARDLVNEGWSVPVSIAPFSCHPTIEVGRKHLVRVGCTTALSIILTIPILVMAWAPQLREKISTISASMVLATIIQFVIAGPFYLNALKSLIFSRLIEMDLLIVLSTSAAYIFSIVSFGYFVVGRPLSTEQFFETSSLLVTLIMVGRFVSELARHRAVKSISVRSLQASSAILVDKTGKETEINIRLLQYGDIFKVLPDSRIPTDGTVISGSSEVDEALITGESMPVPKKCQSIVVAGSVNGTGTLFVKLSKLPGNNTISTIATMVDEAKLTKPKIQNIADKIASYFVPTIIGITVVTFCVWIAVGIRVEKQSRSDAVIQAIIYAITVLIVSCPCVIGLAVPIVFVIASGVAAKRGVIFKSAESIEVAHNTSHVVFDKTGTLTEGKLTVVHETVRGDRHNSQSLLLGLTEGIKHPVSMAIASYLKEKGVSAQNVSNTKAVTGKRVEGTSYSGLKLQGGNCRWLGHNNDPDVRKALEQGYSVFCFSVNGSVTAVYALEDSLRADAVSTINLLRQRGISLHILSGDDDGAVRSMAARLGIESSNIRSHATPAEKSEYIKDIVEGRNCDSSSQSKRPVVVFCGDGTNDAIGLTQATIGVHINEGSEVAKLAADVVMLKPKLNNILTMITVSQKAMFRVKLNFLWSFTYNLFAILLAAGAFVDFHIPPEYAGLGELVSILPVIFVAILLRYAKI

SEQ ID NO: 1506 - protein, 614 aa, Saccharomyces cerevisiae
MKGLSSLINRKKDRNDSHLDEIENGVNATEFNSIEMEEQGKKSDFDLSHLEYGPGSLIPNDNNEEVPDLLDEAMQDAKEADESERGMPLMTALKTYPKAAAWSLLVSTTLIQEGYDTAILGAFYALPVFQKKYGSLNSNTGDYEISVSWQIGLCLCYMAGEIVGLQMTGPSVDYMGNRYTLIMALFFLAAFIFILYFCKSLGMIAVGQALCGMPWGCFQCLTVSYASEICPLALRYYLTTYSNLCWAFGQLFAAGIMKNSQNKYANSELGYKLPFALQWIWPLPLAVGIFFAPESPWWLVKKGRIDQARRSLERTLSGKGPEKELLVSMELDKIKTTIEKEQKMSDEGTYWDCVKDGINRRRTRIACLCWIGQCSCGASLIGYSTYFYEKAGVSTDTAFTFSIIQYCLGIAATFISWWASKYCGRFDLYAFGLAFQAIMFFIIGGLGCSDTHGAKMGSGALLMVVAFFYNLGIAPVVFCLVSEIPSSRLRTKTIILARNAYNVIQVVVTVLIMYQLNSEKWNWGAKSGFFWGGFCLATLAWAVVDLPETAGRTFIEINELFRLGVPARKFKSTKVDPFAAAKAAAAEINVKDPKEDLETSVVDEGRNTSSVVNK

SEQ ID NO: 1507 - protein, 584 aa, Saccharomyces cerevisiae
MTISDHPETEPKWWKEATIYQIYPASFKDSNNDGWGDLKGITSKLQYIKDLGVDAIWVCPFYDSPQQDMGYDISNYEKVWPTYGTNEDCFELIDKTHKLGMKFITDLVINHCSTEHEWFKESRSSKTNPKRDWFFWRPPKGYDAEGKPIPPNNWKSFFGGSAWTFDETTNEFYLRLFASRQVDLNWENEDCRRAIFESAVGFWLDHGVDGFRIDTAGLYSKRPGLPDSPIFDKTSKLQHPNWGSHNGPRIHEYHQELHRFMKNRVKDGREIMTVGEVAHGSDNALYTSAARYEVSEVFSFTHVELGTSPFFRYNIVPFTLKQWKEAIASNFLFINGTDSWATTYIENHDQARSITRFADDSPKYRKISGKLLTLLECSLTGTLYVYQGQEIGQINFKEWPIEKYEDVDVKNNYEIIKKSFGKNSKEMKDFFKGIALLSRDHSRTPMPWTKDKPNAGFTGPDVKPWFFLNESFEQGINVEQESRDDDSVLNFWKRALQARKKYKELMIYGYDFQFIDLDSDQIFSFTKEYEDKTLFAALNFSGEEIEFSLPREGASLSFILGNYDDTDVSSRVLKPWEGRIYLVK

SEQ ID NO: 1508 - protein, 712 aa, Saccharomyces cerevisiae
MRLLLCKNWFASPVISPLLYTRSLYSMANTTSFPIAPQAPPNWSFTPSDISGKTNEIINNSNNFYDSMSKVESPSVSNFVEPFMKFENELGPIINQLTFLQHVSSDKEIRDASVNSSMKLDELNIDLSLRHDIFLQFARVWQDVQSKADSVERETFKYVEKSYKDYIHSGLELDEGNRLKIKEIKKKISVNSINFSKNLGEQKEYITFTKEQLEGVPDSILTQFETIKSDKDSNETLYKVTFKYPDIFPVMKLASSAQTRKQAFLADQNKVPENEAILLDTLKLRDELASLLGYDTYANYNLYDKMAEDSTTVMNFLNDLKDKLIPLGRKELQVLQDMKAEDVKKLNQGADPNYYIWDHRYYDNKYLLENFNVDLEKISEYFPLEATITGMLEIYETLFNLKFIETKDSQNKSVWHDDVKQIAVWNMDDPKSPNFVGWIYFDLHPRDGKYGHAANFGLSSSFMIDDTTRSYPVTALVCNFSKSTKDKPSLLKHNEIVTFFHELGHGIHDLVGQNKESRFNGPGSVPWDFVEAPSQMLEFWTWNKNELINLSSHYKTGEKIPESLINSLIKTKHVNGALFTLRQLHFGLFDMKVHTCKDLQNLSICDTWNQLRQDISLISNGGTLSKGYDSFGHIMSDSYSAGYYGYLWAEVFATDMYHTKFAKDPLNAKNGIQYRDIVLARGGLYDINDNLKEFLGREPSKDAFLKELGLQN

SEQ ID NO: 1509 - protein, 335 aa, Saccharomyces cerevisiae
MAFQDPTYDQNKSRHINNSHLQGPNQETIEMKSKHVSFKPSRDFHTNDYSNNYIHGKSLPQQHVTNIENRVDGYPKLQKLFQAKAKQINQFATTPFGCKIGIDSIVPTLNHWIQNENLTFDVVMIGCLTENQFIYPILTQLPLDRLISKPGFLFIWANSQKINELTKLLNNEIWAKKFRRSEELVFVPIDKKSPFYPGLDQDDETLMEKMQWHCWMCITGTVRRSTDGHLIHCNVDTDLSIETKDTTNGAVPSHLYRIAENFSTATRRLHIIPARTGYETPVKVRPGWVIVSPDVMLDNFSPKRYKEEIANLGSNIPLKNEIELLRPRSPVQKAQ

SEQ ID NO: 1510 - protein, 500 aa, Saccharomyces cerevisiae
MSFDDLHKATERAVIQAVDQICDDFEVTPEKLDELTAYFIEQMEKGLAPPKEGHTLASDKGLPMIPAFVTGSPNGTERGVLLAADLGGTNFRICSVNLHGDHTFSMEQMKSKIPDDLLDDENVTSDDLFGFLARRTLAFMKKYHPDELAKGKDAKPMKLGFTFSYPVDQTSLNSGTLIRWTKGFRIADTVGKDVVQLYQEQLSAQGMPMIKVVALTNDTVGTYLSHCYTSDNTDSMTSGEISEPVIGCIFGTGTNGCYMEEINKITKLPQELRDKLIKEGKTHMIINVEWGSFDNELKHLPTTKYDVVIDQKLSTNPGFHLFEKRVSGMFLGEVLRNILVDLHSQGLLLQQYRSKEQLPRHLTTPFQLSSEVLSHIEIDDSTGLRETELSLLQSLRLPTTPTERVQIQKLVRAISRRSAYLAAVPLAAILIKTNALNKRYHGEVEIGCDGSVVEYYPGFRSMLRHALALSPLGAEGERKVHLKIAKDGSGVGAALCALVA

SEQ ID NO: 1511 - protein, 799 aa, Saccharomyces cerevisiae
MVLPILPLIDDLASWNSKKEYVSLVGQVLLDGSSLSNEEILQFSKEEEVPLVALSLPSGKFSDDEIIAFLNNGVSSLFIASQDAKTAEHLVEQLNVPKERVVVEENGVFSNQFMVKQKFSQDKIVSIKKLSKDMLTKEVLGEVRTDRPDGLYTTLVVDQYERCLGLVYSSKKSIAKAIDLGRGVYYSRSRNEIWIKGETSGNGQKLLQISTDCDSDALKFIVEQENVGFCHLETMSCFGEFKHGLVGLESLLKQRLQDAPEESYTRRLFNDSALLDAKIKEEAEELTEAKGKKELSWEAADLFYFALAKLVANDVSLKDVENNLNMKHLKVTRRKGDAKPKFVGQPKAEEEKLTGPIHLDVVKASDKVGVQKALRRPIQKTSEIMHLVNPIIENVRDKGNSALLEYTEKFDGVKLSNPVLNAPFPEEYFEGLTEEMKEALDLSIENVRKFHAAQLPTETLEVETQPGVLCSRFPRPIEKVGLYIPGGTAILPSTALMLGVPAQVAQCKEIVFASPPRKSDGKVSPEVVYVAEKVGASKIVLAGGAQAVAAMAYGTETIPKVDKILGPGNQFVTAAKMYVQNDTQALCSIDMPAGPSEVLVIADEDADVDFVASDLLSQAEHGIDSQVILVGVNLSEKKIQEIQDAVHNQALQLPRVDIVRKCIAHSTIVLCDGYEEALEMSNQYAPEHLILQIANANDYVKLVDNAGSVFVGAYTPESCGDYSSGTNHTLPTYGYARQYSGANTATFQKFITAQNITPEGLENIGRAVMCVAKKEGLDGHRNAVKIRMSKLGLIPKDFQ

SEQ ID NO: 1512 - protein, 440 aa, Saccharomyces cerevisiae
MDRYQRKIGCFIQIPNLGRGQLKYVGPVDTKAGMFAGVDLLANIGKNDGSFMGKKYFQTEYPQSGLFIQLQKVASLIEKASISQTSRRTTMEPLSIPKNRSIVRLTNQFSPMDDPKSPTPMRSFRITSRHSGNQQSMDQEASDHHQQQEFGYDNREDRMEVDSILSSDRKANHNTTSDWKPDNGHMNDLNSSEVTIELREAQLTIEKLQRKQLHYKRLLDDQRMVLEEVQPTFDRYEATIQEREKEIDHLKQQLELERRQQAKQKQFFDAENEQLLAVVSQLHEEIKENEERNLSHNQPTGANEDVELLKKQLEQLRNIEDQFELHKTKWAKEREQLKMHNDSLSKEYQNLSKELFLTKPQDSSSEEVASLTKKLEEANEKIKQLEQAQAQTAVESLPIFDPPAPVDTTAGRQQWCEHCDTMGHNTAECPHHNPDNQQFF

SEQ ID NO: 1513 - protein, 633 aa, Saccharomyces cerevisiae
MSSSKSLYELKDLKNSSTEIHATGQDNEIEYFETGSNDRPSSQPHLGYEQHNTSAVRRFFDSFKRADQGPQDEVEATQMNDLTSAISPSSRQAQELEKNESSDNIGANTGHKSDSLKKTIQPRHVLMIALGTGIGTGLLVGNGTALVHAGPAGLLIGYAIMGSILYCIIQACGEMALVYSNLTGGYNAYPVSLWMMVFGFAVAWVYCLQWLCVCPLELVTASMTIKYWTTSVNPDVFVIIFYVLVITINIFGARGYAEAEFFFNCCKILMMTGFFILGIIIDVGGAGNDGFIGGKYWHDPGAFNGKHAIDRFKGVVATLVTAAFAFGGSEFIAITTAEQSNPRKAIPGAAKQMIYRILFLFLATIILLGFLVPYNSDQLLGSTGGGTKASPYVIAVASHGVRVVPHFINAVILLSVLSMANSSFYSSARLFLTLSEQGYAPKVFSYIDRAGRPLIAMGVSALFAVIAFCAASPKEEQVFTWLLAISGLSQLFTWTAICLSHLRFRRAMKVQGRSLGELGFKSQTGVWGSAYACIMMILILIAQFWVAIAPIGEGKLDAQAFFENYLAMPILIALYVGYKVWHKDWKLFIRADKIDLDSHRQIFDEELIKQEDEEYRERLRNGPYWKRVVAFWC

SEQ ID NO: 1514 - protein, 816 aa, Saccharomyces cerevisiae
MTVANTETHSAAKPSSTIGPWKLGETLGFGSTGKVQLAQHERTGHRTAVKVISKSIFNNNGNHSNDDSVLPYNIEREIVIMKLLSHPNVLSLYDVWETNNNLYLILEYAEKGELFNLLVDHGPLPEREAINCFRQIIIGISYCHALGIVHRDLKPENLLLDSFYNIKIADFGMAALQTDADLLETSCGSPHYAAPEIVSGLPYEGFASDVWSCGVILFALLTGRLPFDEENGNVRDLLLKVQKGQFEMPNDTEISRDAQDLIGKILVVDPRQRIKIRDILSHPLLKKYQTIKDSKSIKDLPRENTYLYPLADSNNHTSASIDDSILQNLVVLWHGRHADDIVSKLKENGTNKEKILYALLYRFKLDSVRGSNKKNRNKIKKTKKNKRSSTLSSSSSLLLNNRSIQSTPRRRTSKRHSREFSSSRKRSSFLLSSNPTDSSPIPLRSSKRITHINVASANTQATPSGVPNPHKRNSKKRSSKRLSYMPNTKRSSLTSKSLSNFTNLIDDDDWEYIEKDAKRTSSNFATLIDEIFEPEKFELAKREKAELQRKVQEAKRQSVNAQKINEDEFGSEVSDGMKELKKINDKVSSPLINYEFSQQELLQDIDTLLTNRYQLSSYTRPISRLDPGLTPVTETLPNNLKEKTALLQDTEKKIIETIRRSKFLGSLLNVRGGLSPGKSELAPIEESPIVSTTPLIYNDRMEPRRISDVEVPHFTRKSKHFTTANNRRSVLSLYAKDSIKDLNEFLIKEDPDLPPQGSTDNESRSEDPEIAESITDSRNIQYDEDDSKDGDNVNNDNILSDFPSRRWHITGIRHEG

SEQ ID NO: 1515 - protein, 364 aa, Saccharomyces cerevisiae
MSAPKKIVVLPGDHVGQEITAEAIKVLKAISDVRSNVKFDFENHLIGGAAIDATGVPLPDEALEASKKVDAVLLGAVGGPKWGTGSVRPEQGLLKIRKELQLYANLRPCNFASDSLLDLSPIKPQFAKGTDFVVVRELVGGIYFGKRKEDDGDGVAWDSEQYTVPEVQRITRMAAFMALQHEPPLPIWSLDKANVLASSRLWRKTVEETIKNEFPTLKVQHQLIDSAAMILVKNPTHLNGIIITSNMFGDIISDEASVIPGSLGLLPSASLASLPDKNTAFGLYEPCHGSAPDLPKNKVNPIATILSAAMMLKLSLNLPEEGKAIEDAVKKVLDAGIRTGDLGGSNSTTEVGDAVAEEVKKILA

SEQ ID NO: 1516 - protein, 994 aa, Saccharomyces cerevisiae
MEKDLSSLYSEKKDKENDETLFNIKLSKSVVETTPLNGHSLFDDDKSLSDWTDNVFTQSVFYHGSDDLIWGKFFVCVYKSPNSNKLNAIIFDKLGTSCFESVDISSNSQYYPAIENLSPSDQESNVKKCIAVILLQRYPLLSPSDLSQILSNKSENCDYDPPYAGDLASSCQLITAVPPEDLGKRFFTSGLLQNRFVSSTLLDVIYENNESTIELNNRLVFHLGEQLEQLFNPVTEYSPEQTEYGYKAPEDELPTESDDDLVKAICNELLQLQTNFTFNLVEFLPKFLIALRVRVLNEEINGLSTTKLNRLFPPTIDEVTRINCIFLDSLKTAIPYGSLEVLKACSITIPYFYKAYTRHEAATKNFSKDIKLFIRHFSNVIPEREVYTEMKIESIIKGPQEKLLKLNLIIERLWKSKKWRPKNQEMAKKCYNNIIDVIDSFGKLDSPLHSYSTRVFTPSGKILTELAKCWPVELQYKWLKRRVVGVYDVVDLNDENKRNLLVIFSDYVVFINILEAESYYTSDGSNRPLISDILMNSLINEVPLPSKIPKLKVERHCYIDEVLVSILDKSTLRFDRLKGKDSFSMVCKLSSAFISSSSVADLITKARILEKDTAFHLFKASRSHFTLYSTAHELCAYDSEKIKSKFALFLNIPPSKEILEVNNLHLAFFARFCSNDGRDNIVILDVLTKHDDKHIEVTSDNIVFTIINQLAIEIPICFSSLNSSMAKDLLCVNENLIKNLEHQLEEVKHPSTDEHRAVNSKLSGASDFDATHEKKRSYGTITTFRSYTSDLKDSPSGDNSNVTKETKEILPVKPTKKSSKKPREIQKKTKTNASKAEHIEKKKPNKGKGFFGVLKNVFGSKSKSKPSPVQRVPKKISQRHPKSPVKKPMTSEKKSSPKRAVVSSPKIKKKSTSFSTKESQTAKSSLRAVEFKSDDLIGKPPDVGNGAHPQENTRISSVVRDTKYVSYNPSQPVTENTSNEKKCRTKSGSIHKAG

SEQ ID NO: 1517 - protein, 322 aa, Saccharomyces cerevisiae
MDPLSSVQPASYVGFDTITNQIEHRLLKKGFQFNIMVVGQSGLGKSTLINTLFASHLIDSATGDDISALPVTKTTEMKISTHTLVEDRVRLNINVIDTPGFGDFIDNSKAWEPIVKYIKEQHSQYLRKELTAQRERFITDTRVHAILYFLQPNGKELSRLDVEALKRLTEIANVIPVIGKSDTLTLDERTEFRELIQNEFEKYNFKIYPYDSEELTDEELELNRSVRSIIPFAVVGSENEIEINGETFRGRKTRWSAINVEDINQCDFVYLREFLIRTHLQDLIETTSYIHYEGFRARQLIALKENANSRSSAHMSSNAIQR

SEQ ID NO: 1518 - protein, 460 aa, Saccharomyces cerevisiae
MTVPYLNSNRNVASYLQSNSSQEKTLKERFSEIYPIHAQDVRQFVKEHGKTKISDVLLEQVYGGMRGIPGSVWEGSVLDPEDGIRFRGRTIADIQKDLPKAKGSSQPLPEALFWLLLTGEVPTQAQVENLSADLMSRSELPSHVVQLLDNLPKDLHPMAQFSIAVTALESESKFAKAYAQGISKQDYWSYTFEDSLDLLGKLPVIAAKIYRNVFKDGKMGEVDPNADYAKNLVNLIGSKDEDFVDLMRLYLTIHSDHEGGNVSAHTSHLVGSALSSPYLSLASGLNGLAGPLHGRANQEVLEWLFALKEEVNDDYSKDTIEKYLWDTLNSGRVIPGYGHAVLRKTDPRYMAQRKFAMDHFPDYELFKLVSSIYEVAPGVLTEHGKTKNPWPNVDAHSGVLLQYYGLKESSFYTVLFGVSRAFGILAQLITDRAIGASIERPKSYSTEKYKELVKNIESKL

SEQ ID NO: 1519 - protein, 265 aa, Saccharomyces cerevisiae
MSWEGFKKAINRAGHSVIIKNVDKTIDKEYDMEERRYKVLQRAGEALQKEAKGFLDSLRAVTASQTTIAEVISNLYDDSKYVAGGGYNVGNYYLQCVQDFDSETVKQLDGPLRETVLDPITKFSTYFKEIEEAIKKRDHKKQDFDAAKAKVRRLVDKPAKDASKLPRAEKELSLAKDIFENLNNQLKTELPQLVSLRVPYFDPSFEALIKIQLRFCTDGYTRLAQIQQYLDQQSRDDYANGLLDTKIEELLGQMTSLDICALGIK

SEQ ID NO: 1520 - protein, 1049 aa, Saccharomyces cerevisiae
MGSHRRYLYYSILSFLLLSCSVVLAKQDETPFFEGTSSKNSRLTAQDKGNDTCPPCFNCMLPIFECKQFSECNSYTGRCECIEGFAGDDCSLPLCGGLSPDESGNKDRPIRAQNDTCHCDNGWGGINCDVCQEDFVCDAFMPDPSIKGTCYKNGMIVDKVFSGCNVTNEKILQILNGKIPQITFACDKPNQECNFQFWIDQLESFYCGLSDCAFEYDLEQNTSHYKCNDVQCKCVPDTVLCGAKGSIDISDFLTETIKGPGDFSCDLETRQCKFSEPSMNDLILTVFGDPYITLKCESGECVHYSEIPGYKSPSKDPTVSWQGKLVLALTAVMVLALFTFATFYISKSPLFRNGLGSSKSPIRLPDEDAVNNFLQNEDDTLATLSFENITYSVPSINSDGVEETVLNEISGIVKPGQILAIMGGSGAGKTTLLDILAMKRKTGHVSGSIKVNGISMDRKSFSKIIGFVDQDDFLLPTLTVFETVLNSALLRLPKALSFEAKKARVYKVLEELRIIDIKDRIIGNEFDRGISGGEKRRVSIACELVTSPLVLFLDEPTSGLDASNANNVIECLVRLSSDYNRTLVLSIHQPRSNIFYLFDKLVLLSKGEMVYSGNAKKVSEFLRNEGYICPDNYNIADYLIDITFEAGPQGKRRRIRNISDLEAGTDTNDIDNTIHQTTFTSSDGTTQREWAHLAAHRDEIRSLLRDEEDVEGTDGRRGATEIDLNTKLLHDKYKDSVYYAELSQEIEEVLSEGDEESNVLNGDLPTGQQSAGFLQQLSILNSRSFKNMYRNPKLLLGNYLLTILLSLFLGTLYYNVSNDISGFQNRMGLFFFILTYFGFVTFTGLSSFALERIIFIKERSNNYYSPLAYYISKIMSEVVPLRVVPPILLSLIVYPMTGLNMKDNAFFKCIGILILFNLGISLEILTIGIIFEDLNNSIILSVLVLLGSLLFSGLFINTKNITNVAFKYLKNFSVFYYAYESLLINEVKTLMLKERKYGLNIEVPGATILSTFGFVVQNLVFDIKILALFNVVFLIMGYLALKWIVVEQK

SEQ ID NO: 1521 - protein, 416 aa, Saccharomyces cerevisiae
MSLSSKLSVQDLDLKDKRVFIRVDFNVPLDGKKITSNQRIVAALPTIKYVLEHHPRYVVLASHLGRPNGERNEKYSLAPVAKELQSLLGKDVTFLNDCVRPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKK

SEQ ID NO: 1522 - protein, 332 aa, Saccharomyces cerevisiae
MNDTLSSFLNRNEALGLNPPHGLDMHITKRGSDWLWAVFAVFGFILLCYVVMFFIAENKGSRLTRYALAPAFLITFFEFFAFFTYASDLGWTGVQAEFNHVKVSKSITGEVPGIRQIFYSKYIAWFLSWPCLLFLIELAASTTGENDDISALDMVHSLLIQIVGTLFWVVSLLVGSLIKSTYKWGYYTIGAVAMLVTQGVICQRQFFNLKTRGFNALMLCTCMVIVWLYFICWGLSDGGNRIQPDGEAIFYGVLDLCVFAIYPCYLLIAVSRDGKLPRLSLTGGFSHHHATDDVEDAAPETKEAVPESPRASGETAIHEPEPEAEQAVEDTA

SEQ ID NO: 1523 - protein, 209 aa, Saccharomyces cerevisiae
MEYATMSSSNSTHNFQRKIALIGARNVGKTTLTVRFVESRFVESYYPTIENEFTRIIPYKSHDCTLEILDTAGQDEVSLLNIKSLTGVRGIMLCYSIINRASFDLIPILWDKLVDQLGKDNLPVILVGTKADLGRSTKGVKRCVTKAEGEKLASTIGSQDKRNQAAFIECSAELDYNVEETFMLLLKQMERVEGTLGLDAENNNKCSIM

SEQ ID NO: 1524 - protein, 512 aa, Saccharomyces cerevisiae
MMKESKSITQHEVERESVSSKRAIKKRLLLFKIDLFVLSFVCLQYWINYVDRVGFTNAYISGMKEDLKMVGNDLTVSNTVFMIGYIVGMVPNNLMLLCVPPRIWLSFCTFAWGLLTLGMYKVTSFKHICAIRFFQALFESCTFSGTHFVLGSWYKEDELPIRSAIFTGSGLVGSMFSGFMQTSIFTHLNGRNGLAGWRWLFIIDFCITLPIAIYGFIFFPGLPDQTSAVSKFSMTRYIFNEQELHYARRRLPARDESTRLDWSTIPRVLKRWHWWMFSLVWVLGGENLGFASNSTFALWLQNQKYTLAQRNNYPSGIFAVGIVSTLCSAVYMSKIPRARHWHVSVFISLVMVIVAVLIRADPLNPKVVFSAQYLGGVAYAGQAVFFSWANIICHADLQERAIVLASMNMFSGAVNAWWSILFFASDMVPKFERGCYALLATAISSGIVSVVIRSLQIKENLSKKQVPYIDANDMPGEDDDDDNQDNENDGDDESMEVELHNEEMAEISNPFR

SEQ ID NO: 1525 - protein, 347 aa, Saccharomyces cerevisiae
MNSLVTQYAAPLFERYPQLHDYLPTLERPFFNISLWEHFDDVVTRVTNGRFVPSEFQFIAGELPLSTLPPVLYAITAYYVIIFGGRFLLSKSKPFKLNGLFQLHNLVLTSLSLTLLLLMVEQLVPIIVQHGLYFAICNIGAWTQPLVTLYYMNYIVKFIEFIDTFFLVLKHKKLTFLHTYHHGATALLCYTQLMGTTSISWVPISLNLGVHVVMYWYYFLAARGIRVWWKEWVTRFQIIQFVLDIGFIYFAVYQKAVHLYFPILPHCGDCVGSTTATFAGCAIISSYLVLFISFYINVYKRKGTKTSRVVKRAHGGVAAKVNEYVNVDLKNVPTPSPSPKPQHRRKR

SEQ ID NO: 1526 - protein, 333 aa, Saccharomyces cerevisiae
MGITVIGSLNYDLDTFTDRLPNAGETFRANHFETHAGGKGLNQAAAIGKLKNPSSRYSVRMIGNVGNDTFGKQLKDTLSDCGVDITHVGTYEGINTGTATILIEEKAGGQNRILIVEGANSKTIYDPKQLCEIFPEGKEEEEYVVFQHEIPDPLSIIKWIHANRPNFQIVYNPSPFKTMPKKDWELVDLLVVNEIEGLQIVESVFDNELVEEIREKIKDDFLGEYRKICELLYEKLMNRKKRGIVVMTLGSRGVLFCSHESPEVQFLPAIQNVSVVDTTGAGDTFLGGLVTQLYQGETLSMAIKFSTLASSLTIQRKGAAESMPLYKDVQKDA

SEQ ID NO: 1527 - protein, 538 aa, Saccharomyces cerevisiae
MRTAVPQLLEATACVSRECPLVKRSQDIKRARKRLLSDWYRLGADANMDAVLLVVNSAWRFLAVWRPFVNSIQHATQELYQNIAHYLLHGNVNIQRVTALIQLVMGQDDLLFSMDDVLQEVFRIQLYLNKMLPHNSHKWQKPSPFDSANLLLNFRDWTTDNALLQELLLSYPTINKNKHKNHSVPRLIQIWVESYWQDSETTLKDILNFWYSHLAEYYEYQELFADIVQLFINKKRTRQLKIHYIGLTDKEIEENKPPLDYENLFLQYEIDKTNANDELCGATDLSDLLFQWKQGEPLEVEAFALNVSPWSLAKTLTLLESSLYLDIETIEFTRHFKHNDTTIDSVFTLSNQLSSYVLETTLQQTHTISYWLQVALACLYLRNLNSLASIITSLQNHSIERLSLPIDVKSDHLFQRLKVVVHPNNNYNVYRRTIKHIFHSQLPCVPFTSLLIRDITFIRDGNDTFTKDGNNVNMQKFNQITKIVAFAQYLQQKQYEDIHCSNTTARSLLGAMIKVHTLYNDNKDRAYQVSIAKVPRLT

SEQ ID NO: 1528 - protein, 1407 aa, Saccharomyces cerevisiae
MMSFSKNATPRAIVSESSTLHEMKFRNFRVAHEKISLDIDLATHCITGSATIIIIPLIQNLEYVTFDCKEMTIKDVLVENRRCDQFIHDDPLQTNLNGLTSQNVLYSDNSIEQSHFLRSKFASLNEYPETDSKSQLTIKIPSSIKISLEDANALSNYTPITPSIKTTPGFQESVFTPITLQIEYEIRNPKSGIKFDTVYADKPWLWNVYTSNGEICSSASYWVPCVDLLDEKSTWELEFSVPRLVKNIGTSKLIGQNGEESEKEKEDTPEHDEEEEGKPARVIKDEDKDSNLKNDEEGKNSKSKDAQDNDEEEEEGESDEEEEEGEEERRNIEESNNPSLRDVIVCCSEYSNIKELPHPIDLTKKKCIFQIINPVAPHHIGWAIGAFNSWSLPLISPPSVDAEDEVEEDKLRENVVDNVNDTMDDDIGSDIIPIQIFTLPTQETDELTVINSTVVCQKIIDFYSKEFGSYPFTCYSMVFLPTAPSKHMDFAALGICNTRLLYPLEVIDKAFSTTNELAWALANQWSCVNITPLDMNDYWCCLGIAGYMVFQVTKKLMGNNTYKYQLKRNSEAIVEQDFEKPPIGSTFTGSSRPISWSSKDLSFIQLKAPMILHILDRRMTKTERSFGMSRVLPKIFLQAMSGDLPNNSLTSSHFQHVCERVNKSKLENFFNEWVYGSGVPILRVTQRFNRKRMVIELGIRQVQDEELGHEKVVGEEGFFKSALDHLEHPDLNRTECFTGSMTIRIHEHDGTPYEHIVEIKDTFTKIDIQYNTKYRRLRKRGGGANDENGVENNNEEKPIVVDVNCLGNVYMSPEECSRFSLTEFNRTSESNELLKQNEAFEWIRIDSDLEWICQMHINQPDYMFSSQLRQDGDIEAQLEAIRYYEDVVVNGGVKSLVYSSILFRTAIDERYFFGIRLAACEALSKYVYDPDFTGGVKHLIQIFQILFCLEDSNIPKSNNFENPKLYFLQCNIPKYLAKVKNENGKCPKLVKQFLLDILVYNENGENKYSDDAYVRSLIENVVKVALNEYKDKAYMEKVKTQLLRYENLVNWLSSYESLIKTTIMYAKYKLHKVGAYDFTELTGMIMHTLTLGINNGDISRESFQNEFLMVLKIMLLEGGLKNKDALVLFTEILCFHEDSYIRDKSVDVLSECVNLVVMDGSLDTISDDIKSSVQSVHNEVKNIKSEDDIELFLSGHYVDDMKIKIEKIGRQNISGLIQICRDMFKGYSPLKILLWDVLNLPVLSLYQRKQIHDLVRVMYTLINSFVVRLETPRERRLVAKMNSNEEGKLDIVIKRESILKVHIKKEVTSTVEAPKKANKIKISLKGDKPVRKVEKQIVKPKVTSKQRKVKSHVNRMGSLPLRFVKIQQQPRVMVHLSSVPYSQFVQITKVTSRSFMVKIRTKNDAKN

SEQ ID NO: 1529 - protein, 610 aa, Saccharomyces cerevisiae
MTETKDLLQDEEFLKIRRLNSAEANKRHSVTYDNVILPQESMEVSPRSSTTSLVEPVESTEGVESTEAERVAGKQEQEEEYPVDAHMQKYLSHLKSKSRSRFHRKDASKYVSFFGDVSFDPRPTLLDSAINVPFQTTFKGPVLEKQLKNLQLTKTKTKATVKTTVKTTEKTDKADAPPGEKLESNFSGIYVFAWMFLGWIAIRCCTDYYASYGSAWNKLEIVQYMTTDLFTIAMLDLAMFLCTFFVVFVHWLVKKRIINWKWTGFVAVSIFELAFIPVTFPIYVYYFDFNWVTRIFLFLHSVVFVMKSHSFAFYNGYLWDIKQELEYSSKQLQKYKESLSPETREILQKSCDFCLFELNYQTKDNDFPNNISCSNFFMFCLFPVLVYQINYPRTSRIRWRYVLEKVCAIIGTIFLMMVTAQFFMHPVAMRCIQFHNTPTFGGWIPATQEWFHLLFDMIPGFTVLYMLTFYMIWDALLNCVAELTRFADRYFYGDWWNCVSFEEFSRIWNVPVHKFLLRHVYHSSMGALHLSKSQATLFTFFLSAVFHEMAMFAIFRRVRGYLFMFQLSQFVWTALSNTKFLRARPQLSNVVFSFGVCSGPSIIMTLYLTL

SEQ ID NO: 1530 - protein, 439 aa, Saccharomyces cerevisiae
MVRRFRGKELAATTFNGHRDYVMGAFFSHDQEKIYTVSKDGAVFVWEFTKRPSDDDDNESEDDDKQEEVDISKYSWRITKKHFFYANQAKVKCVTFHPATRLLAVGFTSGEFRLYDLPDFTLIQQLSMGQNPVNTVSVNQTGEWLAFGSSKLGQLLVYEWQSESYILKQQGHFDSTNSLAYSPDGSRVVTASEDGKIKVWDITSGFCLATFEEHTSSVTAVQFAKRGQVMFSSSLDGTVRAWDLIRYRNFRTFTGTERIQFNCLAVDPSGEVVCAGSLDNFDIHVWSVQTGQLLDALSGHEGPVSCLSFSQENSVLASASWDKTIRIWSIFGRSQQVEPIEVYSDVLALSMRPDGKEVAVSTLKGQISIFNIEDAKQVGNIDCRKDIISGRFNQDRFTAKILNDPNFLLQYITVLMVWLLWLVVIITPFVYMMFQMKSC

SEQ ID NO: 1531 - protein, 515 aa, Saccharomyces cerevisiae
MSTLIPPPSKKQKKEAQLPREVAIIPKDLPNVSIKFQALDTGDNVGGALRVPGAISEKQLEELLNQLNGTSDDPVPYTFSCTIQGKKASDPVKTIDITDNLYSSLIKPGYNSTEDQITLLYTPRAVFKVKPVTRSSSAIAGHGSTILCSAFAPHTSSRMVTGAGDNTARIWDCDTQTPMHTLKGHYNWVLCVSWSPDGEVIATGSMDNTIRLWDPKSGQCLGDALRGHSKWITSLSWEPIHLVKPGSKPRLASSSKDGTIKIWDTVSRVCQYTMSGHTNSVSCVKWGGQGLLYSGSHDRTVRVWDINSQGRCINILKSHAHWVNHLSLSTDYALRIGAFDHTGKKPSTPEEAQKKALENYEKICKKNGNSEEMMVTASDDYTMFLWNPLKSTKPIARMTGHQKLVNHVAFSPDGRYIVSASFDNSIKLWDGRDGKFISTFRGHIASVYQVAWSSDCRLLVSCSKDTTLKVWDVRTRKLSVDLPGHKDEVYTVDWSVDGKRVCSGGKDKMVRLWTH

SEQ ID NO: 1532 - protein, 1314 aa, Saccharomyces cerevisiae
MMMDILNTQQQKAAEGGRVLAPHTISSKLVKRLSSHSSHKLSRSDLKALGGSETISDGPSQLTFKDRYVFNESLYLKKLKKTALDDYYTRGIKLTNRYEEDDGDDEIIRLSNGDRIDEDLHSGVKFFSTTPYCRKMRSDSDELAWNEIATERFKWQSMLARVLKGDIVKGEKTRIANQVKKPGLNKELSDEIWLELKAWLNGRTMQEMEQSLTYLRDSSDSVFEEIMKFQIPQGKILSLDALEAILQDLMNRYHSVVSYWPNLKKMYKDKPITNTAEFTARIDVMNSWLNFKTNLTLRRQELDDWINRFSPISSSDNCQEDFDGVPQWNCKMKILAEQLMKEKNIESIFQKKIFYPLSPWMFKLKLHFIVYRETLTKMNIKYPYERLRSLLAFPVYLIKEVILTRLSYARKLKNPTMMMIDQMIDDFNAFIRLSVQLKYTLTKYCSNLPFDVDFDPTFENTVIEAIRYLFFLLNLKLIDSSKQNFKAPDLLLKYWDHLKNTGHYINGAETVIPNEFLKLTLRLVHKLQFYLLKQQNFPPTFANASEAEKWLSSIFENLGAMKRKLNRFSNILVKAFQNSAVYQINHNAQLVKKLKDAHYFLVYSGNTFESSGVYMFAAPELLGCDNDTILRILRNKSIGCDLVPKLDIGNNLNVYDITTKETDLNILVSKGEDSKGIPYYRVVANSSSDLDRHAHQSKKKNFSTDPFDQHLDEKNNEVFELEVALSSLGALVVLYPGEPVVWDGPVYKLPGNNLFASNEMDLGKIGNPNTLILLNQGSNYALTYQIDKFNQTVGDSVSFIEKRCSLNSIESSLQKINKAYYKLTYTVLNNYKGILGSFMKQCPGNELLNSIFMFGRDFGRSFLKYNAFSSKRKYVIIFLMVKLGMNWLKFLVEECDPTDQRTFRWCVLAMDFAMQMTSGYNILALNVKQFQELKERVSVCMSLLISHFDVMGARATEAENGMQQARLNIDTEENIDEEATLEINSRLRLEAIKTLEKTMKRNPRQMGKVLDATDQGNKYLLSLASSLSNVSMRWQKRSFIGGGTFGQVYSAINLENGEILAVKEIKIHDTTTMKKIFPLIKEEMTVLEMLNHPNIVQYYGVEVHRDKVNIFMEYCEGGSLASLLDHGRIEDEMVTQVYTFELLEGLAYLHQSGVVHRDIKPENILLDFNGIIKYVDFGTARTVVGSRTRTVRNAAVQDFGVETKSLNEMMGTPMYMAPETISGSAVKGKLGADDVWALGCVVLEMATGRRPWSNLDNEWAIMYHVAAGRIPQLPNRDEMTAAGRALLGKVFGSRPHYEGYCCGTTDRPLDDTNP

SEQ ID NO: 1533 - protein, 1226 aa, Saccharomyces cerevisiae
MHLLKDWTDTFVYILEKLIFDMTNHYNDSQQLRTWKRQISYFLKLLGNCYSLRLINKEIFHHWLVEFINKMENFEFLPLSLHILMIFWNDICQIDTNAPVAATITSSQKEPFFLVTKITDMLLHKYYIVSSSKSMINDENYIINDIKKNNKIKLNILKILSSLILKIFQEQSLEVFIFPTSNWEIYKPLLFEIVSNADTNQNSDMKKKLELISYRNESLKNNSSIRNVIMSASNANDFQLTIVTCKQFPKLSCIQLNCIDTQFTKLLDDNPTEFDWPTYVDQNPLTMHKIIQLILWSIHPSRQFDHYESNQLVAKLLLLRINSTDEDLHEFQIEDAIWSLVFQLAKNFSAQKRVVSYMMPSLYRLLNILITYGIIKVPTYIRKLISSGLLYLQDSNDKFVHVQLLINLKISPLMKSQYNMVLRNVMEYDVKFYEIFNFDQLVEITEQIKMRILSNDITNLQLSKTPLSIKIMVAEWYLSHLCSGILSSVNRTVLLKIFKIFCIDLEVFHHFFKWIEFIVYHQLLSDIESLEALMDILLCYQKLFSQFINDHILFTKTFIFIYKKVLKEKDVPAYNVTSFMPFWKFFMKNFPFVLKVDNDLRIELQSVYNDEKLKTEKLKNDKSEVLKVYSMINNSNQAVGQTWNFPEVFQVNIRFLLHNSEIIDTNTSKQFQKARNNVMLLIATNLKEYNKFMSIFLKRKDFTNKNLIQLISLKLLTFEVTQNVLGLEYIIRLLPINLENNDGSYGLFLKYHKEQFIKSNFEKILLTCYELEKKYHGNECEINYYEILLKILITYGSSPKLLATSTKIIMLLLNDSVENSSNILEDILYYSTCPSETDLNDIPLGSGQPDNDTVVTNDDKSDDDDHTVDEIDHVEYYVMMDFANLWVFQAFTCFCIKKIMENNEPAMAMEDLKNFIFQIIEITNSNDLCSQIFDQLKDMQTIEMITQIVEKDFCTSCLQNNNQKIDDNYIVVVIEIITSLSMRFQRETSGMIVISMENYHLLIKIIRQLSELNEGNLSKREIQIDAVLKIFSFHQDSIFQRIIADLSADKPTSPFIDSICKLFDKISFNLRLKLFLYEILSSLKSFAIYSSTIDAPAFHTSGKVELPKKLLNLPPFQVSSFVKETKLHSGDYGEEEDADQEESFSLNLGIGIVEIAHENEQKWLIYDKKDHKYVCTFSMEPYHFISNYNTKYTDDMATGSNDTTAFNDSCVNLSLFDARFERKNPH

SEQ ID NO: 1534 - protein, 592 aa, Saccharomyces cerevisiae
MALEPIDYTTHSREIDAEYLKIVRGSDPDTTWLIISPNAKKEYEPESTGSSFHDFLQLFDETKVQYGLARVSPPGSDVEKIIIIGWCPDSAPLKTRASFAANFAAVANNLFKGYHVQVTARDEDDLDENELLMKISNAAGARYSIQTSSKQQGKASTPPVKKSFTPSKSPAPVSKKEPVKTPSPAPAAKISSRVNDNNDDDDWNEPELKERDFDQAPLKPNQSSYKPIGKIDLQKVIAEEKAKEDPRLVQKPTAAGSKIDPSSDIANLKNESKLKRDSEFNSFLGTTKPPSMTESSLKNDDDKVIKGFRNEKSPAQLWAERKAKQNSGNAETKAEAPKPEVPEDEPEGEPDVKDLKSKFEGLAASEKEEEEMENKFAPPPKKSEPTIISPKPFSKPQEPVKAEEAEQPKTDYKKIGNPLPGMHIEADNEEEPEENDDDWDDDEDEAAQPPLPSRNVASGAPVQKEEPEQEEIAPSLPSRNSIPAPKQEEAPEQAPEEEIEEEAEEAAPQLPSRSSAAPPPPPRRATPEKKPKENPWATAEYDYDAAEDNELTFVENDKIINIEFVDDDWWLGELEKDGSKGLFPSNYVSLGN

SEQ ID NO: 1535 - protein, 1609 aa, Saccharomyces cerevisiae
MNSFASLGLIYSVVNLLTRVEAQIVFYQNSSTSLPVPTLVSTSIADFHESSSTGEVQYSSSYSYVQPSIDSFTSSSFLTSFEAPTETSSSYAVSSSLITSDTFSSYSDIFDEETSSLISTSAASSEKASSTLSSTAQPHRTSHSSSSFELPVTAPSSSSLPSSTSLTFTSVNPSQSWTSFNSEKSSALSSTIDFTSSEISGSTSPKSLESFDTTGTITSSYSPSPSSKNSNQTSLLSPLEPLSSSSGDLILSSTIQATTNDQTSKTIPTLVDATSSLPPTLRSSSMAPTSGSDSISHNFTSPPSKTSGNYDVLTSNSIDPSLFTTTSEYSSTQLSSLNRASKSETVNFTASIASTPFGTDSATSLIDPISSVGSTASSFVGISTANFSTQGNSNYVPESTASGSSQYQDWSSSSLPLSQTTWVVINTTNTQGSVTSTTSPAYVSTATKTVDGVITEYVTWCPLTQTKSQAIGVSSSISSVPQASSFSGSSILSSNSSTLAASNNVPESTASGSSQYQDWSSSSLPLSQTTWVVINTTNTQGSVTSTTSPAYVSTATKTVDGVITEYVTWCPLTQTKSQAIGISSSTISATQTSKPSSILTLGISTLQLSDATFKGTETINTHLMTESTSITEPTYFSGTSDSFYLCTSEVNLASSLSSYPNFSSSEGSTATITNSTVTFGSTSKYPSTSVSNPTEASQHVSSSVNSLTDFTSNSTETIAVISNIHKTSSNKDYSLTTTQLKTSGKQTLVLSTVTTTVNGAATEYTTWCPASSIAYTTSISYKTLVLTTEVCSHSECTPTVITSVTATSSTIPLLSTSSSTVLSSTVSEGAKNPAASEVTINTQVSATSEATSTSTQVSATSATATASESSTTSQVSTASETISTLGTQNFTTTGSLLFPALSTEMINTTVVSRKTLIISTEVCSHSKCVPTVITEVVTSKGTPSNGHSSQTLQTEAVEVTLSSHQTVTMSTEVCSNSICTPTVITSVQMRSTPFPYLTSSTSSSSLASTKKSSLEASSEMSTFSVSTQSLPLAFTCSEKRSTTSVSQWSNTVLTNTIMSSSSNVISTNEKPSSTTSPYNFSSGYSLPSSSTPSQYSLSTATTTINGIKTVYTTWCPLAEKSTVAASSQSSRSVDRFVSSSKPSSSLSQTSIQYTLSTATTTISGLKTVYTTWCPLTSKSTLGATTQTSSTAKVRITSASSATSTSISLSTSTESESSSGYLSKGVCSGTECTQDVPTQSSSPASTLAYSPSVSTSSSSSFSTTTASTLTSTHTSVPLLPSSSSISASSPSSTSLLSTSLPSPAFTSSTLPTATAVSSSTFIASSLPLSSKSSLSLSPVSSSILMSQFSSSSSSSSSLASLPSLSISPTVDTVSVLQPTTSIATLTCTDSQCQQEVSTICNGSNCDDVTSTATTPPSTVTDTMTCTGSECQKTTSSSCDGYSCKVSETYKSSATISACSGEGCQASATSELNSQYVTMTSVITPSAITTTSVEVHSTESTISITTVKPVTYTSSDTNGELITITSSSQTVIPSVTTIITRTKVAITSAPKPTTTTYVEQRLSSSGIATSFVAAASSTWITTPIVSTYAGSASKFLCSKFFMIMVMVINFI

SEQ ID NO: 1536 - protein, 1047 aa, Saccharomyces cerevisiae
MVIGNEPKLVLLRAKSSANRFILLNLLTIMAGQPTISRFFKKAVKSELTHKQEQEVAVGNGAGSESICLDTDEEDNLSSVASTTVTNDSFPLKGSVSSKNSKNSEKTSGTSTTFNDIDFAKKLDRIMKRRSDENVEAEDDEEEGEEDFVKKKARKSPTAKLTPLDKQVKDLKMHHRDKVLVIRVGYKYKCFAEDAVTVSRILHIKLVPGKLTIDESNPQDCNHRQFAYCSFPDVRLNVHLERLVHHNLKVAVVEQAETSAIKKHDPGASKSSVFERKISNVFTKATFGVNSTFVLRGKRILGDTNSIWALSRDVHQGKVAKYSLISVNLNNGEVVYDEFEEPNLADEKLQIRIKYLQPIEVLVNTDDLPLHVAKFFKDISCPLIHKQEYDLEDHVVQAIKVMNEKIQLSPSLIRLVSKLYSHMVEYNNEQVMLIPSIYSPFASKIHMLLDPNSLQSLDIFTHDGGKGSLFWLLDHTRTSFGLRMLREWILKPLVDVHQIEERLDAIECITSEINNSIFFESLNQMLNHTPDLLRTLNRIMYGTTSRKEVYFYLKQITSFVDHFKMHQSYLSEHFKSSDGRIGKQSPLLFRLFSELNELLSTTQLPHFLTMINVSAVMEKNSDKQVMDFFNLNNYDCSEGIIKIQRESESVRSQLKEELAEIRKYLKRPYLNFRDEVDYLIEVKNSQIKDLPDDWIKVNNTKMVSRFTTPRTQKLTQKLEYYKDLLIRESELQYKEFLNKITAEYTELRKITLNLAQYDCILSLAATSCNVNYVRPTFVNGQQAIIAKNARNPIIESLDVHYVPNDIMMSPENGKINIITGPNMGGKSSYIRQVALLTIMAQIGSFVPAEEIRLSIFENVLTRIGAHDDIINGDSTFKVEMLDILHILKNCNKRSLLLLDEVGRGTGTHDGIAISYALIKYFSELSDCPLILFTTHFPMLGEIKSPLIRNYHMDYVEEQKTGEDWMSVIFLYKLKKGLTYNSYGMNVAKLARLDKDIINRAFSISEELRKESINEDALKLFSSLKRILKSDNITATDKLAKLLSLDIH

SEQ ID NO: 1537 - protein, 2108 aa, Saccharomyces cerevisiae
MLSATYRDLNTASNLETSKEKQAAQIVIAQISLLFTTLNNDNFESVEREIRHILDRSSVDIYIKVWERLLTLSSRDILQAGKFLLQENLLHRLLLEFAKDLPKKSTDLIELLKERTFNNQEFQKQTGITLSLFIDLFDKSANKDIIESLDRSSQINDFKTIKMNHTNYLRNFFLQTTPETLESNLRDLLHSLEGESLNDLLALLLSEILSPGSQNLQNDPTRSWLTPPMVLDATNRGNVIARSISSLQANQINWNRVFNLMSTKYFLSAPLMPTTASLSCLFAALHDGPVIDEFFSCDWKVIFKLDLAIQLHKWSVQNGCFDLLNAEGTRKVSETIPNTKQSLLYLLSIASLNLELFLQREELSDGPMLAYFQECFFEDFNYAPEYLILALVKEMKRFVLLIENRTVIDEILITLLIQVHNKSPSSFKDVISTITDDSKIVDAAKIIINSDDAPIANFLKSLLDTGRLDTVINKLPFNEAFKILPCARQIGWEGFDTFLKTKVSPSNVDVVLESLEVQTKMTDTNTPFRSLKTFDLFAFHSLIEVLNKCPLDVLQLQRFESLEFSLLIAFPRLINFGFGHDEAILANGDIAGINNDIEKEMQNYLQKMYSGELAIKDVIELLRRLRDSDLPRDQEVFTCITHAVIAESTFFQDYPLDALATTSVLFGSMILFQLLRGFVLDVAFRIIMRFAKEPPESKMFKFAVQAIYAFRIRLAEYPQYCKDLLRDVPALKSQAQVYQSIVEAATLANAPKERSRPVQEMIPLKFFAVDEVSCQINQEGAPKDVVEKVLFVLNNVTLANLNNKVDELKKSLTPNYFSWFSTYLVTQRAKTEPNYHDLYSKVIVAMGSGLLHQFMVNVTLRQLFVLLSTKDEQAIDKKHLKNLASWLGCITLALNKPIKHKNIAFREMLIEAYKENRLEIVVPFVTKILQRASESKIFKPPNPWTVGILKLLIELNEKANWKLSLTFEVEVLLKSFNLTTKSLKPSNFINTPEVIETLSGALGSITLEQQQTEQQRQIILMQQHQQQMLIYQQRQQQQQQRQQQQQHHISANTIADQQAAFGGEGSISHDNPFNNLLGSTIFVTHPDLKRVFQMALAKSVREILLEVVEKSSGIAVVTTTKIILKDFATEVDESKLKTAAIIMVRHLAQSLARATSIEPLKEGIRSTMQSLAPNLMSLSSSPAEELDTAINENIGIALVLIEKASMDKSTQDLADQLMQAIAIRRYHKERRADQPFITQNTNPYSLSLPEPLGLKNTGVTPQQFRVYEEFGKNIPNLDVIPFAGLPAHAPPMTQNVGSTQPQQQQAQMPTQILTSEQIRAQQQQQQLQKSRLNQPSQSAQPPGVNVPNPQGGIAAVQSDLEQNQRVLVHLMDILVSQIKENATKNNLAELGDQNQIKTIIFQILTFIAKSAQKDQLALKVSQAVVNSLFATSESPLCREVLSLLLEKLCSLSLVARKDVVWWLVYALDSRKFNVPVIRSLLEVNLIDATELDNVLVTAMKNKMENSTEFAMKLIQNTVLSDDPILMRMDFIKTLEHLASSEDENVKKFIKEFEDTKIMPVRKGTKTTRTEKLYLVFTEWVKLLQRVENNDVITTVFIKQLVEKGVISDTDNLLTFVKSSLELSVSSFKESDPTDEVFIAIDALGSLIIKLLILQGFKDDTRRDYINAIFSVIVLVFAKDHSQEGTTFNERPYFRLFSNILYEWATIRTHNFVRISDSSTRQELIEFDSVFYNTFSGYLHALQPFAFPGFSFAWVTLLSHRMLLPIMLRLPNKIGWEKLMLLIIDLFKFLDQYTSKHAVSDAVSVVYKGTLRVILGISNDMPSFLIENHYELMNNLPPTYFQLKNVILSAIPKNMTVPNPYDVDLNMEDIPACKELPEVFFDPVIDLHSLKKPVDNYLRIPSNSLLRTILSAIYKDTYDIKKGVGYDFLSVDSKLIRAIVLHVGIEAGIEYKRTSSNAVFNTKSSYYTLLFNLIQNGSIEMKYQIILSIVEQLRYPNIHTYWFSFVLMNMFKSDEWNDQKLEVQEIILRNFLKRIIVNKPHTWGVSVFFTQLINNNDINLLDLPFVQSVPEIKLILQQLVKYSKKYTTSEQDDQSATINRRQTPLQSNA

SEQ ID NO: 1538 - protein, 518 aa, Saccharomyces cerevisiae
MEDKDITSVNEKEVNENTNPRIIKYDAERRATRTETSKKDKWKNIVTIIASGFALISDGYVNGSMSMLNKVFVMEYGKKNYSSKVSTRVSNAALVGIIFGQFFMGIAADYYSRKSCILVATAILVIGSALCAASHGTTVPGMFWMLTVMRGLVGIGVGAEYPTSTLSANESANEYTTTKRGGILVMVTNLPLAFGGPFATIIFLIVYKICSGTKHLEAIWRTVFAIGCFWPLSVFYFRWKTATTEVYEKGRIKRNIPYFLALKFYWKRLLGTCGTWFMYDFVTFPNGIFSSTIISSVIKDQNDLVKVAEWNLLLGVLAVLGVPIGAYLSDRIGRKYTLMFGFSGYIIFGLIIGCAYDQLKKITPLFIIFYAFMNMLGNAGPGDMLGVISSEASATAVRGVFYGLSAVTGKIGSVVGVECFQPIRDNLGARWTFIIAAICGLIGIIITYFFVPHSLESDLMKQDVEFHNYLVSNGWTGKMGFDETDEESMVRTIEVEENGTNCSKKNAEIISVRQVDQS

SEQ ID NO: 1539 - protein, 361 aa, Saccharomyces cerevisiae
MLYPEKFQGIGISNAKDWKHPKLVSFDPKPFGDHDVDVEIEACGICGSDFHIAVGNWGPVPENQILGHEIIGRVVKVGSKCHTGVKIGDRVGVGAQALACFECERCKSDNEQYCTNDHVLTMWTPYKDGYISQGGFASHVRLHEHFAIQIPENIPSPLAAPLLCGGITVFSPLLRNGCGPGKRVGIVGIGGIGHMGILLAKAMGAEVYAFSRGHSKREDSMKLGADHYIAMLEDKGWTEQYSNALDLLVVCSSSLSKVNFDSIVKIMKIGGSIVSIAAPEVNEKLVLKPLGLMGVSISSSAIGSRKEIEQLLKLVSEKNVKIWVEKLPISEEGVSHAFTRMESGDVKYRFTLVDYDKKFHK

SEQ ID NO: 1540 - protein, 832 aa, Saccharomyces cerevisiae
MDSITVKKPRLRLVCLQCKKIKRKCDKLRPACSRCQQNSLQCEYEERTDLSANVAANDSDGFNSSHKLNFEQQPVLERTGLRYSLQVPEGVVNATLSIWNAEDMLVIVGLVTFLDYPFAAHSLAQHDQYIRALCASLYGMALVDFSNYANGIPCEDTSRSILGPLSFIEKAIFRRIEHSKQFRVQSAALGLLYNAFSMEEENFSTLLPSLIAEVEDVLMQKKDCEILLRCFYQNIYPFYPFMDISLFESDLTSLLLQDDNNRWKISTEVKNVRKKIETLSLLTIVMAMALMHSKLDANLLSMVKENASESARKLSLLCHKLLCLLDVFRYPNENTFTCLLYFYVSEHLDPESPDCVLSPTNLLTLHHLLNLSMTLGLQYEPSKYKRFKDPEVIRQRRILWLGVQSLLFQISLAEGDAGKSNSEYMEAYLTDFEEYIEASSEYEKSSASESNVQMNDIVWNKYKFHVILSKLMSDCTSVIQHPQLFHILGNIKRSEDFMAENFPTSSIYQPLHEKEPNAIKVGKSTVLDVMDIQKTEIFLTNIVGSMCFLNIFDVLSLHFEKKCVMHWEEYEKNYHFLTLKSFNAYLKLAGLISDYLENKFQGNILESRGYIIDKQICFMLVRIWMFQCRILLRFSYKQESQKKLASSSISTNDNEKEDEMIVILERLIKHIRNQMAHLVDLAKGKLQDSYFGAYQTVPMFRYVVYLIDVGGLVSVTNGFWDKISSDGEIPPKVQQAVRLKWGLDCNNSRRIKQKLISSQSLQSFNQVLLCQMEDAVLSSSFAIKANTAMSQNTAEEFFNISEEEALNQLLENNNFDAFWDLLGENLSDMPSL

SEQ ID NO: 1541 - protein, 609 aa, Saccharomyces cerevisiae
MKNLSFLINRRKENTSDSNVYPGKAKSHEPSWIEMDDQTKKDGLDIVHVEFSPDTRAPSDSNKVITEIFDATEDAKEADESERGMPLATALNTYPKAAAWSLLVSTTLIMEGYDTAILGAFYALPIFQRKFGSQNDKTGEWEISASWQIGLTLCYMAGEIVGLQLTGPSVDLVGNRYTLIIALFFLAAFTFILYFCNSLGMIAVGQALCGMPWGCFQCLTVSYASEICPLALRYYLTTYSNLCWLFGQLFAAGIMKNSQKKYADSELGYKLPFALQWILPVPLALGIFFAPESPWWLVKKGRFDEARRSLRRTLSGKGPEKEILVTLEVDKIKVTIDKEKRLTSKEGSYSDCFEDKINRRRTRITCLCWAGQATCGSILIGYSTYFYEKAGVSTEMSFTFSIIQYCLGICATFLSWWASKYFGRYDLYAFGLAFQTIVFFIIGGLGCSSTHGSKMGSGSLLMAVAFFYNLGIAPVVFCLVSEMPSSRLRTKTIILARNTYNVVSIICSVLILYQLNSKKWNWGAKSGFFWGVLCFCTLIWAVVDLPETAGKTFVEINELFKLGVSARKFKSTKVDPFVVKTPLKTSLITTPREISKLPLQRNSNVSHHL

SEQ ID NO: 1542 - protein, 357 aa, Saccharomyces cerevisiae
MSQNSNPAVVLEKVGDIAIEQRPIPTIKDPHYVKLAIKATGICGSDIHYYRSGGIGKYILKAPMVLGHESSGQVVEVGDAVTRVKVGDRVAIEPGVPSRYSDETKEGSYNLCPHMAFAATPPIDGTLVKYYLSPEDFLVKLPEGVSYEEGACVEPLSVGVHSNKLAGVRFGTKVVVFGAGPVGLLTGAVARAFGATDVIFVDVFDNKLQRAKDFGATNTFNSSQFSTDKAQDLADGVQKLLGGNHADVVFECSGADVCIDAAVKTTKVGGTMVQVGMGKNYTNFPIAEVSGKEMKLIGCFRYSFGDYRDAVNLVATGKVNVKPLITHKFKFEDAAKAYDYNIAHGGEVVKTIIFGPE

SEQ ID NO: 1543 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEEIQLLYEEGIKPWKSASWVPPSRRGASSRETEAKKKSWKEVLKFPKSFN

SEQ ID NO: 1544 - protein, 613 aa, Saccharomyces cerevisiae
MAEGVFQGAIGIDLGTTYSCVATYESSVEIIANEQGNRVTPSFVAFTPEERLIGDAAKNQAALNPRNTVFDAKRLIGRRFDDESVQKDMKTWPFKVIDVDGNPVIEVQYLEETKTFSPQEISAMVLTKMKEIAEAKIGKKVEKAVITVPAYFNDAQRQATKDAGAISGLNVLRIINEPTAAAIAYGLGAGKSEKERHVLIFDLGGGTFDVSLLHIAGGVYTVKSTSGNTHLGGQDFDTNLLEHFKAEFKKKTGLDISDDARALRRLRTAAERAKRTLSSVTQTTVEVDSLFDGEDFESSLTRARFEDLNAALFKSTLEPVEQVLKDAKISKSQIDEVVLVGGSTRIPKVQKLLSDFFDGKQLEKSINPDEAVAYGAAVQGAILTGQSTSDETKDLLLLDVAPLSLGVGMQGDMFGIVVPRNTTVPTIKRRTFTTCADNQTTVQFPVYQGERVNCKENTLLGEFDLKNIPMMPAGEPVLEAIFEVDANGILKVTAVEKSTGKSSNITISNAVGRLSSEEIEKMVNQAEEFKAADEAFAKKHEARQRLESYVASIEQTVTDPVLSSKLKRGSKSKIEAALSDALAALQIEDPSADELRKAEVGLKRVVTKAMSSR

SEQ ID NO: 1545 - protein, 352 aa, Saccharomyces cerevisiae
MSDWKVDPDTRRRLLQLQKIGANKKCMDCGAPNPQWATPKFGAFICLECAGIHRGLGVHISFVRSITMDQFKPEELLRMEKGGNEPLTEWFKSHNIDLSLPQKVKYDNPVAEDYKEKLTCLCEDRVFEEREHLDFDASKLSATSQTAASATPGVAQSREGTPLENRRSATPANSSNGANFQKEKNEAYFAELGKKNQSRPDHLPPSQGGKYQGFGSTPAKPPQERSAGSSNTLSLENFQADPLGTLSRGWGLFSSAVTKSFEDVNETVIKPHVQQWQSGELSEETKRAAAQFGQKFQETSSYGFQAFSNFTKNFNGNAEDSSTAGNTTHTEYQKIDNNDKKNEQDEDKWDDF

SEQ ID NO: 1546 - protein, 551 aa, Saccharomyces cerevisiae
MSTASTPPINLFRRKKEHKRGITYTMLLCGPAGTGKTAFANNLLETKIFPHKYQYGKSNASISSNPEVKVIAPTKVVSFNSKNGIPSYVSEFDPMRANLEPGITITSTSLELGGNKDQGKPEMNEDDTVFFNLIMTHGIGENLDDSLCSEEVMSYLEQQFDIVLAEETRIKRNPRFEDTRVHVALYFIEPTGHGLREVDVELMKSISKYTNVLPIITRADSFTKEELTQFRKNIMFDVERYNVPIYKFEVDPEDDDLESMEENQALASLQPFAIITSDTRDSEGRYVREYPWGIISIDDDKISDLKVLKNVLFGSHLQEFKDTTQNLLYENYRSEKLSSVANAEEIGPNSTKRQSNAPSLSNFASLISTGQFNSSQTLANNLRADTPRNQVSGNFKENEYEDNGEHDSAENEQEMSPVRQLGREIKQENENLIRSIKTESSPKFLNSPDLPERTKLRNISETVPYVLRHERILARQQKLEELEAQSAKELQKRIQELERKAHELKLREKLINQNKLNGSSSSINSLQQSTRSQIKKNDTYTDLASIASGRD

SEQ ID NO: 1547 - protein, 1046 aa, Saccharomyces cerevisiae
MNMNESISKDGQGEEEQNNFSFGGKPGSYDSNSDSAQRKKSFSTTKPTEYNLPKEQPESTSKNLETKAKNILLPWRKKHNKDSETPHEDTEADANRRANVTSDVNPVSADTKSSSGPNATITTHGYSYVKTTTPAATSEQSKVKTSPPTSHEHSNIKASPTAHRHSKGDAGHPSIATTHNHSTSKAATSPVTHTHGHSSATTSPVTHTHGHASVKTTSPTNTHEHSKANTGPSATATTHGHINVKTTHPVSHGHSGSSTGPKSTAAAQDHSSTKTNPSVTHGHTSVKDNSSATKGYSNTDSNSDRDVIPGSFRGMTGTDVNPVDPSVYTSTGPKSNVSSGMNAVDPSVYTDTSSKSADRRKYSGNTATGPPQDTIKEIAQNVKMDESEQTGLKNDQVSGSDAIQQQTMEPEPKAAVGTSGFVSQQPSYHDSNKNIQHPEKNKVDNKNISERAAEKFNIERDDILESADDYQQKNIKSKTDSNWGPIEYSSSAGKNKNLQDVVIPSSMKEKFDSGTSGSQNMPKAGTELGHMKYNDNGRDNLQYVAGSQAGSQNTNNNIDMSPRHEAEWSGLSNDATTRNNVVSPAMKDEDMNEDSTKPHQYGLDYLDDVEDYHENDIDDYSNAKKNDLYSKKAYQGKPSDYNYEQREKIPGTFEPDTLSKSVQKQDEDPLSPRQTTNRAGMETARDESLGNYEYSNTSGNKKLSDLSKNKSGPTPTRSNFIDQIEPRRAKTTQDIASDAKDFTNNPETGTTGNVDTTGRMGAKSKTFSSNPFDDSKNTDTHLENANVAAFDNSRSGDTTYSKSGDAETAAYDNIKNADPTYAKSQDITGMTHDQEPSSEQKASYGSGGNSQNQEYSSDDNIDVNKNAKVLEEDAPGYKREVDLKNKRRTDLGGADASNAYAAEVGNFPSLIDPHVPTYGFKDTNTSSSQKPSEGTYPETTSYSIHNETTSQGRKVSVGSMGSGKSKHHHNHHRHSRQNSSKGSDYDYNNSTHSAEHTPRHHQYGSDEGEQDYHDDEQGEEQAGKQSFMGRVRKSISGGTFGFRSEI

SEQ ID NO: 1548 - protein, 327 aa, Saccharomyces cerevisiae
MGPETLHIGGRKSKLAVIQSNHVLKLIEEKYPDYDCKVFTLQTLGDQIQFKPLYSFGGKALWTKELEDHLYHDDPSKKLDLIVHSLKDMPTLLPEGFELGGITKRVDPTDCLVMPFYSAYKSLDDLPDGGIVGTSSVRRSAQLKRKYPHLKFESVRGNIQTRLQKLDDPKSPYQCIILASAGLMRMGLENRITQRFHSDTMYHAVGQGALGIEIRKGDTKMMKILDEICDLNATICCLSERALMRTLEGGCSVPIGVESKYNEETKKLLLKAIVVDVEGTEAVEDEIEMLIENVKEDSMACGKILAERMIADGAKKILDEINLDRIK

SEQ ID NO: 1549 - protein, 300 aa, Saccharomyces cerevisiae
MPHTDKKQSGLARLLGSASAGIMEIAVFHPVDTISKRLMSNHTKITSGQELNRVIFRDHFSEPLGKRLFTLFPGLGYAASYKVLQRVYKYGGQPFANEFLNKHYKKDFDNLFGEKTGKAMRSAAAGSLIGIGEIVLLPLDVLKIKRQTNPESFKGRGFIKILRDEGLFNLYRGWGWTAARNAPGSFALFGGNAFAKEYILGLKDYSQATWSQNFISSIVGACSSLIVSAPLDVIKTRIQNRNFDNPESGLRIVKNTLKNEGVTAFFKGLTPKLLTTGPKLVFSFALAQSLIPRFDNLLSK

SEQ ID NO: 1550 - protein, 181 aa, Saccharomyces cerevisiae
MGLFASKLFSNLFGNKEMRILMVGLDGAGKTTVLYKLKLGEVITTIPTIGFNVETVQYKNISFTVWDVGGQDRIRSLWRHYYRNTEGVIFVVDSNDRSRIGEAREVMQRMLNEDELRNAAWLVFANKQDLPEAMSAAEITEKLGLHSIRNRPWFIQATCATSGEGLYEGLEWLSNSLKNST

SEQ ID NO: 1551 - protein, 377 aa, Saccharomyces cerevisiae
MDMEIDDPMHGSDEDQLSPTLDEDMNSDDGKNNTKARSNDEDTDEELEDFNFKPGSSGIADHKSSKPLKLTNTNINQLDQWIEHLSKCEPLSEDDVARLCKMAVDVLQFEENVKPINVPVTICGDVHGQFHDLLELFKIGGPCPDTNYLFMGDYVDRGYYSVETVSYLVAMKVRYPHRITILRGNHESRQITQVYGFYDECLRKYGSANVWKMFTDLFDYFPVTALVDNKIFCLHGGLSPMIETIDQVRDLNRIQEVPHEGPMCDLLWSDPDDRGGWGISPRGAGFTFGQDISEQFNHTNDLSLIARAHQLVMEGYSWSHQQNVVTIFSAPNYCYRCGNQAAIMEVDENHNRQFLQYDPSVRPGEPTVTRKTPDYFL

SEQ ID NO: 1552 - protein, 1071 aa, Saccharomyces cerevisiae
MAGAIENARKEIKRISLEDHAESEYGAIYSVSGPVVIAENMIGCAMYELVKVGHDNLVGEVIRIDGDKATIQVYEETAGLTVGDPVLRTGKPLSVELGPGLMETIYDGIQRPLKAIKEESQSIYIPRGIDTPALDRTIKWQFTPGKFQVGDHISGGDIYGSVFENSLISSHKILLPPRSRGTITWIAPAGEYTLDEKILEVEFDGKKSDFTLYHTWPVRVPRPVTEKLSADYPLLTGQRVLDALFPCVQGGTTCIPGAFGCGKTVISQSLSKYSNSDAIIYVGCFAKGTNVLMADGSIECIENIEVGNKVMGKDGRPREVIKLPRGRETMYSVVQKSQHRAHKSDSSREVPELLKFTCNATHELVVRTPRSVRRLSRTIKGVEYFEVITFEMGQKKAPDGRIVELVKEVSKSYPISEGPERANELVESYRKASNKAYFEWTIEARDLSLLGSHVRKATYQTYAPILYENDHFFDYMQKSKFHLTIEGPKVLAYLLGLWIGDGLSDRATFSVDSRDTSLMERVTEYAEKLNLCAEYKDRKEPQVAKTVNLYSKVVRGNGIRNNLNTENPLWDAIVGLGFLKDGVKNIPSFLSTDNIGTRETFLAGLIDSDGYVTDEHGIKATIKTIHTSVRDGLVSLARSLGLVVSVNAEPAKVDMNGTKHKISYAIYMSGGDVLLNVLSKCAGSKKFRPAPAAAFARECRGFYFELQELKEDDYYGITLSDDSDHQFLLANQVVVHNCGERGNEMAEVLMEFPELYTEMSGTKEPIMKRTTLVANTSNMPVAAREASIYTGITLAEYFRDQGKNVSMIADSSSRWAEALREISGRLGEMPADQGFPAYLGAKLASFYERAGKAVALGSPDRTGSVSIVAAVSPAGGDFSDPVTTATLGITQVFWGLDKKLAQRKHFPSINTSVSYSKYTNVLNKFYDSNYPEFPVLRDRMKEILSNAEELEQVVQLVGKSALSDSDKITLDVATLIKEDFLQQNGYSTYDAFCPIWKTFDMMRAFISYHDEAQKAVANGANWSKLADSTGDVKHAVSSSKFFEPSRGEKEVHGEFEKLLSTMQERFAESTD

SEQ ID NO: 1553 - protein, 304 aa, Saccharomyces cerevisiae
MISDYDALLQFNKKPVSQEMIQFLATSTASIIKIRENNNPIQGCRPPDLSIFIKNVVIQSNVQTPTLMATSVYLNKLKSVIPKNVYGINTTRHRIFLGCLILAAKTLNDSSPWNKHWTTYTEGLLRIREVNTIERELLEYLNWDVRITTPDLIDSLSYFLGPIKEQLFLQRRQEMLLFNAPSPGQLKEYINHRRPVSHSRTSSAISVPSLTSMATVSTTDSRSSLLAKYQPSLPLVESDNFNKKNHVPLRNNNDICNNFRAEENIHSVNHIDVTMGSSPVMSHKPTIHQRLNFTRRGWSSFFKQ

SEQ ID NO: 1554 - protein, 530 aa, Saccharomyces cerevisiae
MLRNILVRSTGSNFKFAGRYMKSSALLGYYRRVNYYSTKIQTRLTSENYPDVHRDPRFKKLTSDDLNYFKSILSEQEILRASESEDLSFYNEDWMRKYKGQSKLVLRPKSVEKVSLILNYCNDEKIAVVPQGGNTGLVGGSVPIFDELILSLANLNKIRDFDPVSGILKCDAGVILENANNYVMEQNYMFPLDLGAKGSCHVGGVVATNAGGLRLLRYGSLHGSVLGLEVVMPNGQIVNSMHSMRKDNTGYDLKQLFIGSEGTIGIITGVSILTVPKPKAFNVSYLSVESFEDVQKVFVRARQELSEILSAFEFMDAKSQVLAKSQLKDAAFPLEDEHPFYILIETSGSNKDHDDSKLETFLENVMEEGIVTDGVVAQDETELQNLWKWREMIPEASQANGGVYKYDVSLPLKDLYSLVEATNARLSEAELVGDSPKPVVGAIGYGHVGDGNLHLNVAVREYNKNIEKTLEPFVYEFVSSKHGSVSAEHGLGFQKKNYIGYSKSPEEVKMMKDLKVHYDPNGILNPYKYI

SEQ ID NO: 1555 - protein, 587 aa, Saccharomyces cerevisiae
MLWKRTCTRLIKPIAQPRGRLVRRSCYRYASTGTGSTDSSSQWLKYSVIASSATLFGYLFAKNLYSRETKEDLIEKLEMVKKIDPVNSTLKLSSLDSPDYLHDPVKIDKVVEDLKQVLGNKPENYSDAKSDLDAHSDTYFNTHHPSPEQRPRIILFPHTTEEVSKILKICHDNNMPVVPFSGGTSLEGHFLPTRIGDTITVDLSKFMNNVVKFDKLDLDITVQAGLPWEDLNDYLSDHGLMFGCDPGPGAQIGGCIANSCSGTNAYRYGTMKENIINMTIVLPDGTIVKTKKRPRKSSAGYNLNGLFVGSEGTLGIVTEATVKCHVKPKAETVAVVSFDTIKDAAACASNLTQSGIHLNAMELLDENMMKLINASESTDRCDWVEKPTMFFKIGGRSPNIVNALVDEVKAVAQLNHCNSFQFAKDDDEKLELWEARKVALWSVLDADKSKDKSAKIWTTDVAVPVSQFDKVIHETKKDMQASKLINAIVGHAGDGNFHAFIVYRTPEEHETCSQLVDRMVKRALNAEGTCTGEHGVGIGKREYLLEELGEAPVDLMRKIKLAIDPKRIMNPDKIFKTDPNEPANDYR

SEQ ID NO: 1556 - protein, 386 aa, Saccharomyces cerevisiae
MSAATVGKPIKCIAAVAYDAKKPLSVEEITVDAPKAHEVRIKIEYTAVCHTDAYTLSGSDPEGLFPCVLGHEGAGIVESVGDDVITVKPGDHVIALYTAECGKCKFCTSGKTNLCGAVRATQGKGVMPDGTTRFHNAKGEDIYHFMGCSTFSEYTVVADVSVVAIDPKAPLDAACLLGCGVTTGFGAALKTANVQKGDTVAVFGCGTVGLSVIQGAKLRGASKIIAIDINNKKKQYCSQFGATDFVNPKEDLAKDQTIVEKLIEMTDGGLDFTFDCTGNTKIMRDALEACHKGWGQSIIIGVAAAGEEISTRPFQLVTGRVWKGSAFGGIKGRSEMGGLIKDYQKGALKVEEFITHRRPFKEINQAFEDLHNGDCLRTVLKSDEIK

SEQ ID NO: 1557 - protein, 191 aa, Saccharomyces cerevisiae
MEKFGLKALVPLLKLEDKELSSTYDHSMTLGADLSSMLYSLGIPRDSQDHRVLDTFQSPWAETSRSEVEPRFFTPESFTNIPGVLQSTVTPPCFNSIQNDQQRVALFQDETLFFLFYKHPGTVIQELTYLELRKRNWRYHKTLKAWLTKDPMMEPIVSADGLSERGSYVFFDPQRWEKCQRDFLLFYNAIM

SEQ ID NO: 1558 - protein, 755 aa, Saccharomyces cerevisiae
MRRLLTGCLLSSARPLKSRLPLLMSSSLPSSAGKKPKQATLARFFTSMKNKPTEGTPSPKKSSKHMLEDRMDNVSGEEEYATKKLKQTAVTHTVAAPSSMGSNFSSIPSSAPSSGVADSPQQSQRLVGEVEDALSSNNNDHYSSNIPYSEVCEVFNKIEAISSRLEIIRICSDFFIKIMKQSSKNLIPTTYLFINRLGPDYEAGLELGLGENLLMKTISETCGKSMSQIKLKYKDIGDLGEIAMGARNVQPTMFKPKPLTVGEVFKNLRAIAKTQGKDSQLKKMKLIKRMLTACKGIEAKFLIRSLESKLRIGLAEKTVLISLSKALLLHDENREDSPDKDVPMDVLESAQQKIRDAFCQVPNYEIVINSCLEHGIMNLDKYCTLRPGIPLKPMLAKPTKAINEVLDRFQGETFTSEYKYDGERAQVHLLNDGTMRIYSRNGENMTERYPEINITDFIQDLDTTKNLILDCEAVAWDKDQGKILPFQVLSTRKRKDVELNDVKVKVCLFAFDILCYNDERLINKSLKERREYLTKVTKVVPGEFQYATQITTNNLDELQKFLDESVNHSCEGLMVKMLEGPESHYEPSKRSRNWLKLKKDYLEGVGDSLDLCVLGAYYGRGKRTGTYGGFLLGCYNQDTGEFETCCKIGTGFSDEMLQLLHDRLTPTIIDGPKATFVFDSSAEPDVWFEPTTLFEVLTADLSLSPIYKAGSATFDKGVSLRFPRFLRIREDKGVEDATSSDQIVELYENQSHMQN

SEQ ID NO: 1559 - protein, 506 aa, Saccharomyces cerevisiae
MGSINNNFNTNNNSNTDLDRDWKTALNIPKKDTRPQTDDVLNTKGNTFEDFYLKRELLMGIFEAGFEKPSPIQEEAIPVAITGRDILARAKNGTGKTAAFVIPTLEKVKPKLNKIQALIMVPTRELALQTSQVVRTLGKHCGISCMVTTGGTNLRDDILRLNETVHILVGTPGRVLDLASRKVADLSDCSLFIMDEADKMLSRDFKTIIEQILSFLPPTHQSLLFSATFPLTVKEFMVKHLHKPYEINLMEELTLKGITQYYAFVEERQKLHCLNTLFSKLQINQAIIFCNSTNRVELLAKKITDLGYSCYYSHARMKQQERNKVFHEFRQGKVRTLVCSDLLTRGIDIQAVNVVINFDFPKTAETYLHRIGRSGRFGHLGLAINLINWNDRFNLYKIEQELGTEIAAIPATIDKSLYVAENDETVPVPFPIEQQSYHQQAIPQQQLPSQQQFAIPPQQHHPQFMVPPSHQQQQAYPPPQMPSQQGYPPQQEHFMAMPPGQSQPQY

SEQ ID NO: 1560 - protein, 515 aa, Saccharomyces cerevisiae
MFQRKTLQRRNLKGLNLNLHPDVGNNGQLQEKTETHQGQSRIEGHVMSNINAIQNNSNLFLRRGIKKKLTLDAFGDDQAISKPNTVVIQQPQNEPVLVLSSLSQSPCVSSSSSLSTPCIIDAYSNNFGLSPSSTNSTPSTIQGLSNIATPVENEHSISLPPLEESLSPAAADLKDTLSGTSNGNYIQLQDLVQLGKIGAGNSGTVVKALHVPDSKIVAKKTIPVEQNNSTIINQLVRELSIVKNVKPHENIITFYGAYYNQHINNEIIILMEYSDCGSLDKILSVYKRFVQRGTVSSKKTWFNELTISKIAYGVLNGLDHLYRQYKIIHRDIKPSNVLINSKGQIKLCDFGVSKKLINSIADTFVGTSTYMSPERIQGNVYSIKGDVWSLGLMIIELVTGEFPLGGHNDTPDGILDLLQRIVNEPSPRLPKDRIYSKEMTDFVNRCCIKNERERSSIHELLHHDLIMKYVSPSKDDKFRHWCRKIKSKIKEDKRIKREALDRAKLEKKQSERSTH

SEQ ID NO: 1561 - protein, 427 aa, Saccharomyces cerevisiae
MHHNSQSLSSGHIRSPEDENVAPIGNLKHRTGSLSHISSAHPRVALSDVTNIVATNSSNNSISKPKVAPIKERLDSAAIIEEERLDANSVAQRKEADHNDLLTDREQEEPVEDDGESEEDEEEDQEPLLLQHYASDTLVWEHAFRTYYRTTLDPNDDDVYDVVMVAELSNEIFEYMRKLEDLYKPNPYYMDKQPELRWSFRSTLIDWIVQVHEKFQLLPETLYLCINIIDRYLCKEVVPVNKFQLVGAASLFIAAKYEEINCPTIKDFVYMSENCYSRNDLLDAERTILNGLEFELGWPGPMSFLRRISKADDYEHDTRTLAKYLLESTIMDHRLVSAQPSWLAAGAYFLSKIILGQNQWSLAHVYYSNYTQEQILPLATIILENCRYASKRHNAIWRKYSSRRYLHSSQIVAKWIALAEHRVERSN

SEQ ID NO: 1562 - protein, 901 aa, Saccharomyces cerevisiae
MSHEWLISASETMRSIGNGEGLRDKGAVVANNDGEFNEGDTNREEDSSTIFSFDFDEEIVMCIDFSGGKLGCSILDYHTKTLKAFDQDYVVNKTTISSHDLIDDADMSSNDISLLLGLLIMEANPTVCLVPARLEDWIFDYIKTKCDEINCRLELQPIKRFKKWDLLQSLQLRGHDNQTILNDILSNSKFTTTVTLGTVGCILANHEQLGEYNDSTASSNMVTGRLVQNAFEDVIHGIRYIDIRDRMVLDENTISALHIFPTAHKLGHDKMMRNGFFSVFELFNQVSSDYARRILKSWLINPLTNKKRIETRYSIIRTLLDKQNAIIFSDLSQSIKRCPDAFGFINQLRSGKSTLGTWSKVASFLEKGIAIFQLVSSLKLGSDEANILHDIKNKVDISALKECLRKVETVIDFDTSRDTKTLTINTGVDNRLDECRNIYNHLEGILLDVARETQIFLLNTMPQEDCKTTKSLEKLVNAVYIPQLGYLVTISVLMEPLLDGIPNLQWEEIFRSSENIYFKNGRVLELDETYGDIYGAISDFEIEILFSLQEQILRRKTQLTAYNILLSELEILLSFAQVSAERNYAEPQLVEDECILEIINGRHALYETFLDNYIPNSTMIDGGLFSELSWCEQNKGRIIVVTGANASGKSVYLTQNGLIVYLAQIGCFVPAERARIGIADKILTRIRTQETVYKTQSSFLLDSQQMAKSLSLATEKSLILIDEYGKGTDILDGPSLFGSIMLNMSKSEKCPRIIACTHFHELFNENVLTENIKGIKHYCTDILISQKYNLLETAHVGEDHESEGITFLFKVKEGISKQSFGIYCAKVCGLSRDIVERAEELSRMINRGDDVVQQCGNLTEKEMREFQKNQEIVKKFLSWDLDLETTTTSENLRLKLKNFLR

SEQ ID NO: 1563 - protein, 528 aa, Saccharomyces cerevisiae
MSAKVPSNATFKNKEKPQEVRKANIIAARSVADAIRTSLGPKGMDKMIKTSRGEIIISNDGHTILKQMAILHPVARMLVEVSAAQDSEAGDGTTSVVILTGALLGAAERLLNKGIHPTIIADSFQSAAKRSVDILLEMCHKVSLSDREQLVRAASTSLSSKIVSQYSSFLAPLAVDSVLKISDENSKNVDLNDIRLVKKVGGTIDDTEMIDGVVLTQTAIKSAGGPTRKEKAKIGLIQFQISPPKPDTENNIIVNDYRQMDKILKEERAYLLNICKKIKKAKCNVLLIQKSILRDAVNDLALHFLSKLNIMVVKDIEREEIEFLSKGLGCKPIADIELFTEDRLGSADLVEEIDSDGSKIVRVTGIRNNNARPTVSVVIRGANNMIIDETERSLHDALCVIRCLVKERGLIAGGGAPEIEISRRLSKEARSMEGVQAFIWQEFASALEVIPTTLAENAGLNSIKVVTELRSKHENGELNDGISVRRSGTTNTYEEHILQPVLVSTSAITLASECVKSILRIDDIAFSR

SEQ ID NO: 1564 - protein, 1733 aa, Saccharomyces cerevisiae
MVGQQYSSAPLRTVKEVQFGLFSPEEVRAISVAKIRFPETMDETQTRAKIGGLNDPRLGSIDRNLKCQTCQEGMNECPGHFGHIDLAKPVFHVGFIAKIKKVCECVCMHCGKLLLDEHNELMRQALAIKDSKKRFAAIWTLCKTKMVCETDVPSEDDPTQLVSRGGCGNTQPTIRKDGLKLVGSWKKDRATGDADEPELRVLSTEEILNIFKHISVKDFTSLGFNEVFSRPEWMILTCLPVPPPPVRPSISFNESQRGEDDLTFKLADILKANISLETLEHNGAPHHAIEEAESLLQFHVATYMDNDIAGQPQALQKSGRPVKSIRARLKGKEGRIRGNLMGKRVDFSARTVISGDPNLELDQVGVPKSIAKTLTYPEVVTPYNIDRLTQLVRNGPNEHPGAKYVIRDSGDRIDLRYSKRAGDIQLQYGWKVERHIMDNDPVLFNRQPSLHKMSMMAHRVKVIPYSTFRLNLSVTSPYNADFDGDEMNLHVPQSEETRAELSQLCAVPLQIVSPQSNKPCMGIVQDTLCGIRKLTLRDTFIELDQVLNMLYWVPDWDGVIPTPAIIKPKPLWSGKQILSVAIPNGIHLQRFDEGTTLLSPKDNGMLIIDGQIIFGVVEKKTVGSSNGGLIHVVTREKGPQVCAKLFGNIQKVVNFWLLHNGFSTGIGDTIADGPTMREITETIAEAKKKVLDVTKEAQANLLTAKHGMTLRESFEDNVVRFLNEARDKAGRLAEVNLKDLNNVKQMVMAGSKGSFINIAQMSACVGQQSVEGKRIAFGFVDRTLPHFSKDDYSPESKGFVENSYLRGLTPQEFFFHAMGGREGLIDTAVKTAETGYIQRRLVKALEDIMVHYDNTTRNSLGNVIQFIYGEDGMDAAHIEKQSLDTIGGSDAAFEKRYRVDLLNTDHTLDPSLLESGSEILGDLKLQVLLDEEYKQLVKDRKFLREVFVDGEANWPLPVNIRRIIQNAQQTFHIDHTKPSDLTIKDIVLGVKDLQENLLVLRGKNEIIQNAQRDAVTLFCCLLRSRLATRRVLQEYRLTKQAFDWVLSNIEAQFLRSVVHPGEMVGVLAAQSIGEPATQMTLNTFHFAGVASKKVTSGVPRLKEILNVAKNMKTPSLTVYLEPGHAADQEQAKLIRSAIEHTTLKSVTIASEIYYDPDPRSTVIPEDEEIIQLHFSLLDEEAEQSFDQQSPWLLRLELDRAAMNDKDLTMGQVGERIKQTFKNDLFVIWSEDNDEKLIIRCRVVRPKSLDAETEAEEDHMLKKIENTMLENITLRGVENIERVVMMKYDRKVPSPTGEYVKEPEWVLETDGVNLSEVMTVPGIDPTRIYTNSFIDIMEVLGIEAGRAALYKEVYNVIASDGSYVNYRHMALLVDVMTTQGGLTSVTRHGFNRSNTGALMRCSFEETVEILFEAGASAELDDCRGVSENVILGQMAPIGTGAFDVMIDEESLVKYMPEQKITEIEDGQDGGVTPYSNESGLVNADLDVKDELMFSPLVDSGSNDAMAGGFTAYGGADYGEATSPFGAYGEAPTSPGFGVSSPGFSPTSPTYSPTSPAYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPAYSPTSPSYSPTSPSYSPTSPSYSPTSPSYSPTSPNYSPTSPSYSPTSPGYSPGSPAYSPKQDEQKHNENENSR

SEQ ID NO: 1565 - protein, 763 aa, Saccharomyces cerevisiae
MNDSQNCLRQREENSHLNPGNDFGHHQGAECTINHNNMPHRNAYTESTNDTEAKSIVMCDDPNAYQISYTNNEPAGDGAIETTSILLSQPLPLRSNVMSVLVGIFVAVGGFLFGYDTGLINSITDMPYVKTYIAPNHSYFTTSQIAILVSFLSLGTFFGALIAPYISDSYGRKPTIMFSTAVIFSIGNSLQVASGGLVLLIVGRVISGIGIGIISAVVPLYQAEAAQKNLRGAIISSYQWAITIGLLVSSAVSQGTHSKNGPSSYRIPIGLQYVWSSILAVGMIFLPESPRYYVLKDELNKAAKSLSFLRGLPIEDPRLLEELVEIKATYDYEASFGPSTLLDCFKTSENRPKQILRIFTGIAIQAFQQASGINFIFYYGVNFFNNTGVDNSYLVSFISYAVNVAFSIPGMYLVDRIGRRPVLLAGGVIMAIANLVIAIVGVSEGKTVVASKIMIAFICLFIAAFSATWGGVVWVVSAELYPLGVRSKCTAICAAANWLVNFTCALITPYIVDVGSHTSSMGPKIFFIWGGLNVVAVIVVYFAVYETRGLTLEEIDELFRKAPNSVISSKWNKKIRKRCLAFPISQQIEMKTNIKNAGKLDNNNSPIVQDDSHNIIDVDGFLENQIQSNDHMIAADKGSGSLVNIIDTAPLTSTEFKPVEHPPVNYVDLGNGLGLNTYNRGPPSIISDSTDEFYEENDSSYYNNNTERNGANSVNTYMAQLINSSSTTSNDTSFSPSHNSNARTSSNWTSDLASKHSQYTSPQ

SEQ ID NO: 1566 - protein, 181 aa, Saccharomyces cerevisiae
MGLYASKLFSNLFGNKEMRILMVGLDGAGKTTVLYKLKLGEVITTIPTIGFNVETVQYKNISFTVWDVGGQDRIRSLWRHYYRNTEGVIFVIDSNDRSRIGEAREVMQRMLNEDELRNAVWLVFANKQDLPEAMSAAEITEKLGLHSIRNRPWFIQSTCATSGEGLYEGLEWLSNNLKNQS

SEQ ID NO: 1567 - protein, 202 aa, Saccharomyces cerevisiae
MAEESTDFSQFEEERNNDQYKVSAKKTVDEYKNLDAEDESLAKWKESLGLSSDVLPLEFPGDKRKVVVQKIQLLVNTEPNPITFDLTNEKTIKELASKRYKIKENSIYKLKIVFKVQHEIITGLRYVQYIKKAGIAVDKIDDHLGSYAPNTKTKPFYEVELPESEAPSGFLARGNYSAVSKFIDDDKTNHLTLNWGVEIVKK

SEQ ID NO: 1568 - protein, 369 aa, Saccharomyces cerevisiae
MDTDLDVPMQDAVTEQLTPTVSEDMDLNNNSSDNNAEEFSVDDLKPGSSGIADHKSSKPLELNNTNINQLDQWIEHLSKCEPLSEDDVARLCKMAVDVLQFEENVKPINVPVTICGDVHGQFHDLLELFKIGGPCPDTNYLFMGDYVDRGYYSVETVSYLVAMKVRYPHRITILRGNHESRQITQVYGFYDECLRKYGSANVWKMFTDLFDYFPITALVDNKIFCLHGGLSPMIETIDQVRELNRIQEVPHEGPMCDLLWSDPDDRGGWGISPRGAGFTFGQDVSEQFNHTNDLSLIARAHQLVMEGYAWSHQQNVVTIFSAPNYCYRCGNQAAIMEVDENHNRQFLQYDPSVRPGEPSVSRKTPDYFL

SEQ ID NO: 1569 - protein, 815 aa, Saccharomyces cerevisiae
MSETLPRSDDLEATWNFIEPGINQILGNEKNQASTSKRVYKILSPTMYMEVYTAIYNYCVNKSRSSGHFSTDSRTGQSTILVGSEIYEKLKNYLKNYILNFKQSNSETFLQFYVKRWKRFTIGAIFLNHAFDYMNRYWVQKERSDGKRHIFDVNTLCLMTWKEVMFDPSKDVLINELLDQVTLGREGQIIQRSNISTAIKSLVALGIDPQDLKKLNLNVYIQVFEKPFLKKTQEYYTQYTNDYLEKHSVTEYIFEAHEIIKREEKAMTIYWDDHTKKPLSMALNKVLITDHIEKLENEFVVLLDARDIEKITSLYALIRRDFTLIPRMASVFENYVKKTGENEISSLLAMHKHNIMKNENANPKKLALMTAHSLSPKDYIKKLLEVHDIFSKIFNESFPDDIPLAKALDNACGAFININEFALPAGSPKSATSKTSEMLAKYSDILLKKATKPEVASDMSDEDIITIFKYLTDKDAFETHYRRLFAKRLIHGTSTSAEDEENIIQRLQAANSMEYTGKITKMFQDIRLSKILEDDFAVALKNEPDYSKAKYPDLQPFVLAENMWPFSYQEVEFKLPKELVPSHEKLKESYSQKHNGRILKWLWPLCRGELKADIGKPGRMPFNFTVTLFQMAILLLYNDADVLTLENIQEGTSLTIQHIAAAMVPFIKFKLIQQVPPGLDALVKPETQFKLSRPYKALKTNINFASGVKNDILQSLSGGGHDNHGNKLGNKRLTEDERIEKELNTERQIFLEACIVRIMKAKRNLPHTTLVNECIAQSHQRFNAKVSMVKRAIDSLIQKGYLQRGDDGESYAYLA

SEQ ID NO: 1570 - protein, 279 aa, Saccharomyces cerevisiae
MSNYEALLKFNRKAVSKEMVQYLASTTASIIKIKKTNSMIDIALPAPPLTKFINRLIKHSNVQTPTLMATSVYLAKLRSIIPSNVYGIETTRHRIFLGCLILAAKTLNDSSPLNKHWAEYTDGLLILREVNTIERELLEYFDWDVTISTDDLITCLSPFLKPIKEEQLYKSQRDCRTLKNFSAQEKDIVNKTSISHSRSSSNMSIPSLASTSTLSTLESRRSNLSNYSNRIRTLPELHESNNISDKFSPRTYNIDSKHDNKEIGQYRQLSLLILVKRAL

SEQ ID NO: 1571 - protein, 835 aa, Saccharomyces cerevisiae
MGEEHKPLLDASGVDPREEDKTATAILRRKKKDNMLLVDDAINDDNSVIAINSNTMDKLELFRGDTVLVKGKKRKDTVLIVLIDDELEDGACRINRVVRNNLRIRLGDLVTIHPCPDIKYATRISVLPIADTIEGITGNLFDVFLKPYFVEAYRPVRKGDHFVVRGGMRQVEFKVVDVEPEEYAVVAQDTIIHWEGEPINREDEENNMNEVGYDDIGGCRKQMAQIREMVELPLRHPQLFKAIGIKPPRGVLMYGPPGTGKTLMARAVANETGAFFFLINGPEVMSKMAGESESNLRKAFEEAEKNAPAIIFIDEIDSIAPKRDKTNGEVERRVVSQLLTLMDGMKARSNVVVIAATNRPNSIDPALRRFGRFDREVDIGIPDATGRLEVLRIHTKNMKLADDVDLEALAAETHGYVGADIASLCSEAAMQQIREKMDLIDLDEDEIDAEVLDSLGVTMDNFRFALGNSNPSALRETVVESVNVTWDDVGGLDEIKEELKETVEYPVLHPDQYTKFGLSPSKGVLFYGPPGTGKTLLAKAVATEVSANFISVKGPELLSMWYGESESNIRDIFDKARAAAPTVVFLDELDSIAKARGGSLGDAGGASDRVVNQLLTEMDGMNAKKNVFVIGATNRPDQIDPAILRPGRLDQLIYVPLPDENARLSILNAQLRKTPLEPGLELTAIAKATQGFSGADLLYIVQRAAKYAIKDSIEAHRQHEAEKEVKVEGEDVEMTDEGAKAEQEPEVDPVPYITKEHFAEAMKTAKRSVSDAELRRYEAYSQQMKASRGQFSNFNFNDAPLGTTATDNANSNNSAPSGAGAAFGSNAEEDDDLYS

SEQ ID NO: 1572 - protein, 312 aa, Saccharomyces cerevisiae
MSFHQQFFTLNNGNKIPAIAIIGTGTRWYKNEETDATFSNSLVEQIVYALKLPGIIHIDAAEIYRTYPEVGKALSLTEKPRNAIFLTDKYSPQIKMSDSPADGLDLALKKMGTDYVDLYLLHSPFVSKEVNGLSLEEAWKDMEQLYKSGKAKNIGVSNFAVEDLQRILKVAEVKPQVNQIEFSPFLQNQTPGIYKFCQEHDILVEAYSPLGPLQKKTAQDDSQPFFEYVKELSEKYIKSEAQIILRWVTKRGVLPVTTSSKPQRISDAQNLFSFDLTAEEVDKITELGLEHEPLRLYWNKLYGKYNYAAQKV

SEQ ID NO: 1573 - protein, 809 aa, Saccharomyces cerevisiae
MDLFIESKINSLLQFLFGSRQDFLRNFKTWSNNNNNLSIYLLIFGIVVFFYKKPDHLNYIVESVSEMTTNFRNNNSLSRWLPRSKFTHLDEEILKRGGFIAGLVNDGNTCFMNSVLQSLASSRELMEFLDNNVIRTYEEIEQNEHNEEGNGQESAQDEATHKKNTRKGGKVYGKHKKKLNRKSSSKEDEEKSQEPDITFSVALRDLLSALNAKYYRDKPYFKTNSLLKAMSKSPRKNILLGYDQEDAQEFFQNILAELESNVKSLNTEKLDTTPVAKSELPDDALVGQLNLGEVGTVYIPTEQIDPNSILHDKSIQNFTPFKLMTPLDGITAERIGCLQCGENGGIRYSVFSGLSLNLPNENIGSTLKLSQLLSDWSKPEIIEGVECNRCALTAAHSHLFGQLKEFEKKPEGSIPEKLINAVKDRVHQIEEVLAKPVIDDEDYKKLHTANMVRKCSKSKQILISRPPPLLSIHINRSVFDPRTYMIRKNNSKVLFKSRLNLAPWCCDINEINLDARLPMSKKEKAAQQDSSEDENIGGEYYTKLHERFEQEFEDSEEEKEYDDAEGNYASHYNHTKDISNYDPLNGEVDGVTSDDEDEYIEETDALGNTIKKRIIEHSDVENENVKDNEELQEIDNVSLDEPKINVEDQLETSSDEEDVIPAPPINYARSFSTVPATPLTYSLRSVIVHYGTHNYGHYIAFRKYRGCWWRISDETVYVVDEAEVLSTPGVFMLFYEYDFDEETGKMKDDLEAIQSNNEEDDEKEQEQKGVQEPKESQEQGEGEEQEEGQEQMKFERTEDHRDISGKDVN

SEQ ID NO: 1574 - protein, 307 aa, Saccharomyces cerevisiae
MTEQATKPRNSSHLIGGFFGGLTSAVALQPLDLLKTRIQQDKKATLWKNLKEIDSPLQLWRGTLPSALRTSIGSALYLSCLNLMRSSLAKRRNAVPSLTNDSNIVYNKSSSLPRLTMYENLLTGAFARGLVGYITMPITVIKVRYESTLYNYSSLKEAITHIYTKEGLFGFFRGFGATCLRDAPYAGLYVLLYEKSKQLLPMVLPSRFIHYNPEGGFTTYTSTTVNTTSAVLSASLATTVTAPFDTIKTRMQLEPSKFTNSFNTFTSIVKNENVLKLFSGLSMRLARKAFSAGIAWGIYEELVKRFM

SEQ ID NO: 1575 - protein, 308 aa, Saccharomyces cerevisiae
MVRKNKINRASGTTKHLKDFPSVILSLPSYNPSILSKNATALITGGSSGLGFELAKELSRRINKVIVADIQSFPTFAQVEYNNIFYYQCDITSLDEIKNLKKAIERDHGNINIIINNAGVAHIKKLEHMTNKEVEQLIDINLIGAYRIISTFAEDMIDNREGFIINIASVLGELTPARLTSYGASKGAMIGFHKCMSRHFRSLSTECNKTGIKTLLVCPGKIKTNMFIDVPTPSKLLAPDIIPSQLALAIISAMEHNHLQTLNAPYYVNLVPFFKTLSWPYRHLLKHFSGMDHVTSTSPRAINPKRSA

SEQ ID NO: 1576 - protein, 306 aa, Saccharomyces cerevisiae
MKVNMEYTKEKKVGEGTYAVVYLGCQHSTGRKIAIKEIKTSEFKDGLDMSAIREVKYLQEMQHPNVIELIDIFMAYDNLNLVLEFLPTDLEVVIKDKSILFTPADIKAWMLMTLRGVYHCHRNFILHRDLKPNNLLFSPDGQIKVADFGLARAIPAPHEILTSNVVTRWYRAPELLFGAKHYTSAIDIWSVGVIFAELMLRIPYLPGQNDVDQMEVTFRALGTPTDRDWPEVSSFMTYNKLQIYPPPSRDELRKRFIAASEYALDFMCGMLTMNPQKRWTAVQCLESDYFKELPPPSDPSSIKIRN

SEQ ID NO: 1577 - protein, 1097 aa, Saccharomyces cerevisiae
MSEKRSLPMVDVKIDDEDTPQLEKKIKRQSIDHGVGSEPVSTIEIIPSDSFRKYNSQGFKAKDTDLMGTQLESTFEQDVSQMEHDMADQEEHDLSSFERKKLPTDFDPSLYDISFQQIDAEQSVLNGIKDENTSTVVRFFGVTSEGHSVLCNVTGFKNYLYVPAPNSSDANDQEQINKFVHYLNETFDHAIDSIEVVSKQSIWGYSGDTKLPFWKIYVTYPHMVNKLRTAFERGHLSFNSWFSNGTTTYDNIAYTLRLMVDCGIVGMSWITLPKGKYSMIEPNNRVSSCQLEVSINYRNLIAHPAEGDWSHTAPLRIMSFDIECAGRIGVFPEPEYDPVIQIANVVSIAGAKKPFIRNVFTLNTCSPITGSMIFSHATEEEMLSNWRNFIIKVDPDVIIGYNTTNFDIPYLLNRAKALKVNDFPYFGRLKTVKQEIKESVFSSKAYGTRETKNVNIDGRLQLDLLQFIQREYKLRSYTLNAVSAHFLGEQKEDVHYSIISDLQNGDSETRRRLAVYCLKDAYLPLRLMEKLMALVNYTEMARVTGVPFSYLLARGQQIKVVSQLFRKCLEIDTVIPNMQSQASDDQYEGATVIEPIRGYYDVPIATLDFNSLYPSIMMAHNLCYTTLCNKATVERLNLKIDEDYVITPNGDYFVTTKRRRGILPIILDELISARKRAKKDLRDEKDPFKRDVLNGRQLALKISANSVYGFTGATVGKLPCLAISSSVTAYGRTMILKTKTAVQEKYCIKNGYKHDAVVVYGDTDSVMVKFGTTDLKEAMDLGTEAAKYVSTLFKHPINLEFEKAYFPYLLINKKRYAGLFWTNPDKFDKLDQKGLASVRRDSCSLVSIVMNKVLKKILIERNVDGALAFVRETINDILHNRVDISKLIISKTLAPNYTNPQPHAVLAERMKRREGVGPNVGDRVDYVIIGGNDKLYNRAEDPLFVLENNIQVDSRYYLTNQLQNPIISIVAPIIGDKQANGMFVVKSIKINTGSQKGGLMSFIKKVEACKSCKGPLRKGEGPLCSNCLARSGELYIKALYDVRDLEEKYSRLWTQCQRCAGNLHSEVLCSNKNCDIFYMRVKVKKELQEKVEQLSKW

SEQ ID NO: 1578 - protein, 513 aa, Saccharomyces cerevisiae
MSLSTKREHSGDVTDSSFKRQQRSNKPSSEYTCLGHLVNLIPGKEQKVEITNRNVTTIGRSRSCDVILSEPDISTFHAEFHLLQMDVDNFQRNLINVIDKSRNGTFINGNRLVKKDYILKNGDRIVFGKSCSFLFKYASSSSTDIENDDEKVSSESRSYKNDDEVFKKPQISATSSQNATTSAAIRKLNKTRPVSFFDKYLLGKELGAGHYALVKEAKNKKTGQQVAVKIFHAQQNDDQKKNKQFREETNILMRVQHPNIVNLLDSFVEPISKSQIQKYLVLEKIDDGELFERIVRKTCLRQDESKALFKQLLTGLKYLHEQNIIHRDIKPENILLNITRRENPSQVQLGPWDEDEIDIQVKIADFGLAKFTGEMQFTNTLCGTPSYVAPEVLTKKGYTSKVDLWSAGVILYVCLCGFPPFSDQLGPPSLKEQILQAKYAFYSPYWDKIDDSVLHLISNLLVLNPDERYNIDEALNHPWFNDIQQQSSVSLELQRLQITDNKIPKTYSELSCL

SEQ ID NO: 1579 - protein, 446 aa, Saccharomyces cerevisiae
MSHEGEEDLLEYSDNEQEIQIDASKAAEAGETGAATSATEGDNNNNTAAGDKKGSYVGIHSTGFKDFLLKPELSRAIIDCGFEHPSEVQQHTIPQSIHGTDVLCQAKSGLGKTAVFVLSTLQQLDPVPGEVAVVVICNARELAYQIRNEYLRFSKYMPDVKTAVFYGGTPISKDAELLKNKDTAPHIVVATPGRLKALVREKYIDLSHVKNFVIDECDKVLEELDMRRDVQEIFRATPRDKQVMMFSATLSQEIRPICRRFLQNPLEIFVDDEAKLTLHGLQQYYIKLEEREKNRKLAQLLDDLEFNQVIIFVKSTTRANELTKLLNASNFPAITVHGHMKQEERIARYKAFKDFEKRICVSTDVFGRGIDIERINLAINYDLTNEADQYLHRVGRAGRFGTKGLAISFVSSKEDEEVLAKIQERFDVKIAEFPEEGIDPSTYLNN

SEQ ID NO: 1580 - protein, 609 aa, Saccharomyces cerevisiae
MNSSYTQRYALPKCIAISDYLFHRLNQLNIHTIFGLSGEFSMPLLDKLYNIPNLRWAGNSNELNAAYAADGYSRLKGLGCLITTFGVGELSAINGVAGSYAEHVGILHIVGMPPTSAQTKQLLLHHTLGNGDFTVFHRIASDVACYTTLIIDSELCADEVDKCIKKAWIEQRPVYMGMPVNQVNLPIESARLNTPLDLQLHKNDPDVEKEVISRILSFIYKSQNPAIIVDACTSRQNLIEETKELCNRLKFPVFVTPMGKGTVNETDPQFGGVFTGSISAPEVREVVDFADFIIVIGCMLSEFSTSTFHFQYKTKNCALLYSTSVKLKNATYPDLSIKLLLQKILANLDESKLSYQPSEQPSMMVPRPYPAGNVLLRQEWVWNEISHWFQPGDIIITETGASAFGVNQTRFPVNTLGISQALWGSVGYTMGACLGAEFAVQEINKDKFPATKHRVILFMGDGAFQLTVQELSTIVKWGLTPYIFVMNNQGYSVDRFLHHRSDASYYDIQPWNYLGLLRVFGCTNYETKKIITVGEFRSMISDPNFATNDKIRMIEIMLPPRDVPQALLDRWVVEKEQSKQVQEENENSSAVNTPTPEFQPLLKKNQVGY

SEQ ID NO: 1581 - protein, 501 aa, Saccharomyces cerevisiae
MTDVLRSLVRKISFNNSDNLQLKHKTSIQSNTALEKKKRKPDTIKKVSDVQVHHTVPNFNNSSEYINDIENLIISKLIDGGKEGIAVDHIEHANISDSKTDGKVANKHENISSKLSKEKVEKMINFDYRYIKTKERTIHKRVYKHDRKTDVDRKNHGGTIDISYPTTEVVGHGSFGVVVTTVIIETNQKVAIKKVLQDRRYKNRELETMKMLCHPNTVGLQYYFYEKDEEDEVYLNLVLDYMPQSLYQRLRHFVNLKMQMPRVEIKFYAYQLFKALNYLHNVPRICHRDIKPQNLLVDPTTFSFKICDFGSAKCLKPDQPNVSYICSRYYRAPELMFGATNYSNQVDVWSSACVIAELLLGKPLFSGESGIDQLVEIIKIMGIPTKDEISGMNPNYEDHVFPNIKPITLAEIFKAEDPDTLDLLTKTLKYHPCERLVPLQCLLSSYFDETKRCDTDTYVKAQNLRIFDFDVETELGHVPLVERPAIEERLKHFVSAPSSSL

SEQ ID NO: 1582 - protein, 343 aa, Saccharomyces cerevisiae
MVKVAILGASGGVGQPLSLLLKLSPYVSELALYDIRAAEGIGKDLSHINTNSSCVGYDKDSIENTLSNAQVVLIPAGVPRKPGLTRDDLFKMNAGIVKSLVTAVGKFAPNARILVISNPVNSLVPIAVETLKKMGKFKPGNVMGVTNLDLVRAETFLVDYLMLKNPKIGQEQDKTTMHRKVTVIGGHSGETIIPIITDKSLVFQLDKQYEHFIHRVQFGGDEIVKAKQGAGSATLSMAFAGAKFAEEVLRSFHNEKPETESLSAFVYLPGLKNGKKAQQLVGDNSIEYFSLPIVLRNGSVVSIDTSVLEKLSPREEQLVNTAVKELRKNIEKGKSFILDSSKL

SEQ ID NO: 1583 - protein, 638 aa, Saccharomyces cerevisiae
MSRTNMDTRHAHSALLAAPQSATANSRSSNSSSESSSNKNNINVGVGDDSGNVSAVSIDDGPHFRDIFHYGHEENYKLASSGITNLNSSSHAHQTLSPISISNASTPESFPEHPLGLERETEPALEAEMEAEELPPHQSKYLLSSIKATKRLKDARPFLKPVDPIALNIPHYFNYVQTPMDLSLIETKLQGNVYHSVEQVTSDFKTMVDNCLNFNGPESSISSMAKRIQKYFEKKLSAMPPRVLPASALKKTSRNRKKNEDMDSPLVIRRSVSTTNDNIGESGNREGVSGGRPKRTIHPPKSKDLFDIYENSKPKSKTLQKKFRTCLKILKVLMSKKNSDINFPFLQPVDPIALNLPNYFDVVKNPMDLGTISNNLMNWKYKTIDQFVDDLNLVFYNCFQFNPEGNEVHSMGKKLKELFNFHWLENQDILNEIETDSDLEEDNYSSSYSSDDEYDDEDINENDITNPAIQYLEQKLKKMEVELQQLKRQELSKLSKERKRKHLGKTLLRRKAMKHSVDDLKKSITDKINELSDLEMNGMIRIIKNSLPADEILTSNEDEIEIDLDILDEATIARIYERYFEKKNNNNSKRKLSGNYSTAPTNKKKKTLKFLEKDEIINNNNYSDSEEDSSDSSDSDSD

SEQ ID NO: 1584 - protein, 428 aa, Saccharomyces cerevisiae
MSMLSRRLFSTSRLAAFSKIKVKQPVVELDGDEMTRIIWDKIKKKLILPYLDVDLKYYDLSVESRDATSDKITQDAAEAIKKYGVGIKCATITPDEARVKEFNLHKMWKSPNGTIRNILGGTVFREPIVIPRIPRLVPRWEKPIIIGRHAHGDQYKATDTLIPGPGSLELVYKPSDPTTAQPQTLKVYDYKGSGVAMAMYNTDESIEGFAHSSFKLAIDKKLNLFLSTKNTILKKYDGRFKDIFQEVYEAQYKSKFEQLGIHYEHRLIDDMVAQMIKSKGGFIMALKNYDGDVQSDIVAQGFGSLGLMTSILVTPDGKTFESEAAHGTVTRHYRKYQKGEETSTNSIASIFAWSRGLLKRGELDNTPALCKFANILESATLNTVQQDGIMTKDLALACGNNERSAYVTTEEFLDAVEKRLQKEIKSIE

SEQ ID NO: 1585 - protein, 157 aa, Saccharomyces cerevisiae [sequence omitted]

SEQ ID NO: 1586 - protein, 1790 aa, Saccharomyces cerevisiae
MDIIQGLIQQPKIQSVDETIPTLCDRVENSTLISDRRSAVLGLKAFSRQYRESVIASGLKPLLNTLKRDYMDEDSVKAILETILILFIRGDGHDDLTRGWISQQSRLQNGKYPSPLVMKQEKEQVDQFSLWIADALTQSEDLIHLLVEFWEIDNFHIRLYTIQLLEAVMATRPLKARSALISLPTSISTMVSLLDDMHEPIRDEAILLLMAVVNDSPHVQKLVAFENIFERLFSIIEEEGGLRGSLVVNDCLSLINNILKYNTSNQTLFLETGNLPKLAHLLSEPISQDEVFFWNDQRIVNINTALDIVSLTVEPGNTVTTKHQNALLDSSVLMVVLRLAFFHNIPKKVRPVALLTAANMVRSNEHAQLEFSKIDVPYFDPSLPVNSTANGGPIKLIPVVSILINWMLYANSVHTFDTRVACSRLLKAYFMDNFDLQRDFLLKQVQLCNNSTNNVGDNAKENGGSNKSDKESDSDKDTDGKDGTEYEGSFKANLFEVLLNYDAELNLNPFKLFFTTDIFMFFFQQDHKYSEELREITRNVTTGNDLEDEEPLKAIQTISELLTTSLTAADIRIPISYLTFLIYWLFGDFKATNDFLSDKSVIKSLLSFSYQIQDEDVTIKCLVTMLLGVAYEFSSKESPFPRKEYFEFITKTLGKDNYASRIKQFKKDSYFSKVDMNEDSILTPELDETGLPKVYFSTYFIQLFNENIYRIRTALSHDPDEEPINKISFEEVEKLQRQCTKLKGEITSLQTETESTHENLTEKLIALTNEHKELDEKYQILNSSHSSLKENFSILETELKNVRDSLDEMTQLRDVLETKDKENQTALLEYKSTIHKQEDSIKTLEKGLETILSQKKKAEDGINKMGKDLFALSREMQAVEENCKNLQKEKDKSNVNHQKETKSLKEDIAAKITEIKAINENLEEMKIQCNNLSKEKEHISKELVEYKSRFQSHDNLVAKLTEKLKSLANNYKDMQAENESLIKAVEESKNESSIQLSNLQNKIDSMSQEKENFQIERGSIEKNIEQLKKTISDLEQTKEEIISKSDSSKDEYESQISLLKEKLETATTANDENVNKISELTKTREELEAELAAYKNLKNELETKLETSEKALKEVKENEEHLKEEKIQLEKEATETKQQLNSLRANLESLEKEHEDLAAQLKKYEEQIANKERQYNEEISQLNDEITSTQQENESIKKKNDELEGEVKAMKSTSEEQSNLKKSEIDALNLQIKELKKKNETNEASLLESIKSVESETVKIKELQDECNFKEKEVSELEDKLKASEDKNSKYLELQKESEKIKEELDAKTTELKIQLEKITNLSKAKEKSESELSRLKKTSSEERKNAEEQLEKLKNEIQIKNQAFEKERKLLNEGSSTITQEYSEKINTLEDELIRLQNENELKAKEIDNTRSELEKVSLSNDELLEEKQNTIKSLQDEILSYKDKITRNDEKLLSIERDNKRDLESLKEQLRAAQESKAKVEEGLKKLEEESSKEKAELEKSKEMMKKLESTIESNETELKSSMETIRKSDEKLEQSKKSAEEDIKNLQHEKSDLISRINESEKDIEELKSKLRIEAKSGSELETVKQELNNAQEKIRINAEENTVLKSKLEDIERELKDKQAEIKSNQEEKELLTSRLKELEQELDSTQQKAQKSEEERRAEVRKFQVEKSQLDEKAMLLETKYNDLVNKEQAWKRDEDTVKKTTDSQRQEIEKLAKELDNLKAENSKLKEANEDRSEIDDLMLLVTDLDEKNAKYRSKLKDLGVEISSDEEDDEEDDEEDEEEGQVA

SEQ ID NO: 1587 - protein, 833 aa, Saccharomyces cerevisiae
MSNQIYSARYSGVDVYEFIHSTGSIMKRKKDDWVNATHILKAANFAKAKRTRILEKEVLKETHEKVQGGFGKYQGTWVPLNIAKQLAEKFSVYDQLKPLFDFTQTDGSASPPPAPKHHHASKVDRKKAIRSASTSAIMETKRNNKKAEENQFQSSKILGNPTAAPRKRGRPVGSTRGSRRKLGVNLQRSQSDMGFPRPAIPNSSISTTQLPSIRSTMGPQSPTLGILEEERHDSRQQQPQQNNSAQFKEIDLEDGLSSDVEPSQQLQQVFNQNTGFVPQQQSSLIQTQQTESMATSVSSSPSLPTSPGDFADSNPFEERFPGGGTSPIISMIPRYPVTSRPQTSDINDKVNKYLSKLVDYFISNEMKSNKSLPQVLLHPPPHSAPYIDAPIDPELHTAFHWACSMGNLPIAEALYEAGTSIRSTNSQGQTPLMRSSLFHNSYTRRTFPRIFQLLHETVFDIDSQSQTVIHHIVKRKSTTPSAVYYLDVVLSKIKDFSPQYRIELLLNTQDKNGDTALHIASKNGDVVFFNTLVKMGALTTISNKEGLTANEIMNQQYEQMMIQNGTNQHVNSSNTDLNIHVNTNNIETKNDVNSMVIMSPVSPSDYITYPSQIATNISRNIPNVVNSMKQMASIYNDLHEQHDNEIKSLQKTLKSISKTKIQVSLKTLEVLKESSKDENGEAQTNDDFEILSRLQEQNTKKLRKRLIRYKRLIKQKLEYRQTVLLNKLIEDETQATTNNTVEKDNNTLERLELAQELTMLQLQRKNKLSSLVKKFEDNAKIHKYRRIIREGTEMNIEEVDSSLDVILQTLIANNNKNKGAEQIITISNANSHA

SEQ ID NO: 1588 - protein, 361 aa, Saccharomyces cerevisiae
MKGLILVGGYGTRLRPLTLTVPKPLVEFGNRPMILHQIEALANAGVTDIVLAVNYRPEVMVETLKKYEKEYGVNITFSVETEPLGTAGPLKLAEDVLKKDNSPFFVLNSDVICEYPFKELADFHKAHGGKGTIVATKVDEPSKYGVIVHDIATPNLIDRFVEKPKEFVGNRINAGLYILNPEVIDLIEMKPTSIEKETFPILVEEKQLYSFDLEGFWMDVGQPKDFLSGTVLYLNSLAKRQPKKLATGANIVGNALIDPTAKISSTAKIGPDVVIGPNVTIGDGVRITRSVVLCNSTIKNHSLVKSTIVGWNSTVGQWCRLEGVTVLGDDVEVKDEIYINGGKVLPHKSISDNVPKEAIIM

SEQ ID NO: 1589 - protein, 303 aa, Saccharomyces cerevisiae
MSVIGRFLYYLRSVLVVLALAGCGFYGVIASILCTLIGKQHLAQWITARCFYHVMKLMLGLDVKVVGEENLAKKPYIMIANHQSTLDIFMLGRIFPPGCTVTAKKSLKYVPFLGWFMALSGTYFLDRSKRQEAIDTLNKGLENVKKNKRALWVFPEGTRSYTSELTMLPFKKGAFHLAQQGKIPIVPVVVSNTSTLVSPKYGVFNRGCMIVRILKPISTENLTKDKIGEFAEKVRDQMVDTLKEIGYSPAINDTTLPPQAIEYAALQHDKKVNKKIKNEPVPSVSISNDVNTHNEGSSVKKMH

SEQ ID NO: 1590 - protein, 268 aa, Saccharomyces cerevisiae
MLIVLFLTLFCSVVFRTAYCDVAIVAPEPNSVYDLSGTSQAVVKVKWMHTDNTPQEKDFVRYTFTLCSGTNAMIEAMATLQTLSASDLTDNEFNAIIENTVGTDGVYFIQVFAQTAIGYTIHYTNRFKLKGMIGTKAANPSMITIAPEAQTRITTGDVGATIDSKSFTVPYNLQTGVVKYAPMQLQPATKVTAKTWKRKYATSEVTYYYTLRNSVDQHTTVTPGWSYIITADSNYATPAPMPADNGGWYNPRKRLSLTARKVNALRHR

SEQ ID NO: 1591 - protein, 311 aa, Saccharomyces cerevisiae
MVSRGPDEWLETIKKCQALTENEMKQLCEMVKELLMEESNIQPVQTPVTVCGDIHGQFHDLLELFRTAGGFPDDINYIFLGDYVDRGYYSLETFTLLMCLKVKYPAKITLVRGNHESRQITQVYGFYEECLNKYGSTTVWKYCCQVFDFLTLAAIIDGKILCVHGGLSPEIRMLDQIRVLSRAQEVPHEGGFSDLLWSDPDNVEAWQVSPRGAGWLFGSKVAREFNHVNGLNLIARAHQLVMEGFKYHFPEKDVVTVWSAPNYCYRCGNVASVMKVDEDLEPTFKIFSAVPDDYIRESTANHNNQRAGYFL

SEQ ID NO: 1592 - protein, 854 aa, Saccharomyces cerevisiae
MSRKRSTKPKPAAKIALKKENDQFLEALKLYEGKQYKKSLKLLDAILKKDGSHVDSLALKGLDLYSVGEKDDAASYVANAIRKIEGASASPICCHVLGIYMRNTKEYKESIKWFTAALNNGSTNKQIYRDLATLQSQIGDFKNALVSRKKYWEAFLGYRANWTSLAVAQDVNGERQQAINTLSQFEKLAEGKISDSEKYEHSECLMYKNDIMYKAASDNQDKLQNVLKHLNDIEPCVFDKFGLLERKATIYMKLGQLKDASIVYRTLIKRNPDNFKYYKLLEVSLGIQGDNKLKKALYGKLEQFYPRCEPPKFIPLTFLQDKEELSKKLREYVLPQLERGVPATFSNVKPLYQRRKSKVSPLLEKIVLDYLSGLDPTQDPIPFIWTNYYLSQHFLFLKDFPKAQEYIDAALDHTPTLVEFYILKARILKHLGLMDTAAGILEEGRQLDLQDRFINCKTVKYFLRANNIDKAVEVASLFTKNDDSVNGIKDLHLVEASWFIVEQAEAYYRLYLDRKKKLDDLASLKKEVESDKSEQIANDIKENQWLVRKYKGLALKRFNAIPKFYKQFEDDQLDFHSYCMRKGTPRAYLEMLEWGKALYTKPMYVRAMKEASKLYFQMHDDRLKRKSDSLDENSDEIQNNGQNSSSQKKKAKKEAAAMNKRKETEAKSVAAYPSDQDNDVFGEKLIETSTPMEDFATEFYNNYSMQVREDERDYILDFEFNYRIGKLALCFASLNKFAKRFGTTSGLFGSMAIVLLHATRNDTPFDPILKKVVTKSLEKEYSENFPLNEISNNSFDWLNFYQEKFGKNDINGLLFLYRYRDDVPIGSSNLKEMIISSLSPLEPHSQNEILQYYL

SEQ ID NO: 1593 - protein, 995 aa, Saccharomyces cerevisiae
MAGVQKRKRDLEDQDDNGSEEDDIAFDIANEIALNDSESDANDSDSEVEADYGPNDVQDVIEYSSDEEEGVNNKKKAENKDIKKKKNSKKEIAAFPMLEMSDDENNASGKTQTGDDEDDVNEYFSTNNLEKTKHKKGSFPSFGLSKIVLNNIKRKGFRQPTPIQRKTIPLILQSRDIVGMARTGSGKTAAFILPMVEKLKSHSGKIGARAVILSPSRELAMQTFNVFKDFARGTELRSVLLTGGDSLEEQFGMMMTNPDVIIATPGRFLHLKVEMNLDLKSVEYVVFDEADRLFEMGFQEQLNELLASLPTTRQTLLFSATLPNSLVDFVKAGLVNPVLVRLDAETKVSENLEMLFLSSKNADREANLLYILQEIIKIPLATSEQLQKLQNSNNEADSDSDDENDRQKKRRNFKKEKFRKQKMPAANELPSEKATILFVPTRHHVEYISQLLRDCGYLISYIYGTLDQHARKRQLYNFRAGLTSILVVTDVAARGVDIPMLANVINYTLPGSSKIFVHRVGRTARAGNKGWAYSIVAENELPYLLDLELFLGKKILLTPMYDSLVDVMKKRWIDEGKPEYQFQPPKLSYTKRLVLGSCPRLDVEGLGDLYKNLMSSNFDLQLAKKTAMKAEKLYYRTRTSASPESLKRSKEIISSGWDAQNAFFGKNEEKEKLDFLAKLQNRRNKETVFEFTRNPDDEMAVFMKRRRKQLAPIQRKATERRELLEKERMAGLHILSKMKFWKGDDVETGYTVSEDALKEFEDAHQLLEAQENENKKKKKPKSFKDPTFFLSHYAPAGDIQDKQLQITNGFANDAAQAAYDLNSDDKVQVHKQTATVKWDKKRKKYVNTQGIDNKKYIIGESGQKIAASFRSGRFDDWSKARNLKPLKVGSRETSIPSNLLEDPSQGPAANGRTVRGKFKHKQMKAPKMPDKHRDNYYSQKKKVEKALQSGISVKGYNNAPGLRSELKSTEQIRKDRIIAEKKRAKNARPSKKRKF

SEQ ID NO: 1594 - protein, 391 aa, Saccharomyces cerevisiae
MDPHNPIVLDQGTGFVKIGRAGENFPDYTFPSIVGRPILRAEERASVATPLKDIMIGDEASEVRSYLQISYPMENGIIKNWTDMELLWDYAFFEQMKLPSTSNGKILLTEPPMNPLKNREKMCEVMFEKYDFGGVYVAIQAVLALYAQGLSSGVVVDSGDGVTHIVPVYESVVLSHLTRRLDVAGRDVTRHLIDLLSRRGYAFNRTADFETVRQIKEKLCYVSYDLDLDTKLARETTALVESYELPDGRTIKVGQERFEAPECLFQPGLVDVEQPGVGELLFNTVQSADVDIRSSLYKAIVLSGGSSMYPGLPSRLEKELKQLWFSRVLHNDPSRLDKFKVRIEDPPRRKHMVFIGGAVLASIMADKDHMWLSKQEWQESGPSAMTKFGPR

SEQ ID NO: 1595 - protein, 764 aa, Saccharomyces cerevisiae
MSTNSFHDYVDLKSRTNTRQFSDDEEFTTPPKLSNFGSALLSHTEKTSASEILSSHNNDKIANRLEEMDRSSSRSHPPPSMGNLTSGHTSTSSHSTLFGRYLRNNHQTSMTTMNTSDIEINVGNSLDKSFERIRNLRQNMKEDITAKYAERRSKRFLISNRTTKLGPAKRAMTLTNIFDEDVPNSPNQPINARETVELPLEDSHQTNFKERRENTDYDSIDFGDLNPIQYIKKHNLPTSDLPLISQIYFDKQREENRQAALRKHSSRELLYKSRSSSSSLSSNNLLANKDNSITSNNGSQPRRKVSTGSSSSKSSIEIRRALKENIDTSNNSNFNSPIHKIYKGISRNKDSDSEKREVLRNISINANHADNLLQQENKRLKRSLDDAITNENINSKNLEVFYHRPAPKPPVTKKVEIVEPAKSASLSNNRNIITVNDSQYEKIELLGRGGSSRVYKVKGSGNRVYALKRVSFDAFDDSSIDGFKGEIELLEKLKDQKRVIQLLDYEMGDGLLYLIMECGDHDLSQILNQRSGMPLDFNFVRFYTKEMLLCIKVVHDAGIVHSDLKPANFVLVKGILKIIDFGIANAVPEHTVNIYRETQIGTPNYMAPEALVAMNYTQNSENQHEGNKWKVGRPSDMWSCGCIIYQMIYGKPPYGSFQGQNRLLAIMNPDVKIPFPEHTSNNEKIPKSAIELMKACLYRNPDKRWTVDKVLSSTFLQPFMISGSIMEDLIRNAVRYGSEKPHISQDDLNDVVDTVLRKFADYKI

SEQ ID NO: 1596 - protein, 468 aa, Saccharomyces cerevisiae
MVKPVIFAICLGVLLSKALSIPLRSFADIELIGSQKSLFPFLGGSAPYFSFPANYGIPTDIPEGCRLTQVQMIGRHGERYPTRSEAKDIFEVWYKISNYTGKYEGSLSFLNNGYEFFIPDESLLEMETTLQNSIDVLNPYTGEMNAKRHAREFLAKYGKLMENCTNFPIFTTNSKRIYDTAQYFAEALGDGFNISLQTLSENSSSGANTLAAKSSCPNWNSNANNDILMSYSRDYLENISDRLNDENKGLNLSRKDAAALFSWCAFELNAKGYSNICDIFSAAELIHYSYETDLTSFYQNGPGYKLIKSIGANLFNATVKLIRQSAHLDQKVWLSFTHDTDILNYLTTAGLIDDTRNLTTNHVPFRDHSYHRSWYIPQGARVYTEKFQCSNDSYVRYVVNDAVVPIESCSSGPGFSCEEGTFYEYAKDRLRGVSFYEDCDVSKVSKEKELTFYWDWNTTRYNASLVNQ

SEQ ID NO: 1597 - protein, 391 aa, Saccharomyces cerevisiae
MSAAADRLNLTSGHLNAGRKRSSSSVSLKAAEKPFKVTVIGSGNWGTTIAKVVAENCKGYPEVFAPIVQMWVFEEEINGEKLTEIINTRHQNVKYLPGITLPDNLVANPDLIDSVKDVDIIVFNIPHQFLPRICSQLKGHVDSHVRAISCLKGFEVGAKGVQLLSSYITEELGIQCGALSGANIATEVAQEHWSETTVAYHIPKDFRGEGKDVDHKVLKALFHRPYFHVSVIEDVAGISICGALKNVVALGCGFVEGLGWGNNASAAIQRVGLGEIIRFGQMFFPESREETYYQESAGVADLITTCAGGRNVKVARLMATSGKDAWECEKELLNGQSAQGLITCKEVHEWLETCGSVEDFPLFEAVYQIVYNNYPMKNLPDMIEELDLHED

SEQ ID NO: 1598 - protein, 311 aa, Saccharomyces cerevisiae
MTASTPSNVMTLFLLRHGQSELNHENIFCGWIDAKLTEKGKEQARHSAELIEQYCKANNLRLPQIGYTSRLIRTQQTIETMCEEFKLKPQLQVVYDFNKIKLGDEFGSDDKDNMKIPILQTWRLNERHYGSWQGQRKPNVLKEYGKDKYMFIRRDYEGKPPPVDLDREMIQQENEKGSSTGYEFKEPNRQIKYELECSNHDIVLPDSESLREVVYRLNPFLQNVILKLANQYDESSCLIVGHGSSVRSLLKILEGISDDDIKNVDIPNGIPLVVELDKNNGLKFIRKFYLDPESAKINAEKVRNEGFIKNP

SEQ ID NO: 1599 - protein, 531 aa, Saccharomyces cerevisiae
MASTELSLKRTLTDILEDELYHTNPGHSQFTSHYQNYHPNASITPYKLVNKNKENNTFTWNHSLQHQNESSAASIPPQQTYHFPIFNKYADPTLTTTTSFTTSEATANDRQINNVHLIPNEIKGASETPLQKTVNLKNIMKVSDPYVPTRNTFNYDVKISNDFFDNGDNLYGNDEEVLFYEDNYNPKMQWSLQDNSAAINNEDARAIFNNEFDSDDDDISDDEEDEIEENCLQQEQHQEEPLLSLDVTPISMFGSDQKTGRAKSSSHLFNEYSYVDSNMDSISSVVSEDLLDERGHEKIEDEDEDNDLDEDDIYDISLLKNRRKQSFVLNKNTIDFERFPSPSTSANVPSTATTGKRKPAKSSSNRSCVSNSNENGTLERIKKPTSAVVSSNASRRKLINYTKKHLSSHSSTNSNSKPSTASPSAHTSSSDGNNEIFTCQIMNLITNEPCGAQFSRSYDLTRHQNTIHAKRKIVFRCSECIKILGSEGYQKTFSRLDALTRHIKSKHEDLSLEQRQEVTKFAKANIGYVMG

SEQ ID NO: 1600 - protein, 507 aa, Saccharomyces cerevisiae
MTSKTKNIDDIPPEIKEEMIQLYHDLPGIENEYKLIDKIGEGTFSSVYKAKDITGKITKKFASHFWNYGSNYVALKKIYVTSSPQRIYNELNLLYIMTGSSRVAPLCDAKRVRDQVIAVLPYYPHEEFRTFYRDLPIKGIKKYIWELLRALKFVHSKGIIHRDIKPTNFLFNLELGRGVLVDFGLAEAQMDYKSMISSQNDYDNYANTNHDGGYSMRNHEQFCPCIMRNQYSPNSHNQTPPMVTIQNGKVVHLNNVNGVDLTKGYPKNETRRIKRANRAGTRGFRAPEVLMKCGAQSTKIDIWSVGVILLSLLGRRFPMFQSLDDADSLLELCTIFGWKELRKCAALHGLGFEASGLIWDKPNGYSNGLKEFVYDLLNKECTIGTFPEYSVAFETFGFLQQELHDRMSIEPQLPDPKTNMDAVDAYELKKYQEEIWSDHYWCFQVLEQCFEMDPQKRSSAEDLLKTPFFNELNENTYLLDGESTDEDDVVSSSEADLLDKDVLLISE

SEQ ID NO: 1601 - protein, 437 aa, Saccharomyces cerevisiae
MGQGVSSGQDKKKKKGSNQKPKYEPPVQSKFGRKKRKGGPATAEKLPNIYPSTRCKLKLLRMERIKDHLLLEEEFVSNSEILKPFEKKQEEEKKQLEEIRGNPLSIGTLEEIIDDDHAIVTSPTMPDYYVSILSFVDKELLEPGCSVLLHHKTMSIVGVLQDDADPMVSVMKMDKSPTESYSDIGGLESQIQEIKESVELPLTHPELYEEMGIKPPKGVILYGAPGTGKTLLAKAVANQTSATFLRIVGSELIQKYLGDGPRLCRQIFKVAGENAPSIVFIDEIDAIGTKRYDSNSGGEREIQRTMLELLNQLDGFDDRGDVKVIMATNKIETLDPALIRPGRIDRKILFENPDLSTKKKILGIHTSKMNLSEDVNLETLVTTKDDLSGADIQAMCTEAGLLALRERRMQVTAEDFKQAKERVMKNKVEENLEGLYL

SEQ ID NO: 1602 - protein, 281 aa, Saccharomyces cerevisiae
MSNHSEILERPETPYDITYRVGVAENKNSKFRRTMEDVHTYVKNFASRLDWGYFAVFDGHAGIQASKWCGKHLHTIIEQNILADETRDVRDVLNDSFLAIDEEINTKLVGNSGCTAAVCVLRWELPDSVSDDSMDLAQHQRKLYTANVGDSRIVLFRNGNSIRLTYDHKASDTLEMQRVEQAGGLIMKSRVNGMLAVTRSLGDKFFDSLVVGSPFTTSVEITSEDKFLILACDGLWDVIDDQDACELIKDITEPNEAAKVLVRYALENGTTDNVTVMVVFL

SEQ ID NO: 1603 - protein, 751 aa, Saccharomyces cerevisiae
MSQVNTSQGPVAQGRQRRLSSLSEFNDPFSNAEVYYGPPTDPRKQKQAKPAKINRTRTMSVFDNVSPFKKTGFGKLQQTRRGSEDDTYSSSQGNRRFFIEDVDKTLNELLAAEDTDKNYQITIEDTGPKVLKVGTANSYGYKHINIRGTYMLSNLLQELTIAKSFGRHQIFLDEARINENPVNRLSRLINTQFWNSLTRRVDLNNVGEIAKDTKIDTPGAKNPRIYVPYDCPEQYEFYVQASQMHPSLKLEVEYLPKKITAEYVKSVNDTPGLLALAMEEHFNPSTGEKTLIGYPYAVPGGRFNELYGWDSYMMALGLLEANKTDVARGMVEHFIFEINHYGKILNANRSYYLCRSQPPFLTEMALVVFKKLGGRSNPDAVDLLKRAFQASIKEYKTVWTASPRLDPETGLSRYHPNGLGIPPETESDHFDTVLLPYASKHGVTLDEFKQLYNDGKIKEPKLDEFFLHDRGVRESGHDTTYRFEGVCAYLATIDLNSLLYKYEIDIADFIKEFCDDKYEDPLDHSITTSAMWKEMAKIRQEKITKYMWDDESGFFFDYNTKIKHRTSYESATTFWALWAGLATKEQAQKMVEKALPKLEMLGGLAACTERSRGPISISRPIRQWDYPFGWAPHQILAWEGLRSYGYLTVTNRLAYRWLFMMTKAFVDYNGIVVEKYDVTRGTDPHRVEAEYGNQGADFKGAATEGFGWVNASYILGLKYMNSHARRALGACIPPISFFSSLRPQERNLYGL

SEQ ID NO: 1604 - protein, 157 aa, Saccharomyces cerevisiae
GTPKYLVGVFRNQPKEDVLALVNDYGIDIVQLHGDESWQEYQEFLGLPVIKRLVFPKDCNILLSAASQKPHSFIPLFDSEAGGTGELLDWNSISDWVGRQESPESLHFMLAGGLTPENVGDALRLNGVIGVDVSGGVETNGVKDSNKIANFVKNAKK

SEQ ID NO: 1605 - protein, 520 aa, Saccharomyces cerevisiae
MNTNVPIFSSPVRDLPRSFEQKHLAVVDAFFQTYHVKPDFIARSPGRVNLIGEHIDYCDFSVLPLAIDVDMLCAVKILDEKNPSITLTNADPKFAQRKFDLPLDGSYMAIDPSVSEWSNYFKCGLHVAHSYLKKIAPERFNNTPLVGAQIFCQSDIPTGGGLSSAFTCAAALATIRANMGKNFDISKKDLTRITAVAEHYVGVNNGGMDQATSVYGEEDHALYVEFRPKLKATPFKFPQLKNHEISFVIANTLVKSNKFETAPTNYNLRVIEVTVAANALATRYSVALPSHKDNSNSERGNLRDFMDAYYARYENQAQPWNGDIGTGIERLLKMLQLVEESFSRKKSGFTVHEASTALNCSREEFTRDYLTTFPVRFQVLKLYQRAKHVYSESLRVLKALKMMTSATFHTDEDFFTDFGRLMNESQASCDKLYECSCIETNQICSIALANGSFGSRLTGAGWGGCTIHLVPSGANGNVEQVRKALIEKFYNVRYPDLTDEELKDAIIVSKPALGTCLYEQ

SEQ ID NO: 1606 - protein, 1501 aa, Saccharomyces cerevisiae
MSNIKSTQDSSHNAVARSSSASFAASEESFTGITHDKDEQSDTPADKLTKMLTGPARDTASQISATVSEMAPDVVSKVESFADALSRHTTRSGAFNMDSDSDDGFDAHAIFESFVRDADEQGIHIRKAGVTIEDVSAKGVDASALEGATFGNILCLPLTIFKGIKAKRHQKMRQIISNVNALAEAGEMILVLGRPGAGCSSFLKVTAGEIDQFAGGVSGEVAYDGIPQEEMMKRYKADVIYNGELDVHFPYLTVKQTLDFAIACKTPALRVNNVSKKEYIASRRDLYATIFGLRHTYNTKVGNDFVRGVSGGERKRVSIAEALAAKGSIYCWDNATRGLDASTALEYAKAIRIMTNLLKSTAFVTIYQASENIYETFDKVTVLYSGKQIYFGLIHEAKPYFAKMGYLCPPRQATAEFLTALTDPNGFHLIKPGYENKVPRTAEEFETYWLNSPEFAQMKKDIAAYKEKVNTEKTKEVYDESMAQEKSKYTRKKSYYTVSYWEQVKLCTQRGFQRIYGNKSYTVINVCSAIIQSFITGSLFYNTPSSTSGAFSRGGVLYFALLYYSLMGLANISFEHRPILQKHKGYSLYHPSAEAIGSTLASFPFRMIGLTCFFIILFFLSGLHRTAGSFFTIYLFLTMCSEAINGLFEMVSSVCDTLSQANSISGILMMSISMYSTYMIQLPSMHPWFKWISYVLPIRYAFESMLNAEFHGRHMDCANTLVPSGGDYDNLSDDYKVCAFVGSKPGQSYVLGDDYLKNQFQYVYKHTWRNFGILWCFLLGYVVLKVIFTEYKRPVKGGGDALIFKKGSKRFIAHADEESPDNVNDIDAKEQFSSESSGANDEVFDDLEAKGVFIWKDVCFTIPYEGGKRMLLDNVSGYCIPGTMTALMGESGAGKTTLLNTLAQRNVGIITGDMLVNGRPIDASFERRTGYVQQQDIHIAELTVRESLQFSARMRRPQHLPDSEKMDYVEKIIRVLGMEEYAEALVGEVGCGLNVEQRKKLSIGVELVAKPDLLLFLDEPTSGLDSQSSWAIIQLLRKLSKAGQSILCTIHQPSATLFEEFDRLLLLRKGGQTVYFGDIGKNSATILNYFERNGARKCDSSENPAEYILEAIGAGATASVKEDWHEKWLNSVEFEQTKEKVQDLINDLSKQETKSEVGDKPSKYATSYAYQFRYVLIRTSTSFWRSLNYIMSKMMLMLVGGLYIGFTFFNVGKSYVGLQNAMFAAFISIILSAPAMNQIQGRAIASRELFEVRESQSNMFHWSLVLITQYLSELPYHLFFSTIFFVSSYFPLRIFFEASRSAVYFLNYCIMFQLYYVGLGLMILYMSPNLPSANVILGLCLSFMLSFCGVTQPVSLMPGFWTFMWKASPYTYFVQNLVGIMLHKKPVVCKKKELNYFNPPNGSTCGEYMKPFLEKATGYIENPDATSDCAYCIYEVGDNYLTHISSKYSYLWRNFGIFWIYIFFNIIAMVCVYYLFHVRQSSFLSPVSILNKIKNIRKKKQ

SEQ ID NO: 1607 - protein, 399 aa, Saccharomyces cerevisiae
MSFDREEDQKLKFKTSKKLKVSSTFESMNLKDDLLRGIYSYGFEAPSSIQSRAITQIISGKDVIAQAQSGTGKTATFTIGLLQAIDLRKKDLQALILSPTRELASQIGQVVKNLGDYMNVNAFAITGGKTLKDDLKKMQKHGCQAVSGTPGRVLDMIKKQMLQTRNVQMLVLDEADELLSETLGFKQQIYDIFAKLPKNCQVVVVSATMNKDILEVTRKFMNDPVKILVKRDEISLEGIKQYVVNVDKEEWKFDTLCDIYDSLTITQCVIFCNTKKKVDWLSQRLIQSNFAVVSMHGDMKQEERDKVMNDFRTGHSRVLISTDVWARGIDVQQVSLVINYDLPEIIENYIHRIGRSGRFGRKGVAINFITKADLAKLREIEKFYSIKINPMPANFAELS

SEQ ID NO: 1608 - protein, 1014 aa, Saccharomyces cerevisiae
MSTNLANYFAGKKDIENEHVNRNASHESNSKSDVKISGNDNDNDEDMGPSVSMAVQAKNDDDFHKSTFNLKRTRSMGLLDEYIDPTKKLLGRSDDLYDNDNEYYDNSSNNSSSNSSDDDYDDGYQEHSTSVSPPPADNDSYLIPQDDNDVVVEPERHVDYLSHEWKESEISNSWKYIILKKKKRDVDLVNAARLENASWRTWAKARNNLKTVSPEVVNWSKDSDVTWLYGPIVRDSEGNAQSEEEHDLERGYGSDDENSKRISMPTKNSKSIAAAPKPILKKRTVTEIIEDNALWKLNEARKHMTEMKHASVIMDPNGNKNVHDDFDALAAQVNAQYYHYPKESNSSVSLKSQHSDKKDNSTIPNPVGENSNGGGDKGEEDLHLKSALHVQNNRSTAQSNKSILENSTNDRKANLDQNLNSPDNNRFPSSTSSSNRDNENNSMGLSSILTSNPSEKSNKPTKNRHIHFNDRVEQCMALRYPASQSEDDESDDENKQYVDVNNNANVTTINNNRTPLLAIQHKSIPINSATEHLNKNTSDDDTSSQSSSSSHSDDEEHGGLYINARFSRRSDSGVHSPITDNSSVASSTTSRAHVRPIIKLLPDTTLNYGSDEESDNGEFNGYGNAVSHNVNTSRGYDYIYDYNSVYTGDTSSFLPVDSCDIVDVPEGMDLQTAIADDNASNYEFNNAVESKEKHVPQLHKASANNTTRQHGSHMLLYDDDNYSSSSDSEQQFIEDSQYNSSDDEEEEDDDDQEVDDNHDEGLSLRRTLSLGKSGSTNSLYDLAQPSLSSATPQQKNPTNFTGGKTDVDKDAQLAVRPYPLKRNSSSGNFIFNSDSEEESSSEEEQRPLPANSQLVNRSVLKGSVTPANISSQKKKALPKQPKASDSSQSFRIVNNTPSPAEVGASDVAIEGYFSPRNESIKSVVSGGNMMDHQDHSEMDTLAKGFENCHINNASKLKDKKVDSVQTTRKEASLTDSSNESLHKVVQNARGMASKYLHSWKKSDVKPQENGNDSS

SEQ ID NO: 1609 - protein, 320 aa, Saccharomyces cerevisiae
MSTFETLIKRGGNEAIKINPPTGADFHITSRGSDWFWTCFCCYLLFGLILTFLMFRKPVNDRFFYLTGIAPNFFMCIAYFTMASNLGWIPVKAKYNHVQTSTQKEHPGYRQIFYSRFVGWFLALPWPIIQICMLAGTPFWQMAFNVCITEFFTVCWLIAACVHSTYKWGYYTIGLGAAIVVSISVMTTSYNLVKQRDNDIRLTFLVFFSIIMFLWIIAYPTCFGITDGGNVLQPDSAGIFYGIIDLILMCFIPTLLVPIANHFGADKLGYHFGPSDAEAVMAPKAPVASPRPAATPNLSKDKKKKSKKSKKSKKSKKSEE

SEQ ID NO: 1610 - protein, 370 aa, Saccharomyces cerevisiae
MFIKNDHAGDRKRLEDWRIKGYDPLTPPDLLQHEFPISAKGEENIIKARDSVCDILNGKDDRLVIVIGPCSLHDPKAAYDYADRLAKISEKLSKDLLIIMRAYLEKPRTTVGWKGLINDPDMNNSFQINKGLRISREMFIKLVEKLPIAGEMLDTISPQFLSDCFSLGAIGARTTESQLHRELASGLSFPIGFKNGTDGGLQVAIDAMRAAAHEHYFLSVTKPGVTAIVGTEGNKDTFLILRGGKNGTNFDKESVQNTKKQLEKAGLTDDSQKRIMIDCSHGNSNKDFKNQPKVAKCIYDQLTEGENSLCGVMIESNINEGRQDIPKEGGREGLKYGCSVTDACIGWESTEQVLELLAEGVRNRRKALKK

SEQ ID NO: 1611 - protein, 1091 aa, Saccharomyces cerevisiae
MSEGTVKENNNEEFNAYHTLTTEEAAEFIGTSLTEGLTQDESLRRLKAVGENTLGDDTKIDYKAMVLHQVCNAMIMVLVISMAISFAVRDWITGGVISFVIAVNVLIGLVQEYKATKTMNSLKNLSSPNAHVIRNGKSETINSKDVVPGDICLVKVGDTIPADLRLIETKNFDTDESLLTGESLPVSKDANLVFGKEEETSVGDRLNLAFSSSAVVKGRAKGIVIKTALNSEIGKIAKSLQGDSGLISRDPSKSWLQNTWISTKKVTGAFLGTNVGTPLHRKLSKLAVLLFWIAVLFAIIVMASQKFDVDKRVAIYAICVALSMIPSSLVVVLTITMSVGAAVMVSRNVIVRKLDSLEALGAVNDICSDKTGTLTQGKMLARQIWIPRFGTITISNSDDPFNPNEGNVSLIPRFSPYEYSHNEDGDVGILQNFKDRLYEKDLPEDIDMDLFQKWLETATLANIATVFKDDATDCWKAHGDPTEIAIQVFATKMDLPHNALTGEKSTNQSNENDQSSLSQHNEKPGSAQFEHIAEFPFDSTVKRMSSVYYNNHNETYNIYGKGAFESIISCCSSWYGKDGVKITPLTDCDVETIRKNVYSLSNEGLRVLGFASKSFTKDQVNDDQLKNITSNRATAESDLVFLGLIGIYDPPRNETAGAVKKFHQAGINVHMLTGDFVGTAKAIAQEVGILPTNLYHYSQEIVDSMVMTGSQFDGLSEEEVDDLPVLPLVIARCSPQTKVRMIEALHRRKKFCAMTGDGVNDSPSLKMANVGIAMGINGSDVSKEASDIVLSDDNFASILNAVEEGRRMTDNIQKFVLQLLAENVAQALYLIIGLVFRDENGKSVFPLSPVEVLWIIVVTSCFPAMGLGLEKAAPDLMDRPPNDSEVGIFTWEVIIDTFAYGIIMTGSCMASFTGSLYGINSGRLGHDCDGTYNSSCRDVYRSRSAAFATMTWCALILAWEVVDMRRSFFRMHPDTDSPVKEFFRSIWGNQFLFWSIIFGFVSAFPVVYIPVINDKVFLHKPIGAEWGLAIAFTIAFWIGAELYKCGKRRYFKTQRAHNSENDLERSSKHDPFEAYSTSTTLQSEINISVKH

SEQ ID NO: 1612 - protein, 1091 aa, Saccharomyces cerevisiae
MSEGTVKENNNEEFNAYHTLTTEEAAEFIGTSLTEGLTQDESLRRLKAVGENTLGDDTKIDYKAMVLHQVCNAMIMVLVISMAISFAVRDWITGGVISFVIAVNVLIGLVQEYKATKTMNSLKNLSSPNAHVIRNGKSETINSKDVVPGDICLVKVGDTIPADLRLIETKNFDTDESLLTGESLPVSKDANLVFGKEEETSVGDRLNLAFSSSAVVKGRAKGIVIKTALNSEIGKIAKSLQGDSGLISRDPSKSWLQNTWISTKKVTGAFLGTNVGTPLHRKLSKLAVLLFWIAVLFAIIVMASQKFDVDKRVAIYAICVALSMIPSSLVVVLTITMSVGAAVMVSRNVIVRKLDSLEALGAVNDICSDKTGTLTQGKMLARQIWIPRFGTITISNSDDPFNPNEGNVSLIPRFSPYEYSHNEDGDVGILQNFKDRLYEKDLPEDIDMDLFQKWLETATLANIATVFKDDATDCWKAHGDPTEIAIQVFATKMDLPHNALTGEKSTNQSNENDQSSLSQHNEKPGSAQFEHIAEFPFDSTVKRMSSVYYNNHNETYNIYGKGAFESIISCCSSWYGKDGVKITPLTDCDVETIRKNVYSLSNEGLRVLGFASKSFTKDQVNDDQLKNITSNRATAESDLVFLGLIGIYDPPRNETAGAVKKFHQAGINVHMLTGDFVGTAKAIAQEVGILPTNLYHYSQEIVDSMVMTGSQFDGLSEEEVDDLPVLPLVIARCSPQTKVRMIEALHRRKKFCAMTGDGVNDSPSLKMANVGIAMGINGSDVSKEASDIVLSDDNFASILNAVEEGRRMTDNIQKFVLQLLAENVAQALYLIIGLVFRDENGKSVFPLSPVEVLWIIVVTSCFPAMGLGLEKAAPDLMDRPPHDSEVGIFTWEVIIDTFAYGIIMTGSCMASFTGSLYGINSGRLGHDCDGTYNSSCRDVYRSRSAAFATMTWCALILAWEVVDMRRSFFRMHPDTDSPVKEFFRSIWGNQFLFWSIIFGFVSAFPVVYIPVINDKVFLHKPIGAEWGLAIAFTIAFWIGAELYKCGKRRYFKTQRAHNPENDLESNNKRDPFEAYSTSTTIHTEVNIGIKQ

SEQ ID NO: 1613 - protein, 1091 aa, Saccharomyces cerevisiae
MGEGTTKENNNAEFNAYHTLTAEEAAEFIGTSLTEGLTQDEFVHRLKTVGENTLGDDTKIDYKAMVLHQVCNAMIMVLLISMIISFAMHDWITGGVISFVIAVNVLIGLVQEYKATKTMNSLKNLSSPNAHVIRNGKSETINSKDVVPGDICLVKVGDTIPADLRLIETKNFDTDESLLTGESLPVSKDANLVFGKEEETSVGDRLNLAFSSSAVVKGRAKGIVIKTALNSEIGKIAKSLQGDSGLISRDPSKSWLQNTWISTKKVTGAFLGTNVGTPLHRKLSKLAVLLFWIAVLFAIIVMASQKFDVDKRVAIYAICVALSMIPSSLVVVLTITMSVGAAVMVSRNVIVRKLDSLEALGAVNDICSDKTGTLTQGKMLARQIWIPRFGTITISNSDDPFNPNEGNVSLIPRFSPYEYSHNEDGDVGILQNFKDRLYEKDLPEDIDMDLFQKWLETATLANIATVFKDDATDCWKAHGDPTEIAIQVFATKMDLPHNALTGEKSTNQSNENDQSSLSQHNEKPGSAQFEHIAEFPFDSTVKRMSSVYYNNHNETYNIYGKGAFESIISCCSSWYGKDGVKITPLTDCDVETIRKNVYSLSNEGLRVLGFASKSFTKDQVNDDQLKNITSNRATAESDLVFLGLIGIYDPPRNETAGAVKKFHQAGINVHMLTGDFVGTAKAIAQEVGILPTNLYHYSQEIVDSMVMTGSQFDGLSEEEVDDLPVLPLVIARCSPQTKVRMIEALHRRKKFCTMTGDGVNDSPSLKMANVGIAMGINGSDVSKEASDIVLSDDNFASILNAVEEGRRMTDNIQKFVLQLLAENVAQALYLIIGLVFRDENGKSVFPLSPVEVLWIIVVTSCFPAMGLGLEKAAPDLMDRPPHDSEVGIFTWEVIIDTFAYGIIMTGSCMASFTGSLYGINSGRLGHDCDGTYNSSCRDVYRSRSAAFATMTWCALILAWEVVDMRRSFFRMHPDTDSPVKEFFRSIWGNQFLFWSIIFGFVSAFPVVYIPVINDKVFLHKPIGAEWGLAIAFTIAFWIGAELYKCGKRRYFKTQRAHNPENDLESNNKRDPFEAYSTSTTIHTEVNIGIKQ

SEQ ID NO: 1614 - protein, 328 aa, Saccharomyces cerevisiae
MPAPQDPRNLPIRQQMEALIRRKQAEITQGLESIDTVKFHADTWTRGNDGGGGTSMVIQDGTTFEKGGVNVSVVYGQLSPAAVSAMKADHKNLRLPEDPKTGLPVTDGVKFFACGLSMVIHPVNPHAPTTHLNYRYFETWNQDGTPQTWWFGGGADLTPSYLYEEDGQLFHQLHKDALDKHDTALYPRFKKWCDEYFYITHRKETRGIGGIFFDDYDERDPQEILKMVEDCFDAFLPSYLTIVKRRKDMPYTKEEQQWQAIRRGRYVEFNLIYDRGTQFGLRTPGSRVESILMSLPEHASWLYNHHPAPGSREAKLLEVTTKPREWVK

SEQ ID NO: 1615 - protein, 110 aa, Saccharomyces cerevisiae
MLSFCPSCNNMLLITSGDSGVYTLACRSCPYEFPIEGIEIYDRKKLPRKEVDDVLGGGWDNVDQTKTQCPNYDTCGGESAYFFQLQIRSADEPMTTFYKCVNCGHRWKEN

SEQ ID NO: 1616 - protein, 604 aa, Saccharomyces cerevisiae
MSDPIVTSSKMEKSAEFEVTDSALYNNFNTSTTASLTPEIKEHSEESRNGLVHRFVDSFRRAESQRLEEDNDLEDGTKSMKSNNHLKKSMKSRHVVMMSLGTGIGTGLLVANAKGLSLAGPGSLVIGYVMVSFVTYFMVQAAGEMGVTYPTLPGNFNAYNSIFISKSFGFATTWLFCIQWLTVLPLELITSSMTVKYWNDTINADVFIVIFYVFLLFIHFFGVKAYGETEFIFNSCKILMVAGFIILSVVINCGGAGVDGYIGGKYWRDPGSFAEGSGATRFKGICYILVSAYFSFGGIELFVLSINEQSNPRKSTPVAAKRSVYRILIIYLLTMILIGFNVPHNNDQLMGSGGSATHASPYVLAASIHKVRVIPHIINAVILISVISVANSALYAAPRLMCSLAQQGYAPKFLNYIDREGRPLRALVVCSLVGVVGFVACSPQEEQAFTWLAAIAGLSELFTWSGIMLSHIRFRKAMKVQGRSLDEVGYKANTGIWGSYYGVFFNMLVFMAQFWVALSPIGNGGKCDAQAFFESYLAAPLWIFMYVGYMVYKRDFTFLNPLDKIDLDFHRRVYDPEIMRQEDEENKERLKNSSIFVRVYKFWC

SEQ ID NO: 1617 - protein, 362 aa, Saccharomyces cerevisiae
MGNFPAPKNDLILRAAKGEKVERPPCWIMRQAGRYLPEYHEVKNNRDFFQTCRDAEIASEITIQPVRRYRGLIDAAIIFSDILVIPQAMGMRVEMLEGKGPHFPEPLRNPEDLQTVLDYKVDVLKELDWAFKAITMTRIKLDGEVPLFGFCGGPWTLMVYMTEGGGSRLFRFAKQWINMYPELSHKLLQKITDVAVEFLSQQVVAGAQILQVFESWGGELSSVDFDEFSLPYLRQIAERVPKRLQELGIMEQIPMIVFAKGSWYALDKLCCSGFDVVSLDWSWDPREAVKINKNRVTLQGNLDPGVMYGSKEVITKKVKQMIEAFGGGKSRYIVNFGHGTHPFMDPDVIKFFLEECHRIGSK

SEQ ID NO: 1618 - protein, 248 aa, Saccharomyces cerevisiae
MARTFFVGGNFKLNGSKQSIKEIVERLNTASIPENVEVVICPPATYLDYSVSLVKKPQVTVGAQNAYLKASGAFTGENSVDQIKDVGAKWVILGHSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 1619 - protein, 704 aa, Saccharomyces cerevisiae
MVSPTKMIIRSPLKETDTNLKHNNGIAASTTAAGHLNVFSNDNNCNNNNTTESFPKKRSLERLELQQQQHLHEKKRARIERARSIEGAVQVSKGTGLKNVEPRVTPKELLEWQTNWKKIMKRDSRIYFDITDDVEMNTYNKSKMDKRRDLLKRGFLTLGAQITQFFDTTVTIVITRRSVENIYLLKDTDILSRAKKNYMKVWSYEKAARFLKNLDVDLDHLSKTKSASLAAPTLSNLLHNEKLYGPTDRDPRTKRDDIHYFKYPHVYLYDLWQTWAPIITLEWKPQELTNLDELPYPILKIGSFGRCPFIGDRNYDESSYKRVVKRYSRDKANKKYALQLRALFQYHADTLLNTSSVNDQTKNLIFIPHTCNDSTKSFKKWMQEKAKNFEKTELKKTDDSAVQDVRNEHADQTDEKNSILLNETETKEPPLKEEKENKQSIAEESNKYPQRKELAATPKLNHPVLATFARQETEEVPDDLCTLKTKSRQAFEIKASGAHQSNDVATSFGNGLGPTRASVMSKNMKSLSRLMVDRKLGVKQTNGNNKNYTATIATTAETSKENRHRLDFNALKKDEAPSKETGKDSAVHLETNRKPQNFPKVATKSVSADSKVHNDIKITTTESPTASKKSTSTNVTLHFNAQTAQTAQPVKKETVKNSGYCENCRVKYESLEQHIVSEKHLSFAENDLNFEAIDSLIENLRFQI

SEQ ID NO: 1620 - protein, 295 aa, Saccharomyces cerevisiae
MSSRKSTASSLLLRQYRELTDPKKAIPSFHIELEDDSNIFTWNIGVMVLNEDSIYHGGFFKAQMRFPEDFPFSPPQFRFTPAIYHPNVYRDGRLCISILHQSGDPMTDEPDAETWSPVQTVESVLISIVSLLEDPNINSPANVDAAVDYRKNPEQYKQRVKMEVERSKQDIPKGFIMPTSESAYISQSKLDEPESNKDMADNFWYDSDLDDDENGSVILQDDDYDDGNNHIPFEDDDVYNYNDNDDDDERIEFEDDDDDDDDSIDNDSVMDRKQPHKAEDESEDVEDVERVSKKI

SEQ ID NO: 1621 - protein, 148 aa, Saccharomyces cerevisiae
MSSSKRIAKELSDLGRDPPASCSAGPVGDDLYHWQASIMGPSDSPYAGGVFFLSIHFPTDYPFKPPKVNFTTKIYHPNINSSGNICLDILKDQWSPALTLSKVLLSICSLLTDANPDDPLVPEIAQIYKTDKAKYEATAKEWTKKYAV

SEQ ID NO: 1622 - protein, 561 aa, Saccharomyces cerevisiae
MSTPANYTRVPLCEPEELPDDIQKENEYGTLDSPGHLYQVKSRHGKPLPEPVVDTPPYYISLLTYLNYLILIILGHVHDFLGMTFQKNKHLDLLEHDGLAPWFSNFESFYVRRIKMRIDDCFSRPTTGVPGRFIRCIDRISHNINEYFTYSGAVYPCMNLSSYNYLGFAQSKGQCTDAALESVDKYSIQSGGPRAQIGTTDLHIKAEKLVARFIGKEDALVFSMGYGTNANLFNAFLDKKCLVISDELNHTSIRTGVRLSGAAVRTFKHGDMVGLEKLIREQIVLGQPKTNRPWKKILICAEGLFSMEGTLCNLPKLVELKKKYKCYLFIDEAHSIGAMGPTGRGVCEIFGVDPKDVDILMGTFTKSFGAAGGYIAADQWIIDRLRLDLTTVSYSESMPAPVLAQTISSLQTISGEICPGQGTERLQRIAFNSRYLRLALQRLGFIVYGVADSPVIPLLLYCPSKMPAFSRMMLQRRIAVVVVAYPATPLIESRVRFCMSASLTKEDIDYLLRHVSEVGDKLNLKSNSGKSSYDGKRQRWDIEEVIRRTPEDCKDDKYFVN

SEQ ID NO: 1623 - protein, 926 aa, Saccharomyces cerevisiae
MEQNIISTIRDECIRHRSKYLTIAQLTAIAEAKINEFIITGKAKDQDLSSLLDKCIDILSIYKKNSKDIKNIISCKNKGAMISSNSVMIIQLNYVYYKVIHIIVTTNIPHLSEFAKIKLHKSTSDEGNGNNNNNEFQLMNIYNTLLETLLKDENIAKIKSFIKSSIKQTKLNHEQEECNLMRTGSYITSNQLNSLISSSANSASSQMEILLIDIRSRLEFNKSHIDTKNIICLEPISFKMSYSDHDLEKKSLITSPNSEIKMFQSRNLFKFIILYTDANEYNVKQQSVLLDILVNHSFEKPISDDFTKIFILESGFPGWLKSNYGRQVSSSFPSNNNIKDDSVYINGNTSGLSLQHLPKMSPSIRHSMDDSMKEMLVAPTPLNHLQQQQQQQSDNDHVLKRSSSFKKLFSNYTSPNPKNSNSNLYSISSLSISSSPSPLPLHSPDPVKGNSLPINYPETPHLWKNSETDFMTNQREQLNHNSFAHIAPINTKAITSPSRTATPKLQRFPQTISMNLNMNSNGHSSATSTIQPSCLSLSNNDSLDHTDVTPTSSHNYDLDFAVGLENLGNSCYMNCIIQCILGTHELTQIFLDDSYAKHININSKLGSKGILAKYFARLVHMMYKEQVDGSKKISISPIKFKLACGSVNSLFKTASQQDCQEFCQFLLDGLHEDLNQCGSNPPLKELSQEAEARREKLSLRIASSIEWERFLTTDFSVIVDLFQGQYASRLKCKVCSHTSTTYQPFTVLSIPIPKKNSRNNITIEDCFREFTKCENLEVDEQWLCPHCEKRQPSTKQLTITRLPRNLIVHLKRFDNLLNKNNDFVIYPFLLDLTPFWANDFDGVFPPGVNDDELPIRGQIPPFKYELYGVACHFGTLYGGHYTAYVKKGLKKGWLYFDDTKYKPVKNKADAINSNAYVLFYHRVYGV

SEQ ID NO: 1624 - protein, 896 aa, Saccharomyces cerevisiae
MTTTAQDNSPKKRQRIINCVTQLPYKIQLGESNDDWKISATTGNSALFSSLEYLQFDSTEYEQHVVGWTGEITRTERNLFTREAKEKPQDLDDDPLYLTKEQINGLTTTLQDHMKSDKEAKTDTTQTAPVTNNVHPVWLLRKNQSRWRNYAEKVIWPTFHYILNPSNEGEQEKNWWYDYVKFNEAYAQKIGEVYRKGDIIWIHDYYLLLLPQLLRMKFNDESIIIGYFHHAPWPSNEYFRCLPRRKQILDGLVGANRICFQNESFSRHFVSSCKRLLDATAKKSKNSSNSDQYQVSVYGGDVLVDSLPIGVNTTQILKDAFTKDIDSKVLSIKQAYQNKKIIIGRDRLDSVRGVVQKLRAFETFLAMYPEWRDQVVLIQVSSPTANRNSPQTIRLEQQVNELVNSINSEYGNLNFSPVQHYYMRIPKDVYLSLLRVADLCLITSVRDGMNTTALEYVTVKSHMSNFLCYGNPLILSEFSGSSNVLKDAIVVNPWDSVAVAKSINMALKLDKEEKSNLESKLWKEVPTIQDWTNKFLSSLKEQASSNDDMERKMTPALNRPVLLENYKQAKRRLFLFDYDGTLTPIVKDPAAAIPSARLYTILQKLCADPHNQIWIISGRDQKFLNKWLGGKLPQLGLSAEHGCFMKDVSCQDWVNLTEKVDMSWQVRVNEVMEEFTTRTPGSFIERKKVALTWHYRRTVPELGEFHAKELKEKLLSFTDDFDLEVMDGKANIEVRPRFVNKGEIVKRLVWHQHGKPQDMLKGISEKLPKDEMPDFVLCLGDDFTDEDMFRQLNTIETCWKEKYPDQKNQWGNYGFYPVTVGSASKKTVAKAHLTDPQQVLETLGLLVGDVSLFQSAGTVDLDSRGHVKNSESSLKSKLASKAYVMKRSASYTGAKV

SEQ ID NO: 1625 - protein, 308 aa, Saccharomyces cerevisiae
MMDLDKIIASLRDGKHIPEETVFRLCLNSQELLMNEGNVTQVDTPVTICGDIHGQLHDLLTLFEKSGGVEKTRYIFLGDFVDRGFYSLESFLLLLCYKLRYPDRITLIRGNHETRQITKVYGFYDEVVRKYGNSNVWRYCCEVFDYLSLGAIINNSIFCVHGGLSPDMTTVDEIRTIDRKQEVPHEGAMCDLLWSDPEDVDTWSLSPRGAGFLFGKREVDQFLEKNNVELIARAHQLVMEGYKEMFDGGLVTVWSAPNYCYRCGNVAAVLKIDDDLNREYTIFEAVQAQNEVGNAIIPTKKSQMDYFL

SEQ ID NO: 1626 - protein, 620 aa, Saccharomyces cerevisiae
MEGSYLSAQENQPIPERLIPRSNSTSNLFALSSTFSKLNVRNDADYNYSNPNKKRHIYSGEIDCRSVTAARKFPVRSCSMTAAQQRKRTALFTVRERNSYHEGFNNDQDYVSQYQKPQYTFGVYKELTPYQLQRSKMKRSFQFPNGEIYKPKLDGKCTHSLKKPELNSRDSSLFKFSEKKGRNLSKDFVGPHNGTSVIHIPPNDTGYGVNSLELNTSVPSTIKSSVSSTSPISAVNTLTSLPESQTDDDDGYENKTVTISYCFENTVNEKHGSHIEKLDLSTKEKTKPTTNSGLFDRKKKTILGTEKYRCIKSQSKLKLGSVLKKLWRTSGNSNTKHGKKDTKRRRIPIDDMVTHSDGNSEAENDIELMDANLDGIEFDDDETLMDTDSIFDDLLSKENDKYDLRRRQLEIRQKLHETSHNDDGKVSFRDTEKHNVNEGLIDKTIIEEFSKLGEYIIDTRNQPPPRSSKRPSLDDNESARYFYNISTDLRQSLSGPISLPMHVGNDMVNRLRNDWEYIRFEDRRNSLPDSSFDKVETPPKPIKKDVRFAKEVCLASTWSSNAYERANPEFIMNRHRLLWMMKVHPSMNSAMNEIKLELNSYKKNEMVVHENSKCFTHYLI

SEQ ID NO: 1627 - protein, 153 aa, Saccharomyces cerevisiae
MASLPKRIIKETEKLVSDPVPGITAEPHDDNLRYFQVTIEGPEQSPYEDGIFELELYLPDDYPMEAPKVRFLTKIYHPNIDRLGRICLDVLKTNWSPALQIRTVLLSIQALLASPNPNDPLANDVAEDWIKNEQGAKAKAREWTKLYAKKKPE

SEQ ID NO: 1628 - protein, 1612 aa, Saccharomyces cerevisiae
MSSPSKPTSPFVDDIEHESGSASNGLSSMSPFDDSFQFEKPSSAHGNIEVAKTGGSVLKRQSKPMKDISTPDLSKVTFDGIDDYSNDNDINDDDELNGKKTEIHEHENEVDDDLHSFQATPMPNTGGFEDVELDNNEGSNNDSQADHKLKRVRFGTRRNKSGRIDINRSKTLKWAKKNFHNAIDEFSTKEDSLENSALQNRSDELRTVYYNLPLPEDMLDEDGLPLAVYPRNKIRTTKYTPLTFFPKNILFQFHNFANIYFLILLILGAFQIFGVTNPGFASVPLIVIVIITAIKDGIEDSRRTVLDLEVNNTRTHILSGVKNENVAVDNVSLWRRFKKANTRALIKIFEYFSENLTAAGREKKLQKKREELRRKRNSRSFGPRGSLDSIGSYRMSADFGRPSLDYENLNQTMSQANRYNDGENLVDRTLQPNPECRFAKDYWKNVKVGDIVRVHNNDEIPADMILLSTSDVDGACYVETKNLDGETNLKVRQSLKCSKIIKSSRDITRTKFWVESEGPHANLYSYQGNFKWQDTQNGNIRNEPVNINNLLLRGCTLRNTKWAMGMVIFTGDDTKIMINAGVTPTKKSRISRELNFSVILNFVLLFILCFTAGIVNGVYYKQKPRSRDYFEFGTIGGSASTNGFVSFWVAVILYQSLVPISLYISVEIIKTAQAIFIYTDVLLYNAKLDYPCTPKSWNISDDLGQIEYIFSDKTGTLTQNVMEFKKCTINGVSYGRAYTEALAGLRKRQGVDVESEGRREKEEIAKDRETMIDELRSMSDNTQFCPEDLTFVSKEIVEDLKGSSGDHQQKCCEHFLLALALCHSVLVEPNKDDPKKLDIKAQSPDESALVSTARQLGYSFVGSSKSGLIVEIQGVQKEFQVLNVLEFNSSRKRMSCIIKIPGSTPKDEPKALLICKGADSVIYSRLDRTQNDATLLEKTALHLEEYATEGLRTLCLAQRELTWSEYERWVKTYDVAAASVTNREEELDKVTDVIERELILLGGTAIEDRLQDGVPDSIALLAEAGIKLWVLTGDKVETAINIGFSCNVLNNDMELLVVKASGEDVEEFGSDPIQVVNNLVTKYLREKFGMSGSEEELKEAKREHGLPQGNFAVIIDGDALKVALNGEEMRRKFLLLCKNCKAVLCCRVSPAQKAAVVKLVKKTLDVMTLAIGDGSNDVAMIQSADVGVGIAGEEGRQAVMCSDYAIGQFRYVTRLVLVHGKWCYKRLAEMIPQFFYKNVIFTLSLFWYGIYNNFDGSYLFEYTYLTFYNLAFTSVPVILLAVLDQDVSDTVSMLVPQLYRVGILRKEWNQTKFLWYMLDGVYQSVICFFFPYLAYHKNMVVTENGLGLDHRYFVGVFVTAIAVTSCNFYVFMEQYRWDWFCGLFICLSLAVFYGWTGIWTSSSSSNEFYKGAARVFAQPAYWAVLFVGVLFCLLPRFTIDCIRKIFYPKDIEIVREMWLRGDFDLYPQGYDPTDPSRPRINEIRPLTDFKEPISLDTHFDGVSHSQETIVTEEIPMSILNGEQGSRKGYRVSTTLERRDQLSPVTTTNNLPRRSMASARGNKLRTSLDRTREEMLANHQLDTRYSVERARASLDLPGINHAETLLSQRSRDR

SEQ ID NO: 1629 - protein, 1242 aa, Saccharomyces cerevisiae
MAPATPKTSKTAHFENGSTSSQKKMKQSSLLSFFSKQVPSGTPSKKVQKPTPATLENTATDKITKNPQGGKTGKLFVDVDEDNDLTIAEETVSTVRSDIMHSQEPQSDTMLNSNTTEPKSTTTDEDLSSSQSRRNHKRRVNYAESDDDDSDTTFTAKRKKGKVVDSESDEDEYLPDKNDGDEDDDIADDKEDIKGELAEDSGDDDDLISLAETTSKKKFSYNTSHSSSPFTRNISRDNSKKKSRPNQAPSRSYNPSHSQPSATSKSSKFNKQNEERYQWLVDERDAQRRPKSDPEYDPRTLYIPSSAWNKFTPFEKQYWEIKSKMWDCIVFFKKGKFFELYEKDALLANALFDLKIAGGGRANMQLAGIPEMSFEYWAAQFIQMGYKVAKVDQRESMLAKEMREGSKGIVKRELQCILTSGTLTDGDMLHSDLATFCLAIREEPGNFYNETQLDSSTIVQKLNTKIFGAAFIDTATGELQMLEFEDDSECTKLDTLMSQVRPMEVVMERNNLSTLANKIVKFNSAPNAIFNEVKAGEEFYDCDKTYAEIISSEYFSTEEDWPEVLKSYYDTGKKVGFSAFGGLLYYLKWLKLDKNLISMKNIKEYDFVKSQHSMVLDGITLQNLEIFSNSFDGSDKGTLFKLFNRAITPMGKRMMKKWLMHPLLRKNDIESRLDSVDSLLQDITLREQLEITFSKLPDLERMLARIHSRTIKVKDFEKVITAFETIIELQDSLKNNDLKGDVSKYISSFPEGLVEAVKSWTNAFERQKAINENIIVPQRGFDIEFDKSMDRIQELEDELMEILMTYRKQFKCSNIQYKDSGKEIYTIEIPISATKNVPSNWVQMAANKTYKRYYSDEVRALARSMAEAKEIHKTLEEDLKNRLCQKFDAHYNTIWMPTIQAISNIDCLLAITRTSEYLGAPSCRPTIVDEVDSKTNTQLNGFLKFKSLRHPCFNLGATTAKDFIPNDIELGKEQPRLGLLTGANAAGKSTILRMACIAVIMAQMGCYVPCESAVLTPIDRIMTRLGANDNIMQGKSTFFVELAETKKILDMATNRSLLVVDELGRGGSSSDGFAIAESVLHHVATHIQSLGFFATHYGTLASSFKHHPQVRPLKMSILVDEATRNVTFLYKMLEGQSEGSFGMHVASMCGISKEIIDNAQIAADNLEHTSRLVKERDLAANNLNGEVVSVPGGLQSDFVRIAYGDGLKNTKLGSGEGVLNYDWNIKRNVLKSLFSIIDDLQS

SEQ ID NO: 1630 - protein, 273 aa, Saccharomyces cerevisiae
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGESKVFYYKMKGDYHRYLAEFSSGDAREKATNSSLEAYKTASEIATTELPPTHPIRLGLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 1631 - protein, 917 aa, Saccharomyces cerevisiae
MMETPTDNIVSPFHNFGSSTQYSGTLSRTPNQIIELEKPSTLSPLSRGKKWTEKLARFQRSSAKKKRFSPSPISSSTFSFSPKSRVTSSNSSGNEDGNLMNTPSTVSTDYLPQHPHRTSSLPRPNSNLFHASNSNLSRANEPPRAENLSDNIPPKVAPFGYPIQRTSIKKSFLNASCTLCDEPISNRRKGEKIIELACGHLSHQECLIISFGTTSKADVRALFPFCTKCKKDTNKAVQCIPENDELKDILISDFLIHKIPDSELSITPQSRFPPYSPLLPPFGLSYTPVERQTIYSQAPSLNPNLILAAPPKERNQIPQKKSNYTFLHSPLGHRRIPSGANSILADTSVALSANDSISAVSNSVRAKDDETKTTLPLLRSYFIQILLNNFQEELQDWRIDGDYGLLRLVDKLMISKDGQRYIQCWCFLFEDAFVIAEVDNDVDVLEIRLKNLEVFTPIANLRMTTLEASVLKCTLNKQHCADLSDLYIVQNINSDESTTVQKWISGILNQDFVFNEDNITSTLPILPIIKNFSKDVGNGRHETSTFLGLINPNKVVEVGNVHDNDTVIIRRGFTLNSGECSRQSTVDSIQSVLTTISSILSLKREKPDNLAIILQIDFTKLKEEDSLIVVYNSLKALTIKFARLQFCFVDRNNYVLDYGSVLHKIDSLDSISNLKSKSSSTQFSPIWLKNTLYPENIHEHLGIVAVSNSNMEAKKSILFQDYRCFTSFGRRRPNELKIKVGYLNVDYSDKIDELVEASSWTFVLETLCYSFGLSFDEHDDDDEEDNDDSTDNELDNSSGSLSDAESTTTIHIDSPFDNENATANMVNDRNLLTEGEHSNIENLETVASSVQPALIPNIRFSLHSEEEGTNENENENDMPVLLLSDMDKGIDGITRRSSFSSLIESGNNNCPLHMDYI

SEQ ID NO: 1632 - protein, 715 aa, Saccharomyces cerevisiae
MKSRKRQNNMQNETREPAVLSSQETSISRISPQDPEAKFYVGVDVGTGSARACVIDQSGNMLSLAEKPIKREQLISNFITQSSREIWNAVCYCVRTVVEESGVDPERVRGIGFDATCSLVVVSATNFEEIAVGPDFTNNDQNIILWMDHRAMKETEEINSSGDKCLKYVGGQMSVEMEIPKIKWLKNNLEAGIFQDCKFFDLPDYLTFKATGKENRSFCSAVCKQGFLPVGVEGSDIGWSKEFLNSIGLSELTKNDFERLGGSLREKKNFLTAGECISPLDKKAACQLGLTEHCVVSSGIIDAYAGWVGTVAAKPESAVKGLAETENYKKDFNGAIGRLAAVAGTSTCHILLSKNPIFVHGVWGPYRDVLARGFWAAEGGQSCTGVLLDHLITTHPAFTELSHMANLAGVSKFEYLNKILETLVEKRKVRSVISLAKHLFFYGDYHGNRSPIADPNMRACIIGQSMDNSIEDLAVMYLSACEFISQQTRQIIEVMLKSGHEINAIFMSGGQCRNSLLMRLLADCTGLPIVIPRYVDAAVVFGSALLGAAASEDFDYTREKRTLKGQKSSQTKTERFNDSYSSIQKLSMEDRNSTNGFVSPHNLQLSTPSAPAKINNYSLPICTQQPLDKTSEESSKDASLTVGQESLGEGRYNGTSFLWKVMQELTGNARIVNPNEKTHPDRILLDTKYQIFLDMIETQRKYRRMVDKVEGSFSR

SEQ ID NO: 1633 - protein, 566 aa, Saccharomyces cerevisiae
MTKPRYNDVLFDDDDSVPSESVTRKSQRRKATSPGESRESSKDRLLILPSMGESYTEYVDSYLNLELLERGERETPIFLESLTRQLTQKIYELIKTKSLTADTLQQISDKYDGVVAENKLLFLQRQYYVDDEGNVRDGRNNDKIYCEPKHVYDMVMATHLMNKHLRGKTLHSFLFSHFANISHAIIDWVQQFCSKCNKKGKIKPLKEYKRPDMYDKLLPMERIHIEVFEPFNGEAIEGKYSYVLLCRDYRSSFMWLLPLKSTKFKHLIPVVSSLFLTFARVPIFVTSSTLDKDDLYDICEEIASKYGLRIGLGLKSSARFHTGGILCIQYALNSYKKECLADWGKCLRYGPYRFNRRRNKRTKRKPVQVLLSEVPGHNAKFETKRERVIENTYSRNMFKMAGGKGLIYLEDVNTFALANEADNSCNNNGILHNNNIGNDNFEEEVQKQFDLTEKNYIDEYDDLAHDSSEGEFEPNTLTPEEKPPHNVDEDRIESTGVAAPMQGTEEPEKGDQKESDGASQVDQSVEITRPETSYYQTLESPSTKRQKLDQQGNGDQTRDFGTSMEL

SEQ ID NO: 1634 - protein, 1064 aa, Saccharomyces cerevisiae [sequence omitted]

SEQ ID NO: 1635 - protein, 1588 aa, Saccharomyces cerevisiae
MVQLAKVPILGNDIIHVGYNIHDHLVETIIKHCPSSTYVICNDTNLSKVPYYQQLVLEFKASLPEGSRLLTYVVKPGETSKSRETKAQLEDYLLVEGCTRDTVMVAIGGGVIGDMIGFVASTFMRGVRVVQVPTSLLAMVDSSIGGKTAIDTPLGKNFIGAFWQPKFVLVDIKWLETLAKREFINGMAEVIKTACIWNADEFTRLESNASLFLNVVNGAKNVKVTNQLTNEIDEISNTDIEAMLDHTYKLVLESIKVKAEVVSSDERESSLRNLLNFGHSIGHAYEAILTPQALHGECVSIGMVKEAELSRYFGILSPTQVARLSKILVAYGLPVSPDEKWFKELTLHKKTPLDILLKKMSIDKKNEGSKKKVVILESIGKCYGDSAQFVSDEDLRFILTDETLVYPFKDIPADQQKVVIPPGSKSISNRALILAALGEGQCKIKNLLHSDDTKHMLTAVHELKGATISWEDNGETVVVEGHGGSTLSACADPLYLGNAGTASRFLTSLAALVNSTSSQKYIVLTGNARMQQRPIAPLVDSLRANGTKIEYLNNEGSLPIKVYTDSVFKGGRIELAATVSSQYVSSILMCAPYAEEPVTLALVGGKPISKLYVDMTIKMMEKFGINVETSTTEPYTYYIPKGHYINPSEYVIESDASSATYPLAFAAMTGTTVTVPNIGFESLQGDARFARDVLKPMGCKITQTATSTTVSGPPVGTLKPLKHVDMEPMTDAFLTACVVAAISHDSDPNSANTTTIEGIANQRVKECNRILAMATELAKFGVKTTELPDGIQVHGLNSIKDLKVPSDSSGPVGVCTYDDHRVAMSFSLLAGMVNSQNERDEVANPVRILERHCTGKTWPGWWDVLHSELGAKLDGAEPLECTSKKNSKKSVVIIGMRAAGKTTISKWCASALGYKLVDLDELFEQQHNNQSVKQFVVENGWEKFREEETRIFKEVIQNYGDDGYVFSTGGGIVESAESRKALKDFASSGGYVLHLHRDIEETIVFLQSDPSRPAYVEEIREVWNRREGWYKECSNFSFFAPHCSAEAEFQALRRSFSKYIATITGVREIEIPSGRSAFVCLTFDDLTEQTENLTPICYGCEAVEVRVDHLANYSADFVSKQLSILRKATDSIPIIFTVRTMKQGGNFPDEEFKTLRELYDIALKNGVEFLDLELTLPTDIQYEVINKRGNTKIIGSHHDFQGLYSWDDAEWENRFNQALTLDVDVVKFVGTAVNFEDNLRLEHFRDTHKNKPLIAVNMTSKGSISRVLNNVLTPVTSDLLPNSAAPGQLTVAQINKMYTSMGGIEPKELFVVGKPIGHSRSPILHNTGYEILGLPHKFDKFETESAQLVKEKLLDGNKNFGGAAVTIPLKLDIMQYMDELTDAAKVIGAVNTVIPLGNKKFKGDNTDWLGIRNALINNGVPEYVGHTAGLVIGAGGTSRAALYALHSLGCKKIFIINRTTSKLKPLIESLPSEFNIIGIESTKSIEEIKEHVGVAVSCVPADKPLDDELLSKLERFLVKGAHAAFVPTLLEAAYKPSVTPVMTISQDKYQWHVVPGSQMLVHQGVAQFEKWTGFKGPFKAIFDAVTKE

SEQ ID NO: 1636 - protein, 642 aa, Saccharomyces cerevisiae
MNIVKLQRKFPILTQEDLFSTIEKFRAIDLDDKGWVEKQQALEAVSKDGDATYDEARETLKHVGVDASGRVELDDYVGLVAKLRESKTGAAPQTTFNVAPNSTPIVSTAATGLQHKGKGTQAKIIVAGSQTGTTHTINEEERREFTKHINSVLAGDQDIGDLLPFPTDTFQLFDECRDGLVLSKLINDSVPDTIDTRVLNWPKKGKELNNFQASENANIVINSAKAIGCVVVNVHSEDIIEGREHLILGLIWQIIRRGLLSKIDIKLHPELYRLLEDDETLEQFLRLPPEQILLRWFNYHLKQANWNRRVTNFSKDVSDGENYTILLNQLDPALCSKAPLQTTDLMERAEQVLQNAEKLDCRKYLTPSSLVAGNPKLNLAFVAHLFNTHPGLEPIQEEEKPEIEEFDAEGEREARVFTLWLNSLDVDPPVISLFDDLKDGLILLQAYEKVMPGAVDFKHVNKRPASGAEISRFKALENTNYAVDLGRAKGFSLVGIEGSDIVDGNKLLTLGLVWQLMRRNISITMKTLSSSGRDMSDSQILKWAQDQVTKGGKNSTIRSFKDQALSNAHFLLDVLNGIAPGYVDYDLVTPGNTEEERYANARLAISIARKLGALIWLVPEDINEVRARLIITFIASLMTLNK

SEQ ID NO: 1637 - protein, 1515 aa, Saccharomyces cerevisiae
MAGNLVSWACKLCRSPEGFGPISFYGDFTQCFIDGVILNLSAIFMITFGIRDLVNLCKKKHSGIKYRRNWIIVSRMALVLLEIAFVSLASLNISKEEAENFTIVSQYASTMLSLFVALALHWIEYDRSVVANTVLLFYWLFETFGNFAKLINILIRHTYEGIWYSGQTGFILTLFQVITCASILLLEALPKKPLMPHQHIHQTLTRRKPNPYDSANIFSRITFSWMSGLMKTGYEKYLVEADLYKLPRNFSSEELSQKLEKNWENELKQKSNPSLSWAICRTFGSKMLLAAFFKAIHDVLAFTQPQLLRILIKFVTDYNSERQDDHSSLQGFENNHPQKLPIVRGFLIAFAMFLVGFTQTSVLHQYFLNVFNTGMYIKSALTALIYQKSLVLSNEASGLSSTGDIVNLMSVDVQKLQDLTQWLNLIWSGPFQIIICLYSLYKLLGNSMWVGVIILVIMMPLNSFLMRIQKKLQKSQMKYKDERTRVISEILNNIKSLKLYAWEKPYREKLEEVRNNKELKNLTKLGCYMAVTSFQFNIVPFLVSCCTFAVFVYTEDRALTTDLVFPALTLFNLLSFPLMIIPMVLNSFIEASVSIGRLFTFFTNEELQPDSVQRLPKVKNIGDVAINIGDDATFLWQRKPEYKVALKNINFQAKKGNLTCIVGKVGSGKTALLSCMLGDLFRVKGFATVHGSVAYVSQVPWIMNGTVKENILFGHRYDAEFYEKTIKACALTIDLAILMDGDKTLVGEKGISLSGGQKARLSLARAVYARADTYLLDDPLAAVDEHVARHLIEHVLGPNGLLHTKTKVLATNKVSALSIADSIALLDNGEITQQGTYDEITKDADSPLWKLLNNYGKKNNGKSNEFGDSSESSVRESSIPVEGELEQLQKLNDLDFGNSDAISLRRASDATLGSIDFGDDENIAKREHREQGKVKWNIYLEYAKACNPKSVCVFILFIVISMFLSVMGNVWLKHWSEVNSRYGSNPNAARYLAIYFALGIGSALATLIQTIVLWVFCTIHASKYLHNLMTNSVLRAPMTFFETTPIGRILNRFSNDIYKVDALLGRTFSQFFVNAVKVTFTITVICATTWQFIFIIIPLSVFYIYYQQYYLRTSRELRRLDSITRSPIYSHFQETLGGLATVRGYSQQKRFSHINQCRIDNNMSAFYPSINANRWLAYRLELIGSIIILGAATLSVFRLKQGTLTAGMVGLSLSYALQITQTLNWIVRMTVEVETNIVSVERIKEYADLKSEAPLIVEGHRPPKEWPSQGDIKFNNYSTRYRPELDLVLKHINIHIKPNEKVGIVGRTGAGKSSLTLALFRMIEASEGNIVIDNIAINEIGLYDLRHKLSIIPQDSQVFEGTVRENIDPINQYTDEAIWRALELSHLKEHVLSMSNDGLDAQLTEGGGNLSVGQRQLLCLARAMLVPSKILVLDEATAAVDVETDKVVQETIRTAFKDRTILTIAHRLNTIMDSDRIIVLDNGKVAEFDSPGQLLSDNKSLFYSLCMEAGLVNEN

SEQ ID NO: 1638 - protein, 752 aa, Saccharomyces cerevisiae [sequence omitted]

SEQ ID NO: 1639 - protein, 409 aa, Saccharomyces cerevisiae
NSNNTEFSIAYGDTTFASGTWGHDQLSLNDLNITGLSFAVANETNSTVGVLGIGLPGLESTYSGVSLSSVQKSYTYNNFPMVLKNSGVIKSTAYSLFANDSDSKHGTILFGAVDHGKYAGDLYTIPIINTLQHRGYKDPIQFQVTLQGLGTSKGDKEDNLTTLTTTKIPVLLDSGTTISYMPTELVKMLADQVGATYSSAYGYYIMDCIKEMEEESSIIFDFGGFYLSNWLSDFQLVTDSRSNICILGIAPQSDPTIILGDNFLANTYVVYDLDNMEISMAQANFSDDGEYIEIIESAVPSALKAPGYSSTWSTYESIVSGGNMFSTAANSSISYFASTSHSATSSSSSKGQKTQTSTTALSISKSTSSTSSTGMLSPTSSSSTRKENGGHNLNPPFFARFITAIFHHI

SEQ ID NO: 1640 - protein, 709 aa, Saccharomyces cerevisiae
MDTSNSWFDASKVQSLNFDLQTNSYYSNARGSDPSSYAIEGEYKTLATDDLGNILNLNYGETNEVIMNEINDLNLPLGPLSDEKSVKVSTFSELIGNDWQSMNFDLENNSREVTLNATSLLNENRLNQDSGMTVYQKTMSDKPHDEKKISMADNLLSTINKSEINKGFDRNLGELLLQQQQELREQLRAQQEANKKLELELKQTQYKQQQLQATLENSDGPQFLSPKRKISPASENVEDVYANSLSPMISPPMSNTSFTGSPSRRNNRQKYCLQRKNSSGTVGPLCFQELNEGFNDSLISPKKIRSNPNENLSSKTKFITPFTPKSRVSSATSNSANITPNNLRLDFKINVEDQESEYSEKPLGLGIELLGKPGPSPTKSVSLKSASVDIMPTIPGSVNNTPSVNKVSLSSSYIDQYTPRGKQLHFSSISENALGINAATPHLKPPSQQARHREGVFNDLDPNVLTKNTDNEGDDNEENEPESRFVISETPSPVLKSQSKYEGRSPQFGTHIKEINTYTTNSPSKITRKLTTLPRGSIDKYVKEMPDKTFECLFPGCTKTFKRRYNIRSHIQTHLEDRPYSCDHPGCDKAFVRNHDLIRHKKSHQEKAYACPCGKKFNREDALVVHRSRMICSGGKKYENVVIKRSPRKRGRPRKDGTSSVSSSPIKENINKDHNGQLMFKLEDQLRRERSYDGNGTGIMVSPMKTNQR

SEQ ID NO: 1641 - protein, 534 aa, Saccharomyces cerevisiae
MYTNYSLTSSDAMPRTYLVGTASPEMSKKKRQSANCDKPTRRVIHIIDTNEHSEVDLKNELPITCTNEDGEMTSSSWTSQTANDFLKLAYVNAKLDPSLPSQYFKQDIINVLQSLEIPGWSVPGSKESSLNKNLLTLTQIKGALTNVIYKIHYPNLPPLLMRIFGDSIDSVIDREYELKVIARLSFYDLGPKLEGFFENGRFEKYIEGSRTSTQADFIDRDTSIKIAKKLKELHCTVPLTHKEITDQPSCWTTFDQWIKLIDSHKEWVSNNVNISENLRCSSWNFFLKSFKNYKRWLYNDSAFTSKLLREDDKDSMINSGLKMVFCHNDLQHGNLLFKSKGKDDISVGDLTIIDFEYAGPNPVVFDLSNHLNEWMQDYNDVQSFKSHIDKYPKEEDILVFAQSYINHMNENHVKIASQEVRILYNLIIEWRPCTQLFWCLWALLQSGRLPQRPLIEGEKLMSEKAGLGDETHLMEHKNKENGKYDCSEDDSFNYLGFCKEKMSVFWGDLITLGVIDKDCPDIGKTDYLDTKLIF

SEQ ID NO: 1642 - protein, 463 aa, Saccharomyces cerevisiae
MLSRATRTAAAKSLVKSKVARNVMAASFVKRHASTSLFKQANKVESLGSIYLSGKKISVAANPFSITSNRFKSTSIEVPPMAESLTEGSLKEYTKNVGDFIKEDELLATIETDKIDIEVNSPVSGTVTKLNFKPEDTVTVGEELAQVEPGEAPAEGSGESKPEPTEQAEPSQGVAARENSSEETASKKEAAPKKEAAPKKEVTEPKKADQPKKTVSKAQEPPVASNSFTPFPRTETRVKMNRMRLRIAERLKESQNTAASLTTFNEVDMSALMEMRKLYKDEIIKKTGTKFGFMGLFSKACTLAAKDIPAVNGAIEGDQIVYRDYTDISVAVATPKGLVTPVVRNAESLSVLDIENEIVRLSHKARDGKLTLEDMTGGTFTISNGGVFGSLYGTPIINSPQTAVLGLHGVKERPVTVNGQIVSRPMMYLALTYDHRLLDGREAVTFLKTVKELIEDPRKMLLW

SEQ ID NO: 1643 - protein, 365 aa, Saccharomyces cerevisiae
MAGKKIAGVLGATGSVGQRFILLLANHPHFELKVLGASSRSAGKKYVDAVNWKQTDLLPESATDIIVSECKSEFFKECDIVFSGLDADYAGAIEKEFMEAGIAIVSNAKNYRREQDVPLIVPVVNPEHLDIVAQKLDTAKAQGKPRPGFIICISNCSTAGLVAPLKPLIEKFGPIDALTTTTLQAISGAGFSPGVPGIDILDNIIPYIGGEEDKMEWETKKILAPLAEDKTHVKLLTPEEIKVSAQCNRVAVSDGHTECISLRFKNRPAPSVEQVKTCLKEYVCDAYKLGCHSAPKQTIHVLEQPDRPQPRLDRNRDSGYGVSVGRIREDPLLDFKMVVLSHNTIIGAAGSGVLIAEILLARNLI

SEQ ID NO: 1644 - protein, 1301 aa, Saccharomyces cerevisiae
MNTSFGSVVPSTNFNFFKGHGNNDNTSANSTVNNSNFFLNSNETKPSKNVFMVHSTSQKKSQQPLQNLSHSPSYTENKPDKKKKYMINDAKTIQLVGPLISSPDNLGFQKRSHKARELPRFLINQEPQLEKRAFVQDPWDKANQEKMISLEESIDDLNELYETLKKMRNTERSIMEEKGLVDKADSAKDLYDAIVFQGTCLDMCPTFERSRRNVEYTVYSYEKNQPNDKKASRTKALKVFARPAAAAAPPLPSDVRPPHILVKTLDYIVDNLLTTLPESEGFLWDRMRSIRQDFTYQNYSGPEAVDCNERIVRIHLLILHIMVKSNVEFSLQQELEQLHKSLITLSEIYDDVRSSGGTCPNEAEFRAYALLSKIRDPQYDENIQRLPKHIFQDKLVQMALCFRRVISNSAYTERGFVKTENCLNFYARFFQLMQSPSLPLLMGFFLQMHLTDIRFYALRALSHTLNKKHKPIPFIYLENMLLFNNRQEIIEFCNYYSIEIINGDAADLKTLQHYSHKLSETQPLKKTYLTCLERRLQKTTYKGLINGGEDNLASSVYVKDPKKDRIPSIADQSFLMENFQNNYNEKLNQNSSVKPQINTSPKRVATRPNHFPFSQESKQLPQISQSHTLSTNPLLTPQVHGDLSEQKQQQIKTVTDGGSPFVFDQSAQNSTVEASKAHMISTTSNGAYDEKLSSEQEEMRKKEEQRIEEEKTQLKKKQENADKQVITEQIANDLVKEVVNSSVISIVKREFSEANYRKDFIDTMTRELYDAFLHERLYLIYMDSRAELKRNSTLKKKFFEKWQASYSQAKKNRILEEKKREEIKLVSHQLGVPGFKKSTCLFRTPYKGNVNSSFMLSSSDKNLIFSPVNDEFNKFATHLTKISKLWRPLEMQSIYYDNLTKKFPSNSLTPANLFIYAKDWTSLSNRWILSKFNLQTAQDSKKFSNNIISSRIICIDDEYEPSDFSDLQLLIFNTGVTNPDIFDLEMKLKDDGEELIKLITGISLNTNICFSLLIIYWESAENTLSESTIKHLLKLNRISKNYSSVIERIDLMNLTEESPHKCLEDKLSEISHSYVYKLTERGKYDKTLRQKRSLAGIHSRSTQLQTTKDIDQKMKKMLEKEKNKYQQQIGERNTYAHLESHIDASPRSKKRKLPILLSTSHSSQFKTPLASRLNTSGSSTSPPLPSHLAMKFRKNSRVTSLHTVLPVSTPSHSNNIPAASFSGNNTTDIQSQQLIENQKSTSVYLNNVSERILGNQEICQTPINPVTPVLDGADQGKEDIPDSILELKILIDSVKKKVNND

SEQ ID NO: 1645 - protein, 852 aa, Saccharomyces cerevisiae
MSSVNQIYDLFPNKHNIQFTDSHSQEHDTSSSLAKNDTDGTISIPGSIDTGILKSIIEEQGWNDAELYRSSIQNQRFFLTDKYTKKKHLTMEDMLSPEEEQIYQEPIQDFQTYNKRVQREYELRERMEEFFRQNTKNDLHILNEDSLNQQYSPLGPADYVLPLDRYSRMKHIASNFFRKKLGIPRKLKRRSHYNPNAEGHTKGNSSILSSTTDVIDNASYRNIAIDENVDITHKEHAIDEINEQGASGSESVVEGGSLLHDIEKVFNRSRATRKYHIQRKLKVRHIQMLSIGACFSVGLFLTSGKAFSIAGPFGTLLGFGLTGSIILATMLSFTELSTLIPVSSGFSGLASRFVEDAFGFALGWTYWISCMLALPAQVSSSTFYLSYYNNVNISKGVTAGFITLFSAFSIVVNLLDVSIMGEIVYVAGISKVIIAILMVFTMIILNAGHGNDIHEGVGFRYWDSSKSVRNLTYGLYRPTFDLADAGEGSKKGISGPKGRFLATASVMLISTFAFSGVEMTFLASGEAINPRKTIPSATKRTFSIVLISYVFLIFSVGINIYSGDPRLLSYFPGISEKRYEAIIKGTGMDWRLRTNCRGGIDYRQISVGTGYSSPWVVALQNFGLCTFASAFNAILIFFTATAGISSLFSCSRTLYAMSVQRKAPPVFEICSKRGVPYVSVIFSSLFSVIAYIAVDQTAIENFDVLANVSSASTSIIWMGLNLSFLRFYYALKQRKDIISRNDSSYPYKSPFQPYLAIYGLVGCSLFVIFMGYPNFIHHFWSTKAFFSAYGGLMFFFISYTAYKVLGTSKIQRLDQLDMDSGRREMDRTDWTEHSQYLGTYRERAKKLVTWLI

SEQ ID NO: 1646 - protein, 891 aa, Saccharomyces cerevisiae
DPLNGQEMSKELQHLPNDSMRLNYLVNSKQFNVKAFLRDMHKQDSFNDLNNSLDRLDSDIQDQSIHLKQLVGKNFTKYVKIKNKLDQIYKEFDEKTNEKNQCDSPKENQINVESLNKKVDEVIRTTTFKLKPLMDNYQKILNYQATKKFIELNKFYFNLPKSLKRCLTNNDFNEFIIEYSKGLTLRRRFNQSSDASQSLVIKRIWTQIENLLVTYKDLIWNSLINSNFNIDQPQETILSLFSKLLNLENFINNNQRESESGNKNTTSSSNENPILRWMSIKMNGFQNELNELSGHMISKIIHSQRLILQNNTNQDKSQGCVELSYYLKINQLFQIISDTGKDSEGLKSTVEPNKVNTISGTSYLNLNCQPSSQGLTDSPTIIEMWLLILKYINDLWKICDQFIEFWEHIEKFLDGTYQNSIINEKRKENILIGDSNIIESYQKSLILKEEQINEVRLKGEEFITSVSQNLISFFTSSQSSLPSSLKDSTGDITRSNKDSGSPLDYGFIPPNCNGLSCLRYLPKIVEPILKFSTELAQLNITTNGITICRNTLSTIINRCVGAISSTKLRDISNFYQLENWQVYETVTFSSKSQDSSKNLTFEYGVTQFPEIVTSFQEVSIKTTRDLLFAYEKLPIINGISVVSYPSKQLLTGIEIQQIISMEAVLEAILKNAAKDKDNPRNSHTILTLTNLQYFRECAFPNILQYFDDAFEWNLASKNLELFSLLSKMESSIFGNYLSDLKINLRDTLEEKFHEINWPMYTSNSFRVGDYIIEALMILIVVHSECFRIGPQLIHKILIETQIFIARYLFEAFKPYVGNLSNDGSLQIIVDLEFFQKVMGPLLEKDTEATLRACLQNCFQNDTNRLQKCINEINPIVSANLKRTAIQFAAFS

SEQ ID NO: 1647 - protein, 206 aa, Saccharomyces cerevisiae
MDFEEDYDAEFDDNQEGQLETPFPSVAGADDGDNDNDDSVAENMKKKQKREAVVDDGSENAFGIPEFTRKDKTLEEILEMMDSTPPIIPDAVIDYYLTKNGFNVADVRVKRLLALATQKFVSDIAKDAYEYSRIRSSVAVSNANNSQARARQLLQGQQQPGVQQISQQQHQQNEKTTASKVVLTVNDLSSAVAEYGLNIGRPDFYR

SEQ ID NO: 1648 - protein, 506 aa, Saccharomyces cerevisiae
MAIDYSKWDKIELSDDSDVEVHPNVDKKSFIKWKQQSIHEQRFKRNQDIKNLETQVDMYSHLNKRVDRILSNLPESSLTDLPAVTKFLNANFDKMEKSKGENVDPEIATYNEMVEDLFEQLAKDLDKEGKDSKSPSLIRDAILKHRAKIDSVTVEAKKKLDELYKEKNAHISSEDIHTGFDSSFMNKQKGGAKPLEATPSEALSSAAESNILNKLAKSSVPQTFIDFKDDPMKLAKETEEFGKISINEYSKSQKFLLEHLPIISEQQKDALMMKAFEYQLHGDDKMTLQVIHQSELMAYIKEIYDMKKIPYLNPMELSNVINMFFEKVIFNKDKPMGKESFLRSVQEKFLHIQKRSKILQQEEMDESNAEGVETIQLKSLDDSTELEVNLPDFNSKDPEEMKKVKVFKTLIPEKMQEAIMTKNLDNINKVFEDIPIEEAEKLLEVFNDIDIIGIKAILENEKDFQSLKDQYEQDHEDATMENLSLNDRDGGGDNHEEVKHTADTVD

SEQ ID NO: 1649 - protein, 375 aa, Saccharomyces cerevisiae
MSFYQPSLSLYDVLNALSNQTGQRGQQGYPRQPQRPQRYHPHYGQVHVGGHHPRHHPLYSRYNGVPNTYYYQFPGQAYYYSPEYGYDDEDGEEEDQDEDMVGDSGTTRQEDGGEDSNSRRYPSYYHCNTARNNRTNQQANSLNDLLTALIGVPPYEGTEPEIEANTEQEGEKGEEKDKKDKSEAPKEEAGETNKEKPLNQLEESSRPPLAKKSSSFAHLQAPSPIPDPLQVSKPETRMDLPFSPEVNVYDTEDTYVVVLALPGANSRAFHIDYHPSSHEMLIKGKIEDRVGIDEKFLKITELKYGAFERTVKFPVLPRIKDEEIKATYNNGLLQIKVPKIVNDTEKPKPKKRIAIEEIPDEELEFEENPNPTVEN

SEQ ID NO: 1650 - protein, 215 aa, Saccharomyces cerevisiae
MSRAKRIMKEIQAVKDDPAAHITLEFVSESDIHHLKGTFLGPPGTPYEGGKFVVDIEVPMEYPFKPPKMQFDTKVYHPNISSVTGAICLDILKNAWSPVITLKSALISLQALLQSPEPNDPQDAEVAQHYLRDRESFNKTAALWTRLYASETSNGQKGNVEESDLYGIDHDLIDEFESQGFEKDKIVEVLRRLGVKSLDPNDNNTANRIIEELLK

SEQ ID NO: 1651 - protein, 181 aa, Saccharomyces cerevisiae
MMLPRSMKFMTGRRIFHTATVRAFQSTAKKSLTIPFLPVLPQKPGGVRGTPNDAYVPPPENKLEGSYHWYMEKIFALSVVPLATTAMLTTGPLSTAADSFFSVMLLGYCYMEFNSCITDYISERVYGVWHKYAMYMLGLGSAVSLFGIYKLETENDGVVGLVKSLWDSSEKDNSQKIEAKK

SEQ ID NO: 1652 - protein, 491 aa, Saccharomyces cerevisiae
MVYRNRSKSVLSTHSKKSDDKAHYKSRSKKKSKSRSKKRLRIYWRYISIVWILWLGLISYYESVVVKRAMKKCQWSTWEDWPEGAESHRVGLFADPQIMDEYSYPGRPQIVNYFTRVIVDHYHRRNWKYVQYYLDPDSNFFLGDLFDGGRNWDDKQWIKEYTRFNQIFPKKPLRRTVMSLPGNHDIGFGDTVVESSLQRFSSYFGETSSSLDAGNHTFVLLDTISLSDKTNPNVSRVPRQFLDNFAMGSHPLPRILLTHVPLWRDPEQQTCGQLRESKEPFPIQKGHQYQTVIENDISQEILTKIQPEILFSGDDHDHCQISHSYPFQGKTKNAQEITVKSCAMNMGISRPAIQLLSLYNPSDLTMVNAGGEYASKTYQTELCYMPDPYKAIRMYLWGLLFSAAFIAYMHFFPKSFNNRVATIMNRVFTRPDGNTSDLPLPTSISKSKSKKSLTHSKYAVNDTRSIKQFLVNAIVLFVSVMPIFIYFYTVV

SEQ ID NO: 1653 - protein, 546 aa, Saccharomyces cerevisiae
MSLQLLNPKAESLRRDAALKVNVTSAEGLQSVLETNLGPKGTLKMLVDGAGNIKLTKDGKVLLTEMQIQSPTAVLIARAAAAQDEITGDGTTTVVCLVGELLRQAHRFIQEGVHPRIITDGFEIARKESMKFLDEFKISKTNLSNDREFLLQVARSSLLTKVDADLTEVLTPIVTDAVLSVYDAQADNLDLHMVEIMQMQHLSPKDTTFIKGLVLDHGGRHPDMPTRVKNAYVLILNVSLEYEKTEVNSGFFYSSADQRDKLAASERKFVDAKLKKIIDLKNEVCGMDPDKGFVIINQKGIDPMSLDVFAKHNILALRRAKRRNMERLQLVTGGEAQNSVEDLSPQILGFSGLVYQETIGEEKFTYVTENTDPKSCTILIKGSTHYALAQTKDAVRDGLRAVANVLKDKNIIPGAGAFYIALSRYLRSANMNKLGAKGKTKTGIEAFAEALLVIPKTLVKNSGFDPLDVLAMVEDELDDAQDSDETRYVGVDLNIGDSCDPTIEGIWDSYRVLRNAITGATGIASNLLLCDELLRAGRSTLKETPQ

SEQ ID NO: 1654 - protein, 664 aa, Saccharomyces cerevisiae
MLTSILIKGRTPVLASRNLLAALSNCNHITWAVSRRLYNDGNRDQRNFGRNQRNNNSNRYRNSRFNSRPRTRSREDDDEVHFDKTTFSKLIHVPKEDNSKEVTLDSLLEEGVLDKEIHKAITRMEFPGLTPVQQKTIKPILSSEDHDVIARAKTGTGKTFAFLIPIFQHLINTKFDSQYMVKAVIVAPTRDLALQIEAEVKKIHDMNYGLKKYACVSLVGGTDFRAAMNKMNKLRPNIVIATPGRLIDVLEKYSNKFFRFVDYKVLDEADRLLEIGFRDDLETISGILNEKNSKSADNIKTLLFSATLDDKVQKLANNIMNKKECLFLDTVDKNEPEAHERIDQSVVISEKFANSIFAAVEHIKKQIKERDSNYKAIIFAPTVKFTSFLCSILKNEFKKDLPILEFHGKITQNKRTSLVKRFKKDESGILVCTDVGARGMDFPNVHEVLQIGVPSELANYIHRIGRTARSGKEGSSVLFICKDELPFVRELEDAKNIVIAKQEKYEPSEEIKSEVLEAVTEEPEDISDIVISLISSYRSCIKEYRFSERRILPEIASTYGVLLNDPQLKIPVSRRFLDKLGLSRSPIGKAMFEIRDYSSRDGNNKSYDYDDDSEISFRGNKNYNNRSQNRDYDDEPFRRSNNNRRSFSRSNDKNNYSSRNSNIY

SEQ ID NO: 1655 - protein, 559 aa, Saccharomyces cerevisiae
MSQLFNNSRSDTLFLGGEKISGDDIRNQNVLATMAVANVVKSSLGPVGLDKMLVDDIGDFTVTNDGATILSLLDVQHPAGKILVELAQQQDREIGDGTTSVVIIASELLKRANELVKNKIHPTTIITGFRVALREAIRFINEVLSTSVDTLGKETLINIAKTSMSSKIIGADSDFFSNMVVDALLAVKTQNSKGEIKYPVKAVNVLKAHGKSATESLLVPGYALNCTVASQAMPKRIAGGNVKIACLDLNLQKARMAMGVQINIDDPEQLEQIRKREAGIVLERVKKIIDAGAQVVLTTKGIDDLCLKEFVEAKIMGVRRCKKEDLRRIARATGATLVSSMSNLEGEETFESSYLGLCDEVVQAKFSDDECILIKGTSKHSSSSIILRGANDYSLDEMERSLHDSLSVVKRTLESGNVVPGGGCVEAALNIYLDNFATTVGSREQLAIAEFAAALLIIPKTLAVNAAKDSSELVAKLRSYHAASQMAKPEDVKRRSYRNYGLDLIRGKIVDEIHAGVLEPTISKVKSLKSALEACVAILRIDTMITVDPEPPKEDPHDH

SEQ ID NO: 1656 - protein, 1309 aa, Saccharomyces cerevisiae
MSGQLVQWKSSPDRVTQSAIKEALHSPLADGDMNEMNVPVDPLENKVNSTNIIEGSPKANPNPVKFMNTSEIFQKSLGLLDESPRHDDELNIEVGDNDRPNANILHNERTPDLDRIANFFKSNRTPGKENLLTKYQSSDLEDTPLMLRKKMTFQTPTDPLEQKTFKKLKSDTGFCYYGEQNDGEENASLEVTEADATFVQMAERSADNYDCALEGIVTPKRYKDELSKSGGMQDERVQKTQIMISAESPNSISSYDKNKITGNGRTTRNVNKVFNNNEDNIGAIEEKNPVKKKSENYSSDDLRERNNQIIQSNESEEINELEKNLNVSGRENDVNNLDIDINSAVSGTPSRNNAEEEMYSSESVNNREPSKKWIFRYSKDKTENNSNRSTQIVNNPRTQEMPLDSISIDTQPLSKSFNTETNNELETQIIVSSLSQGISAQKGPVFHSTGQTEEIKTQIINSPEQNALNATFETPVTLSRINFEPILEVPETSSPSKNTMSKPSNSSPIPKEKDTFNIHEREVETNNVFSNDIQNSSNAATRDDIIIAGSSDFNEQKEITDRIYLQLSGKQISDSGSDETERMSPNELDTKKESTIMSEVELTQELPEVEEQQDLQTSPKKLVVEEETLMEIKKSKGNSLQLHDDNKECNSDKQDGTESLDVALIEHESKGQSSELQKNLMQLFPSESQEIIQNRRTIKRRQKDTIEIGEEEENRSTKTSPTKHLKRNSDLDAASIKREPSCSITIQTGETGSGKDSKEQSYVFPEGIRTADNSFLSKDDIIFGNAVWCQYTWNYKFYPGILLEVDTNQDGCWIYFETGRSLTKDEDIYYLDIRIGDAVTFDGNEYVVVGLECRSHDLNIIRCIRGYDTVHLKKKNASGLLGKRTLIKALSSISLDLSEWAKRAKIILEDNEKNKGDAYRYLRHPIRGRKSMTNVLSPKKHTDDEKDINTHTEVYNNEIESSSEKKEIVKKDSRDALAEHAGAPSLLFSSGEIRTGNVFDKCIFVLTSLFENREELRQTIESQGGTVIESGFSTLFNFTHPLAKSLVNKGNTDNIRELALKLAWKPHSLFADCRFACLITKRHLRSLKYLETLALGWPTLHWKFISACIEKKRIVPHLIYQYLLPSGESFRLSLDSPSKGGIIKSNNIFSFYTQFLRGSNLRDQICGVKKMLNDYIVIVWGRSELDSFVKFAFACLSAGRMLTIDLPNIDVDDTEPLLNALDSLVPRIGSELSNRKLKFLIYANENNGKSQMKLLERLRSQISLKFKKFNYIFHTESKEWLIQTIINEDTGFHDDITDNDIYNTISEVR

SEQ ID NO: 1657 - protein, 423 aa, Saccharomyces cerevisiae
MFPMKDHSALEQHTLSRDELRRRKGYKKGLQLSILLLGEKGSGKSTFLNNLCGQDISLSDGDYDDDDDKVTNNVTPENGNAIEDIDPGYKTAHLSPGLKLVTRRVYLNDELGVPITLDIILFPGCGDNVDNSQSSVVIKNYLDQQFANVLKEEVRIKRNTKETDGRPHVCLYFLKSTPRGVKKFDIELMKTICDKVNLIPIIPKADGLTETELNLHKDIVRQEISQNNIRVFDFKSDTLGETLALYDMDIDSSSAKSKYDNDTKIKEISPFAIVCSKTFNKNSENRVEHIRTYEWGSLVVEDQNTSDFIYLKAILLGSHLQELKDVTNNVLYENYRAKVLTEKKNNYDIPNYSYIDETSRGSVSNVSTRRNSASRTLGNPDTNDENAYQIHKEIDEKNRIIEDYQRKIDLLEKMLAAPHQNKV

SEQ ID NO: 1658 - protein, 1358 aa, Saccharomyces cerevisiae
MPNDNKTPNRSSTPKFTKKPVTPNDKIPEREEKSNEVKTPKIPLFTFAKSKNYSRPSTAIHTSPHQPSDVKPTSHKQLQQPKSSPLKKNNYNSFPHSNLEKISNSKLLSLLRSKTSAGRIESNNPSHDASRSLASFEQTAFSRHAQQQTSTFNSKPVRTIVPISTSQTNNSFLSGVKSLLSEEKIRDYSKEILGINLANEQPVLEKPLKKGSADIGASVISLTKDKSIRKDTVEEKKEEKLNIGKNFAHSDSLSVPKVSAGDSGISPEESKARSPGIAKPNAIQTEVYGINEESTNERLEINQEKPVKLDENSANSTVASALDTNGTSATTETLTSKKIVPSPKKVAIDQDKITLHDEKTLAPSKHQPITSEQKMKEDADLKRMEILKSPHLSKSPADRPQGRRNSRNFSTRDEETTKLAFLVEYEGQENNYNSTSRSTEKKNDMNTSAKNKNGENKKIGKRPPEIMSTEAHVNKVTEETTKQIQSVRIDGRKVLQKVQGESHIDSRNNTLNVTPSKRPQLGEIPNPMKKHKPNEGRTPNISNGTINIQKKLEPKEIVRDILHTKESSNEAKKTIQNPLNKSQNTALPSTHKVTQKKDIKIGTNDLFQVESAPKISSEIDRENVKSKDEPVSKAVESKSLLNLFSNVLKAPFIKSESKPFSSDALSKEKANFLETIASTEKPENKTDKVSLSQPVSASKHEYSDNFPVSLSQPSKKSFANHTEDEQIEKKKICRGRMNTIITHPGKMELVYVSDSDDSSSDNDSLTDLESLSSGESNEIKVTNDLDTSAEKDQIQAGKWFDPVLDWRKSDRELTKNILWRIADKTTYDKETITDLIEQGIPKHSYLSGNPLTSVTNDICSVENYETSSAFFYQQVHKKDRLQYLPLYAVSTFENTNNTEKNDVTNKNINIGKHSQEQNSSSAKPSQIPTVSSPLGFEETKLSTTPTKSNRRVSHSDTNSSKPKNTKENLSKSSWRQEWLANLKLISVSLVDEFPSELSDSDRQIINEKMQLLKDIFANNLKSAISNNFRESDIIILKGEIEDYPMSSEIKIYYNELQNKPDAKKARFWSFMKTQRFVSNMGFDIQKSCEPVSISTSVKPHVVEPEHMADAKIMPKDILQITKKPLMVKNVKPSSPPDVKSLVQLSTMETKTLPEKKQFDSIFNSNKAKIIPGNGKHASENISLSFSRPASYGYFSVGKRVPIVEDRRVKQLDDITDSNTTEILTSVDVLGTHSQTGTQQSNMYTSTQKTELEIDNKDSVTECSKDMKEDGLSFVDIVLSKAASALDEKEKQLAVANEIIRSLSDEVMRNEIRITSLQGDLTFTKKCLENARSQISEKDAKINKLMEKDFQVNKEIKPY

SEQ ID NO: 1659 - protein, 548 aa, Saccharomyces cerevisiae
MQRSIFARFGNSSAAVSTLNRLSTTAAPHAKNGYATATGAGAAAATATASSTHAAAAAAAAANHSTQESGFDYEGLIDSELQKKRLDKSYRYFNNINRLAKEFPLAHRQREADKVTVWCSNDYLALSKHPEVLDAMHKTIDKYGCGAGGTRNIAGHNIPTLNLEAELATLHKKEGALVFSSCYVANDAVLSLLGQKMKDLVIFSDELNHASMIVGIKHANVKKHIFKHNDLNELEQLLQSYPKSVPKLIAFESVYSMAGSVADIEKICDLADKYGALTFLDEVHAVGLYGPHGAGVAEHCDFESHRASGIATPKTNDKGGAKTVMDRVDMITGTLGKSFGSVGGYVAASRKLIDWFRSFAPGFIFTTTLPPSVMAGATAAIRYQRCHIDLRTSQQKHTMYVKKAFHELGIPVIPNPSHIVPVLIGNADLAKQASDILINKHQIYVQAINFPTVARGTERLRITPTPGHTNDLSDILINAVDDVFNELQLPRVRDWESQGGLLGVGESGFVEESNLWTSSQLSLTNDDLNPNVRDPIVKQLEVSSGIKQ

SEQ ID NO: 1660 - protein, 588 aa, Saccharomyces cerevisiae
MARPIDVSQLIAGINKKKGLDENTSGKISKPRFLNKQERSKQERLKENEESLTPTQSDSAKVEIKKVNSRDDSFFNETNDKKRNPSKQNGSKFHFSWNESEDTLSGYDPIVSTRAIDLLWKGKTPKNAAESSYMGKHWTEKSLHEMNERDWRILKEDYAIVTKGGTVENPLRNWEELNIIPRDLLRVIIQELRFPSPTPIQRITIPNVCNMKQYRDFLGVASTGSGKTLAFVIPILIKMSRSPPRPPSLKIIDGPKALILAPTRELVQQIQKETQKVTKIWSKESNYDCKVISIVGGHSLEEISFSLSEGCDILVATPGRLIDSLENHLLVMKQVETLVLDEADKMIDLGFEDQVTNILTKVDINADSAVNRQTLMFTATMTPVIEKIAAGYMQKPVYATIGVETGSEPLIQQVVEYADNDEDKFKKLKPIVAKYDPPIIIFINYKQTADWLAEKFQKETNMKVTILHGSKSQEQREHSLQLFRTNKVQIMIATNVAARGLDIPNVSLVVNFQISKKMDDYIHRIGRTGRAANEGTAVSFVSAAEDESLIRELYKYVRKHDPLNSNIFSEAVKNKYNVGKQLSNEIIY

SEQ ID NO: 1661 - protein, 393 aa, Saccharomyces cerevisiae
MSSVPYNSQLPISNHLEYDEDEKKSRGSKLGLKYKMIYWRKTLCSSLARWRKLILLISLALFLFIWISDSTISRNPSTTSFQGQNSNDNKLSNTGSSINSKRYVPPYSKRSRWSFWNQDPRIVIILAANEGGGVLRWKNEQEWAIEGISIENKKAYAKRHGYALTIKDLTTSKRYSHEYREGWQKVDILRQTFREFPNAEWFWWLDLDTMIMEPSKSLEEHIFDRLETLADRELKSFNPLNLRDDIPYVDYSEEMEFLITQDCGGFNLGSFLIKNSEWSKLLLDMWWDPVLYEQKHMVWEHREQDALEALYENEPWIRSRIGFLPLRTINAFPPGACSEYSGDSRYFYSEKDHDFVVNMAGCNFGRDCWGEMQYYTTLMEKLNRKWYTRFFFP

SEQ ID NO: 1662 - protein, 193 aa, Saccharomyces cerevisiae
MTEKHKTMGKFKVIVLAGTAGTGKSTIAGELIHEFKDIYPDLKFIEGDDLHPPANVEKMTRGIPLNDDDRWDWLKKVAVESTKAAASTKEHLSIVACSSLKKKYRDLIRHTCPESEFHFIFLYASKIEVLKRLKTRKGHFMKADMMESQFRDLELPDINDETDCDIVPLDFKTFYQIEKDVIQVVKSKVLNIE

SEQ ID NO: 1663 - protein, 659 aa, Saccharomyces cerevisiae
MTSALRVLVCGDHPNLILYTSRFQHAKNIEFYLVNNSKNANYEVSSLFYGTERFQIQNHFQSLLDLVDLNNENGGLVFDLIIMSASSLQEIPQVLRDIKPMMNKTTKILFESSGFIYLEPFIKASVDLSLSNIFSIFTDYDIRRLDNGSYKQFTTANAKSFSVSIGQTTSVHENSYSSDIIPILNTFQKLFQKLFPRDVVTLYDHSPSAFLAKEWELALPQICFDPLLIILEEKNPSTLDDHVLAKPLISGLLGESLLIIKKMGIAMNNPNFQNEQTILKHWKNKCEDLPDGPALLYNFIHKASSLNIDLLLLQPILLADDFGVKTPYLECLFTMMTQYQLLNKGDSEWFIRKDENTALTRVDDLQNSIALKDGKIMQLQNSESTLKNEIKELQSQVLSLKQEVSSSKANNGQELEILKKKVQMGDNSLFDRPNSNTNGISPSDNIVDVDLNYERSDQGNNSSGNDSRRQSFFNSTSDTTLSRDETSLKERELEVRMKELELQERELELQRKALQQQQQYQQRPPKQVYSGPSGTPTSGNNNNKSYNPNRKSSYSQPQHVAMMTSRGLHGPSAASSSPVISANNFVDPVSSGTPYSSNSSRFSQQIPSQQYMHTVKPTSRKNRSSVMPNIGYVPGLTNNEYGRKFNGNGMNGTQSRLNS

SEQ ID NO: 1664 - protein, 515 aa, Saccharomyces cerevisiae
MSKLGQEKNEVNYSDVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKFYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQGQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAEAKHASELSSNSKF

SEQ ID NO: 1665 - protein, 811 aa, Saccharomyces cerevisiae
MLRQATKAPIQKYLQRTQLLRRSTPRIYTIVQCKRSICSFNARPRVANKLLSDIKTNALNEVAISTCALKSSYGLPNFKRTYVQMRMDPNQQPEKPALEQFGTNLTKLARDGKLDPVIGRDEEIARAIQILSRRTKNNPCLIGRAGVGKTALIDGLAQRIVAGEVPDSLKDKDLVALDLGSLIAGAKYRGEFEERLKKVLEEIDKANGKVIVFIDEVHMLLGLGKTDGSMDASNILKPKLARGLRCISATTLDEFKIIEKDPALSRRFQPILLNEPSVSDTISILRGLKERYEVHHGVRITDTALVSAAVLSNRYITDRFLPDKAIDLVDEACAVLRLQHESKPDEIQKLDRAIMKIQIELESLKKETDPVSVERREALEKDLEMKNDELNRLTKIWDAERAEIESIKNAKANLEQARIELEKCQREGDYTKASELRYSRIPDLEKKVALSEKSKDGDKVNLLHDSVTSDDISKVVAKMTGIPTETVMKGDKDRLLYMENSLKERVVGQDEAIAAISDAVRLQRAGLTSEKRPIASFMFLGPTGTGKTELTKALAEFLFDDESNVIRFDMSEFQEKHTVSRLIGAPPGYVLSESGGQLTEAVRRKPYAVVLFDEFEKAHPDVSKLLLQVLDEGKLTDSLGHHVDFRNTIIVMTSNIGQDILLNDTKLGDDGKIDTATKNKVIEAMKRSYPPEFINRIDDILVFNRLSKKVLRSIVDIRIAEIQDRLAEKRMKIDLTDEAKDWLTDKGYDQLYGARPLNRLIHRQILNSMATFLLKGQIRNGETVRVVVKDTKLVVLPNHEEGEVVEEEAEK

SEQ ID NO: 1666 - protein, 430 aa, Saccharomyces cerevisiae
MGIPGLLPQLKRIQKQVSLKKYMYQTLAIDGYAWLHRASCACAFELVMNKPTNKYLQFFIKRLQLLKRLKIKPYIVFDGDSLFVKNHTETRRRKKRLENEMIAKKLWSAGNRYNAMEYFQKSVDITPEMAKCIIDYCKLHSIPYIVAPFEADPQMVYLEKMGLIQGIISEDSDLLVFGCKTLITKLNDQGKALEISKDDFSALPENFPLGELSEQQFRNLVCLAGCDYTSGIWKVGVVTAMKIVKRYSEMKDILIQIERTEKLCFSKAFKQQVEFANYAFQYQRVFCPLSNQITTLNNIPKAVTNSHAEIIKIMKCIGSVVERGSGVRKDVINTKNIDHKVHEMIAKGELHPVDMASKLINRERKLKARKLFKVGLLGGESNSFNKKVEQPLVDTQDVLSERENSLDNKNASSIYMTSPAAISGTVPSIF

SEQ ID NO: 1667 - protein, 764 aa, Saccharomyces cerevisiae
MVNELENVPRASTLTNEEQTVDPSNNDSQEDISLGDSNEITSLASLKAIRSGNEEESGNEQVNHNDEAEEDPLLTRYHTACQRGDLATVKEMIHGKLLEVNNDGDSTEHITGLHWASINNRLSVVDFLVSQGADVNARAGALHATPLHWAARYGYVYIVDFLLKHGADPTMTDDQGFNLLHLSVNSSNIMLVLYVLFNVVSKGLLDIDCRDPKGRTSLLWAAYQGDSLTVAELLKFGASIKIADTEGFTPLHWGTVKGQPHVLKYLIQDGADFFQKTDTGKDCFAIAQEMNTVYSLREALTHSGFDYHGYPIKKWFKKSQHAKLVTFITPFLFLGIAFALFSHINPLFVIIVLFLLAIATNKGLNKFVLPSYGRMGVHNVTLLRSPLLSGVFFGTLLWVTIVWFFKVMPRTFSDEQYTNILMLVILVSVFYLFGQLVIMDPGCLPEETDHENVRQTISNLLEIGKFDTKNFCIETWIRKPLRSKFSPLNNAVVARFDHYCPWIFNDVGLKNHKAFIFFITLMESGIFTFLALCLEYFDELEDAHEDTSQKNGKCFILGASDLCSGLIYDRFVFLILLWALLQSIWVASLIFVQAFQICKGMTNTEFNVLMKESKSIGPDGLSFNENFNTTPEGFAPSIDPGEESNDTVLAPVPGSTIRKPRTCFGVCYAVTGMDQWLAVIKETIGIKDSTGHNVYSITSRIPTNYGWKRNVKDFWLTSDINAPLWRRILYPPSGSKALLNGIEVDYFKLYKLPNKDVEQGNDMV

SEQ ID NO: 1668 - protein, 1004 aa, Saccharomyces cerevisiae
MREVILAVHGMTCSACTNTINTQLRALKGVTKCDISLVTNECQVTYDNEVTADSIKEIIEDCGFDCEILRDSEITAISTKEGLLSVQGMTCGSCVSTVTKQVEGIEGVESVVVSLVTEECHVIYEPSKTTLETAREMIEDCGFDSNIIMDGNGNADMTEKTVILKVTKAFEDESPLILSSVSERFQFLLDLGVKSIEISDDMHTLTIKYCCNELGIRDLLRHLERTGYKFTVFSNLDNTTQLRLLSKEDEIRFWKKNSIKSTLLAIICMLLYMIVPMMWPTIVQDRIFPYKETSFVRGLFYRDILGVILASYIQFSVGFYFYKAAWASLKHGSGTMDTLVCVSTTCAYTFSVFSLVHNMFHPSSTGKLPRIVFDTSIMIISYISIGKYLETLAKSQTSTALSKLIQLTPSVCSIISDVERNETKEIPIELLQVNDIVEIKPGMKIPADGIITRGESEIDESLMTGESILVPKKTGFPVIAGSVNGPGHFYFRTTTVGEETKLANIIKVMKEAQLSKAPIQGYADYLASIFVPGILILAVLTFFIWCFILNISANPPVAFTANTKADNFFICLQTATSVVIVACPCALGLATPTAIMVGTGVGAQNGVLIKGGEVLEKFNSITTFVFDKTGTLTTGFMVVKKFLKDSNWVGNVDEDEVLACIKATESISDHPVSKAIIRYCDGLNCNKALNAVVLESEYVLGKGIVSKCQVNGNTYDICIGNEALILEDALKKSGFINSNVDQGNTVSYVSVNGHVFGLFEINDEVKHDSYATVQYLQRNGYETYMITGDNNSAAKRVAREVGISFENVYSDVSPTGKCDLVKKIQDKEGNNKVAVVGDGINDAPALALSDLGIAISTGTEIAIEAADIVILCGNDLNTNSLRGLANAIDISLKTFKRIKLNLFWALCYNIFMIPIAMGVLIPWGITLPPMLAGLAMAFSSVSVVLSSLMLKKWTPPDIESHGISDFKSKFSIGNFWSRLFSTRAIAGEQDIESQAGLMSNEEVL

SEQ ID NO: 1669 - protein, 274 aa, Saccharomyces cerevisiae
MQVKSIKMRWESGGVNYCYLLSDSKNKKSWLIDPAEPPEVLPELTEDEKISVEAIVNTHHHYDHADGNADILKYLKEKNPTSKVEVIGGSKDCPKVTIIPENLKKLHLGDLEITCIRTPCHTRDSICYYVKDPTTDERCIFTGDTLFTAGCGRFFEGTGEEMDIALNNSILETVGRQNWSKTRVYPGHEYTSDNVKFVRKIYPQVGENKALDELEQFCSKHEVTAGRFTLKDEVEFNPFMRLEDPKVQKAAGDTNNSWDRAQIMDKLRAMKNRM

SEQ ID NO: 1670 - protein, 289 aa, Saccharomyces cerevisiae
MNRVSFIKTPFNIGAKWRLEDVFLLIIMILLNYPVYYQQPFERQFYINDLTISHPYATTERVNNNMLFVYSFVVPSLTILIIGSILADRRHLIFILYTSLLGLSLAWFSTSFFTNFIKNWIGRLRPDFLDRCQPVEGLPLDTLFTAKDVCTTKNHERLLDGFRTTPSGHSSESFAGLGYLYFWLCGQLLTESPLMPLWRKMVAFLPLLGAALIALSRTQDYRHHFVDVILGSMLGYIMAHFFYRRIFPPIDDPLPFKPLMDDSDVTLEEAVTHQRIPDEELHPLSDEGM

SEQ ID NO: 1671 - protein, 875 aa, Saccharomyces cerevisiae
MSNFFRDSSMGFKPRPNIFAKLRVRDVDSDSSANTVVENSSNCLDVGSSIEGDDTFKKPHKTSTEQELITSMSLSQRNHGYSDDMEIGSPKKTTSTDQYNRILKNDVAAIENDTDEDFEITEVREVSEGVAKETKESHGDPNDSETTLKDSKMHEYTMTNGKAPLHTSINNSSTSSNDVLLEAFTNTQRICSNLKQELQKQQQDNAKLKVRLQSYASNSDKINEKVGKYKSCLETLQERIATLTSHKNNQETKLKDLRQNHQLYQRRISGFKTSIENLNKTINDLGKNKKEADAELMKKGKEIEYLKRELDDCSGQLSEEKIKNSSLIQEMGKNREEMIKSIENFFSEDKAHHLLQFNKFEERVHDLFEKKLQKHFDVAKDTLNVGLRNTTVELSSNTETMLKQQYEDIKENLEQKMSSSKDEMAKTINELSVTQKGLIMGVQEELLTSSGNIQTALVSEMNNTRQELLDDASQTAKNYASLENLVKAYKAEIVQSNEYEERIKHLESERSTLSSQKNQIISSLGTKEAQYEDLVKKLEAKNIEISQISGKEQSLTEKNENLSNELKKVQDQLEKLNNLNITTKSNYENKISSQNEIVKALVSENDTLKQRIQQLVEIKENEQKDHTTKLEAFQKNNEQLQKLNVEVVQLKAHELELEEQNRHLKNCLEKKETGVEESLSDVKTLKQQVIVLKSEKQDITAEKLELQDNLESLEEVTKNLQQKVQSQKRELEQKIKELEEIKNHKRNEPSKKGTQNFTKPSDSPKKNATTSNLFPNNSAAIHSPMKKCPKVDHISKSRINSSKETSKFNDEFDLSSSSNDDLELTNPSPIQIKPVRGKIKKGSNCMKPPISSRKKLLLVEDEDQSLKISKKRRRK

SEQ ID NO: 1672 - protein, 1250 aa, Saccharomyces cerevisiae
MSKNSNVNNNRSQEPNNMFVQTTGGGKNAPKQIHVAHRRSQSELTNLMIEQFTLQKQLEQVQAQQQQLMAQQQQLAQQTGQYLSGNSGSNNHFTPQPPHPHYNSNGNSPGMSAGGSRSRTHSRNNSGYYHNSYDNNNNSNNPGSNSHRKTSSQSSIYGHSRRHSLGLNEAKKAAAEEQAKRISGGEAGVTVKIDSVQADSGSNSTTEQSDFKFPPPPNAHQGHRRATSNLSPPSFKFPPNSHGDNDDEFIATSSTHRRSKTRNNEYSPGINSNWRNQSQQPQQQLSPFRHRGSNSRDYNSFNTLEPPAIFQQGHKHRASNSSVHSFSSQGNNNGGGRKSLFAPYLPQANIPELIQEGRLVAGILRVNKKNRSDAWVSTDGALDADIYICGSKDRNRALEGDLVAVELLVVDDVWESKKEKEEKKRRKDASMQHDLIPLNSSDDYHNDASVTAATSNNFLSSPSSSDSLSKDDLSVRRKRSSTINNDSDSLSSPTKSGVRRRSSLKQRPTQKKNDDVEVEGQSLLLVEEEEINDKYKPLYAGHVVAVLDRIPGQLFSGTLGLLRPSQQANSDNNKPPQSPKIAWFKPTDKKVPLIAIPTELAPKDFVENADKYSEKLFVASIKRWPITSLHPFGILVSELGDIHDPDTEIDSILRDNNFLSNEYLDQKNPQKEKPSFQPLPLTAESLEYRRNFTDTNEYNIFAISELGWVSEFALHVRNNGNGTLELGCHVVDVTSHIEEGSSVDRRARKRSSAVFMPQKLVNLLPQSFNDELSLAPGKESATLSVVYTLDSSTLRIKSTWVGESTISPSNILSLEQLDEKLSTGSPTSYLSTVQEIARSFYARRINDPEATLLPTLSLLESLDDEKVKVDLNILDRTLGFVVINEIKRKVNSTVAEKIYTKLGDLALLRRQMQPIATKMASFRKKIQNFGYNFDTNTADELIKGVLKIKDDDVRVGIEILLFKTMPRARYFIAGKVDPDQYGHYALNLPIYTHFTAPMRRYADHVVHRQLKAVIHDTPYTEDMEALKITSEYCNFKKDCAYQAQEQAIHLLLCKTINDMGNTTGQLLTMATVLQVYESSFDVFIPEFGIEKRVHGDQLPLIKAEFDGTNRVLELHWQPGVDSATFIPADEKNPKSYRNSIKNKFRSTAAEIANIELDKEAESEPLISDPLSKELSDLHLTVPNLRLPSASDNKQNALEKFISTTETRIENDNYIQEIHELQKIPILLRAEVGMALPCLTVRALNPFMKRV

SEQ ID NO: 1673 - protein, 349 aa, Saccharomyces cerevisiae
MNVTSNATAAGSFPLAFGLKTSFGFMHYAKAPAINLRPKESLLPEMSDGVLALVAPVVAYWALSGIFHVIDTFHLAEKYRIHPSEEVAKRNKASRMHVFLEVILQHIIQTIVGLIFMHFEPIYMTGFEENAMWKLRADLPRIIPDAAIYYGYMYGMSALKIFAGFLFVDTWQYFLHRLMHMNKTLYKWFHSVHHELYVPYAYGALFNNPVEGFLLDTLGTGIAMTLTHLTHREQIILFTFATMKTVDDHCGYALPLDPFQWLFPNNAVYHDIHHQQFGIKTNFAQPFFTFWDNLFQTNFKGFEEYQKKQRRVTIDKYKEFLQERELEKKEKLKNFKAMNAAENEVKKEK

SEQ ID NO: 1674 - protein, 212 aa, Saccharomyces cerevisiae
MFNRVFTRSFASSLRAAASKAAAPPPVRLFGVEGTYATALYQAAAKNSSIDAAFQSLQKVESTVKKNPKLGHLLLNPALSLKDRNSVIDAIVETHKNLDGYVVNLLKVLSENNRLGCFEKIASDFGVLNDAHNGLLKGTVTSAEPLDPKSFKRIEKALSASKLVGQGKSLKLENVVKPEIKGGLIVELGDKTVDLSISTKIQKLNKVLEDSI

SEQ ID NO: 1675 - protein, 383 aa, Saccharomyces cerevisiae
MTSASITNTGNETMNLPQMRSIWLDEDEEAEKLYGLQAQQFMGSDDEENLGITFINSDKPVLSNKKNIELPPLSPNSHPSCHHRRSNSNSAKSKESSSSSSSANKTNHKKVFLKLNLLKKKLLGAQPDIRGKGISTPFDFQHISHADTRNGFQDEQLQEPSSLSTEIKDDYTSSSSKRDSKSLNKAFVTERIPANRESKLISRSHENKTSRLSVARSISVTSSNYSKNTQGNNHSINGRVVSTSTMATSIFEYSPNASPKQFKNKSHALGHRYTNSTDSSESSLDFLKNYNFPTLLEDKPILDFLPRSQRSSAYRSLLETPNSNKDSAKAFFPSRQSPLPKRRNSIATPSPQSKFSYSDSPVNHRKSFDDVLYSFNQLEPLQT

SEQ ID NO: 1676 - protein, 1062 aa, Saccharomyces cerevisiae
MSENTTAPSDNITNEQRLPSGPKDDVDTLALTSAQNQANSLRKLDTDANAKALPSITDIPVSDDSDIKRQVGSGFGSNPLHIKDSEAFPHSSIEALKEGMDKVTKQCNDLKTALLSKDTSLTDSVQDLFNSLKVLSHNQSVLENKLDDVMKNQVNTDILVNNLNERLNKLSTMLQNTSKVNHSNLLIENSSNNTSSQHNTSSSRRGPGRPRKDASTSTMNKLVSNAASVNLKSASNQGAPFSPVNITLPTAVVQTSKSKRYFVEPSTKQESLLLSAPSSSRDDADMSLTSVPQRTNNENGKERPSTANSSSITPTPVTPNNLIQIKRKRGRPPKKRTVETMISNSTDTIDKSDASNRIKNEIPINSLLPSSKFHQIPSSPSNPVSQPAPVRTSRSATQEIDIKSLELASLISTNGDPNAEDSNTTDTVHNNVEGKVNVEENKTEKEKIITIKSSSENSGNNTTNNNNTDNVIKFSANSDINSDIRRLMVNDQFSLSYDASGNITVKLPPVSSPAAATAAAAAAVTSEMNRQQRELDKRRDSREKMLVNMKYNDRDKAKSFMESNKKLLKAMKEEERRKRMTSIIHDNHLNLNLNEISTRSKIKSAEKPTTKGSSMSPKPRSASISGISDHQQEGYQPLEQEKLVDIDNEGSNANSDSLKMGLTISAADTVHKVGIQSMLNSGEEAITKENAEYERKTPGDEETTTFVPLENSQPSDTIRKRTAGDDGALDQTENTSISPKKRRTEDHTKGEEDEGERGVGNSGTLATVENVSGDISADLSKGTSSIHNDTESANDSSNGNGNLGLGTESRNTLLTATPIELICREGFFYRRDIPDVPITTGAYLEFKFKAKEEELINSSINEEDYAAKSKHEKMNAHFFKPDIQEETELAFEILSKTTLTEKYVNSLEYFLMEFRWENKLVGLGLKLRESKRTWQRRKALFALFEFWRDQSRDKRRFHNYTILHAVKEMENYRIFINRSVSWFYNHITLLKMILYDLCDNVTTQWREWMFPHNETLPALGQDGINEDNLNETIDNMLIFDFLDDGSENNQVKYSRIIPPDIR

SEQ ID NO: 1677 - protein, 642 aa, Saccharomyces cerevisiae
MSHSGAAIFEKVSGIIAINEDVSPAELTWRSTDGDKVHTVVLSTIDKLQATPASSEKMMLRLIGKVDESKKRKDNEGNEVVPKPQRHMFSFNNRTVMDNIKMTLQQIISRYKDADIYEEKRRREESAQHTETPMSSSSVTAGTPTPHLDTPQLNNGAPLINTAKLDDSLSKEKLLTNLKLQQSLLKGNKVLMKVFQETVINAGLPPSEFWSTRIPLLRAFALSTSQKVGPYNVLSTIKPVASSENKVNVNLSREKILNIFENYPIVKKAYTDNVPKNFKEPEFWARFFSSKLFRKLRGEKIMQNDRGDVIIDRYLTLDQEFDRKDDDMLLHPVKKIIDLDGNIQDDPVVRGNRPDFTMQPGVDINGNSDGTVDILKGMNRLSEKMIMALKNEYSRTNLQNKSNITNDEEDEDNDERNELKIDDLNESYKTNYAIIHLKRNAHEKTTDNDAKSSADSIKNADLKVSNQQMLQQLSLVMDNLINKLDLNQVVPNNEVSNKINKRVITAIKINAKQAKHNNVNSALGSFVDNTSQANELEVKSTLPIDLLESCRMLHTTCCEFLKHFYIHFQSGEQKQASTVKKLYNHLKDCIEKLNELFQDVLNGDGESMSNTCTAYLKPVLNSITLATHKYDEYFNEYNNNSN

SEQ ID NO: 1678 - protein, 194 aa, Saccharomyces cerevisiae
MVTSNVVLVSGEGERFTVDKKIAERSLLLKNYLNDMHDSNLQNNSDSESDSDSETNHKSKDNNNGDDDDEDDDEIVMPVPNVRSSVLQKVIEWAEHHRDSNFPDEDDDDSRKSAPVDSWDREFLKVDQEMLYEIILAANYLNIKPLLDAGCKVVAEMIRGRSPEEIRRTFNIVNDFTPEEEAAIRRENEWAEDR

SEQ ID NO: 1679 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMTHDDKPLYKRMFSTK

SEQ ID NO: 1680 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMAHDDKPLYKRMFSTK

SEQ ID NO: 1681 - protein, 567 aa, Saccharomyces cerevisiae
MNSTPDLISPQKSSENSNADLPSNSSQVMNMPEEKGVQDDFQAEADQVLTNPNTGKGAYVTVSICCVMVAFGGFVFGWDTGTISGFVAQTDFLRRFGMKHKDGSYYLSKVRTGLIVSIFNIGCAIGGIILAKLGDMYGRKMGLIVVVVIYIIGIIIQIASINKWYQYFIGRIISGLGVGGIAVLSPMLISEVAPKEMRGTLVSCYQLMITLGIFLGYCTNFGTKNYSNSVQWRVPLGLCFAWALFMIGGMTFVPESPRYLVEAGQIDEARASLSKVNKVAPDHPFIQQELEVIEASVEEARAAGSASWGELFTGKPAMFKRTMMGIMIQSLQQLTGDNYFFYYGTTVFNAVGMSDSFETSIVFGVVNFFSTCCSLYTVDRFGRRNCLLYGAIGMVCCYVVYASVGVTRLWPNGEGNGSSKGAGNCMIVFACFYIFCFATTWAPIAYVVISETFPLRVKSKAMSIATAANWLWGFLIGFFTPFITGAINFYYGYVFMGCMVFAYFYVFFFVPETKGLTLEEVNDMYAEGVLPWKSASWVPTSQRGANYDADALMHDDQPFYKKMFGKK

SEQ ID NO: 1682 - protein, 944 aa, Saccharomyces cerevisiae
MDEASHLPNGSLKNMEFTPVGFIKSKRNTTQTQVVSPTKVPNANNGDENEGPVKKRQRRSIDDTIDSTRLFSEASQFDDSFPEIKANIPPSPRSGNVDKSRKRNLIDDLKKDVPMSQPLKEQEVREHQMKKERFDRALESKLLGKRHITYANSDISNKELYINEIKSLKHEIKELRKEKNDTLNNYDTLEEETDDLKNRLQALEKELDAKNKIVNSRKVDDHSGCIEEREQMERKLAELERKLKTVKDQVLELENNSDVQSLKLRSKEDELKNLMNELNELKSNAEEKDTQLEFKKNELRKRTNELNELKIKSDEMDLQLKQKQNESKRLKDELNELETKFSENGSQSSAKENELKMLKNKIAELEEEISTKNSQLIAKEGKLASLMAQLTQLESKLNQRDSQLGSREEELKKTNDKLQKDIRIAREETVSKDERIIDLQKKVKQLENDLFVIKKTHSESKTITDNELESKDKLIKILENDLKVAQEKYSKMEKELKEREFNYKISESKLEDEKTTLNEKISNLAAENSQLKNKIEDNSTATHHMKENYEKQLESLRKDIEEYKESAKDSEDKIEELKIRIAENSAKVSEKRSKDIKQKDEQISDLTQNLKLQEDEISSLKSIIDRYKKDFNQLKSEQSNIQHDLNLQILNLENKLIESEDELKSLRDSQKIEIENWKRKYNNLSLENDRLLTEKESASDKEREISILNRKLDEMDKEKWNLQESKEKYKRELQKVITANDRLRREKEELNENSNNIRIMEDKMTRIKKNYLSEITSLQEENRRLEERLILNERRKDNDSTMQLNDIISYYKLKYHSEVRHNNDLKVINDYLNKVLALGTRRLRLDTRKGEHSLNISLPDDDELDRDYYNSHVYTRYHDYEYPLRFNLNRRGPYFERRLSFKTVALLVLACVRMKRIAFYRRSDDNRLRILRDRIESSSGRISW

SEQ ID NO: 1683 - protein, 312 aa, Saccharomyces cerevisiae
MPATLKNSSATLKLNTGASIPVLGFGTWRSVDNNGYHSVIAALKAGYRHIDAAAIYLNEEEVGRAIKDSGVPREEIFITTKLWGTEQRDPEAALNKSLKRLGLDYVDLYLMHWPVPLKTDRVTDGNVLCIPTLEDGTVDIDTKEWNFIKTWELMQELPKTGKTKAVGVSNFSINNIKELLESPNNKVVPATNQIEIHPLLPQDELIAFCKEKGIVVEAYSPFGSANAPLLKEQAIIDMAKKHGVEPAQLIISWSIQRGYVVLAKSVNPERIVSNFKIFTLPEDDFKTISNLSKVHGTKRVVDMKWGSFPIFQ

SEQ ID NO: 1684 - protein, 511 aa, Saccharomyces cerevisiae
MVGHSAQHRSKSSLVSHLLILLIFITIIIEMCLYNKIFKNQRSDDIRDNFNNGGHRVPSNVQNHGTHIRDEAFISGVYYSNWSPYKPRFHFPHDINLKQVSHIYYAFFKINSRTGGIENTDSWSDLEMNLYKSLAIKNSELIKESSNNSVQNILPLGCIGELFYLKNTCSDKKFKVIMSIGGWSDSENFKIIIKDDKLLQNFVDSSVETMFRLGFDGIDLDWEFPGNNESEPRGYLKLVRMLRLKLNSLESQIFGKRTEDHFQLSIAAPAFKDKLFYLPITEIDQYVDYWNMMTYDYYGSWSETTGYHSNLFSETELNGNFAMHYMIDRFGVNSRKLVLGMAAYGRSFHIKDNKFEPFNQNTVLINKIFKGVGKPTKEIDKADGKEGIWPYKNLPKIGTIEQYDPKYVSAYCFDEKNSIFISYDNTKSVKTKAEYVTHNNLGGGFWWESCGEAYANESRSLINAFNEGLHFNVSSKPSIFQDVRVKKYYLNKYGDGGFLSPYLKHLDSRKQ

SEQ ID NO: 1685 - protein, 190 aa, Saccharomyces cerevisiae
MGAKTSKLSKDDLTCLKQSTYFDRREIQQWHKGFLRDCPSGQLAREDFVKIYKQFFPFGSPEDFANHLFTVFDKDNNGFIHFEEFITVLSTTSRGTLEEKLSWAFELYDLNHDGYITFDEMLTIVASVYKMMGSMVTLNEDEATPEMRVKKIFKLMDKNEDGYITLDEFREGSKVDPSIIGALNLYDGLI

SEQ ID NO: 1686 - protein, 456 aa, Saccharomyces cerevisiae
MSDKPIDIQYDKQATPNLSGVITPPTNETGNDSVREKLSKLVGDAMSNNPYFAAGGGLMILGTGLAVARSGIIKASRVLYRQMIVDLEIQSKDKSYAWFLTWMAKHPQRVSRHLSVRTNYIQHDNGSVSTKFSLVPGPGNHWIRYKGAFILIKRERSAKMIDIANGSPFETVTLTTLYRDKHLFDDILNEAKDIALKTTEGKTVIYTSFGPEWRKFGQPKAKRMLPSVILDSGIKEGILDDVYDFMKNGKWYSDRGIPYRRGYLLYGPPGSGKTSFIQALAGELDYNICILNLSENNLTDDRLNHLMNNMPERSILLLEDIDAAFNKRSQTGEQGFHSSVTFSGLLNALDGVTSSEETITFMTTNHPEKLDAAIMRPGRIDYKVFVGNATPYQVEKMFMKFYPGETDICKKFVNSVKELDITVSTAQLQGLFVMNKDAPHDALKMVSSLRNANHIF

SEQ ID NO: 1687 - protein, 1009 aa, Saccharomyces cerevisiae
MSADPINDQSSLCVRCNKSIASSQVYELESKKWHDQCFTCYKCDKKLNADSDFLVLDIGTLICYDCSDKCTNCGDKIDDTAIILPSSNEAYCSNCFRCCRCSNRIKNLKYAKTKRGLCCMDCHEKLLRKKQLLLENQTKNSSKEDFPIKLPERSVKRPLSPTRINGKSDVSTNNTAISKNLVSSNEDQQLTPQVLVSQERDESSLNDNNDNDNSKDREETSSHARTVSIDDILNSTLEHDSNSIEEQSLVDNEDYINKMGEDVTYRLLKPQRANRDSIVVKDPRIPNSNSNANRFFSIYDKEETDKDDTDNKENEIIVNTPRNSTDKITSPLNSPMAVQMNEEVEPPHGLALTLSEATKENNKSSQGIQTSTSKSMNHVSPITRTDTVEMKTSTSSSTLRLSDNGSFSRPQTADNLLPHKKVAPSPNKKLSRSFSLKSKNFVHNLKSKTSEMLDPKHPHHSTSIQESDTHSGWGVSSTHTNIRKSKAKKNPVSRGQSDSTIYNTLPQHGNFTVPEFNHKKAQSSLGSISKKQNSNDTATNRRINGSFTSSSSGHHIAMFRTPPLESGPLFKRPSLSSESAHHRSSSLQTSRSTNALLEDDSTKVDATDESATSLEKDFYFTELTLRKLKLDVRELEGTKKKLLQDVENLRLAKERLLNDVDNLTREKDKQSASSRESLEQKENIATSITVKSPSSNSDRKGSISNASPKPRFWKIFSSAKDHQVGDLESQQRSPNSSSGGTTNIAQKEISSPKLIRVHDELPSPGKVPLSPSPKRLDYTPDGSHLYGSSLQARCAYEKSTVPIIIRCCIDRIEKDDIGLNMEGLYRKSGSQTLVEEIENEFAQNNSLHSDTLSPKLNALLNQDIHAVASVLKRYLRKLPDPVLSFSIYDALIDLVRNNQLIERLPLNNDKFLDSPQKVTIYEMVLKSLLEIFKILPVEHQEVLKVLAAHIGKVRRCSERNLMNLHNLSLVFAPSLIHDFDGEKDIVDMKERNYIVEFILGNYRDIFKQA

SEQ ID NO: 1688 - protein, 635 aa, Saccharomyces cerevisiae
MAPVTIEKFVNQEERHLVSNRSATIPFGEYIFKRLLSIDTKSVFGVPGDFNLSLLEYLYSPSVESAGLRWVGTCNELNAAYAADGYSRYSNKIGCLITTYGVGELSALNGIAGSFAENVKVLHIVGVAKSIDSRSSNFSDRNLHHLVPQLHDSNFKGPNHKVYHDMVKDRVACSVAYLEDIETACDQVDNVIRDIYKYSKPGYIFVPADFADMSVTCDNLVNVPRISQQDCIVYPSENQLSDIINKITSWIYSSKTPAILGDVLTDRYGVSNFLNKLICKTGIWNFSTVMGKSVIDESNPTYMGQYNGKEGLKQVYEHFELCDLVLHFGVDINEINNGHYTFTYKPNAKIIQFHPNYIRLVDTRQGNEQMFKGINFAPILKELYKRIDVSKLSLQYDSNVTQYTNETMRLEDPTNGQSSIITQVHLQKTMPKFLNPGDVVVCETGSFQFSVRDFAFPSQLKYISQGFFLSIGMALPAALGVGIAMQDHSNAHINGGNVKEDYKPRLILFEGDGAAQMTIQELSTILKCNIPLEVIIWNNNGYTIERAIMGPTRSYNDVMSWKWTKLFEAFGDFDGKYTNSTLIQCPSKLALKLEELKNSNKRSGIELLEVKLGELDFPEQLKCMVEAAALKRNKK

SEQ ID NO: 1689 - protein, 555 aa, Saccharomyces cerevisiae
MSTDESEDVYSDLYSIISQVTSNTANDIEQLPYALTFKTSLIFVGATIGGLLFGYDTGVISGVLLSLKPEDLSLVVLTDVQKELITSSTSVGSFFGSILAFPLADRYGRRITLAICCSIFILAAIGMAIARTLTFLICGRLLVGIAVGVSAQCVPLFLSEISPSRIRGFMLTLNIIAITGGQLVSYVIASLMKEIDNSWRYLFALSAIPAILFLSILDFIPESPRWSISKGDILYTRDSLRMLYPTASTYHVNSKIKQLIIELDKLRLYEDASEPLLVQSQSVIRYMDSSTSGTLSPPNIKRLSSNTERTSNTMSSSSAYLSALRGPAPNGALASNKKKRHRMEPRTIRALIVGCMLMFFQQITGFNAFMYYAAIIFSKFNIKNPLLPPILIASTNFIFTFFAMYTMDSLGRRAILLRTILIMTVGLLLCSVGFGHDQVNLLLISVVIYVAAYASAMGSVPWTCVEFLPLNRRSFGASCIACTNWLTNAFVSMTYLSTINTIGDENTMLIFAFFTVCAWFFVYFWYPEVKGLSLEEVGRVFDNGIDVHYVFRTYH

SEQ ID NO: 1690 - protein, 482 aa, Saccharomyces cerevisiae
MSFKGFTKAVSRAPQSFRQKFKMGEQTEDPVYEDAERRFQELEQETKKLSEESKRYSTAVNGMLTHQIGFAKSMEEIFKPISGKMSDPNATIPEDNPQGIEASEQYRAIVAELQETLKPDLALVEEKIVTPCQELLKIITYIRKMATKRNHKKLDLDRHLNTYNKHEKKKEPTAKDEERLYKAQAQVEVAQQEYDYYNDLLKTQLPILFSLEAEFVKPLFVSFYFMQLNIFYTLYNRLQDMKIPYFDLNSDIVESYIAKKGNVEEQTDALTITHFKLGYSKAKLEMTRRKYGVATAEGSPVSGASSGVGYGAGYDPATATSPTPTGYGYGAAAPSYAAQPAAQYGTAAAVGTAAAVGTAAGAAAGAVPGTYPQYAAAQSPPLTGLGFQQSPQQQQGPPPAYSNPLTSPVAGTPAAAVAAAPGVETVTALYDYQAQAAGDLSFPAGAVIEIVQRTPDVNEWWTGRYNGQQGVFPGNYVQLNKN

SEQ ID NO: 1691 - protein, 428 aa, Saccharomyces cerevisiae
MEELGIVTPVEKAVEEKPAVKSYASLLAQLNGTVNNNSALSNVNSDIYFKLKKLEKEYELLTLQEDYIKDEQRHLKRELKRAQEEVKRIQSVPLVIGQFLEPIDQNTGIVSSTTGMSYVVRILSTLDRELLKPSMSVALHRHSNALVDILPPDSDSSISVMGENEKPDVTYADVGGLDMQKQEIREAVELPLVQADLYEQIGIDPPRGVLLYGPPGTGKTMLVKAVANSTKAAFIRVNGSEFVHKYLGEGPRMVRDVFRLARENAPSIIFIDEVDSIATKRFDAQTGSDREVQRILIELLTQMDGFDQSTNVKVIMATNRADTLDPALLRPGRLDRKIEFPSLRDRRERRLIFGTIASKMSLAPEADLDSLIIRNDSLSGAVIAAIMQEAGLRAVRKNRYVILQSDLEEAYATQVKTDNTVDKFDFYK

SEQ ID NO: 1692 - protein, 1529 aa, Saccharomyces cerevisiae
MSSDIRDVEERNSRSSSSSSSSNSAAQSIGQHPYRGFDSEAAERVHELARTLTSQSLLYTANSNNSSSSNHNAHNADSRSVFSTDMEGVNPVFTNPDTPGYNPKLDPNSDQFSSTAWVQNMANICTSDPDFYKPYSLGCVWKNLSASGDSADVSYQSTFANIVPKLLTKGLRLLKPSKEEDTFQILKPMDGCLNPGELLVVLGRPGSGCTTLLKSISSNSHGFKIAKDSIVSYNGLSSSDIRKHYRGEVVYNAESDIHLPHLTVYQTLFTVARMKTPQNRIKGVDREAYANHVTEVAMATYGLSHTRDTKVGNDLVRGVSGGERKRVSIAEVAICGARFQCWDNATRGLDSATALEFIRALKTQADIGKTAATVAIYQCSQDAYDLFDKVCVLDDGYQLYFGPAKDAKKYFQDMGYYCPPRQTTADFLTSITSPTERIISKEFIEKGTRVPQTPKDMAEYWLQSESYKNLIKDIDSTLEKNTDEARNIIRDAHHAKQAKRAPPSSPYVVNYGMQVKYLLIRNFWRMKQSASVTLWQVIGNSVMAFILGSMFYKVMKKNDTSTFYFRGAAMFFAILFNAFSCLLEIFSLYETRPITEKHRTYSLYHPSADAFASVLSEMPPKLITAVCFNIIFYFLVDFRRNGGVFFFYFLINVIATFTLSHLFRCVGSLTKTLQEAMVPASMLLLAISMYTGFAIPKTKILGWSIWIWYINPLAYLFESLMINEFHDRRFPCAQYIPAGPAYQNITGTQRVCSAVGAYPGNDYVLGDDFLKESYDYEHKHKWRGFGIGMAYVVFFFFVYLILCEYNEGAKQKGEMVVFLRSKIKQLKKEGKLQEKHRPGDIENNAGSSPDSATTEKKILDDSSEGSDSSSDNAGLGLSKSEAIFHWRDLCYDVPIKGGQRRILNNVDGWVKPGTLTALMGASGAGKTTLLDCLAERVTMGVITGNIFVDGRLRDESFPRSIGYCQQQDLHLKTATVRESLRFSAYLRQPSSVSIEEKNRYVEEVIKILEMQQYSDAVVGVAGEGLNVEQRKRLTIGVELAARPKLLVFLDEPTSGLDSQTAWDTCQLMRKLATHGQAILCTIHQPSAILMQQFDRLLFLQKGGQTVYFGDLGEGCKTMIDYFESKGAHKCPPDANPAEWMLEVVGAAPGSHATQDYNEVWRNSDEYKAVQEELDWMEKNLPGRSKEPTAEEHKPFAASLYYQFKMVTIRLFQQYWRSPDYLWSKFILTIFNQVFIGFTFFKADRSLQGLQNQMLSIFMYTVIFNPILQQYLPSFVQQRDLYEARERPSRTFSWLAFFLSQIIVEIPWNILAGTIAYCIYYYAVGFYANASAAGQLHERGALFWLFSIAFYVYIGSMGLLMISFNEVAETAAHMGTLLFTMALSFCGVMATPKVMPRFWIFMYRVSPLTYMIDALLALGVANVDVKCSNYEMVKFTPPSGTTCGDYMASYIKLAGTGYLSDPSATDICSFCAVSTTNAFLATFSSHYYRRWRNYGIFICYIAFDYIAATFLYWLSRVPKKNGKISEKPKK

SEQ ID NO: 1693 - protein, 347 aa, Saccharomyces cerevisiae
MTTLLQLLSNYYKAKLDSERIYNEYVQSQYEFASLDKLNNNKGDPKKVVDETLFLQRQIAQLNKQLQLSFQENEKLLSVQKNQKALYQSKLSSKDAFIDDLKLKLKVEQISVDKHNKERTPSTGRDEQQRNSKAAHTSKPTIHLLSPIVNRDKPNNQTNDRGGNDPDSPTSQRRSRGLRSLLSSGKNTIFDSISKNLDDEINENAHIRNDTTSSKIAGKSPSRLSALQKSPELRKERNNMILKEHILRSKDDQNITSSRKLDNIELSSIGDSTAMTSRSSTVNANDILGNEENDGITKLKRVNKLTSSPVKRDCSTNKKRKLTKQRIATLPNSDEELSNNLNVDEFV

SEQ ID NO: 1694 - protein, 181 aa, Saccharomyces cerevisiae
MSISESYAKEIKTAFRQFTDFPIEGEQFEDFLPIIGNPTLFQKLVHTFKTHLEEKFGKEKIDFIAGIEARGLLFGPSLALALGVGFVPIRRVGKLPGECASITFTKLDHEEIFEMQVEAIPFDSNVVVVDDVLATGGTAYAAGDLIRQVGAHILEYDFVLVLDSLHGEEKLSAPIFSILHS

SEQ ID NO: 1695 - protein, 36 aa, Saccharomyces cerevisiae
MQPSTATAAPKEKTSSEKKDNYIIKGVFWDPACVIA

SEQ ID NO: 1696 - protein, 633 aa, Saccharomyces cerevisiae
MSSNNNTNTAPANANSSHHHHHHHHHHHHHGHGGSNSTLNNPKSSLADGAHIGNYQIVKTLGEGSFGKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLLPPDLKPHPEEENENNDSKKDGSSPDNDEIDDNLVNILSSTMGYEKDEIYESLESSEDTPAFNEIRDAYMLIKENKSLIKDMKANKSVSDELDTFLSQSPPTFQQQSKSHQKSQVDHETAKQHARRMASAITQQRTYHQSPFMDQYKEEDSTVSILPTSLPQIHRANMLAQGSPAASKISPLVTKKSKTRWHFGIRSRSYPLDVMGEIYIALKNLGAEWAKPSEEDLWTIKLRWKYDIGNKTNTNEKIPDLMKMVIQLFQIETNNYLVDFKFDGWESSYGDDTTVSNISEDEMSTFSAYPFLHLTTKLIMELAVNSQSN

SEQ ID NO: 1697 - protein, 442 aa, Saccharomyces cerevisiae
MALFLSKRLLRFTVIAGAVIVLLLTLNSNSRTQQYIPSSISAAFDFTSGSISPEQQVISEENDAKKLEQSALNSEASEDSEAMDEESKALKAAAEKADAPIDTKTTMDYITPSFANKAGKPKACYVTLVRNKELKGLLSSIKYVENKINKKFPYPWVFLNDEPFTEEFKEAVTKAVSSEVKFGILPKEHWSYPEWINQTKAAEIRADAATKYIYGGSESYRHMCRYQSGFFWRHELLEEYDWYWRVEPDIKLYCDINYDVFKWMQENEKVYGFTVSIHEYEVTIPTLWQTSMDFIKKNPEYLDENNLMSFLSNDNGKTYNLCHFWSNFEIANLNLWRSPAYREYFDTLDHQGGFFYERWGDAPVHSIAAALFLPKDKIHYFSDIGYHHPPYDNCPLDKEVYNSNNCECDQGNDFTFQGYSCGKEYYDAQGLVKPKNWKKFRE

SEQ ID NO: 1698 - protein, 584 aa, Saccharomyces cerevisiae
MGIHIPYLTSKTSQSNVGDAVGNADSVEFNSEHDSPSKRGKITLESHEIQRAPASDDEDRIQIKPVNDEDDTSVMITFNQSLSPFIITLTFVASISGFMFGYDTGYISSALISIGTDLDHKVLTYGEKEIVTAATSLGALITSIFAGTAADIFGRKRCLMGSNLMFVIGAILQVSAHTFWQMAVGRLIMGFGVGIGSLIAPLFISEIAPKMIRGRLTVINSLWLTGGQLVAYGCGAGLNYVNNGWRILVGLSLIPTAVQFTCLCFLPDTPRYYVMKGDLARATEVLKRSYTDTSEEIIERKVEELVTLNQSIPGKNVPEKVWNTIKELHTVPSNLRALIIGCGLQAIQQFTGWNSLMYFSGTIFETVGFKNSSAVSIIVSGTNFIFTLVAFFSIDKIGRRTILLIGLPGMTMALVVCSIAFHFLGIKFDGAVAVVVSSGFSSWGIVIIVFIIVFAAFYALGIGTVPWQQSELFPQNVRGIGTSYATATNWAGSLVIASTFLTMLQNITPAGTFAFFAGLSCLSTIFCYFCYPELSGLELEEVQTILKDGFNIKASKALAKKRKQQVARVHELKYEPTQEIIEDI

SEQ ID NO: 1699 - protein, 384 aa, Saccharomyces cerevisiae
MSKSKTFLFTSESVGEGHPDKICDQVSDAILDACLEQDPFSKVACETAAKTGMIMVFGEITTKARLDYQQIVRDTIKKIGYDDSAKGFDYKTCNVLVAIEQQSPDIAQGLHYEKSLEDLGAGDQGIMFGYATDETPEGLPLTILLAHKLNMAMADARRDGSLPWLRPDTKTQVTVEYEDDNGRWVPKRIDTVVISAQHADEISTADLRTQLQKDIVEKVIPKDMLDENTKYFIQPSGRFVIGGPQGDAGLTGRKIIVDAYGGASSVGGGAFSGKDYSKVDRSAAYAARWVAKSLVAAGLCKRVQVQFSYAIGIAEPLSLHVDTYGTATKSDDEIIEIIKKNFDLRPGVLVKELDLARPIYLPTASYGHFTNQEYSWEKPKKLEF

SEQ ID NO: 1700 - protein, 1142 aa, Saccharomyces cerevisiae
MAINGNSIPAIKDNTIGPWKLGETLGLGSTGKVQLARNGSTGQEAAVKVISKAVFNTGNVSGTSIVGSTTPDALPYGIEREIIIMKLLNHPNVLRLYDVWETNTDLYLVLEYAEKGELFNLLVERGPLPEHEAIRFFRQIIIGVSYCHALGIVHRDLKPENLLLDHKYNIKIADFGMAALETEGKLLETSCGSPHYAAPEIVSGIPYQGFASDVWSCGVILFALLTGRLPFDEEDGNIRTLLLKVQKGEFEMPSDDEISREAQDLIRKILTVDPERRIKTRDILKHPLLQKYPSIRDSKSIRGLPREDTYLTPLSESNSSIDATILQNLVILWHGRDPEGIKEKLREPGANAEKTLYALLYRFKCDTQKELIKQQQVKKRQSISSVSVSPSKKVSTTPQRRRNRESLISVTSSRKKPISFNKFTASSASSSNLTTPGSSKRLSKNFSSKKKLSTIVNQSSPTPASRNKRASVINVEKNQKRASIFSTTKKNKRSSRSIKRMSLIPSMKRESVTTKLMSTYAKLAEDDDWEYIEKETKRTSSNFATLIDEIFEYEKYEQIRKEKEELERKVREAKAREELERRRRKQEEKERARKLLEKEDLKRKQEELKKQIEIDISDLEQELSKHKEEKLDGNIRSISAPMENEEKNINHLEVDIDNILRRRNFSLQTRPVSRLDPGIMFSSPTEEVSPVEPKRTENERLTTEKKILETIRRSKFLGSSFNIDKELKLSKMEYPSIIAPQRLSEERVVSDSNDGYESLILPKDGNGVSQLKDSTATTAPVSDGRLRKISEIRVPQFTRKSRHFSESNKRLSVLSMYSTKESFTNLVDILKNGNLDVNNQQSQRIPTPRSADDSEFLFETVNEEAEYTGNSSNDERLYDVGDSTIKDKSALKLNFADRFNGSNEAKQTDNLHLPILPPLNGDNELRKQNSQEGDQAHPKIKSMIPESGSSSHTEKEEENEEKEEKKPEQHKQEEDQEKREKVVDDMEPPLNKSVQKIREKNAGSQAKDHSKDHLKEHKQDKNTAIGNGSFFRKFSKSSDKTMELYAKISAKQLFNGLEKLLRGWTQYGLKNIKSHPNNLTLTGKLSSDNIFSLRSTLFEVNIYPRGKMSVVQFKKVSGSFKAVKKLVNEVENVLNKEGVLQK

SEQ ID NO: 1701 - protein, 663 aa, Saccharomyces cerevisiae
MTLGNRRHGRNNEGSSNMNMNRNDLDDVSHYEMKEIQPKEKQIGSIEPENEVEYFEKTVEKTIENMEYEGEHHASYLRRFIDSFRRAEGSHANSPDSSNSNGTTPISTKDSSSQLDNELNRKSSYITVDGIKQSPQEQEQKQENLKKSIKPRHTVMMSLGTGIGTGLLVGNSKVLNNAGPGGLIIGYAIMGSCVYCIIQACGELAVIYSDLIGGFNTYPLFLVDPALGFSVAWLFCLQWLCVCPLELVTASMTIKYWTTSVNPDVFVVIFYVLIVVINVFGAKGYAEADFFFNCCKILMIVGFFILAIIIDCGGAGTDGYIGSKYWRDPGAFRGDTPIQRFKGVVATFVTAAFAFGMSEQLAMTASEQSNPRKAIPSAAKKMIYRILFVFLASLTLVGFLVPYTSDQLLGAAGSATKASPYVIAVSSHGVRVVPHFINAVILLSVLSVANGAFYTSSRILMSLAKQGNAPKCFDYIDREGRPAAAMLVSALFGVIAFCASSKKEEDVFTWLLAISGLSQLFTWITICLSHIRFRRAMKVQGRSLGEVGYKSQVGVWGSAYAVLMMVLALIAQFWVAIAPIGGGGKLSAQSFFENYLAMPIWIALYIFYKVWKKDWSLFIPADKVDLVSHRNIFDEELLKQEDEEYKERLRNGPYWKRVLDFWC

SEQ ID NO: 1702 - protein, 500 aa, Saccharomyces cerevisiae
MSFENLHKVNAEALEDAVVEICSSLQVDAAKLDELTAYFIECMEKGLNNTSVGEEKTVDKGLPMIPTYVTSLPNGTERGVLLAADLGGTHFRVCSVTLNGDGTFDMQQLKSKIPEEYLNDKDVTSEELFSYLGRRTRAFVRKHHPELLKSTGENIKPLKMGFTFSYPVDQTSLSSGTLIRWTKSFKIEDTVGKDVVRLYQEQLDIQGLSMINVVALTNDTVGTFLSHCYTSGSRPSSAGEISEPVIGCIFGTGTNGCYMEDIENIKKLPDELRTRLLHEGKTQMCINIEWGSFDNELKHLSATKYDIDIDQKFSPNPGYHLFEKRISGMYLGELLRNILVDLHARGLILGQYRNYDQLPHRLKTPFQLCSEVLSRIEIDDSTNLRETELSFLQSLRLPTTFEERKAIQNLVRSITRRSAYLAAVPIAAILIKTNALNKRYHGEVEIGFDGYVIEYYPGFRSMLRHALALSPIGTEGERKIHLRLAKDGSGVGAALCALVA

SEQ ID NO: 1703 - protein, 490 aa, Saccharomyces cerevisiae
MESKEISIRSRTPPSKLYSIQSCIGRGNFGDVYKAVDRVTQEIVAIKVVNLEHSDEDIELLAQEIFFLAELKSPLITNYIATMLEDVSMWIVMEYCGGGSCSDLLKRSYVNGLPEEKVSFIIHEVTLGLKYLHEQRKIHRDIKAANILLNEEGMVKLGDFGVSGHIRSTLKRDTFVGTPYWMAPEVVCCEVDGYNEKADIWSLGITTYELLKGLPPLSKYDPMKVMTNLPKRKPPKLQGPFSDAAKDFVAGCLVKTPADRPSAYNLLSFEFVKNITITNLKSDVDLIKQKKVQERYTKVPKYPLQNRLYKNSNTVRGKEFWNFESTRLSTTQISKEELSPITQDSPTSSLNMESPYLLHGQTVTPITNPSSSSFRKCTQPVFELDSGMDIDSGCPNAQAETEIVPLSNHNKKHKKNDIQALKIEKFDYLKNIVSHILNRMYDRARDDETRKYVNEMLKQFIKTEANVPGFNEVFIEEISLRIEAIKKGFV

SEQ ID NO: 1704 - protein, 569 aa, Saccharomyces cerevisiae
MKDLKLSNFKGKFISRTSHWGLTGKKLRYFITIASMTGFSLFGYDQGLMASLITGKQFNYEFPATKENGDHDRHATVVQGATTSCYELGCFAGSLFVMFCGERIGRKPLILMGSVITIIGAVISTCAFRGYWALGQFIIGRVVTGVGTGLNTSTIPVWQSEMSKAENRGLLVNLEGSTIAFGTMIAYWIDFGLSYTNSSVQWRFPVSMQIVFALFLLAFMIKLPESPRWLISQSRTEEARYLVGTLDDADPNDEEVITEVAMLHDAVNRTKHEKHSLSSLFSRGRSQNLQRALIAASTQFFQQFTGCNAAIYYSTVLFNKTIKLDYRLSMIIGGVFATIYALSTIGSFFLIEKLGRRKLFLLGATGQAVSFTITFACLVKENKENARGAAVGLFLFITFFGLSLLSLPWIYPPEIASMKVRASTNAFSTCTNWLCNFAVVMFTPIFIGQSGWGCYLFFAVMNYLYIPVIFFFYPETAGRSLEEIDIIFAKAYEDGTQPWRVANHLPKLSLQEVEDHANALGSYDDEMEKEDFGEDRVEDTYNQINGDNSSSSSNIKNEDTVNDKANFEG

SEQ ID NO: 1705 - protein, 496 aa, Saccharomyces cerevisiae
MTAAHPVAQLTAEAYPKVKRNPNFKVLDSEDLAYFRSILSNDEILNSQAPEELASFNQDWMKKYRGQSNLILLPNSTDKVSKIMKYCNDKKLAVVPQGGNTDLVGASVPVFDEIVLSLRNMNKVRDFDPVSGTFKCDAGVVMRDAHQFLHDHDHIFPLDLPSRNNCQVGGVVSTNAGGLNFLRYGSLHGNVLGLEVVLPNGEIISNINALRKDNTGYDLKQLFIGAEGTIGVVTGVSIVAAAKPKALNAVFFGIENFDTVQKLFVKAKSELSEILSAFEFMDRGSIECTIEYLKDLPFPLENQHNFYVLIETSGSNKRHDDEKLTAFLKDTTDSKLISEGMMAKDKADFDRLWTWRKSVPTACNSYGGMYKYDMSLQLKDLYSVSAAVTERLNAAGLIGDAPKPVVKSCGYGHVGDGNIHLNIAVREFTKQIEDLLEPFVYEYIASKKGSISAEHGIGFHKKGKLHYTRSDIEIRFMKDIKNHYDPNGILNPYKYI

SEQ ID NO: 1706 - protein, 564 aa, Saccharomyces cerevisiae
MSSAQSSIDSDGDVRDADIHVAPPVEKEWSDGFDDNEVINGDNVEPPKRGLIGYLVIYLLCYPISFGGFLPGWDSGITAGFINMDNFKMNFGSYKHSTGEYYLSNVRMGLLVAMFSIGCAIGGLIFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYDNTAQWRVPLGLCFLWALIIIIGMLLVPESPRYLIECERHEEARASIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAAGMMACMVIFASIGVKCLYPHGQDGPSSKGAGNAMIVFTCFYIFCFATTWAPVAYIVVAESFPSKVKSRAMSISTACNWLWQFLIGFFTPFITGSIHFYYGYVFVGCLVAMFLYVFFFLPETIGLSLEEIQLLYEEGIKPWKSASWVPPSRRGISSEESKTEKKDWKKFLKFSKNSD

SEQ ID NO: 1707 - protein, 590 aa, Saccharomyces cerevisiae
MTNSKEDADIEEKHMYNEPVTTLFHDVEASQTHHRRGSIPLKDEKSKELYPLRSFPTRVNGEDTFSMEDGIGDEDEGEVQNAEVKRELKQRHIGMIALGGTIGTGLFIGLSTPLTNAGPVGALISYLFMGSLAYSVTQSLGEMATFIPVTSSFTVFSQRFLSPAFGAANGYMYWFSWAITFALELSVVGQVIQFWTYKVPLAAWISIFWVIITIMNLFPVKYYGEFEFWVASIKVLAIIGFLIYCFCMVCGAGVTGPVGFRYWRNPGAWGPGIISKDKNEGRFLGWVSSLINAAFTFQGTELVGITAGEAANPRKSVPRAIKKVVFRILTFYIGSLLFIGLLVPYNDPKLTQSTSYVSTSPFIIAIENSGTKVLPHIFNAVILTTIISAANSNIYVGSRILFGLSKNKLAPKFLSRTTKGGVPYIAVFVTAAFGALAYMETSTGGDKVFEWLLNITGVAGFFAWLFISISHIRFMQALKYRGISRDELPFKAKLMPGLAYYAATFMTIIIIIQGFTAFAPKFNGVSFAAAYISIFLFLAVWILFQCIFRCRFIWKIGDVDIDSDRRDIEAIVWEDHEPKTFWDKFWNVVA

SEQ ID NO: 1708 - protein, 1038 aa, Saccharomyces cerevisiae
MVWPESNVEYRYRSKQFKGKSNKKYIKAQKIQQERICLMPAENQNTGQDRSSNSISKNGNSQVGCHTVPNEELNITVAVRCRGRNEREISMKSSVVVNVPDITGSKEISINTTGDTGITAQMNAKRYTVDKVFGPGASQDLIFDEVAGPLFQDFIKGYNCTVLVYGMTSTGKTYTMTGDEKLYNGELSDAAGIIPRVLLKLFDTLELQQNDYVVKCSFIELYNEELKDLLDSNSNGSSNTGFDGQFMKKLRIFDSSTANNTTSNSASSSRSNSRNSSPRSLNDLTPKAALLRKRLRTKSLPNTIKQQYQQQQAVNSRNNSSSNSGSTTNNASSNTNTNNGQRSSMAPNDQTNGIYIQNLQEFHITNAMEGLNLLQKGLKHRQVASTKMNDFSSRSHTIFTITLYKKHQDELFRISKMNLVDLAGSENINRSGALNQRAKEAGSINQSLLTLGRVINALVDKSGHIPFRESKLTRLLQDSLGGNTKTALIATISPAKVTSEETCSTLEYASKAKNIKNKPQLGSFIMKDILVKNITMELAKIKSDLLSTKSKEGIYMSQDHYKNLNSDLESYKNEVQECKREIESLTSKNALLVKDKLKSKETIQSQNCQIESLKTTIDHLRAQLDKQHKTEIEISDFNNKLQKLTEVMQMALHDYKKRELDLNQKFEMHITKEIKKLKSTLFLQLNTMQQESILQETNIQPNLDMIKNEVLTLMRTMQEKAELMYKDCVKKILNESPKFFNVVIEKIDIIRVDFQKFYKNIAENLSDISEENNNMKQYLKNHFFKNNHQELLNRHVDSTYENIEKRTNEFVENFKKVLNDHLDENKKLIMQNLTTATSAVIDQEMDLFEPKRVKWENSFDLINDCDSMNNEFYNSMAATLSQIKSTVDTSSNSMNESISVMKGQVEESENAISLLKNNTKFNDQFEQLINKHNMLKDNIKNSITSTHSHITNVDDIYNTIENIMKNYGNKENATKDEMIENILKEIPNLSKKMPLRLSNINSNSVQSVISPKKHAIEDENKSSENVDNEGSRKMLKIE

SEQ ID NO: 1709 - protein, 401 aa, Saccharomyces cerevisiae
MENQEKPLSVDEEYDLWKSNVPLMYDFVSETRLTWPSLTVQWLPTPVQELDGGFIKQELIIGTHTSGEEENYLKFAEINLPKEILSNEDPQEEAGEEYQSSLPAPRSNIRITAKYEHEEEITRARYMPQDPNIVATINGQGTVFLYSRSEGLQSTLKFHKDNGYALSFSTLVKGRLLSGSDDHTVALWEVGSGGDPTKPVRTWNDLHSDIINDNKWHNFNKDLFGTVSEDSLLKINDVRANNTTIDTVKCPQPFNTLAFSHHSSNLLAAAGMDSYVYLYDLRNMKEPLHHMSGHEDAVNNLEFSTHVDGVVVSSGSDNRLMMWDLKQIGAEQTPDDAEDGVPELIMVHAGHRSSVNDFDLNPQIPWLVASAEEENILQVWKCSHSLPIVGGPPKVNKDIIS

SEQ ID NO: 1710 - protein, 256 aa, Saccharomyces cerevisiae
MSGNREQVFPTRMTLGLMKTKLKGANQGYSLLKRKSEALTKRFRDITKRIDDAKQKMGRVMQTAAFSLAEVSYATGENIGYQVQESVSTARFKVRARQENVSGVYLSQFESYIDPEINDFRLTGLGRGGQQVQRAKEIYSRAVETLVELASLQTAFIILDEVIKVTNRRVNAIEHVIIPRTENTIAYINSELDELDREEFYRLKKVQEKKQNETAKLDAEMKLKRDRAEQDASEVAADEEPQGETLVADQEDDVIF

SEQ ID NO: 1711 - protein, 393 aa, Saccharomyces cerevisiae
MLVLGSLRSALSCSSTASLISKRNPCYPYGILCRTLSQSVKLWQENTSKDDSSLNITPRLLKIIPNDTDIVTLEKQDELIKRRRKLSKEVTQMKRLKPVSPGLRWYRSPIYPYLYKGRPVRALTVVRKKHGGRNNSGKITVRHQGGGHRNRTRLIDFNRWEGGAQTVQRIEYDPGRSSHIALLKHNTTGELSYIIACDGLRPGDVVESFRRGIPQTLLNEMGGKVDPAILSVKTTQRGNCLPISMIPIGTIIHNVGITPVGPGKFCRSAGTYARVLAKLPEKKKAIVRLQSGEHRYVSLEAVATIGVVSNIDHQNRSLGKAGRSRWLGIRPTVRGVAMNKCDHPHGGGRGKSKSNKLSMSPWGQLAKGYKTRRGKNQNRMKVKDRPRGKDARL

SEQ ID NO: 1712 - protein, 470 aa, Saccharomyces cerevisiae
MSLSPVVVIGTGLAGLAAANELVNKYNIPVTILEKASSIGGNSIKASSGINGACTETQRHFHIEDSPRLFEDDTIKSAKGKGVQELMAKLANDSPLAIEWLKNEFDLKLDLLAQLGGHSVARTHRSSGKLPPGFEIVSALSNNLKKLAETKPELVKINLDSKVVDIHEKDGSISAVVYEDKNGEKHMVSANDVVFCSGGFGFSKEMLKEYAPELVNLPTTNGQQTTGDGQRLLQKLGADLIDMDQIQVHPTGFIDPNDRSSSWKFLAAESLRGLGGILLNPITGRRFVNELTTRDVVTAAIQKVCPQEDNRALLVMGEKMYTDLKNNLDFYMFKKLVQKLTLSQVVSEYNLPITVAQLCEELQTYSSFTTKADPLGRTVILNEFGSDVTPETVVFIGEVTPVVHFTMGGARINVKAQVIGKNDERLLKGLYAAGEVSGGVHGANRLGGSSLLECVVFGRTAAESIANDRK

SEQ ID NO: 1713 - protein, 518 aa, Saccharomyces cerevisiae
MAPIFRNYRFAIGAFAVIMLILLIKTSSIGPPSIARTVTPNASIPKTPEDISILPVNDEPGYLQDSKTEQNYPELADAVKSQTSQTCSEEHKYVIMIDAGSTGSRVHIYKFDVCTSPPTLLDEKFDMLEPGLSSFDTDSVGAANSLDPLLKVAMNYVPIKARSCTPVAVKATAGLRLLGDAKSSKILSAVRDHLEKDYPFPVVEGDGVSIMGGDEEGVFAWITTNYLLGNIGANGPKLPTAAVFDLGGGSTQIVFEPTFPINEKMVDGEHKFDLKFGDENYTLYQFSHLGYGLKEGRNKVNSVLVENALKDGKILKGDNTKTHQLSSPCLPPKVNATNEKVTLESKETYTIDFIGPDEPSGAQCRFLTDEILNKDAQCQSPPCSFNGVHQPSLVRTFKESNDIYIFSYFYDRTRPLGMPLSFTLNELNDLARIVCKGEETWNSVFSGIAGSLDELESDSHFCLDLSFQVSLLHTGYDIPLQRELRTGKKIANKEIGWCLGASLPLLKADNWKCKIQSA

SEQ ID NO: 1714 - protein, 398 aa, Saccharomyces cerevisiae
MVSLTFKNFKKEKVPLDLEPSNTILETKTKLAQSISCEESQIKLIYSGKVLQDSKTVSECGLKDGDQVVFMVSQKKSTKTKVTEPPIAPESATTPGRENSTEASPSTDASAAPAATAPEGSQPQEEQTATTERTESASTPGFVVGTERNETIERIMEMGYQREEVERALRAAFNNPDRAVEYLLMGIPENLRQPEPQQQTAAAAEQPSTAATTAEQPAEDDLFAQAAQGGNASSGALGTTGGATDAAQGGPPGSIGLTVEDLLSLRQVVSGNPEALAPLLENISARYPQLREHIMANPEVFVSMLLEAVGDNMQDVMEGADDMVEGEDIEVTGEAAAAGLGQGEGEGSFQVDYTPEDDQAISRLCELGFERDLVIQVYFACDKNEEAAANILFSDHAD

SEQ ID NO: 1715 - protein, 971 aa, Saccharomyces cerevisiae
MEGSTGFDGDATTFFAPDAVFGDRVRRFQEFLDTFTSYRDSVRSIQVYNSNNAANYNDDQDDADERDLLGDDDGDDLEKEKKAASSTSLNILPHRIIISLDDLREFDRSFWSGILVEPAYFIPPAEKALTDLADSMDDVPHPNASAVSSRHPWKLSFKGSFGAHALSPRTLTAQHLNKLVSVEGIVTKTSLVRPKLIRSVHYAAKTGRFHYRDYTDATTTLTTRIPTPAIYPTEDTEGNKLTTEYGYSTFIDHQRITVQEMPEMAPAGQLPRSIDVILDDDLVDKTKPGDRVNVVGVFKSLGAGGMNQSNSNTLIGFKTLILGNTVYPLHARSTGVAARQMLTDFDIRNINKLSKKKDIFDILSQSLAPSIYGHDHIKKAILLMLMGGVEKNLENGSHLRGDINILMVGDPSTAKSQLLRFVLNTASLAIATTGRGSSGVGLTAAVTTDRETGERRLEAGAMVLADRGVVCIDEFDKMTDVDRVAIHEVMEQQTVTIAKAGIHTTLNARCSVIAAANPVFGQYDVNRDPHQNIALPDSLLSRFDLLFVVTDDINEIRDRSISEHVLRTHRYLPPGYLEGEPVRERLNLSLAVGEDADINPEEHSNSGAGVENEGEDDEDHVFEKFNPLLQAGAKLAKNKGNYNGTEIPKLVTIPFLRKYVQYAKERVIPQLTQEAINVIVKNYTDLRNDDNTKKSPITARTLETLIRLATAHAKVRLSKTVNKVDAKVAANLLRFALLGEDIGNDIDEEESEYEEALSKRSPQKSPKKRQRVRQPASNSGSPIKSTPRRSTASSVNATPSSARRILRFQDDEQNAGEDDNDIMSPLPADEEAELQRRLQLGLRVSPRRREHLHAPEEGSSGPLTEVGTPRLPNVSSAGQDDEQQQSVISFDNVEPGTISTGRLSLISGIIARLMQTEIFEEESYPVASLFERINEELPEEEKFSAQEYLAGLKIMSDRNNLMVADDKVWRV

SEQ ID NO: 1716 - protein, 644 aa, Saccharomyces cerevisiae
MLPSWKAFKAHNILRILTRFQSTKIPDAVIGIDLGTTNSAVAIMEGKVPRIIENAEGSRTTPSVVAFTKDGERLVGEPAKRQSVINSENTLFATKRLIGRRFEDAEVQRDINQVPFKIVKHSNGDAWVEARNRTYSPAQIGGFILNKMKETAEAYLAKSVKNAVVTVPAYFNDAQRQATKDAGQIIGLNVLRVVNEPTAAALAYGLDKSEPKVIAVFDLGGGTFDISILDIDNGIFEVKSTNGDTHLGGEDFDIYLLQEIISHFKKETGIDLSNDRMAVQRIREAAEKAKIELSSTLSTEINLPFITADAAGPKHIRMPFSRVQLENITAPLIDRTVDPVKKALKDARITASDISDVLLVGGMSRMPKVADTVKKLFGKDASKAVNPDEAVALGAAIQAAVLSGEVTDVLLLDVTPLSLGIETLGGVFTKLIPRNSTIPNKKSQIFSTAASGQTSVEVKVFQGERELVKDNKLIGNFTLAGIPPAPKGTPQIEVTFDIDANGIINVSAKDLASHKDSSITVAGASGLSDTEIDRMVNEAERYKNQDRARRNAIETANKADQLANDTENSIKEFEGKLDKTDSQRLKDQISSLRELVSRSQAGDEVNDDDVGTKIDNLRTSSMKLFEQLYKNSDNPETKNGRENK

SEQ ID NO: 1717 - protein, 160 aa, Saccharomyces cerevisiae
MTELCPVYAPFFGAIGCASAIIFTSLGAAYGTAKSGVGICATCVLRPDLLFKNIVPVIMAGIIAIYGLVVSVLVCYSLGQKQALYTGFIQLGAGLSVGLSGLAAGFAIGIVGDAGVRGSSQQPRLFVGMILILIFAEVLGLYGLIVALLLNSRATQDVVC

SEQ ID NO: 1718 - protein, 1459 aa, Saccharomyces cerevisiae
MSDREFVTVDPVTIIIKECINLSTAMRKYSKFTSQSGVAALLGGGSEIFSNQDDYLAHTFNNLNTNKHNDPFLSGFIQLRLMLNKLKNLDNIDSLTILQPFLLIVSTSSISGYITSLALDSLQKFFTLNIINESSQNYIGAHRATVNALTHCRFEGSQQLSDDSVLLKVVFLLRSIVDSPYGDLLSNSIIYDVLQTILSLACNNRRSEVLRNAAQSTMIAVTVKIFSKLKTIEPVNVNQIYINDESYTNDVLKADTIGTNVESKEEGSQEDPIGMKVNNEEAISEDDGIEEEHIHSEKSTNGAEQLDIVQKTTRSNSRIQAYADDNYGLPVVRQYLNLLLSLIAPENELKHSYSTRIFGLELIQTALEISGDRLQLYPRLFTLISDPIFKSILFIIQNTTKLSLLQATLQLFTTLVVILGNNLQLQIELTLTRIFSILLDDGTANNSSSENKNKPSIIKELLIEQISILWTRSPSFFTSTFINFDCNLDRADVSINFLKALTKLALPESALTTTESVPPICLEGLVSLVDDMFDHMKDIDREEFGRQKNEMEILKKRDRKTEFIECTNAFNEKPKKGIPMLIEKGFIASDSDKDIAEFLFNNNNRMNKKTIGLLLCHPDKVSLLNEYIRLFDFSGLRVDEAIRILLTKFRLPGESQQIERIIEAFSSAYCENQDYDPSKISDNAEDDISTVQPDADSVFILSYSIIMLNTDLHNPQVKEHMSFEDYSGNLKGCCNHKDFPFWYLDRIYCSIRDKEIVMPEEHHGNEKWFEDAWNNLISSTTVITEIKKDTQSVMDKLTPLELLNFDRAIFKQVGPSIVSTLFNIYVVASDDHISTRMITSLDKCSYISAFFDFKDLFNDILNSIAKGTTLINSSHDDELSTLAFEYGPMPLVQIKFEDTNTEIPVSTDAVRFGRSFKGQLNTVVFFRIIRRNKDPKIFSKELWLNIVNIILTLYEDLILSPDIFPDLQKRLKLSNLPKPSPEISINKSKESKGLLSTFASYLKGDEEPTEEEIKSSKKAMECIKSSNIAASVFGNESNITADLIKTLLDSAKTEKNADNSRYFEAELLFIIELTIALFLFCKEEKELGKFILQKVFQLSHTKGLTKRTVRRMLTYKILLISLCADQTEYLSKLINDELLKKGDIFTQKFFATNQGKEFLKRLFSLTESEFYRGFLLGNENFWKFLRKVTAMKEQSESIFEYLNESIKTDSNILTNENFMWVLGLLDEISSMGAVGNHWEIEYKKLTESGHKIDKENPYKKSIELSLKSIQLTSHLLEDNNDLRKNEIFAIIQALAHQCINPCKQISEFAVVTLEQTLINKIEIPTNEMESVEELIEGGLLPLLNSSETQEDQKILISSILTIISNVYLHYLKLGKTSNETFLKILSIFNKFVEDSDIEKKLQQLILDKKSIEKGNGSSSHGSAHEQTPESNDVEIEATAPIDDNTDDDNKPKLSDVEKD

SEQ ID NO: 1719 - protein, 560 aa, Saccharomyces cerevisiae
MTTTATQHFAQLLQKYGIDTVFGIVGIPIVQLADTMVANGIKFIPCRNEQAASYAASAYGYISDKPGVLLIVGGPGLIHALAGIYNSMSNRWPLLVIAGSSSQSDIHKGGFQELDQVSLLSPFLKFTGKLTPDNIDMITQKALNYCIQGTAGVSYIDVPADFIEYEKPLEGNDRTGNELPMILTPNICGPDPSKIKKVVQLILQHKNKNILIVIGKGAVKNSHEIRRLVNTFNLPFLPTPMAKGIVPDSSPLNVSSARSQALKIADIVLVLGARLNWILHFGTSPKWNSESIFIQFDSNPETLGDNNVSPGADLSIWGDIGLSVTALVEELTRQDSCWKYSGVKQEIREKIQLNQTRLLRKEKTRGAQLNYNQVYGTLRPLIDDYRTILVTEGANTMDIARISFPTDAPRRRLDAGTNATMGIGLGYALACKASHPELDVVLIQGDSAFGFSAMEIETAVRCQLALVIVVMNNSGIYHGEKDIEGDLPPTALSKNCRYDLVGKGLGANDFFVNTISELSRCFQQAVQLSRTKRETSVINVIIEPGEQKQIAFAWQNKPRL

SEQ ID NO: 1720 - protein, 704 aa, Saccharomyces cerevisiae
MYNIPDNVKGAVEFDPWLKPFADVLSERRYLADKWLYDITHATPDGSYQSLSKFARDSYKSYGLHANPETKEITYKEWAPNAERAFLVGDFNNWDTTSHELKNKDEFGNFTITLHPLPNGDFAIPHDSKIKVMFILPDGSKIFRLPAWITRATQPSKETSKQFGPAYEGRFWNPENPYKFVHPRPKFSESVDSLRIYEAHVGISSPEPKITTYKEFTEKVLPRIKYLGYDAIQLMAIMEHAYYASFGYQVTNFFAASSRFGTPEELKELIDTAHSMGILVLLDVVHSHASKNVEDGLNMFDGSDHQYFHSISSGRGEHPLWDSRLFNYGKFEVQRFLLANLAFYVDVYQFDGFRFDGVTSMLYVHHGVGAGGSFSGDYNEYLSRDRSFVDHEALAYLMLANDLVHEMLPNLAVTVAEDVSGYPTLCLPRSIGGTGFDYRLAMALPDMWIKLIKEKKDDEWEMGSIVYTLTNRRYGEKVVAYCESHDQALVGDKTLAFWLMDAAMYTDMTVLKEPSIVIDRGIALHKMIRLITHSLGGEAYLNFEGNEFGHPEWLDFPNVNNGDSYKYARRQFNLADDPLLRYQNLNEFDRSMQLCEKRHKWLNTKQAYVSLKHEGDKMIVFERNNLLFIFNFHPTNSYSDYRVGVEKAGTYHIVLNSDRAEFGGHNRINESSEFFTTDLEWNNRKNFLQVYIPSRVALVLALKE

SEQ ID NO: 1721 - protein, 335 aa, Saccharomyces cerevisiae
MNNGDNKTTLENSKNASLANGNYAIPTKLNRLKKNADPRVAAISGALSGALSAMLVCPFDVAKTRLQAQGLQNMTHQSQHYKGFFGTFATIFKDEGAAGLYKGLQPTVLGYIPTLMIYFSVYDFCRKYSVDIFPHSPFLSNASSAITAGAISTVATNPIWVVKTRLMLQTGIGKYSTHYKGTIDTFRKIIQQEGAKALYAGLVPALLGMLNVAIQFPLYENLKIRFGYSESTDVSTDVTSSNFQKLILASMLSKMVASTVTYPHEILRTRMQLKSDLPNTVQRHLLPLIKITYRQEGFAGFYSGFATNLVRTVPAAVVTLVSFEYSKKYLTTFFQ

SEQ ID NO: 1722 - protein, 630 aa, Saccharomyces cerevisiae
MLIENTNDRFGIVIDAGSSGSRIHVFKWQDTESLLHATNQDSQSILQSVPHIHQEKDWTFKLNPGLSSFEKKPQDAYKSHIKPLLDFAKNIIPESHWSSCPVFIQATAGMRLLPQDIQSSILDGLCQGLKHPAEFLVEDCSAQIQVIDGETEGLYGWLGLNYLYGHFNDYNPEVSDHFTFGFMDMGGASTQIAFAPHDSGEIARHRDDIATIFLRSVNGDLQKWDVFVSTWLGFGANQARRRYLAQLINTLPENTNDYENDDFSTRNLNDPCMPRGSSTDFEFKDTIFHIAGSGNYEQCTKSIYPLLLKNMPCDDEPCLFNGVHAPRIDFANDKFIGTSEYWYTANDVFKLGGEYNFDKFSKSLREFCNSNWTQILANSDKGVYNSIPENFLKDACFKGNWVLNILHEGFDMPRIDVDAENVNDRPLFQSVEKVEERELSWTLGRILLYASGSILAGNDDFMVGIAPSERRTKLTGKKFIPGKLLESDQLRKQSSSLSNKGFLMWFAIICCIFYLIFHRSHIIRRRFSGLYNITKDFKTGIRRRLKFLRRSDPFSRLEEGELGTDVDGFKDVYRMKSSSMFDLGKSSATMQREHEPQRTASQSANLAPSNLRPAFSMADFSKFKDSRLYD

SEQ ID NO: 1723 - protein, 1336 aa, Saccharomyces cerevisiae
MRSSKSPFKRKSHSRETSHDENTSFFHKRTISGSSAHHSRNVSQGAVPSSAPPVSGGNYSHKRNVSRASNSSQTSNFLAEQYERDRKAIINCCFSRPDHKTGEPPNNYITHVRIIEDSKFPSSRPPPDSKLENKKKRLLILSAKPNNAKLIQIHKARENSDGSFQIGRTWQLTELVRVEKDLEISEGFILTMSKKYYWETNSAKERTVFIKSLITLYIQTFEGHVPELVNWDLSLFYLDERSYQRAVITNRPGSVSPIKSPTSNFTTNTTQSVGSVPFSAPTERTRRSETESVNPVSTPASVEYHAGMKSLNKAPYSSNSTLNEVNKRYELEQQQQQEEAELRRLEEQKRLQLQKENEMKRLEEERRIKQEERKRQMELEHQRQLEEEERKRQMELEAKKQMELKRQRQFEEEQRLKKERELLEIQRKQREQETAERLKKEEQEALAKKEEEEKSKRNKVDNESYTQEINGKVDNLLEDLNAVLAEETETTPTMQNGTYVPERSTARAHDQLKKPLNIAKVESLGGSDLNDSISLSDEIAGLNTSNLSGEDQDEKNDLSFEKGDEVRYSNNFEGEAPHVYHEVSIIQEEAPAVSQKLILPEENNESEALIESKEEIKTMENIDDEVLLEILTDINWSIEDDADSMIERIDLRLAETEYLFNQNLLSLQKIGPNIRPYEDKVNDECHRIIPTLSLFLMEMSNFSNDIENVESQDNGLQVESANKKLLWNTLDELLKTVSLDEISLNQLLECPIREKNLPWMENQLNLLLKAFQAIGSDGNEVEYNLREISGLKQRLQFYEKVTKIFLNRIVEEMQKKFSNIRGQDISHDQMIRILTTLLIFSPLILFCKEISQKSYQAIVENWNVSIQPVYMELWTKKISQLQGIDTNDEKMNELSLSQLLNEWDTFRKERKTNDINPVFKNSFSLLTECLQTMRQECIVYQNFVEVFFHISSKHNFEEYIKHFNDPDAPPILLDTVKVMQSDREAAVIETQLVSRIFQPIVTRLSSYFVELVKAEPTVAPALTFYLENEIKSLESSNHEFLLSAVTRMYTQIKQVWSDNVEEQVLHFERISNATTNGEILPGILDLPVGLKNSEDLFQFAKRSMDIKDTDEGYESIELMNSSFRKLSIAATRSITHKEVNSSINPNLSDTAALNNDYMETISLLVNSNWLTEMLSMLNFNKDGIFDTSLQNVKKVFDVEKESYASFLLRDTMPKLTAFVYGVSNIIENTNNVNMTNPSRWAAYSRQNLENILLAYTSHEIETLVKRLHTHMVNDFGYHQENAINNVLCDKLWSCIQGQTVSLYLKLYTVIDKHYRGTNIRFTKNDIISAFEEYKNA

SEQ ID NO: 1724 - protein, 254 aa, Saccharomyces cerevisiae
MAYTKIALFAAIAALASAQTQDQINELNVILNDVKSHLQEYISLASDSSSGFSLSSMPAGVLDIGMALASATDDSYTTLYSEVDFAGVSKMLTMVPWYSSRLEPALKSLNGDASSSAAPSSSAAPTSSAAPSSSAAPTSSAASSSSEAKSSSAAPSSSEAKSSSAAPSSSEAKSSSAAPSSSEAKSSSAAPSSTEAKITSAAPSSTGAKTSAISQITDGQIQATKAVSEQTENGAAKAFVGMGAGVVAAAAMLL

SEQ ID NO: 1725 - protein, 198 aa, Saccharomyces cerevisiae
MDIILGIRVQDSVILASSKAVTRGISVLKDSDDKTRQLSPHTLMSFAGEAGDTVQFAEYIQANIQLYSIREDYELSPQAVSSFVRQELAKSIRSRRPYQVNVLIGGYDKKKNKPELYQIDYLGTKVELPYGAHGYSGFYTFSLLDHHYRPDMTTEEGLDLLKLCVQELEKRMPMDFKGVIVKIVDKDGIRQVDDFQAQ

SEQ ID NO: 1726 - protein, 1145 aa, Saccharomyces cerevisiae
MSDISKLIGAIVGSDDPVIIEFVLNIINKSGNLQEFIRNIQKLDAGISYEDSIKMYNAFLGKQEEEKVRNKVKSSPLSQKINQVLKDDVNLDDPVVTEFVLSILNKSKSITEFQEQLNLMQSGLDNETIFKIYQIASPPVMKEEVSVLPSTKIPAKIEAKIEEEVQKIESLDPSPVLHKVYEGKVRNITTFGCFVQIFGTRMKNCDGLVHISEMSDQRTLDPHDVVRQGQHIFVEVIKIQNNGKISLSMKNIDQHSGEIRKRNTESVEDRGRSNDAHTSRNMKNKIKRRALTSPERWEIRQLIASGAASIDDYPELKDEIPINTSYLTAKRDDGSIVNGNTEKVDSKLEEQQRDETDEIDVELNTDDGPKFLKDQQVKGAKKYEMPKITKVPRGFMNRSAINGSNAIRDHREEKLRKKREIEQQIRKQQSFDDPTKNKKDSRNEIQMLKNQLIVTEWEKNRMNESISYGKRTSLPISAQRQTLPVYAMRSELIQAVRDNQFLVIVGETGSGKTTQITQYLDEEGFSNYGMIGCTQPRRVAAVSVAKRVAEEVGCKVGHDVGYTIRFEDVTGPDTRIKYMTDGMLQREALLDPEMSKYSVIMLDEAHERTVATDVLFALLKKAAIKRPELKVIVTSATLNSAKFSEYFLNCPIINIPGKTFPVEVLYSQTPQMDYIEAALDCVIDIHINEGPGDILVFLTGQEEIDSCCEILYDRVKTLGDSIGELLILPVYSALPSEIQSKIFEPTPKGSRKVVFATNIAETSITIDGIYYVVDPGFAKINIYNARAGIEQLIVSPISQAQANQRKGRAGRTGPGKCYRLYTESAFYNEMLENTVPEIQRQNLSHTILMLKAMGINDLLKFDFMDPPPKNLMLNALTELYHLQSLDDEGKLTNLGKEMSLFPMDPTLSRSLLSSVDNQCSDEIVTIISMLSVQNVFYRPKDRQLEADSKKAKFHHPYGDHLTLLNVYTRWQQANYSEQYCKTNFLHFRHLKRARDVKSQISMIFKKIGLKLISCHSDPDLIRKTFVSGFFMNAAKRDSQVGYKTINGGTEVGIHPSSSLYGKEYEYVMYHSIVLTSREYMSQVTSIEPQWLLEVAPHFYKAGDAESQSRKKAKIIPLHNKFAKDQNSWRLSSIRQSRERALGIKR

SEQ ID NO: 1727 - protein, 539 aa, Saccharomyces cerevisiae
MLLPLTKLKPRAKVAVVGGGVSGLCFTYFLSKLRPDVEITLFESQNRTGGWIYSCNTRDMSGNPIMLEKGPRTLRGVSDGTVLIMDTLKDLGKEAVIQSIDKGCIADKKFLLDPSDKLVQVPNSISTTVKFLLNPLGKGLITGMMGEWFRKKSPHPGQDESVESICDRRFGNNYISNNMISALLRGIYGDDVSLLSAKRTFKKIYYNELKHGSNTQAMIDNMRGKSRSKKTENLHQSLTGCLNDYSNAFGKDRSKLLDLSNTLKKYPMLGLAGGLETFPKIVRNALNEFKNVKIVTGNPVTQIMKRPANETTIGLKAKSGDQYETFDHLRLTITPPKIAKLLPKDQNSLSKLLDEIQSNTIILVNYYLPNKDVIDADLQGFGYLVPKSNKNPGKLLGVIFDSVIERNFKPLFDKLSTNPNALNKYTKVTAMIGGCMLNEHGVPVVPSREVTINAVKDALNNHLGISNKDLEAGQWEFTIADRCLPRFHVGYDAWQERAERKLQESYGQTVSVGGMGFSRSPGVPDVIVDGFNDALQLSK

SEQ ID NO: 1728 - protein, 744 aa, Saccharomyces cerevisiae
MAAPDYALTDLIESDPRFESLKTRLAGYTKGSDEYIEELYSQLPLTSYPRYKTFLKKQAVAISNPDNEAGFSSIYRSSLSSENLVSCVDKNLRTAYDHFMFSARRWPQRDCLGSRPIDKATGTWEETFRFESYSTVSKRCHNIGSGILSLVNTKRKRPLEANDFVVAILSHNNPEWILTDLACQAYSLTNTALYETLGPNTSEYILNLTEAPILIFAKSNMYHVLKMVPDMKFVNTLVCMDELTHDELRMLNESLLPVKCNSLNEKITFFSLEQVEQVGCFNKIPAIPPTPDSLYTISFTSGTTGLPKGVEMSHRNIASGIAFAFSTFRIPPDKRNQQLYDMCFLPLAHIFERMVIAYDLAIGFGIGFLHKPDPTVLVEDLKILKPYAVALVPRILTRFEAGIKNALDKSTVQRNVANTILDSKSARFTARGGPDKSIMNFLVYHRVLIDKIRDSLGLSNNSFIITGSAPISKDTLLFLRSALDIGIRQGYGLTETFAGVCLSEPFEKDVGSCGAIGISAECRLKSVPEMGYHADKDLKGELQIRGPQVFERYFKNPNETSKAVDQDGWFSTGDVAFIDGKGRISVIDRVKNFFKLAHGEYIAPEKIENIYLSSCPYITQIFVFGDPLKTFLVGIVGVDVDAAQPILAAKHPEVKTWTKEVLVENLNRNKKLRKEFLNKINKCTDGLQGFEKLHNIKVGLEPLTLEDDVVTPTFKIKRAKASKFFKDTLDQLYAEGSLVKTEKL

SEQ ID NO: 1729 - protein, 344 aa, Saccharomyces cerevisiae
MSAGIGESRTELLTWLNGLLNLNYKKIEECGTGAAYCQIMDSIYGDLPMNRVKFNATAEYEFQTNYKILQSCFSRHGIEKTVYVDKLIRCKFQDNLEFLQWLKKHWIRHKDESVYDPDARRKYRPIITNNSATKPRTVSNPTTAKRSSSTGTGSAMSGGLATRHSSLGINGSRKTSVTQGQLVAIQAELTKSQETIGSLNEEIEQYKGTVSTLEIEREFYFNKLRDIEILVHTTQDLINEGVYKFNDETITGHGNGNGGALLRFVKKVESILYATAEGFEMNDGEDELNDKNLGEHGTVPNQGGYANSNGEVNGNEGSNHDVIMQNDEGEVGVSNNLIIDEETF

SEQ ID NO: 1730 - protein, 761 aa, Saccharomyces cerevisiae
MMMWQRYARGAPRSLTSLSFGKASRISTVKPVLRSRMPVHQRLQTLSGLATRNTIHRSTQIRSFHISWTRLNENRPNKEGEGKNNGNKDNNSNKEDGKDKRNEFGSLSEYFRSKEFANTMFLTIGFTIIFTLLTPSSNNSGDDSNRVLTFQDFKTKYLEKGLVSKIYVVNKFLVEAELVNTKQVVSFTIGSVDIFEEQMDQIQDLLNIPPRDRIPIKYIERSSPFTFLFPFLPTIILLGGLYFITRKINSSPPNANGGGGGGLGGMFNVGKSRAKLFNKETDIKISFKNVAGCDEAKQEIMEFVHFLKNPGKYTKLGAKIPRGAILSGPPGTGKTLLAKATAGEANVPFLSVSGSEFVEMFVGVGASRVRDLFTQARSMAPSIIFIDEIDAIGKERGKGGALGGANDEREATLNQLLVEMDGFTTSDQVVVLAGTNRPDVLDNALMRPGRFDRHIQIDSPDVNGRQQIYLVHLKRLNLDPLLTDDMNNLSGKLATLTPGFTGADIANACNEAALIAARHNDPYITIHHFEQAIERVIAGLEKKTRVLSKEEKRSVAYHEAGHAVCGWFLKYADPLLKVSIIPRGQGALGYAQYLPPDQYLISEEQFRHRMIMALGGRVSEELHFPSVTSGAHDDFKKVTQMANAMVTSLGMSPKIGYLSFDQNDGNFKVNKPFSNKTARTIDLEVKSIVDDAHRACTELLTKNLDKVDLVAKELLRKEAITREDMIRLLGPRPFKERNEAFEKYLDPKSNTEPPEAPAATN

SEQ ID NO: 1731 - protein, 449 aa, Saccharomyces cerevisiae
MGLCASSEKNGSTPDTQTASAGSDNVGKAKVPPKQEPQKTVRTVNTANQQEKQQQRQQQPSPHNVKDRKEQNGSINNAISPTATANTSGSQQINIDSALRDRSSNVAAQPSLSDASSGSNDKELKVLLLGAGESGKSTVLQQLKILHQNGFSEQEIKEYIPLIYQNLLEIGRNLIQARTRFNVNLEPECELTQQDLSRTMSYEMPNNYTGQFPEDIAGVISTLWALPSTQDLVNGPNASKFYLMDSTPYFMENFTRITSPNYRPTQQDILRSRQMTSGIFDTVIDMGSDIKMHIYDVGGQRSERKKWIHCFDNVTLVIFCVSLSEYDQTLMEDKNQNRFQESLVLFDNIVNSRWFARTSVVLFLNKIDLFAEKLSKVPMENYFPDYTGGSDINKAAKYILWRFVQLNRANLSIYPHVTQATDTSNIRLVFAAIKETILENTLKDSGVLQ

SEQ ID NO: 1732 - protein, 523 aa, Saccharomyces cerevisiae
MASTAVMMDVDSSGVNDLHHSEKKYAEEDQVQELLKVLNEISKTTLTLDPRYIWRSLKDLSSLRNQELLNAETLCFTVNVLYPDSSSFKKNLLKFITSNHKSSVPGSAELRNSYPASFYSVNTEKKTIEVTAEINCFMHLLVQLFLWDSKELEQLVEFNRKVVIPNLLCYYNLRSLNLINAKLWFYIYLSHETLARSSEEINSDNQNIILRSTMMKFLKIASLKHDNETKAMLINLILRDFLNNGEVDSASDFISKLEYPHTDVSSSLEARYFFYLSKINAIQLDYSTANEYIIAAIRKAPHNSKSLGFLQQSNKLHCCIQLLMGDIPELSFFHQSNMQKSLLPYYHLTKAVKLGDLKKFTSTITKYKQLLLKDDTYQLCVRLRSNVIKTGIRIISLTYKKISLRDICLKLNLDSEQTVEYMVSRAIRDGVIEAKINHEDGFIETTELLNIYDSEDPQQVFDERIKFANQLHDEYLVSMRYPEDKKTQQNEKSENGENDDDTLDGDLMDDMSDISDLDDLGFL

SEQ ID NO: 1733 - protein, 286 aa, Saccharomyces cerevisiae
MTYTLAILGCGVMGQALLSAIYNAPKAADETAAAFYPSKIITCNHDEPSAQQVTDLVETFDESPNGIKVESTYGHNVSAVEEASVVLLGTKPFLAEEVLNGVKSVIGGKLLISLAAGWTIDQLSQYTSTVCRVMTNTPAKYGYGCAVVSYSADVSKEQKPLVNELISQVGKYVELPEKNMDAATALVGSGPAFVLLMLESLMESGLKLGIPLQESKECAMKVLEGTVKMVEKSGAHPSVLKHQVCTPGGTTIAGLCVMEEKGVKSGIINGVEEAARVASQLGQKKK

SEQ ID NO: 1734 - protein, 923 aa, Saccharomyces cerevisiae
MSSGSTIVSSDKSGRTFKHEEELPKLPLPKLCDTLQRLKESLEPLYYADGYYQHPLDPEQIEKLSSIIRDFEENPVSEKLQSKLQSYHDTRDCYLDELHLDINNQTSTREIQDDVLPRNPFLVLADDALPNITQADRSAVLVHSAARFISALKQDLLPPDINATNGKPLSMAPFLNLFGTTRSPVFQRGEVENFDLNKPYTASDLEDPDYSSDEDDNDEPTQKDFDDRKRKHEEDIFTGNGITIKRHPDSKHILIISRGQYYTLEVLDSTNKIIYTAAELTTIFNHIIKDSSGIEKSTALGSLTSHSFRNWKYARKRLQKRYPNELHRIDSALFVLVLDESQEETTNDGDDTADISQMFNRTITERDKKCTSANCKRVFYGTSIINSKGHQVGSCVSRWYDKLQLVVTADAKATVIWDSFTCDGSVVLRFTSEIYTESVLRLARDVNAGDPQFSLWPNVTQMDPETKKLMTATISADGGGPSEIDPKLVVNKIDWSFSNILNTHVHLSETKLADLISKYDIVRASIPLGRRSAQRLGVKPDSMVQVALQIAHYALYGRMVFGLEPVSTRGFKNSRSSFINIQSQALLELCQLFISSSIDGTDKLDKFIQTCETHNNMVKHAKSGVGYEKHFNALKYLFKFHDHFGIHLSGDESSAAKDLFENPLVLPFSQPELIVANCGNAATTTFGITPAVPHGFGIGYIIKDDQVDLTVTSQFRQGDRLMFMLSWVLGEIRSYWRMSRGTSHNKTGVKISPVVDKLYEMDNAVNNPPKRNGHTVNGSRKTSSSSQVNLNRYGGFFDLEGHIDSRNISKTPSMKNLQKTFNGLTMSADNDHSSSAVSVPTEKEKLNTGHEILQIQPREVASNGLEADDETDIEIVAGNADGTSSSASSATSLNSKKRNVINSRFDIDFDRSRVGRKVATLDQ

SEQ ID NO: 1735 - protein, 527 aa, Saccharomyces cerevisiae [sequence omitted]

SEQ ID NO: 1736 - protein, 276 aa, Saccharomyces cerevisiae
MVESDEDFAPQEFPHTDTDVIVNEHRDENDGYASDEVGGTLSRRASSIFSINTTPLAPPNATDIQKFTSDEHHFSMMRNLHMADYITMLNGFSGFYSIVSCLRFTLTGKPHYVQRAHFFILLGMCFDFLDGRVARLRNRSSLMGQELDSLADLVSFGVAPAAIAFAIGFQTTFDVMILSFFVLCGLARLARFNVTVAQLPKDSSTGKSKYFEGLPMPTTLALVLGMAYCVRKGLIFDNIPFGIFREDQILEFHPIILVFFIHGCGMISKSLKIPKP

SEQ ID NO: 1737 - protein, 394 aa, Saccharomyces cerevisiae
MNYLRDRFPPDNDQRPFRCEICSRGFHRLEHKKRHGRTHTGEKPHKCTVQGCPKSFSRSDELKRHLRTHTKGVQRRRIKSKGSRKTVVNTATAAPTTFNENTGVSLTGIGQSKVPPILISVAQNCDDVNIRNTGNNNGIVETQAPAILVPVINIPNDPHPIPSSLSTTSITSIASVYPSTSPFQYLKSGFPEDPASTPYVHSSGSSLALGELSSNSSIFSKSRRNLAAMSGPDSLSSSKNQSSASLLSQTSHPSKSFSRPPTDLSPLRRIMPSVNTGDMEISRTVSVSSSSSSLTSVTYDDTAAKDMGMGIFFDRPPVTQKACRSNHKYKVNAVSRGRQHERAQFHISGDDEDSNVHRQESRASNTSPNVSLPPIKSILRQIDNFNSAPSYFSK

SEQ ID NO: 1738 - protein, 223 aa, Saccharomyces cerevisiae
MSSEDYGYDYDLLFKIVLIGDSGVGKSNLLSRFTKNEFNMDSKSTIGVEFATRTLEIDGKRIKAQIWDTAGQERYRAITSAYYRGAVGALIVYDISKSSSYENCNHWLSELRENADDNVAVGLIGNKSDLAHLRAVPTEESKTFAQENQLLFTETSALNSENVDKAFEELINTIYQKVSKHQMDLGDSSANGNANGASAPNGPTISLTPTPNENKKANGNNCC

SEQ ID NO: 1739 - protein, 184 aa, Saccharomyces cerevisiae
MSSLISKTIKYDPAKDKLITLACGCFWGTEHMYRKYLNDRIVDCKVGYANGEESKKDSPSSVSYKRVCGGDTDFAEVLQVSYNPKVITLRELTDFFFRIHDPTTSNSQGPDKGTQYRSGLFAHSDADLKELAKIKEEWQPKWGNKIATVIEPIKNFYDAEEYHQLYLDKNPQGYACPTHYLREM

SEQ ID NO: 1740 - protein, 449 aa, Saccharomyces cerevisiae
MSAPAQNYKIADISLAAFGRKEIELAEHEMPGLMAIRKAYGDVQPLKGARIAGCLHMTIQTAVLIETLVALGAEVTWSSCNIYSTQDHAAAAIAASGVPVFAWKGETEEEYLWCIEQQLFAFKDNKKLNLILDDGGDLTTLVHEKHPEMLEDCFGLSEETTTGVHHLYRMVKEGKLKVPAINVNDSVTKSKFDNLYGCRESLVDGIKRATDVMLAGKVAVVAGYGDVGKGCAAALRGMGARVLVTEIDPINALQAAMEGYQVVTMEDASHIGQVFVTTTGCRDIINGEHFINMPEDAIVCNIGHFDIEIDVAWLKANAKECINIKPQVDRYLLSSGRHVILLANGRLVNLGCATGHSSFVMSCSFSNQVLAQIALFKSNDKSFREKHIEFQKTGPFEVGVHVLPKILDEAVAKFHLGNLGVRLTKLSKVQSEYLGIPEEGPFKADHYRY

SEQ ID NO: 1741 - protein, 527 aa, Saccharomyces cerevisiae
MPMDFQPTSSHSNWVVQKFGGTSVGKFPVQIVDDIVKHYSKPDGPNNNVAVVCSARSSYTKAEGTTSRLLKCCDLASQESEFQDIIEVIRQDHIDNADRFILNPALQAKLVDDTNKELELVKKYLNASKVLGEVSSRTVDLVMSCGEKLSCLFMTALCNDRGCKAKYVDLSHIVPSDFSASALDNSFYTFLVQALKEKLAPFVSAKERIVPVFTGFFGLVPTGLLNGVGRGYTDLCAALIAVAVNADELQVWKEVDGIFTADPRKVPEARLLDSVTPEEASELTYYGSEVIHPFTMEQVIRAKIPIRIKNVQNPLGNGTIIYPDNVAKKGESTPPHPPENLSSSFYEKRKRGATAITTKNDIFVINIHSNKKTLSHGFLAQIFTILDKYKLVVDLISTSEVHVSMALPIPDADSLKSLRQAEEKLRILGSVDITKKLSIVSLVGKHMKQYIGIAGTMFTTLAEEGINIEMISQGANEINISCVINESDSIKALQCIHAKLLSERTNTSNQFEHAIDERLEQLKRLGI

SEQ ID NO: 1742 - protein, 300 aa, Saccharomyces cerevisiae
MESNKQPRKIQLYTKEFYATCTLGGIIACGPTHSSITPLDLVKCRLQVNPKLYTSNLQGFRKIIANEGWKKVYTGFGATFVGYSLQGAGKYGGYEYFKHLYSSWLSPGVTVYLMASATAEFLADIMLCPFEAIKVKQQTTMPPFCNNVVDGWKKMYAESGGMKAFYKGIVPLWCRQIPYTMCKFTSFEKIVQKIYSVLPKKKEEMNALQQISVSFVGGYLAGILCAAVSHPADVMVSKINSERKANESMSVASKRIYQKIGFTGLWNGLMVRIVMIGTLTSFQWLIYDSFKAYVGLPTTG

SEQ ID NO: 1743 - protein, 297 aa, Saccharomyces cerevisiae
MDLVNHLTDRLLFAIPKKGRLYSKSVSILNGADITFHRSQRLDIALSTSLPVALVFLPAADIPTFVGEGKCDLGITGVDQVRESNVDVDLAIDLQFGNCKLQVQVPVNGEYKKPEQLIGKTIVTSFVKLAEKYFADLEGTTVEKMTTRIKFVSGSVEASCALGIGDAIVDLVESGETMRAAGLVDIATVLSTSAYLIESKNPKSDKSLIATIKSRIEGVMTAQRFVSCIYNAPEDKLPELLKVTPGRRAPTISKIDDEGWVAVSSMIERKTKGVVLDELKRLGASDIMVFEISNCRV

SEQ ID NO: 1744 - protein, 420 aa, Saccharomyces cerevisiae
MSIKGDSPSSTNASSSPKSTYSIQSDDKANLGSGNVDIRTDNSQQDSNNRRDIVVVTRVASEETLESQSSTSSMGIRPESSFNYEDASNQARVEMNNRVHGSNMNTINKYYPVRFPKNNERQLSDTNNLNEKVQGTHTVQSSTQEDKILDGDTSNSQVTPSLNIAEFPTDKLLKMLTALLTKIIKSNDRTAATNPSLTQEIENGRCLALSDNEKKYLSPVLGFRGKHVPQIGLDQYFQRIQKYCPTTNDVFLSLLVYFDRISKRCNSVTTTPKTNTAKHESPSNESSLDKANRGADKMSACNSNENNENDDSDDENTGVQRDSRAHPQMFVMDSHNIHRLIIAGITVSTKFLSDFFYSNSRYSRVGGISLQELNHLELQFLVLCDFELLISVNELQRYADLLYRFWNNAKAQSQALVTGM

SEQ ID NO: 1745 - protein, 442 aa, Saccharomyces cerevisiae
MSRRVVITGLGCVTPLGRSLSESWGNLLSSKNGLTPITSLPNYNEDYKLREKSIPSTITVGKIPENFQNENSAINKLLFTSQDERRTSSFIKLALRTTYEALHNAGLLNPNDITINTSLCNLDHFGCLIGSGIGSIQDIYQTSLQFHNDNKRINPYFVPKILTNMAAGNVSIKFNLRGLSHSVSTACATGNNSIGDAFNFIRLGMQDICVAGASETSLHPLSLAGFIRAKSITTNGISRPFDTQRSGFVLGEGCGMIVMESLEHAQKRNANIISELVGYGLSSDACHITSPPADGNGAKRAIEMALKMARLEPTDVDYVNAHATSTLLGDKAECLAVASALLPGRSKSKPLYISSNKGAIGHLLGAAGAVESIFTICSLKDDKMPHTLNLDNVLTLENNEADKLHFIRDKPIVGANPKYALCNSFGFGGVNTSLLFKKWEGS

SEQ ID NO: 1746 - protein, 250 aa, Saccharomyces cerevisiae
MGLTTKPLSLKVNAALFDVDGTIIISQPAIAAFWRDFGKDKPYFDAEHVIQVSHGWRTFDAIAKFAPDFANEEYVNKLEAEIPVKYGEKSIEVPGAVKLCNALNALPKEKWAVATSGTRDMAQKWFEHLGIRRPKYFITANDVKQGKPHPEPYLKGRNGLGYPINEQDPSKSKVVVFEDAPAGIAAGKAAGCKIIGIATTFDLDFLKEKGCDIIVKNHESIRVGGYNAETDEVEFIFDDYLYAKDDLLKW

SEQ ID NO: 1747 - protein, 863 aa, Saccharomyces cerevisiae
MPSASLLVSTKRLNASKFQKFVSSLNKSTIAGFASVPLRAPPSVAFTRKKVGYSKRYVSSTNGFSATRSTVIQLLNNISTKREVEQYLKYFTSVSQQQFAVIKVGGAIISDNLHELASCLAFLYHVGLYPIVLHGTGPQVNGRLEAQGIEPDYIDGIRITDEHTMAVVRKCFLEQNLKLVTALEQLGVRARPITSGVFTADYLDKDKYKLVGNIKSVTKEPIEASIKAGALPILTSLAETASGQMLNVNADVAAGELARVFEPLKIVYLNEKGGIINGSTGEKISMINLDEEYDDLMKQSWVKYGTKLKIREIKELLDYLPRSSSVAIINVQDLQKELFTDSGAGTMIRRGYKLVKRSSIGEFPSADALRKALQRDAGISSGKESVASYLRYLENSDFVSYADEPLEAVAIVKKDTNVPTLDKFVCSDAAWLNNVTDNVFNVLRRDFPALQWVVSENDANIAWHFDKSQGSYLKGGKVLFWYGIDDINTISELVENFVKSCDTASTLNSSASSGVFANKKSARSYSTRSTPRPEGVNTNPGRVALIGARGYTGKNLVSLINGHPYLEVAHVSSRELKGQKLQDYTKSEIIYESLQIQDIRKLEEQNAVDFWVMALPNKVCEPFVETIQSVHGKSKIIDLSADHRFVSESDWAYGLPELNDRAKIANAAKIANPGCYATGSQLTISPLTKYINGLPTVFGVSGYSGAGTKPSPKNDPKFLNNNLIPYALSDHIHEREISARIGHNVAFMPHVGQWFQGISLTVSIPIKKGSLSIDEIRKLYRNFYEDEKLVHVIDDIPLVKDIEGTHGVVIGGFKLNDAEDRVVVCATIDNLLKGAATQCLQNINLAMGYGEYAGIPENKIIGV

SEQ ID NO: 1748 - protein, 888 aa, Saccharomyces cerevisiae
MYVYKRDGRKEPVQFDKITARISRLCYGLDPKHIDAVKVTQRIISGVYEGVTTIELDNLAAETCAYMTTVHPDYATLAARIAISNLHKQTTKQFSKVVEDLYRYVNAATGKPAPMISDDVYNIVMENKDKLNSAIVYDRDFQYSYFGFKTLERSYLLRINGQVAERPQHLIMRVALGIHGRDIEAALETYNLMSLKYFTHASPTLFNAGTPKPQMSSCFLVAMKEDSIEGIYDTLKECALISKTAGGIGLHIHNIRSTGSYIAGTNGTSNGLIPMIRVFNNTARYVDQGGNKRPGAFALYLEPWHADIFDFIDIRKNHGKEEIRARDLFPALWIPDLFMKRVEENGTWTLFSPTSAPGLSDCYGDEFEALYTRYEKEGRGKTIKAQKLWYSILEAQTETGTPFVVYKDACNRKSNQKNLGVIKSSNLCCEIVEYSAPDETAVCNLASVALPAFIETSEDGKTSTYNFKKLHEIAKVVTRNLNRVIDRNYYPVEEARKSNMRHRPIALGVQGLADTFMLLRLPFDSEEARLLNIQIFETIYHASMEASCELAQKDGPYETFQGSPASQGILQFDMWDQKPYGMWDWDTLRKDIMKHGVRNSLTMAPMPTASTSQILGYNECFEPVTSNMYSRRVLSGEFQVVNPYLLRDLVDLGIWDEGMKQYLITQNGSIQGLPNVPQELKDLYKTVWEISQKTIINMAADRSVYIDQSHSLNLFLRAPTMGKLTSMHFYGWKKGLKTGMYYLRTQAASAAIQFTIDQKIADQATENVADISNLKRPSYMPSSASYAASDFVPAAVTANATIPSLDSSSEASREASPAPTGSHSLTKGMAELNVQESKVEVPEVPAPTKNEEKAAPIVDDEETEFDIYNSKVIACAIDNPEACEMCSG

SEQ ID NO: 1749 - protein, 520 aa, Saccharomyces cerevisiae
MLSRTRAAAPNSRIFTRSLLRLYSQAPLRVPITLPNGFTYEQPTGLFINGEFVASKQKKTFDVINPSNEEKITTVYKAMEDDVDEAVAAAKKAFETKWSIVEPEVRAKALFNLADLVEKHQETLAAIESMDNGKSLFCARGDVALVSKYLRSCGGWADKIYGNVIDTGKNHFTYSIKEPLGVCGQIIPWNFPLLMWSWKIGPALATGNTVVLKPAETTPLSALFASQLCQEAGIPAGVVNILPGSGRVVGERLSAHPDVKKIAFTGSTATGRHIMKVAADTVKKVTLELGGKSPNIVFADADLDKAVKNIAFGIFYNSGEVCCAGSRIYIQDTVYEEVLQKLKDYTESLKVGDPFDEEVFQGAQTSDKQLHKILDYVDVAKSEGARLVTGGARHGSKGYFVKPTVFADVKGDMRIVKEEVFGPIVTVSKFSTVDEVIAMANDSQYGLAAGIHTNDINKAVDVSKRVKAGTVWINTYNNFHQNVPFGGFGQSGIGREMGEAALSNYTQTKSVRIAIDKPIR

SEQ ID NO: 1750 - protein, 928 aa, Saccharomyces cerevisiae
MKDSVDCPSILPTDRTSVLSETSTLVGSSSHVYSRHAPMNSYHNSMNSNIYHSPKASSPLVSYKTSSPVLLKRATAPVLPSFKPKEQRYNKPQGCSLITAVELGKIIETLPDEKVLLLDVRPFTEHAKSIITNSIHVCLPSTLLRRKNFTFSKLLDNLTPSEQSVLKSKLAIDNLRIIIYDSTANQTESSVSLPCYGIASKLIEFDTNVKKTVSILMCGFPQFKILFPDHINTNTFNSDCISSAEPKSPKTNLMNSLHNTAPHMTATTPLSSPQMNLKLKVPDDSRSDHSNFSSSPSPRNVLSDSPMSSSSPISALFKFQLPAPQTNINQMFKFSQNEEIMGLETYLSAVNIKEEHERWYNNDSAKKSLQNFQFPKNQNSLEKDTNKDKLGFQIRYENLSKNYEKEVIDSVIPEWFQHLMSIPKIELVSQFQKLDFLEKRRLNHSVSFRKKENSFILEKPSSYPEQLTSTSSSTIMPPKFPDVNKVQKRSHSQPIFTQYSKYKSMLSLESDSDSESDDVIISSGVELGAKNRYKDIFPYEHSRVILKKGLQSSKGIKHSHSTSDGGILDNYINANYLSLPRFSVEQNSSFQTTTTTTRRVRYIATQAPMPSTVHDFYTCILNNGVPLVLSLTNDFENGIEKCYRYWQEGNYNGIHVKLLEKKILKMPSTTSMRKNTMGTQNSSLYSAGVQGNSSNYSTDNDNDNDNNNNNNNNSNIPVTAAACDDDDDDDDDAILIRQILLTYHDQEKPYELLQIQVKNWPDLGTLLNPISILQAINVKNHIIDTLFARNYYQNDQLPTILVHCSAGCGRTGTLCTIDSILSNFEMFEMLQKEFVKLKYPAKLFDPISWTINIFRKERISMVQNINQFIFIYDCLLFYFRLRLDDITERTDGDGSNKDNISLSALIEQIEKLEILQTFVDDKLKELPQ

SEQ ID NO: 1751 - protein, 511 aa, Saccharomyces cerevisiae
MLHRINPVRFSMQSCQRYFSKLVSPLEQHKSNTFTNRVRIPIEAGQPLHETRPFLIKSGELTPGISALEYYERRIRLAETLPPKSCVILAGNDIQFASGAVFYPFQQENDLFYLSGWNEPNSVMILEKPTDSLSDTIFHMLVPPKDAFAEKWEGFRSGVYGVQEIFNADESASINDLSKYLPKIINRNDFIYFDMLSTSNPSSSNFKHIKSLLDGSGNSNRSLNSIANKTIKPISKRIAEFRKIKSPQELRIMRRAGQISGRSFNQAFAKRFRNERTLDSFLHYKFISGGCDKDAYIPVVATGSNSLCIHYTRNDDVMFDDEMVLVDAAGSLGGYCADISRTWPNSGKFTDAQRDLYEAVLNVQRDCIKLCKASNNYSLHDIHEKSITLMKQELKNLGIDKVSGWNVEKLYPHYIGHNLGLDVHDVPKVSRYEPLKVGQVITIEPGLYIPNEESFPSYFRNVGIRIEDDIAIGEDTYTNLTVEAVKEIDDLENVMQNGLSTKFEEDQVAPL

SEQ ID NO: 1752 - protein, 464 aa, Saccharomyces cerevisiae
MGQILSNPVIDKESHSGADSLTAFGLCAMQGWRMSMEDSHILEPNVLTKSDKDHIAFYGIFDGHGGAKVAEYCGNKIVEILQEQKSFHEGNLPRALIDTFINTDVKLLQDPVMKEDHSGCTATSILVSKSQNLLVCGNAGDSRTVLATDGNAKALSYDHKPTLASEKSRIVAADGFVEMDRVNGNLALSRAIGDFEFKSNPKLGPEEQIVTCVPDILEHSLDYDRDEFVILACDGIWDCLTSQDCVDLVHLGLREGKTLNEISSRIIDVCCAPTTEGTGIGCDNMSIVVVALLKEGEDVAQWSDRMKSKAHRTSVRSFADKRRRVFSYYDFSKCNDEQVFAITTKKPQDKFTRDHEAAVASVTAADNDDPMDIDDTDADTDAENLDPSSQSKSKTSGPIDLASLEALLGATGGVKTDSNGNKVTYTLPQSALAQLLQTMGHDPASSHPENDSNTDHKAGRSHLQ

SEQ ID NO: 1753 - protein, 767 aa, Saccharomyces cerevisiae
MVQSAVLGFPRIGPNRELKKATEGYWNGKITVDELFKVGKDLRTQNWKLQKEAGVDIIPSNDFSFYDQVLDLSLLFNVIPDRYTKYDLSPIDTLFAMGRGLQRKATETEKAVDVTALEMVKWFDSNYHYVRPTFSKTTQFKLNGQKPVDEFLEAKELGIHTRPVLLGPVSYLFLGKADKDSLDLEPLSLLEQLLPLYTEILSKLASAGATEVQIDEPVLVLDLPANAQAAIKKAYTYFGEQSNLPKITLATYFGTVVPNLDAIKGLPVAALHVDFVRAPEQFDEVVAAIGNKQTLSVGIVDGRNIWKNDFKKSSAIVNKAIEKLGADRVVVATSSSLLHTPVDLNNETKLDAEIKGFFSFATQKLDEVVVITKNVSGQDVAAALEANAKSVESRGKSKFIHDAAVKARVASIDEKMSTRAAPFEQRLPEQQKVFNLPLFPTTTIGSFPQTKDIRINRNKFNKGTISAEEYEKFINSEIEKVIRFQEEIGLDVLVHGEPERNDMVQYFGEQINGYAFTVNGWVQSYGSRYVRPPIIVGDLSRPKAMSVKESVYAQSITSKPVKGMLTGPITCLRWSFPRDDVDQKTQAMQLALALRDEVNDLEAAGIKVIQVDEPALREGLPLREGTERSAYYTWAAEAFRVATSGVANKTQIHSHFCYSDLDPNHIKALDADVVSIEFSKKDDANYIAEFKNYPNHIGLGLFDIHSPRIPSKDEFIAKISTILKSYPAEKFWVNPDCGLKTRGWEETRLSLTHMVEAAKYFREQYKN

SEQ ID NO: 1754 - protein, 205 aa, Saccharomyces cerevisiae
MSDPSSINGGIVVAMTGKDCVAIACDLRLGSQSLGVSNKFEKIFHYGHVFLGITGLATDVTTLNEMFRYKTNLYKLKEERAIEPETFTQLVSSSLYERRFGPYFVGPVVAGINSKSGKPFIAGFDLIGCIDEAKDFIVSGTASDQLFGMCESLYEPNLEPEDLFETISQALLNAADRDALSGWGAVVYIIKKDEVVKRYLKMRQD

SEQ ID NO: 1755 - protein, 400 aa, Saccharomyces cerevisiae
MSQVQEQHISESQLQYGNGSLMSTVPADLSQSVVDGNGNGSSEDIEATNGSGDGGGLQEQAEAQGEMEDEAYDEAALGSFVPIEKLQVNGITMADVKKLRESGLHTAEAVAYAPRKDLLEIKGISEAKADKLLNEAARLVPMGFVTAADFHMRRSELICLTTGSKNLDTLLGGGVETGSITELFGEFRTGKSQLCHTLAVTCQIPLDIGGGEGKCLYIDTEGTFRPVRLVSIAQRFGLDPDDALNNVAYARAYNADHQLRLLDAAAQMMSESRFSLIVVDSVMALYRTDFSGRGELSARQMHLAKFMRALQRLADQFGVAVVVTNQVVAQVDGGMAFNPDPKKPIGGNIMAHSSTTRLGFKKGKGCQRLCKVVDSPCLPEAECVFAIYEDGVGDPREEDE

SEQ ID NO: 1756 - protein, 754 aa, Saccharomyces cerevisiae
MIKRWLSVNRKKSHPEKNTQGNDEINRKATSLKKTKGSGDPSIAKSPSAKSSTSSIPSNLASHERRSKFSSQTDNLAGNKHYHEHYHNMASTSDEREYDSSTTYEDRAFDTESSILFTTITDLMPYGDGSNKVFGYENFGNTCYCNSVLQCLYNIPEFRCNVLRYPERVAAVNRIRKSDLKGSKIRVFTNESFETSTNSGNSNTGYQSNDNEDAHNHHHLQQSDQDNSSSSTQEKQNNFERKRNSFMGFGKDKSNYKDSAKKDDNNEMERPQPVHTVVMASDTLTEKLHEGCKKIIVGRPLLKQSDSLSKASTTDCQANSHCQCDSQGSRITSVDDDVLVNPESCNDAVNNSNNNKENTFPTSEQRKKAALIRGPVLNVDHLLYPTEEATLYNGLKDIFESITENLSLTGIVSPTEFVKILKKENVLFNTMMQQDAHEFLNFLLNDFSEYIQRNNPRMRFGPQKTDNSNDNFITDLFKGTLTNRIKCLTCDNITSRDEPFLDFPIEVQGDEETDIQKMLKSYHQREMLNGVNKFYCNKCYGLQEAERMVGLKQLPHILSLHLKRFKYSEEQKSNIKLFNKILYPLTLDVSSTFNTSVYKKYELSGVVIHMGSGPQHGHYVCICRNEKFGWLLYDDETVESIKEETVLQFTGHPGDQTTAYVLFYKETQADKTENQNENIDTSSQDQMQTDNNIEQLIKCDDWLRDRKLRAAANIERKKTLGNIPEVKTAETKTPLNDKKRNKQKRKSRILSFIK

SEQ ID NO: 1757 - protein, 318 aa, Saccharomyces cerevisiae
MSTNSIKLLAGNSHPGLAELISQRLGVPLSKVGVYQYSNKETSVTIGESIRDEDVYIIQTGYGEHEINDFLMELLILIHACKTASVRRITAVIPNFPYARQDKKDKSRAPITAKLIANLLETAGCDHVITMDLHASQIQGFFHIPVDNLYGEPSVLNYIRTKTDFNNAILVSPDAGGAKRVASLADKLDMNFALIHKERQKANEVSRMLLVGDVAGKSCLLIDDMADTCGTLVKACDTLMDHGAKEVIAIVTHGIFSGSAREKLINSRLSRIVCTNTVPVDLDLDIVDQVDISPTIAEAIRRLHNGESVSYLFTHAPV

SEQ ID NO: 1758 - protein, 250 aa, Saccharomyces cerevisiae
MATKQAHKRLTKEYKLMVENPPPYILARPNEDNILEWHYIITGPADTPYKGGQYHGTLTFPSDYPYKPPAIRMITPNGRFKPNTRLCLSMSDYHPDTWNPGWSVSTILNGLLSFMTSDEATTGSITTSDHQKKTLARNSISYNTFQNVRFKLIFPEVVQENVETLEKRKLDEGDAANTGDETEDPFTKAAKEKVISLEEILDPEDRIRAEQALRQSENNSKKDGKEPNDSSSMVYIGIAIFLFLVGLFMK

SEQ ID NO: 1759 - protein, 430 aa, Saccharomyces cerevisiae
MAEKILENKDPKLEAMTVDHEVSAPKPIPVDEPTLTRVARPLRHVRHIPVKSLVFHSKHGPITFSYENKIKLPISKNKLVVQVNYVGLNPVDMKIRNGYTKPIYGEAGIGREYSGVITHVGDNLTNRWNVGDDVYGIYYHPKLAIGALQSSLLIDPRVDPILMRPKNTLSPEKAAGSLFCLGTALNLLAQLKEKDQLNTESNVLINGGTSSVGMFAIQLLKRYYKVSKKLVVVTSGNGAAVLSEHFPDLKDEIIFINYLSCRGKSSKPLRRMLDTGKVVDYDDFNTLKETEDYTQGKFNVVLDFIGGYDILSHSSSLIHAKGAYITTVGDYVGNYKKDVFDSWDNPSANARKMFGSMLWSYDYSHFYFDPNIKIIPKKNDWIHECGKLLNEGVVDCVVDKVYSWKNFKEAFSYMATQRAQGKLIMKVEGF

SEQ ID NO: 1760 - protein, 642 aa, Saccharomyces cerevisiae
MSKAVGIDLGTTYSCVAHFANDRVEIIANDQGNRTTPSYVAFTDTERLIGDAAKNQAAMNPHNTVFDAKRLIGRKFDDPEVTNDAKHYPFKVIDKGGKPVVQVEYKGETKTFTPEEISSMILTKMKETAENFLGTEVKDAVVTVPAYFNDSQRQATKDAGTIAGLNVLRIINEPTAAAIAYGLDKKSQKEHNVLIFDLGGGTFDVSLLSIDEGVFEVKATAGDTHLGGEDFDSRLVNFLAEEFKRKNKKDLTTNQRSLRRLRTAAERAKRTLSSSAQTSIEIDSLFEGIDFYTSITRARFEELCADLFRSTLEPVEKVLADSKLDKSQIDEIVLVGGSTRIPKVQKLVSDFFNGKEPNRSINPDEAVAYGAAVQAAILTGDQSSTTQDLLLLDVAPLSLGIETAGGIMTKLIPRNSTIPTKKSEVFSTYADNQPGVLIQVFEGERTRTKDNNLLGKFELSGIPPAPRGVPQIEVTFDIDANGILNVSAVEKGTGKSNKITITNDKGRLSKEDIDKMVAEAEKFKAEDEQEAQRVQAKNQLESYAFTLKNSVSENNFKEKVGEEDARKLEAAAQDAINWLDASQAASTEEYKERQKELEGVANPIMSKFYGAAGGAPGAGPVPGAGAGPTGAPDNGPTVEEVD

SEQ ID NO: 1761 - protein, 365 aa, Saccharomyces cerevisiae
MSFFNRSNTTSALGTSTAMANEKDLANDIVINSPAEDSISDIAFSPQQDFMFSASSWDGKVRIWDVQNGVPQGRAQHESSSPVLCTRWSNDGTKVASGGCDNALKLYDIASGQTQQIGMHSAPIKVLRFVQCGPSNTECIVTGSWDKTIKYWDMRQPQPVSTVMMPERVYSMDNKQSLLVVATAERHIAIINLANPTTIFKATTSPLKWQTRCVACYNEADGYAIGSVEGRCSIRYIDDGMQKKSGFSFKCHRQTNPNRAPGSNGQSLVYPVNSIAFHPLYGTFVTAGGDGTFNFWDKNQRHRLKGYPTLQASIPVCSFNRNGSVFAYALSYDWHQGHMGNRPDYPNVIRLHATTDEEVKEKKKR

SEQ ID NO: 1762 - protein, 594 aa, Saccharomyces cerevisiae
MHLAAMMLGNPMAPAVQMRNVNMNPIPIPMVGNPIVNNFSIPPYNNANPTTGATAVAPTAPPSGDFTNVGPTQNRSQNVTGWPVYNYPMQPTTENPVGNPCNNNTTNNTTNNKSPVNQPKSLKTMHSTDKPNNVPTSKSTRSRSATSKAKGKVKAGLVAKRRRKNNTATVSAGSTNACSPNITTPGSTTSEPAMVGSRVNKTPRSDIATNFRNQAIIFGEEDIYSNSKSSPSLDGASPSALASKQPTKVRKNTKKASTSAFPVESTNKLGGNSVVTGKKRSPPNTRVSRRKSTPSVILNADATKDENNMLRTFSNTIAPNIHSAPPTKTANSLPFPGINLGSFNKPAVSSPLSSVTESCFDPESGKIAGKNGPKRAVNSKVSASSPLSIATPRSGDAQKQRSSKVPGNVVIKPPHGFSTTNLNITLKNSKIITSQNNTVSQELPNGGNILEAQVGNDSRSSKGNRNTLSTPEEKKPSSNNQGYDFDALKNSSSLLFPNQAYASNNRTPNENSNVADETSASTNSGDNDNTLIQPSSNVGTTLGPQQTSTNENQNVHSQNLKFGNIGMVEDQGPDYDLNLLDTNENDFNFINWEG

SEQ ID NO: 1763 - protein, 1093 aa, Saccharomyces cerevisiae
MPFDVLISNQKDNTNHQNITPISKSVLLAPHSNHPVIEIATYSETDVYECYIRGFETKIVMRRTKDDWINITQVFKIAQFSKTKRTKILEKESNDMQHEKVQGGYGRFQGTWIPLDSAKFLVNKYEIIDPVVNSILTFQFDPNNPPPKRSKNSILRKTSPGTKITSPSSYNKTPRKKNSSSSTSATTTAANKKGKKNASINQPNPSPLQNLVFQTPQQFQVNSSMNIMNNNDNHTTMNFNNDTRHNLINNISNNSNQSTIIQQQKSIHENSFNNNYSATQKPLQFFPIPTNLQNKNVALNNPNNNDSNSYSHNIDNVINSSNNNNNGNNNNLIIVPDGPMQSQQQQQHHHEYLTNNFNHSMMDSITNGNSKKRRKKLNQSNEQQFYNQQEKIQRHFKLMKQPLLWQSFQNPNDHHNEYCDSNGSNNNNNTVASNGSSIEVFSSNENDNSMNMSSRSMTPFSAGNTSSQNKLENKMTDQEYKQTILTILSSERSSDVDQALLATLYPAPKNFNINFEIDDQGHTPLHWATAMANIPLIKMLITLNANALQCNKLGFNCITKSIFYNNCYKENAFDEIISILKICLITPDVNGRLPFHYLIELSVNKSKNPMIIKSYMDSIILSLGQQDYNLLKICLNYQDNIGNTPLHLSALNLNFEVYNRLVYLGASTDILNLDNESPASIMNKFNTPAGGSNSRNNNTKADRKLARNLPQKNYYQQQQQQQQPQNNVKIPKIIKTQHPDKEDSTADVNIAKTDSEVNESQYLHSNQPNSTNMNTIMEDLSNINSFVTSSVIKDIKSTPSKILENSPILYRRRSQSISDEKEKAKDNENQVEKKKDPLNSVKTAMPSLESPSSLLPIQMSPLGKYSKPLSQQINKLNTKVSSLQRIMGEEIKNLDNEVVETESSISNNKKRLITIAHQIEDAFDSVSNKTPINSISDLQSRIKETSSKLNSEKQNFIQSLEKSQALKLATIVQDEESKVDMNTNSSSHPEKQEDEEPIPKSTSETSSPKNTKADAKFSNTVQESYDVNETLRLATELTILQFKRRMTTLKISEAKSKINSSVKLDKYRNLIGITIENIDSKLDDIEKDLRANA

SEQ ID NO: 1764 - protein, 1040 aa, Saccharomyces cerevisiae
MSNDREVPTLSQLNTTVSRDKDVSDTLSPDFDSKGSATGRDGGNFPMYIAINEYFKRMEDELDMKPGDKIKVITDDEEYKDGWYFGRNLRTNEEGLYPVVFTQKITVEKAPTLMRAKSTKRIYSPLTNEDPLLSSTFISENDSNSELPTPQPIETAASISRTANGKIERNLSLKNTMSDIDNALLEFKDDSIGPPDRFINSGRDEEHSITHETILSATDGLDVVESNSKPTTSSSTGFLNGDLENQATLINGIDTTKLNPVEAEFWSPEEITAYFIMEGYDVQSASRFQKHKISGKILLELELVHLKELDINSFGTRFEIFKEIEKIKEAIRTNGRSLNRASKTNNANIYNQLMPPANVDQRASYRGHVRKTSQSLEDLPSQQNFIPTPRNTRNSSASKHRPKSLVFDSQEANANIAPDVQIPQVVEEMAGNENLFVSPRRAPKPPSYPSPAQPPKSPLLNNTRTSPSPAQLYSWQSPTLSFSGPKRTSYIDQYSSSDSNFNSRSALPKNNQGGGKALSPIPSPTRNSVRNEDSEGKLTSSSKRNSVPYYGYAPESSSDRKSSCSSHEEEQFQETMNTFERPTSSIYADGSTIASISNDKLAHEKEGKKKPTRHSSSLSSKSKSDSRRNSSLKRSSSASRTSSFKKSSFMLSPFRQQFTDNAARSSSPEENPITSMPSEKNSSPIVDKKSSKKSRSKRRSVSAKEAEIFTETVKDDKNKRSASEAIKGETLKGKSLRQMTARPVAKKKQTSAFIEGLRSISVKEAMKDADFSGWMSKKGSGAMSTWKTRFFTLHGTRLSYFSSTTDTRERGLIDITAHRVVPAKEDDKLVSLYAASTGKGRYCFKLLPPQPGSKKGLTFTQPRTHYFAVDNKEEMRGWMAALIKTTIDIDTSVPIISSYTTPTVSLSKAQEMLAEAREETKLREQQMLENEEDEDQFLWDQQQLQQQQHDNNQGQADRTISASTQRTSDEDNTISTPNLSSANNTTIGSNGFSSPFLLASGLLSPGVARNSSMRGTEKKGKFSTEEDYFGDNSKHKTDKI

SEQ ID NO: 1765 - protein, 367 aa, Saccharomyces cerevisiae
MSISSKIRPTPRKPSRMATDHSFKMKKFYADPFAISSISLAIVSWVIAIGGSISSASTNESFPRFTWWGIVYQFLIICSLMLFYCFDLVDHYRIFITTSIAVAFVYNTNSATNLVYADGPKKAAASAGVILLSIINLIWILYYGGDNASPTNRWIDSFSIKGIRPSPLENSLHRARRRGNRNTTPYQNNVYNDAIRDSGYATQFDGYPQQQPSHTNYVSSTALAGFENTQPNTSEAVNLHLNTLQQRINSASNAKETNDNSNNQTNTNIGNTFDTDFSNGNTETTMGDTLGLYSDIGDDNFIYKAKALYPYDADDDDAYEISFEQNEILQVSDIEGRWWKARRANGETGIIPSNYVQLIDGPEEMHR

SEQ ID NO: 1766 - protein, 539 aa, Saccharomyces cerevisiae
MSQRSSQHIVGIHYAVGPKIGEGSFGVIFEGENILHSCQAQTGSKRDSSIIMANEPVAIKFEPRHSDAPQLRDEFRAYRILNGCVGIPHAYYFGQEGMHNILIIDLLGPSLEDLFEWCGRKFSVKTTCMVAKQMIDRVRAIHDHDLIYRDIKPDNFLISQYQRISPEGKVIKSCASSSNNDPNLIYMVDFGMAKQYRDPRTKQHIPYRERKSLSGTARYMSINTHFGREQSRRDDLESLGHVFFYFLRGSLPWQGLKAPNNKLKYEKIGMTKQKLNPDDLLLNNAIPYQFATYLKYARSLKFDEDPDYDYLISLMDDALRLNDLKDDGHYDWMDLNGGKGWNIKINRRANLHGYGNPNPRVNGNTARNNVNTNSKTRNTTPVATPKQQAQNSYNKDNSKSRISSNPQSFTKQQHVLKKIEPNSKYIPETHSNLQRPIKSQSQTYDSISHTQNSPFVPYSSSKANPKRSNNEHNLPNHYTNLANKNINYQSQRNYEQENDAYSDDENDTFCSKIYKYCCCCFCCCWIKRFLYFSLFPFFF

SEQ ID NO: 1767 - protein, 1142 aa, Saccharomyces cerevisiae
MDRSDKKVNVEEVNVPSNLQIELEKSGTSSSVSLRSPTKSSATNLAGMAEGARDNASIASSSVDSLNMLLERQRVRQLNHPQHQQHISSSLAKTPTTTSSFCSSGSSKNKVKETNRISLTYDPVSKRKVLNTYEIIKELGHGQHGKVKLARDILSKQLVAIKIVDRHEKKQRKFFTFIKSSKISENDKIKREIAIMKKCHHKHVVQLIEVLDDLKSRKIYLVLEYCSRGEVKWCPPDCMESDAKGPSLLSFQETREILRGVVLGLEYLHYQGIIHRDIKPANLLISGDGTVKISDFGVSLAASSTNSSDSSESLDELELAKTVGTPAFFAPEMCLGEDAFTRYNLTKENLFRGSCISFMIDIWAVGVTLYCLLFGMLPFFSDFELKLFEKIVNDPLKFPTFKEIQSNKVSKVSCEEEYEMAKDLLLKLLEKNPQKRMTIPAIKKHPFVSWDFDHVPENDEKLLSSVLEQKLRFQCNQTDQFEPISISKHELKNAVSGVGKKIKESVLKSIPLKDPSDLSNKNYLHPTETTRGRGDANVIVSEGSVLSNIKELSANDGCLNTDSDTNININDDDHYSGDDNDGHLTKRELERELNKFDDKHEAGNMVNLPINSSFASLDSFYIDNFAMARMGMSSPEAGDSVSSVPNLPSAPSSTRLGRSPVFSGVTNQPSPIRPVLPQQKSSFCATGRYDKSHNSLLRNSSSHLTSYNSGRPSSRTGRMNSRNQNLPKIPNSLSKISTTKLTELRVPKDSEIPSPAKNPNADRLRRFPVKKNTKTPAIKDPPRININSSDKSGSKNSPIKSLYQRMKQSKDNSKTFEVRRGNFFSHFNGDDDDSSSQSSVTSSGSESDSELSSTSSSCTSGTQSRNSSNNNAYSETESLPFEFGVDSEDGSGVLLRDLPNEDQIRPFLDIQPCRRMKVKSSLNLEPPSVSSSSSSSSDEDELILNVGTAGHRRRHNSSKLSELSNSPQKGSNNFMYSNGSVHDSETTITPQNMDDLTLHQALSRSQPISKPGPLVLPKRLDQKKATTETSNLTDIVEFNGNNDHRKDKNFDKVLYSRDLLKDALSSTNAGRRRSIPSNKIRGRKDASITMSTNVGNDEHARNTSCHGDKGQENGAIKQRTHERSRSLTVAELNEEKRRSALP

SEQ ID NO: 1768 - protein, 312 aa, Saccharomyces cerevisiae
MDSQPVDVDNIIDRLLEVRGSKPGQQVDLEENEIRYLCSKARSIFIKQPILLELEAPIKICGDIHGQYYDLLRLFEYGGFPPESNYLFLGDYVDRGKQSLETICLLLAYKIKYPENFFILRGNHECASINRIYGFYDECKRRYNIKLWKTFTDCFNCLPIAAIIDEKIFCMHGGLSPDLNSMEQIRRVMRPTDIPDVGLLCDLLWSDPDKDIVGWSENDRGVSFTFGPDVVNRFLQKQDMELICRAHQVVEDGYEFFSKRQLVTLFSAPNYCGEFDNAGAMMSVDESLLCSFQILKPAQKSLPRQAGGRKKK

SEQ ID NO: 1769 - protein, 805 aa, Saccharomyces cerevisiae
MGSEQALSEVVESAKERFGRLRHLVQKFLDDDDVPQECLPLLQECAEIWSSYVDACQDITMQAPKEDANRLSKGFLRLNETAFLYYMIVYTLLEDTLPRLKEFSSNKDQNVRNLYGERIQLLHNDPNIERIRNVIENYPKFIQLQTIEPGKLSSMLHFHGDALLLIDVRPRSEFVRAHIKCKNIICIDPASFKDSFTDQQIESVSLITSPHSDITFFSNRDKFKFIILYTDTQLHNNFQQRQTRILAKILSQNSVIKPLSGTKILILENGFSNWVKLGGAYQSSVSETAHLTSSSSTPAFGSPQVPTGLFNQKSLSPNKDKSMPMVSMNTQPLLTTVQRPQLPLYYSDLPIIPQPSPNRNSPTVQKFSPHPPTTLSKLNTPSTIQNKANTVERISPDIRAAQAHAYLPPASNVFSPRIPPLPQQNLSSSRQTILNNSQVLDLDLIVGLENIGNCCYMNCILQCLVGTHDLVRMFLDNTYLNFINFDSSRGSKGLLAKNFAILVNNMHRHGAFTPPNVRTIPVQTIQFKKICGHINPMYSDSMQQDCQEFCQFLLDGLHEDLNQNGSKKHLKQLSDEEERMREKMSIRKASALEWERFLLTDFSAIIDLFQGQYASRLQCQVCEHTSTTYQTFSVLSVPVPRVKTCNILDCFREFTKCERLGVDEQWSCPKCLKKQPSTKQLKITRLPKKLIINLKRFDNQMNKNNVFVQYPYSLDLTPYWARDFNHEAIVNEDIPTRGQVPPFRYRLYGVACHSGSLYGGHYTSYVYKGPKKGWYFFDDSLYRPITFSTEFITPSAYVLFYERIF

SEQ ID NO: 1770 - protein, 240 aa, Saccharomyces cerevisiae
MADEERLKEFKEANKIVFDPNTRQVWENQNRDGTKPATTFQSEEDIKRAAPESEKDTSATSGIVPTLQNIVATVTLGCRLDLKTVALHARNAEYNPKRFAAVIMRIREPKTTALIFASGKMVVTGAKSEDDSKLASRKYARIIQKIGFAAKFTDFKIQNIVGSCDVKFPIRLEGLAFSHGTFSSYEPELFPGLIYRMVKPKIVLLIFVSGKIVLTGAKQREEIYQAFEAIYPVLSEFRKM

SEQ ID NO: 1771 - protein, 420 aa, Saccharomyces cerevisiae
MHKFDLELSRRANPLLFSAERYEEYPLKYDELKQYLLSQNPSHPHHNSRPYTSIDYFDYLLYRSKNDESEIDLDKKLVSEFALYYVQKEHLNSDDLNPTLNELLKLQPKSADWYEMMLRILESINTTGIDQLTKENNNSFPNSKRARSSTNMGGTDKFNKGAYHTDKADDDKNEILQELTSFLMSNSIQKGIDIKPIPLDDPVKFLKNGINSILDTCVSLEKNTSSPPISPNAAAIQEEDSSKKLEELETAFSDLQLAHNFLTKQFENDRAEYVQDIEKLTRTNRELQDKLLNNHSNLSKTEKKLHELEQENKELEKANNKLNSSRHNFGMSSPASSPVTWDPSSPSSVGSPTSGSGSRSLSIMTSEFKKVLTSTQRKYEKELSDEREHRFKLERELALLKNAEANTSLALNRDDPPDML

SEQ ID NO: 1772 - protein, 912 aa, Saccharomyces cerevisiae
MNMQDANKEESYSMYPKTSSPPPPTPTNMQIPIYQAPLQMYGYTQAPYLYPTQIPAYSFNMVNQNQPIYHQSGSPHHLPPQNNINGGSTTNNNNINKKKWHSNGITNNNGSSGNQGANSSGSGMSYNKSHTYHHNYSNNHIPMMASPNSGSNAGMKKQTNSSNGNGSSATSPSYSSYNSSSQYDLYKFDVTKLKNLKENSSNLIQLPLFINTTEAEFAAASVQRYELNMKALNLNSESLENSSVEKSSAHHHTKSHSIPKHNEEVKTETHGEEEDAHDKKPHASKDAHELKKKTEVKKEDAKQDRNEKVIQEPQATVLPVVDKKEPEESVEENTSKTSSPSPSPPAAKSWSAIASDAIKSRQASNKTVSGSMVTKTPISGTTAGVSSTNMAAATIGKSSSPLLSKQPQKKDKKYVPPSTKGIEPLGSIALRMCFDPDFISYVLRNKDVENKIPVHSIIPRGIINRANICFMSSVLQVLLYCKPFIDVINVLSTRNTNSRVGTSSCKLLDACLTMYKQFDKETYEKKFLENADDAEKTTESDAKKSSKSKSFQHCATADAVKPDEFYKTLSTIPKFKDLQWGHQEDAEEFLTHLLDQLHEELISAIDGLTDNEIQNMLQSINDEQLKVFFIRNLSRYGKAEFIKNASPRLKELIEKYGVINDDSTEENGWHEVSGSSKRGKKTKTAAKRTVEIVPSPISKLFGGQFRSVLDIPNNKESQSITLDPFQTIQLDISDAGVNDLETAFKKFSEYELLPFKSSSGNDVEAKKQTFIDKLPQVLLIQFKRFSFINNVNKDNAMTNYNAYNGRIEKIRKKIKYGHELIIPEESMSSITLKNNTSGIDDRRYKLTGVIYHHGVSSDGGHYTADVYHSEHNKWYRIDDVNITELEDDDVLKGGEEASDSRTAYILMYQKRN

SEQ ID NO: 1773 - protein, 2167 aa, Saccharomyces cerevisiae
MKGLLWSKNRKSSTASASSSSTSTSHKTTTASTASSSSPSSSSQTIRNSTSGASPYMHSHHHHGQGHSHHRGEDNNRDKRKSSVFPPSKQYTSTSSSQVNLGMYHSDTNTRSSRSIASTLKDDSPSVCSEDEISNSSSQKSNAQDETPIAYKKSAHSKDSLLPSRSSSLSPPQSRCSTGTTLEKSLNTSGISNSSGTNNNNSNNNNDNEQKQRNVIHLNSENYDTTVFKTGWVNKSHGQTVATNYNSSMTAPSSSSSSSSQNLRNDAYSRNRESRFYGNDGSSLKNDDSSSTTATNSGNDVASARSSMAIDPQMLVPDYRLYRAQLKGCVLNLYKSGLNSNIKFFDPTLPASNSSIANENHQQKKQQTNNQAQAEALHQKQSFGQMGEPITLDLKYLSEVYPHPDLRQDSDGKIISGTIESLCHTVLFYPGPKQSDVPNEKSLSKTHRAVINLLLMFPLLDHFIKFLKVFNQFGLSFTKNKSRLTNNSTQFYNISPAVDDSMTQRLALTAKTILDVFPGFLLDEPMLKTIISLLDTISLHNDEISNNLKIKIANKHNELMKLTAFTRSLPMATSSTHELEIILDPSHFLSLDITTLADEVHHINLKFDKVWAPKFDYSLLYDSKFINRRIVSLNPLVFNNDQNIHFLGRLLISHLFPTNPEFSKKVTPKVRAELLDKWVQIGCRFEHLGDMVSWLAVATIICSIPVLRSSSWKYVPDQSLKTIFKDWVPTIIQLERRQRTSKSTSSVFILAPPNLDDDFTRANVISYFGDLLIHADDLPSDTKFKYLEKKINRTKNAFHKWQQRLQAIDSTRHKTNSTENVRDNDSPNNVVYQLWKFHLSQPPLNIEGIMKLSVQHEPPIIDQKAYSTIGSQRSALVTGSYLPILFNELFPNYSLFPKNTLVGAASDAKLPPPRSSARLSKSLSISEPIPIASNSHTMGSLTDDAMSSKNDNNKVTGVGKIDGPVIKEMSSKQSNKQRLLKSVRDVFNIDMDVFHISDELVFKSVYDNDGKSRPASMVIETPKRFSQHSSMLINNPATPNQKMRDSLDTTGRLSKTLENMDFFNNIGQVSDSLKESIIRVVLKSSSLEKIFDLLVLTSNIFSKLVDTKDLENYYYHQRQRGHSTRGLSDDNIGLLDYAFVKLTMDNDIFTETFFNTYKSFTTTTTVLENMAKRYVGAKSCSVSISKILDRSDDSKMKINEDTNLVSSSLYDQNFPVWDMKVTDDENINLIYMAKIQIGAAEAILHLVKNHYSDFTDDLCNNSTLLDIIKIMEQEVSTEWPTRIANSKLQKSLPENFVIETENLLTTLTDLFHGIKSAYQKQLYRPIGVNRTQKRITDILNSFNTFSFTDLNNIIDDPSFSDDMIRSFQKLHSTNYEDILEWIYQLDNFISKKFNLVSKKDWIVLFQELELLSKESLVSFFNYPLHFKSSKLINPGYLQLHEFEISNLFTWISTLILKDDNGTESLFFEKLPQSIKLLIKLHTSLTTFFVMEISNVNKSSSERLTTCKVILQILNYIRWKNGSLDLFDSEEDESPHAICPHIPAFIETAIAHAIISPESRNYELSWIKASEKLSDPTKGTQNLRSISNVLEKIDDIHIKRFIEIDDVFSKNCKNLCPCPGWFISRLLEISQFVPNMSITNSKLINFDKRRFVNNIISNVLDLIPNEREFPLDIEMSDENPSKRTTFGRILFNNFEDVNKVYRKKTKKVSESEAISERFQEQGVFNEILVNEIEKIKREARKLEVLLDQEKILKNSAALHQAVPKKNRKSVIISGTHSDNDHSYNINKNTGQTPSLGSVMESNNSARNRRDSRASFSTNRSSVVSNSSHNGVSKKIGGFFRRPFSIGGFNTSSSNYSLNSILSQEVSSNKSILPSILPEVDSMQLHDLKPSYSLKTFEIKSIMEIINHRNIPAYYYAFKIVMQNGHEYLIQTASSSDLTEWIKMIKASKRFSFHSKKYKGKTHNKIFGVPLEDVCERENTLIPTIVVKLLEEIELRGLDEVGLYRIPGSIGSINALKNAFDEEGATDNSFTLEDDRWFEVNAIAGCFKMYLRELPDSLFSHAMVNDFTDLAIKYKAHAMVNEEYKRMMNELLQKLPTCYYQTLKRIVFHLNKVHQHVVNNKMDASNLAIVFSMSFINQEDLANSMGSRLGAVQTILQDFIKNPNDYFKQ

SEQ ID NO: 1774 - protein, 573 aa, Saccharomyces cerevisiae
MLQQGSSSRRSLHGNDFHTLTSPSRRDSLSIPRAVDARSASTIDLFYIPDATVSRRHSTLVANRSDNNGNGAPMRQYNKPNFASSSTSSLPSTRNRPSRYDNMNMNMNMNMNMNMNMNMNMNNHTTSDHNAHPQYRCRPNPSRRHSLMTIPEKYSGSRYSLRSSPPTYSNPRVRKELTPFQLQRKQMKSAFQFPNGENFTPRNQIARLPPSSTFPDSPSSSSLPLTQTGGPSSADNDSIATGTNNRSPQQTKAADANQKSESESPKAIRSNSKKISRFFRKIWSSKSSNSADSVEENSKTKQKRKNPERVVPEPITSLDQPVEIIKQSFSTVNNHETAVPSIKDSGIVQELTALGDNNRIPVLPPPRSPNRPTLSDKRTTKLYYCSQDSSNEDIAPEEKSTVFLKRLQDEWSTVYLNKLPLTASVPSSLSTTTDAANSSFINSSISSPAPSSSSSSSLVSRGPMQSISSSPTPAPSSGSSKSKNAVKSLRFADEIYVNDTWSAADYCRCDNTFLNNFFKGKSQDITNPSTFVGNNLSSTKNISNIEIKMEVNEFKRKEMRVHQDSAKYTHYYL

SEQ ID NO: 1775 - protein, 1468 aa, Saccharomyces cerevisiae
MAAKDISTEVLQNPELYGLRRSHRAAAHQQNYFNDSDDEDDEDNIKQSRRKRMTTIEDDEDEFEDEEGEEDSGEDEDEEDFEEDDDYYGSPIKQNRSKPKSRTKSKSKSKPKSQSEKQSTVKIPTRFSNRQNKTVNYNIDYSDDDLLESEDDYGSEEALSEENVHEASANPQPEDFHGIDIVINHRLKTSLEEGKVLEKTVPDLNNCKENYEFLIKWTDESHLHNTWETYESIGQVRGLKRLDNYCKQFIIEDQQVRLDPYVTAEDIEIMDMERERRLDEFEEFHVPERIIDSQRASLEDGTSQLQYLVKWRRLNYDEATWENATDIVKLAPEQVKHFQNRENSKILPQYSSNYTSQRPRFEKLSVQPPFIKGGELRDFQLTGINWMAFLWSKGDNGILADEMGLGKTVQTVAFISWLIFARRQNGPHIIVVPLSTMPAWLDTFEKWAPDLNCICYMGNQKSRDTIREYEFYTNPRAKGKKTMKFNVLLTTYEYILKDRAELGSIKWQFMAVDEAHRLKNAESSLYESLNSFKVANRMLITGTPLQNNIKELAALVNFLMPGRFTIDQEIDFENQDEEQEEYIHDLHRRIQPFILRRLKKDVEKSLPSKTERILRVELSDVQTEYYKNILTKNYSALTAGAKGGHFSLLNIMNELKKASNHPYLFDNAEERVLQKFGDGKMTRENVLRGLIMSSGKMVLLDQLLTRLKKDGHRVLIFSQMVRMLDILGDYLSIKGINFQRLDGTVPSAQRRISIDHFNSPDSNDFVFLLSTRAGGLGINLMTADTVVIFDSDWNPQADLQAMARAHRIGQKNHVMVYRLVSKDTVEEEVLERARKKMILEYAIISLGVTDGNKYTKKNEPNAGELSAILKFGAGNMFTATDNQKKLEDLNLDDVLNHAEDHVTTPDLGESHLGGEEFLKQFEVTDYKADIDWDDIIPEEELKKLQDEEQKRKDEEYVKEQLEMMNRRDNALKKIKNSVNGDGTAANSDSDDDSTSRSSRRRARANDMDSIGESEVRALYKAILKFGNLKEILDELIADGTLPVKSFEKYGETYDEMMEAAKDCVHEEEKNRKEILEKLEKHATAYRAKLKSGEIKAENQPKDNPLTRLSLKKREKKAVLFNFKGVKSLNAESLLSRVEDLKYLKNLINSNYKDDPLKFSLGNNTPKPVQNWSSNWTKEEDEKLLIGVFKYGYGSWTQIRDDPFLGITDKIFLNEVHNPVAKKSASSSDTTPTPSKKGKGITGSSKKVPGAIHLGRRVDYLLSFLRGGLNTKSPSADIGSKKLPTGPSKKRQRKPANHSKSMTPEITSSEPANGPPSKRMKALPKGPAALINNTRLSPNSPTPPLKSKVSRDNGTRQSSNPSSGSAHEKEYDSMDEEDCRHTMSAIRTSLKRLRRGGKSLDRKEWAKILKTELTTIGNHIESQKGSSRKASPEKYRKHLWSYSANFWPADVKSTKLMAMYDKITESQKK

SEQ ID NO: 1776 - protein, 1571 aa, Saccharomyces cerevisiae
MSGTFHGDGHAPMSPFEDTFQFEDNSSNEDTHIAPTHFDDGATSNKYSRPQVSFNDETPKNKREDAEEFTFNDDTEYDNHSFQPTPKLNNGSGTFDDVELDNDSGEPHTNYDGMKRFRMGTKRNKKGNPIMGRSKTLKWARKNIPNPFEDFTKDDIDPGAINRAQELRTVYYNMPLPKDMIDEEGNPIMQYPRNKIRTTKYTPLTFLPKNILFQFHNFANVYFLVLIILGAFQIFGVTNPGLSAVPLVVIVIITAIKDAIEDSRRTVLDLEVNNTKTHILEGVENENVSTDNISLWRRFKKANSRLLFKFIQYCKEHLTEEGKKKRMQRKRHELRVQKTVGTSGPRSSLDSIDSYRVSADYGRPSLDYDNLEQGAGEANIVDRSLPPRTDCKFAKNYWKGVKVGDIVRIHNNDEIPADIILLSTSDTDGACYVETKNLDGETNLKVRQSLKCTNTIRTSKDIARTKFWIESEGPHSNLYTYQGNMKWRNLADGEIRNEPITINNVLLRGCTLRNTKWAMGVVMFTGGDTKIMLNSGITPTKKSRISRELNFSVVINFVLLFILCFVSGIANGVYYDKKGRSRFSYEFGTIAGSAATNGFVSFWVAVILYQSLVPISLYISVEIIKTAQAAFIYGDVLLYNAKLDYPCTPKSWNISDDLGQVEYIFSDKTGTLTQNVMEFKKCTINGVSYGRAYTEALAGLRKRQGIDVETEGRREKAEIAKDRDTMIDELRALSGNSQFYPEEVTFVSKEFVRDLKGASGEVQQRCCEHFMLALALCHSVLVEANPDNPKKLDLKAQSPDEAALVATARDVGFSFVGKTKKGLIIEMQGIQKEFEILNILEFNSSRKRMSCIVKIPGLNPGDEPRALLICKGADSIIYSRLSRQSGSNSEAILEKTALHLEQYATEGLRTLCIAQRELSWSEYEKWNEKYDIAAASLANREDELEVVADSIERELILLGGTAIEDRLQDGVPDCIELLAEAGIKLWVLTGDKVETAINIGFSCNLLNNEMELLVIKTTGDDVKEFGSEPSEIVDALLSKYLKEYFNLTGSEEEIFEAKKDHEFPKGNYAIVIDGDALKLALYGEDIRRKFLLLCKNCRAVLCCRVSPSQKAAVVKLVKDSLDVMTLAIGDGSNDVAMIQSADVGIGIAGEEGRQAVMCSDYAIGQFRYLARLVLVHGRWSYKRLAEMIPEFFYKNMIFALALFWYGIYNDFDGSYLYEYTYMMFYNLAFTSLPVIFLGILDQDVNDTISLVVPQLYRVGILRKEWNQRKFLWYMLDGLYQSIICFFFPYLVYHKNMIVTSNGLGLDHRYFVGVYVTTIAVISCNTYVLLHQYRWDWFSGLFIALSCLVVFAWTGIWSSAIASREFFKAAARIYGAPSFWAVFFVAVLFCLLPRFTYDSFQKFFYPTDVEIVREMWQHGHFDHYPPGYDPTDPNRPKVTKAGQHGEKIIEGIALSDNLGGSNYSRDSVVTEEIPMTFMHGEDGSPSGYQKQETWMTSPKETQDLLQSPQFQQAQTFGRGPSTNVRSSLDRTREQMIATNQLDNRYSVERARTSLDLPGVTNAASLIGTQQNN

SEQ ID NO: 1777 - protein, 851 aa, Saccharomyces cerevisiae
MPKNSHHHRSSSVNSTKSRSTESTNKWKIPHYYRRSASGSTQASPDRNSSTGSCSTPVLPTMNVMSSPKKVLLEDPRDNHTKAKKSSRKKSGEMVFVNYTVQDTANENDTDLQTQPVSVPAPKAKLKKKSSKRRMLKIFGSSKNEHIEDIVEEQPMVLQMDSESKPLSGTPISESGIDASSLTTKRSYNSFLKHNRLNGKTPFSGNLSFPSLNMMGNTTDLPIDNNDFCSEKEVVPKSTHDPSLAKPPSRFTESETNSTPNLSSIPLMNTKNTRLKYNKVAPQSSDRQKSQESGLYHSTESFNFKDQNYSNNKSSLSLNSDLSTPHFAKHSPDSPRTSRSFNCGDSQSKVKLPEENDASIAFSKMFTRKRANTGGSTCSLASPTIAQTIQQSNIKVNKLPTQRTTSVGSLSSMSNRYSPIRVASPGRARSATRGSSLYRLSRDLNSLPSVTDLPEMDSTTPVNEIFLDGQPQHKSGSVKGGHRKKQESISDAQRIQHSNSYITTPSSSLVTPPYYMTGYTLPSSASASSTPNVLETHNMNFVPSTSTVTSYRPSSNFSSFDKEYSNENDASGEFSAFNTPMENIPALKGIPRSTLEENEEEDVLVQDIPNTAHFQRRDIMGMDTHRKDDSLDFNSLMPHGSTTSSSIVDSVMTNSISTTTSNATGNYFQDQDKYTLVNTGLGLSDANLDHFIRSQWKHASRSESNNNTGNRVSYSGSTPNNVDTTKTNLQVYTEFDFENPESFFHEQSKLLGEMGHSNNNSNSAINMNEPKSADTYIGNISPDTSATVSLGDLMGSNVSNNSERNFYDGHTFVPQYQANSSVENSNNQNAAPIANNDIDNNLQSFYFDNSN

SEQ ID NO: 1778 - protein, 546 aa, Saccharomyces cerevisiae
MLRSTISLLMNSAAQKTMTNSNFVLNAPKITLTKVEQNICNLLNDYTDLYNQKYHNKPEPLTLRITGGWVRDKLLGQGSHDLDIAINVMSGEQFATGLNEYLQQHYAKYGAKPHNIHKIDKNPEKSKHLETATTKLFGVEVDFVNLRSEKYTELSRIPKVCFGTPEEDALRRDATLNALFYNIHKGEVEDFTKRGLQDLKDGVLRTPLPAKQTFLDDPLRVLRLIRFASRFNFTIDPEVMAEMGDPQINVAFNSKISRERVGVEMEKILVGPTPLLALQLIQRAHLENVIFFWHNDSSVVKFNEENCQDMDKINHVYNDNILNSHLKSFIELYPMFLEKLPILREKIGRSPGFQQNFILSAILSPMANLQIIGNPKKKINNLVSVTESIVKEGLKLSKNDAAVIAKTVDSICSYEEILAKFADRSQLKKSEIGIFLRNFNGEWETAHFASLSDAFLKIPKLETKKIELLFQNYNEFYSYIFDNNLNNCHELKPIVDGKQMAKLLQMKPGPWLGKINNEAIRWQFDNPTGTDQELITHLKAILPKYL

SEQ ID NO: 1779 - protein, 778 aa, Saccharomyces cerevisiae
MKFYIDDLPVLFPYPKIYPEQYNYMCDIKKTLDVGGNSILEMPSGTGKTVSLLSLTIAYQMHYPEHRKIIYCSRTMSEIEKALVELENLMDYRTKELGYQEDFRGLGLTSRKNLCLHPEVSKERKGTVVDEKCRRMTNGQAKRKLEEDPEANVELCEYHENLYNIEVEDYLPKGVFSFEKLLKYCEEKTLCPYFIVRRMISLCNIIIYSYHYLLDPKIAERVSNEVSKDSIVIFDEAHNIDNVCIESLSLDLTTDALRRATRGANALDERISEVRKVDSQKLQDEYEKLVQGLHSADILTDQEEPFVETPVLPQDLLTEAIPGNIRRAEHFVSFLKRLIEYLKTRMKVLHVISETPKSFLQHLKQLTFIERKPLRFCSERLSLLVRTLEVTEVEDFTALKDIATFATLISTYEEGFLLIIEPYEIENAAVPNPIMRFTCLDASIAIKPVFERFSSVIITSGTISPLDMYPRMLNFKTVLQKSYAMTLAKKSFLPMIITKGSDQVAISSRFEIRNDPSIVRNYGSMLVEFAKITPDGMVVFFPSYLYMESIVSMWQTMGILDEVWKHKLILVETPDAQETSLALETYRKACSNGRGAILLSVARGKVSEGIDFDHQYGRTVLMIGIPFQYTESRILKARLEFMRENYRIRENDFLSFDAMRHAAQCLGRVLRGKDDYGVMVLADRRFSRKRSQLPKWIAQGLSDADLNLSTDMAISNTKQFLRTMAQPTDPKDQEGVSVWSYEDLIKHQNSRKDQGGFIENENKEGEQDEDEDEDIEMQ

SEQ ID NO: 1780 - protein, 267 aa, Saccharomyces cerevisiae
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLAKQAFDDAIAELDTLSEESYKDSTLIMQLLRDNLTLWTSDMSESGQAEDQQQQQQHQQQQPPAAAEGEAPK

SEQ ID NO: 1781 - protein, 443 aa, Saccharomyces cerevisiae
MFVAPVSSQKLDTAIRKETTFVPMLAASFKRQPSQLVRGLGAVLRTPTRIGHVRTMATLKTTDKKAPEDIEGSDTVQIELPESSFESYMLEPPDLSYETSKATLLQMYKDMVIIRRMEMACDALYKAKKIRGFCHLSVGQEAIAVGIENAITKLDSIITSYRCHGFTFMRGASVKAVLAELMGRRAGVSYGKGGSMHLYAPGFYGGNGIVGAQVPLGAGLAFAHQYKNEDACSFTLYGDGASNQGQVFESFNMAKLWNLPVVFCCENNKYGMGTAASRSSAMTEYFKRGQYIPGLKVNGMDILAVYQASKFAKDWCLSGKGPLVLEYETYRYGGHSMSDPGTTYRTRDEIQHMRSKNDPIAGLKMHLIDLGIATEAEVKAYDKSARKYVDEQVELADAAPPPEAKLSILFEDVYVKGTETPTLRGRIPEDTWDFKKQGFASRD

SEQ ID NO: 1782 - protein, 334 aa, Saccharomyces cerevisiae
MSVTGTEIDSDTAKNILSVDELQNYGINASDLQKLKSGGIYTVNTVLSTTRRHLCKIKGLSEVKVEKIKEAAGKIIQVGFIPATVQLDIRQRVYSLSTGSKQLDSILGGGIMTMSITEVFGEFRCGKTQMSHTLCVTTQLPREMGGGEGKVAYIDTEGTFRPERIKQIAEGYELDPESCLANVSYARALNSEHQMELVEQLGEELSSGDYRLIVVDSIMANFRVDYCGRGELSERQQKLNQHLFKLNRLAEEFNVAVFLTNQVQSDPGASALFASADGRKPIGGHVLAHASATRILLRKGRGDERVAKLQDSPDMPEKECVYVIGEKGITDSSD

SEQ ID NO: 1783 - protein, 558 aa, Saccharomyces cerevisiae
MAVLNLKRETVDIEETAKKDIKPYFASNVEAVDIDEDPDVSRYDPQTGVKRALKNRHISLLALGGVIGPGCLVGAGNALNKGGPLALLLGFSIIGIIAFSVMESIGEMITLYPSGGGFTTLARRFHSDALPAVCGYAYVVVFFAVLANEYNTLSSILQFWGPQVPLYGYILIFWFAFEIFQLVGVGLFGETEYWLAWLKIVGLVAYYIFSIVYISGDIRNRPAFGFHYWNSPGALSHGFKGIAIVFVFCSTFYSGTESVALAATESKNPGKAVPLAVRQTLWRILVVYIGIAVFYGATVPFDDPNLSASTKVLKSPIAIAISRAGWAGGAHLVNAFILITCISAINGSLYIGSRTLTHLAHEGLAPKILAWTDRRGVPIPAITVFNALGLISLMNVSVGAANAYSYIVNLSGVGVFIVWGVISYTHLRIRKAWVAQGRSIEELPYEALFYPWTPVLSLAANIFLALIQGWSYFVPFDAGNFVDAYILLPVGILLYIGICVFKSNHFRTVDLRSINLDEGRRKDMEADLSDQESSLASSETMKDYKSATFFRYLSNIFT

SEQ ID NO: 1784 - protein, 591 aa, Saccharomyces cerevisiae
MSHKQFKSDGNIVTPYLLGLARSNPGLTVIKHDRVVFRTASAPNSGNPPKVSLVSGGGSGHEPTHAGFVGEGALDAIAAGAIFASPSTKQIYSAIKAVESPKGTLIIVKNYTGDIIHFGLAAERAKAAGMKVELVAVGDDVSVGKKKGSLVGRRGLGATVLVHKIAGAAASHGLELAEVAEVAQSVVDNSVTIAASLDHCTVPGHKPEAILGENEYEIGMGIHNESGTYKSSPLPSISELVSQMLPLLLDEDEDRSYVKFEPKEDVVLMVNNMGGMSNLELGYAAEVISEQLIDKYQIVPKRTITGAFITALNGPGFGITLMNASKAGGDILKYFDYPTTASGWNQMYHSAKDWEVLAKGQVPTAPSLKTLRNEKGSGVKADYDTFAKILLAGIAKINEVEPKVTWYDTIAGDGDCGTTLVSGGEALEEAIKNHTLRLEDAALGIEDIAYMVEDSMGGTSGGLYSIYLSALAQGVRDSGDKELTAETFKKASNVALDALYKYTRARPGYRTLIDALQPFVEALKAGKGPRAAAQAAYDGAEKTRKMDALVGRASYVAKEELRKLDSEGGLPDPGAVGLAALLDGFVTAAGY

SEQ ID NO: 1785 - protein, 540 aa, Saccharomyces cerevisiae
MTAMKAIVWRLPKMPKIKITKTYEVTKITAILTLVGFIMGLEVPSLATFLTNKTFNEYFKYPTPLQQGLLMGSTPLGGIMGCFICCIMNDRFSRIYQFQSGIIIWNIVTLLNFCIWDILGLLICRMIKGMILGNFSILVASYANEVIPRGKRGSTMSYIQLCLTIGILVMHYLCIALSLWDSHFAFRIAWCIGIIPGLLFWMASYALPESYHWLVLHGKMSEAQEIQHNLAKKFNESQPRDAVPEMSKIELAGDFWIGVNDLDFSKKLPRGSFKPLILGMTLQLLVQFSGINIILGYITYICEIVGLEGNVKLFTSSIPYFINMVLSLLPITFIDYTSRKLITLLGGFPISGLLITIGALFVKYGQDTKPIDGNRSLVWSIGENPFVGGWILTLCFLIVGIFAMSLSSIPWVYTNEMLPSRVKVKGFAICVTFGWLGNFILTFLCPVMIERLKGTTFIIFGSLTFLISLSVLIWFPETKGMSIEDIDKFFEFESKEGTNLHGEKGIKTPDSNSNGGSTRSSQEGQLHKPIKLKSDEEMII

SEQ ID NO: 1786 - protein, 375 aa, Saccharomyces cerevisiae
MDSEVAALVIDNGSGMCKAGFAGDDAPRAVFPSIVGRPRHQGIMVGMGQKDSYVGDEAQSKRGILTLRYPIEHGIVTNWDDMEKIWHHTFYNELRVAPEEHPVLLTEAPMNPKSNREKMTQIMFETFNVPAFYVSIQAVLSLYSSGRTTGIVLDSGDGVTHVVPIYAGFSLPHAILRIDLAGRDLTDYLMKILSERGYSFSTTAEREIVRDIKEKLCYVALDFEQEMQTAAQSSSIEKSYELPDGQVITIGNERFRAPEALFHPSVLGLESAGIDQTTYNSIMKCDVDVRKELYGNIVMSGGTTMFPGIAERMQKEITALAPSSMKVKIIAPPERKYSVWIGGSILASLTTFQQMWISKQEYDESGPSIVHHKCF

SEQ ID NO: 1787 - protein, 206 aa, Saccharomyces cerevisiae
MNSEYDYLFKLLLIGNSGVGKSCLLLRFSDDTYTNDYISTIGVDFKIKTVELDGKTVKLQIWDTAGQERFRTITSSYYRGSHGIIIVYDVTDQESFNGVKMWLQEIDRYATSTVLKLLVGNKCDLKDKRVVEYDVAKEFADANKMPFLETSALDSTNVEDAFLTMARQIKESMSQQNLNETTQKKEDKGNVNLKGQSLTNTGGGCC

SEQ ID NO: 1788 - protein, 457 aa, Saccharomyces cerevisiae
MREIIHISTGQCGNQIGAAFWETICGEHGLDFNGTYHGHDDIQKERLNVYFNEASSGKWVPRSINVDLEPGTIDAVRNSAIGNLFRPDNYIFGQSSAGNVWAKGHYTEGAELVDSVMDVIRREAEGCDSLQGFQITHSLGGGTGSGMGTLLISKIREEFPDRMMATFSVLPSPKTSDTVVEPYNATLSVHQLVEHSDETFCIDNEALYDICQRTLKLNQPSYGDLNNLVSSVMSGVTTSLRYPGQLNSDLRKLAVNLVPFPRLHFFMVGYAPLTAIGSQSFRSLTVPELTQQMFDAKNMMAAADPRNGRYLTVAAFFRGKVSVKEVEDEMHKVQSKNSDYFVEWIPNNVQTAVCSVAPQGLDMAATFIANSTSIQELFKRVGDQFSAMFKRKAFLHWYTSEGMDELEFSEAESNMNDLVSEYQQYQEATVEDDEEVDENGDFGAPQNQDEPITENFE

SEQ ID NO: 1789 - protein, 455 aa, Saccharomyces cerevisiae
MSEEDKAKKLENLLKLLQLNNDDTSKFTQEQKKAMKDHKFWRTQPVKDFDEKVVEEGPIDKPKTPEDISDKPLPLLSSFEWCSIDVDNKKQLEDVFVLLNENYVEDRDAGFRFNYTKEFFNWALKSPGWKKDWHIGVRVKETQKLVAFISAIPVTLGVRGKQVPSVEINFLCVHKQLRSKRLTPVLIKEITRRVNKCDIWHALYTAGIVLPAPVSTCRYTHRPLNWKKLYEVDFTGLPDGHTEEDMIAENALPAKTKTAGLRKLKKEDIDQVFELFKRYQSRFELIQIFTKEEFEHNFIGEESLPLDKQVIFSYVVEQPDGKITDFFSFYSLPFTILNNTKYKDLGIGYLYYYATDADFQFKDRFDPKATKALKTRLCELIYDACILAKNANMDVFNALTSQDNTLFLDDLKFGPGDGFLNFYLFNYRAKPITGGLNPDNSNDIKRRSNVGVVML

SEQ ID NO: 1790 - protein, 460 aa, Saccharomyces cerevisiae
MMLEGYTVQPPQSTLIGDIEIQDENANQEVKNVLYQGVQKGIKRLEKRQRRVALGDVTSQKANKIHNAIHNKFHQTKNNFEIENIRSSALVKEQQRDVRHEDSDYFLIDSSEGSSTDDEQVNEDAIDDLLSRRVNDQQIQADEVYEDFDGEMQDVIEEDVDSQIEPLSPINNDEIQTELDRAFEKYFRSVPNPLDDDTHDVVMVVEYASDIFYYLRELEVKYRPNPYYMQNQVELTWPFRRTMIDWLVQLHFRFQLLPETLYLTINIVDRFLSKKTVTLNRFQLVGVSALFIAAKFEEINCPTLDDLVYMLENTYTRDDIIRAEQYMIDTLEFEIGWPGPMPFLRRISKADDYDFEPRTLAKYLLETTIVEPKLVAAAPSWLAAGAYFLSRTILGSNDWSLKHVFYSGYTSSQIIPLASLILENCKNASRRHHSIWKKYFDQKHYRCSQIVEEWIVSTEA

SEQ ID NO: 1791 - protein, 473 aa, Saccharomyces cerevisiae
MGGEIITLQAGQCGNHVGKFLWSQLAKEHAIGTDGLSQLPDSSTERDDDTKPFFRENSRNKFTPRAIMMDSEPSVIADVENTFRGFFDPRNTWVASDGASAGNSWANGYDIGTRNQDDILNKIDKEIDSTDNFEGFQLLHSVAGGTGSGLGSNLLEALCDRYPKKILTTYSVFPARSSEVVVQSYNTILALRRLIEDSDATVVFDNASLLNISGKVFRNPNIDLQHTNQLISTIISSVTNSIRFPSYMYSSMSSIYSTLIPSPELHFLSPSFTPFTSDYIHDDIAHKGHSSYDVMLDLLDPSNSLVSTAMNNPTYFNVYNTIIGNVEPRQISRAMTKLQQRIKFPSWSSSAMHVNIGRRSPYLPLQPNENEVSGMMLSNMSTVVNVFENACNTFDKVFAKGAFLNNYNVGDLFQSMQNVQDEFAESREVVQSLMEDYVAAEQDSYLDDVLVDDENMVGELEEDLDADGDHKLV

SEQ ID NO: 1792 - protein, 817 aa, Saccharomyces cerevisiae
MDLKTSYKGISLNPIYAGSSAVATVSENGKILATPVLDEINIIDLTPGSRKILHKISNEDEQEITALKLTPDGQYLTYVSQAQLLKIFHLKTGKVVRSMKISSPSYILDADSTSTLLAVGGTDGSIIVVDIENGYITHSFKGHGGTISSLKFYGQLNSKIWLLASGDTNGMVKVWDLVKRKCLHTLQEHTSAVRGLDIIEVPDNDEPSLNLLSGGRDDIINLWDFNMKKKCKLLKTLPVNQQVESCGFLKDGDGKRIIYTAGGDAIFQLIDSESGSVLKRTNKPIEELFIIGVLPILSNSQMFLVLSDQTLQLINVEEDLKNDEDTIQVTSSIAGNHGIIADMRYVGPELNKLALATNSPSLRIIPVPDLSGPEASLPLDVEIYEGHEDLLNSLDATEDGLWIATASKDNTAIVWRYNENSCKFDIYAKYIGHSAAVTAVGLPNIVSKGYPEFLLTASNDLTIKKWIIPKPTASMDVQIIKVSEYTRHAHEKDINALSVSPNDSIFATASYDKTCKIWNLENGELEATLANHKRGLWDVSFCQYDKLLATSSGDKTVKIWSLDTFSVMKTLEGHTNAVQRCSFINKQKQLISCGADGLIKIWDCSSGECLKTLDGHNNRLWALSTMNDGDMIVSADADGVFQFWKDCTEQEIEEEQEKAKLQVEQEQSLQNYMSKGDWTNAFLLAMTLDHPMRLFNVLKRALGESRSRQDTEEGKIEVIFNEELDQAISILNDEQLILLMKRCRDWNTNAKTHTIAQRTIRCILMHHNIAKLSEIPGMVKIVDAIIPYTQRHFTRVDNLVEQSYILDYALVEMDKLF

SEQ ID NO: 1793 - protein, 191 aa, Saccharomyces cerevisiae
MQTLKCVVVGDGAVGKTCLLISYTTNQFPADYVPTVFDNYAVTVMIGDEPYTLGLFDTAGQEDYDRLRPLSYPSTDVFLVCFSVISPPSFENVKEKWFPEVHHHCPGVPCLVVGTQIDLRDDKVIIEKLQRQRLRPITSEQGSRLARELKAVKYVECSALTQRGLKNVFDEAIVAALEPPVIKKSKKCAIL

SEQ ID NO: 1794 - protein, 656 aa, Saccharomyces cerevisiae
MKVLCVAEKNSIAKAVSQILGGGRSTSRDSGYMYVKNYDFMFSGFPFARNGANCEVTMTSVAGHLTGIDFSHDSHGWGKCAIQELFDAPLNEIMNNNQKKIASNIKREARNADYLMIWTDCDREGEYIGWEIWQEAKRGNRLIQNDQVYRAVFSHLERQHILNAARNPSRLDMKSVHAVGTRIEIDLRAGVTFTRLLTETLRNKLRNQATMTKDGAKHRGGNKNDSQVVSYGTCQFPTLGFVVDRFERIRNFVPEEFWYIQLVVENKDNGGTTTFQWDRGHLFDRLSVLTFYETCIETAGNVAQVVDLKSKPTTKYRPLPLTTVELQKNCARYLRLNAKQSLDAAEKLYQKGFISYPRTETDTFPHAMDLKSLVEKQAQLDQLAAGGRTAWASYAASLLQPENTSNNNKFKFPRSGSHDDKAHPPIHPIVSLGPEANVSPVERRVYEYVARHFLACCSEDAKGQSMTLVLDWAVERFSASGLVVLERNFLDVYPWARWETTKQLPRLEMNALVDIAKAEMKAGTTAPPKPMTESELILLMDTNGIGTDATIAEHIDKIQVRNYVRSEKVGKETYLQPTTLGVSLVHGFEAIGLEDSFAKPFQRREMEQDLKKICEGHASKTDVVKDIVEKYRKYWHKTNACKNTLLQVYDRVKASM

SEQ ID NO: 1795 - protein, 875 aa, Saccharomyces cerevisiae
MSLNNITFCVSQDLDVPLKVKIKSLEGHKPLLKPSQKILNPELMLIGSNVFPSSDLIVSLQVFDKERNRNLTLPIYTPYIPFRNSRTWDYWLTLPIRIKQLTFSSHLRIILWEYNGSKQIPFFNLETSIFNLKDCTLKRGFESLKFRYDVIDHCEVVTDNKDQENLNKYFQGEFTRLPWLDEITISKLRKQRENRTWPQGTFVLNLEFPMLELPVVFIEREIMNTQMNIPTLKNNPGLSTDLREPNRNDPQIKISLGDKYHSTLKFYDPDQPNNDPIEEKYRRLERASKNANLDKQVKPDIKKRDYLNKIINYPPGTKLTAHEKGSIWKYRYYLMNNKKALTKLLQSTNLREESERVEVLELMDSWAEIDIDDALELLGSTFKNLSVRSYAVNRLKKASDKELELYLLQLVEAVCFENLSTFSDKSNSEFTIVDAVSSQKLSGDSMLLSTSHANQKLLKSISSESETSGTESLPIVISPLAEFLIRRALVNPRLGSFFYWYLKSESEDKPYLDQILSSFWSRLDKKSRNILNDQVRLINVLRECCETIKRLKDTTAKKMELLVHLLETKVRPLVKVRPIALPLDPDVLICDVCPETSKVFKSSLSPLKITFKTTLNQPYHLMFKVGDDLRQDQLVVQIISLMNELLKNENVDLKLTPYKILATGPQEGAIEFIPNDTLASILSKYHGILGYLKLHYPDENATLGVQGWVLDNFVKSCAGYCVITYILGVGDRHLDNLLVTPDGHFFHADFGYILGQDPKPFPPLMKLPPQIIEAFGGAESSNYDKFRSYCFVAYSILRRNAGLILNLFELMKTSNIPDIRIDPNGAILRVRERFNLNMSEEDATVHFQNLINDSVNALLPIVIDHLHNLAQYWRT

SEQ ID NO: 1796 - protein, 1556 aa, Saccharomyces cerevisiae
MSAVGALLAREYNVTAEKCDFFLENGSFDSVIAALPALNQEQETVTQKVSKNGKELINVASVNIEIPERISLSNNGRQLFKFIVDIEILPCENDNEATLVVSSDSVSLFQIGFKMENNSKIAVDKQLPLILDICAHKNQERALRNQLENRKSLERKPSRKRRKKNSNVNDPEKLLKSRIHELSLSYKDFECSPVVFRYNDSSLTWVLSFNLKLKFLNNKFNRFSVEANQILDLTFSNRDENEFERYHKHSHIHSNFIQKQFISQILEYSKDRLSKIKPFLPQSIPDLKVNLLPFQRESVEWMLIKEGHGNSLSDTPTVIDEVGLIDFMNEYYAYGYELIARSPDEVGPSLLWNKLTGYILTTEDAAHLYNQYRKERLSGDYPVCAKGVLAEEMGLGKTIEILSLILLNRRKLKDSEATFIDDENRTITKTKTTLIICPNAILKQWLEEIELHANSLKWYTYRGYNEIMKDCKTVDEAVQQLCQYDIIVTSYNIIATEVHHAEFNRSIRSRRLKSPKYDYSSPLALMQFYRIILDEVQMLRSSSTYSAKCTSLLHRIHTWGVSGTPIQNIYNFRMIMSYLKLHPFCDEVDFIRTLQEEIKLRNEAKDYTSNDFVCQLKGVRFSIKDCMNIFYRYDLCIRHSKANVASQIHIPRQHNFIIPLEFAPIEWDNYLNLWNNFLELSGYNSDGSGSPRVSNAFLNEWLSRLRYICCHALFPEILSTRQKRLHGHLSRISNIDDILISMRMDAFDSLIGYYRERFHLSIKQAQYELEISNTPAKALESFIKIRDDLMIHIRQKFNVEDPFDKSLNLSEDEDEHMDERFGEKETSSGDESDREINGAKNHDNHNNDGMLSNHLKKKGLRAMMNLLHDCYFFLGSVYYNLGTRKLEEADDKHRKEKTEEVVYSDVFPKNELEEIEENRLLEQENYANAEILRKSILSSEARKVDMTIKMARTKFAPMTSNIPLRLINIEFDHKNDYSSNLAVSRCFKSLSKLIEGLNEQTKNFNELLDELLIIIYEPVHRTEDDDSTNKIIGNEEYSTSIDSQDKIFSLLGCLEIILQNRDNILTSESEVKIPKHLVPEGSIISKYQKQLLNSLRLISGTPLRTVFDELKNSRIVRRISSSNESESTIQNFEDYLLQYEVESKSLFKYNKQVRESLKILGSIYNAKTEYYSQLQRISDSLVSLHSLSAPQLSHLIRTINKSLGGTLDAKINNIESRLIYLKNLSRLKDTLNDNQILSCSICLGEVEIGAIIKCGHYFCKSCILTWLRAHSKCPICKGFCSISEVYNFKFKNSTEKREKEIQEPRREGADSSQDNSNENSIISNMSEVEKLFGNKYEQFHQINEVHQIHIKESFGAKIDFVIKLISYLRLKSEQENADPPQVILYSQKTEYLKVIGKVLKLYHIEHLACLSNTANVGETINNFKRQPSVTCLLLNVKTLGAGLNLINAKHIFLLDPILNNSDELQAMGRNNRIGQDEETFVWNFMIRNTVEENILRYKCILEERKRKEKSKKGDKYDEAQDETDNEESDDAKFEISVVDQEVSNEHLWNCFFHGSD

SEQ ID NO: 1797 - protein, 705 aa, Saccharomyces cerevisiae
MSRDLQNHLLFETATEVANRVGGIYSVLKSKAPITVAQYKDHYHLIGPLNKATYQNEVDILDWKKPEAFSDEMRPVQHALQTMESRGVHFVYGRWLIEGAPKVILFDLDSVRGYSNEWKGDLWSLVGIPSPENDFETNDAILLGYTVAWFLGEVAHLDSQHAIVAHFHEWLAGVALPLCRKRRIDVVTIFTTHATLLGRYLCASGSFDFYNCLESVDVDHEAGRFGIYHRYCIERAAAHSADVFTTVSQITAFEAEHLLKRKPDGILPNGLNVIKFQAFHEFQNLHALKKEKINDFVRGHFHGCFDFDLDNTLYFFIAGRYEYKNKGADMFIEALARLNYRLKVSGSKKTVVAFIVMPAKNNSFTVEALKGQAEVRALENTVHEVTTSIGKRIFDHAIRYPHNGLTTELPTDLGELLKSSDKVMLKRRILALRRPEGQLPPIVTHNMVDDANDLILNKIRQVQLFNSPSDRVKMIFHPEFLNANNPILGLDYDEFVRGCHLGVFPSYYEPWGYTPAECTVMGVPSITTNVSGFGAYMEDLIETNQAKDYGIYIVDRRFKAPDESVEQLVDYMEEFVKKTRRQRINQRNRTERLSDLLDWKRMGLEYVKARQLALRRGYPDQFRELVGEELNDSNMDALAGGKKLKVARPLSVPGSPRDLRSNSTVYMTPGDLGTLQEVNNADDYFSLGVNPAADDDDDGPYADDS

SEQ ID NO: 1798 - protein, 572 aa, Saccharomyces cerevisiae
MLRSSVVRSRATLRPLLRRAYSSHKELKFGVEGRASLLKGVETLAEAVAATLGPKGRNVLIEQPFGPPKITKDGVTVAKSIVLKDKFENMGAKLLQEVASKTNEAAGDGTTSATVLGRAIFTESVKNVAAGCNPMDLRRGSQVAVEKVIEFLSANKKEITTSEEIAQVATISANGDSHVGKLLASAMEKVGKEGVITIREGRTLEDELEVTEGMRFDRGFISPYFITDPKSSKVEFEKPLLLLSEKKISSIQDILPALEISNQSRRPLLIIAEDVDGEALAACILNKLRGQVKVCAVKAPGFGDNRKNTIGDIAVLTGGTVFTEELDLKPEQCTIENLGSCDSITVTKEDTVILNGSGPKEAIQERIEQIKGSIDITTTNSYEKEKLQERLAKLSGGVAVIRVGGASEVEVGEKKDRYDDALNATRAAVEEGILPGGGTALVKASRVLDEVVVDNFDQKLGVDIIRKAITRPAKQIIENAGEEGSVIIGKLIDEYGDDFAKGYDASKSEYTDMLATGIIDPFKVVRSGLVDASGVASLLATTEVAIVDAPEPPAAAGAGGMPGGMPGMPGMM

SEQ ID NO: 1799 - protein, 215 aa, Saccharomyces cerevisiae
MSRSGKSLTKYKIVFLGEQGVGKTSLITRFMYDTFDDHYQATIGIDFLSKTMYLDDKTIRLQLWDTAGQERFRSLIPSYIRDSRVAIIVYDITKRKSFEYIDKWIEDVKNERGDENVILCIVGNKSDLSDERQISTEEGEKKAKLLGAKIFMETSTKAGYNVKALFKKIAKSLPEFQNSESTPLDSENANSANQNKPGVIDISTAEEQEQSACQC

SEQ ID NO: 1800 - protein, 775 aa, Saccharomyces cerevisiae
MSFDRPEIYSAPVLQGESPNDDDNTEIIKSFKNFILEFRLDSQFIYRDQLRNNILVKNYSLTVNMEHLIGYNEDIYKKLSDEPSDIIPLFETAITQVAKRISILSRAQSANNNDKDPENTSMDTDSLLLNSLPTFQLILNSNANQIPLRDLDSEHVSKIVRLSGIIISTSVLSSRATYLSIMCRNCRHTTSITINNFNSITGNTVSLPRSCLSTIESESSMANESNIGDESTKKNCGPDPYIIIHESSKFIDQQFLKLQEIPELVPVGEMPRNLTMTCDRYLTNKVIPGTRVTIVGIYSIYNSKNGAGSGRSGGGNGGSGVAIRTPYIKILGIQSDVETSSIWNSVTMFTEEEEEEFLQLSRNPKLYEILTNSIAPSIFGNEDIKKAIVCLLMGGSKKILPDGMRLRGDINVLLLGDPGTAKSQLLKFVEKVSPIAVYTSGKGSSAAGLTASVQRDPMTREFYLEGGAMVLADGGVVCIDEFDKMRDEDRVAIHEAMEQQTISIAKAGITTVLNSRTSVLAAANPIYGRYDDLKSPGDNIDFQTTILSRFDMIFIVKDDHNEERDISIANHVINIHTGNANAMQNQQEENGSEISIEKMKRYITYCRLKCAPRLSPQAAEKLSSNFVTIRKQLLINELESTERSSIPITIRQLEAIIRITESLAKLELSPIAQERHVDEAIRLFQASTMDAASQDPIGGLNQASGTSLSEIRRFEQELKRRLPIGWSTSYQTLRREFVDTHRFSQLALDKALYALEKHETIQLRHQGQNIYRSGV

SEQ ID NO: 1801 - protein, 594 aa, Saccharomyces cerevisiae
MSYEKKSVEGAYIDDSTTFEAFHLDSRLLQAIKNIGFQYPTLIQSHAIPLALQQKRDIIAKAATGSGKTLAYLIPVIETILEYKKTIDNGEENGTLGIILVPTRELAQQVYNVLEKLVLYCSKDIRTLNISSDMSDSVLSTLLMDQPEIIVGTPGKLLDLLQTKINSISLNELKFLVVDEVDLVLTFGYQDDLNKIGEYLPLKKNLQTFLMSATLNDDIQALKQKFCRSPAILKFNDEEINKNQNKLLQYYVKVSEFDKFLLCYVIFKLNLIKGKTLIFVNNIDRGYRLKLVMEQFGIKSCILNSELPVNSRQHIVDQFNKNVYQLLIATDDTEYIKEEDDEIEEGHNTENQEEKSLEGEPENDKKPSKKKKVQVKKDKEYGVSRGVDFKNVACVLNFDLPTTAKSYVHRVGRTARGGKTGTAISFVVPLKEFGKHKPSMLQTAKKDERILSRIIKQQSKLGLELQPYKFDQKQVEAFRYRMEDGFRAVTQVAIREARVKELKQELLASEKLKRHFEENPKELQSLRHDKELHPARVQQHLKRVPDYLLPESARGNGTKVKFVPFHNAKKRHSHKKGRVSKPKNGKVDPLKNFK

SEQ ID NO: 1802 - protein, 562 aa, Saccharomyces cerevisiae
MSLLYIILLFTQFLLLPTDAFDRSANTNIAVYWGQNSAGTQESLATYCESSDADIFLLSFLNQFPTLGLNFANACSDTFSDGLLHCTQIAEDIETCQSLGKKVLLSLGGASGSYLFSDDSQAETFAQTLWDTFGEGTGASERPFDSAVVDGFDFDIENNNEVGYSALATKLRTLFAEGTKQYYLSAAPQCPYPDASVGDLLENADIDFAFIQFYNNYCSVSGQFNWDTWLTYAQTVSPNKNIKLFLGLPGSASAAGSGYISDTSLLESTIADIASSSSFGGIALWDASQAFSNELNGEPYVEILKNLLTSASQTATTTVATSKTSAASTSSASTSSASTSQKKTTQSTTSTQSKSKVTLSPTASSAIKTSITQTTKTLTSSTKTKSSLGTTTTESTLNSVAITSMKTTLSSQITSAALVTPQTTTTSIVSSAPIQTAITSTLSPATKSSSVVSLQTATTSTLSPTTTSTSSGSTSSGSTSSDSTARTLAKELNAQYAAGKLNGKSTCTEGEIACSADGKFAVCDHSAWVYMECASGTTCYAYDSGDSVYTQCNFSYLESNYF

SEQ ID NO: 1803 - protein, 193 aa, Saccharomyces cerevisiae
MVTLEYNANSKLITASDAVVALSTETNIDQINVLTTSLIGETNPNFTPQPNEALSKMIKGLFESGMKNLQQKKLNEALKNVSLAIEMAQRKRAPWEAFAIQLPELHFMLRSKIDLCLILGKHLEALQDLDFLLGTGLIQPDVFVRKADCLLKLRQWEEARATCERGLALAPEDMKLRALLIETARNLAEYNGE

SEQ ID NO: 1804 - protein, 219 aa, Saccharomyces cerevisiae
MSAPAANGEVPTFKLVLVGDGGTGKTTFVKRHLTGEFEKKYIATIGVEVHPLSFYTNFGEIKFDVWDTAGQEKFGGLRDGYYINAQCAIIMFDVTSRITYKNVPNWHRDLVRVCENIPIVLCGNKVDVKERKVKAKTITFHRKKNLQYYDISAKSNYNFEKPFLWLARKLAGNPQLEFVASPALAPPEVQVDEQLMQQYQQEMEQATALPLPDEDDADL

SEQ ID NO: 1805 - protein, 444 aa, Saccharomyces cerevisiae
MPSHFDTVQLHAGQENPGDNAHRSRAVPIYATTSYVFENSKHGSQLFGLEVPGYVYSRFQNPTSNVLEERIAALEGGAAALAVSSGQAAQTLAIQGLAHTGDNIVSTSYLYGGTYNQFKISFKRFGIEARFVEGDNPEEFEKVFDERTKAVYLETIGNPKYNVPDFEKIVAIAHKHGIPVVVDNTFGAGGYFCQPIKYGADIVTHSATKWIGGHGTTIGGIIVDSGKFPWKDYPEKFPQFSQPAEGYHGTIYNEAYGNLAYIVHVRTELLRDLGPLMNPFASFLLLQGVETLSLRAERHGENALKLAKWLEQSPYVSWVSYPGLASHSHHENAKKYLSNGFGGVLSFGVKDLPNADKETDPFKLSGAQVVDNLKLASNLANVGDAKTLVIAPYFTTHKQLNDKEKLASGVTKDLIRVSVGIEFIDDIIADFQQSFETVFAGQKP

SEQ ID NO: 1806 - protein, 778 aa, Saccharomyces cerevisiae
MLSARSAIKRPIVRGLATVSNLTRDSKVNQNLLEDHSFINYKQNVETLDIVRKRLNRPFTYAEKILYGHLDDPHGQDIQRGVSYLKLRPDRVACQDATAQMAILQFMSAGLPQVAKPVTVHCDHLIQAQVGGEKDLKRAIDLNKEVYDFLASATAKYNMGFWKPGSGIIHQIVLENYAFPGALIIGTDSHTPNAGGLGQLAIGVGGADAVDVMAGRPWELKAPKILGVKLTGKMNGWTSPKDIILKLAGITTVKGGTGKIVEYFGDGVDTFSATGMGTICNMGAEIGATTSVFPFNKSMIEYLEATGRGKIADFAKLYHKDLLSADKDAEYDEVVEIDLNTLEPYINGPFTPDLATPVSKMKEVAVANNWPLDVRVGLIGSCTNSSYEDMSRSASIVKDAAAHGLKSKTIFTVTPGSEQIRATIERDGQLETFKEFGGIVLANACGPCIGQWDRRDIKKGDKNTIVSSYNRNFTSRNDGNPQTHAFVASPELVTAFAIAGDLRFNPLTDKLKDKDGNEFMLKPPHGDGLPQRGYDAGENTYQAPPADRSTVEVKVSPTSDRLQLLKPFKPWDGKDAKDMPILIKAVGKTTTDHISMAGPWLKYRGHLENISNNYMIGAINAENKKANCVKNVYTGEYKGVPDTARDYRDQGIKWVVIGDENFGEGSSREHAALEPRFLGGFAIITKSFARIHETNLKKQGLLPLNFKNPADYDKINPDDRIDILGLAELAPGKPVTMRVHPKNGKPWDAVLTHTFNDEQIEWFKYGSALNKIKADEKK

SEQ ID NO: 1807 - protein, 188 aa, Saccharomyces cerevisiae
MLKLRQLQKKKQKENENSSSIQPNLSAARIRLKRDLDSLDLPPTVTLNVITSPDSADRSQSPKLEVIVRPDEGYYNYGSINFNLDFNEVYPIEPPKVVCLKKIFHPNIDLKGNVCLNILREDWSPALDLQSIITGLLFLFLEPNPNDPLNKDAAKLLCEGEKEFAEAVRLTMSGGSIEHVKYDNIVSP

SEQ ID NO: 1808 - protein, 1589 aa, Saccharomyces cerevisiae
MSDTNTSIPNTSSAREAGNASQTPSISSSSNTSTTTNTESSSASLSSSPSTSELTSIRPIGIVVAAYDFNYPIKKDSSSQLLSVQQGETIYILNKNSSGWWDGLVIDDSNGKVNRGWFPQNFGRPLRDSHLRKHSHPMKKYSSSKSSRRSSLNSLGNSAYLHVPRNPSKSRRGSSTLSASLSNAHNAETSSGHNNTVSMNNSPFSAPNDASHITPQSSNFNSNASLSQDMTKSADGSSEMNTNAIMNNNETNLQTSGEKAGPPLVAEETIKILPLEEIEMIINGIRSNIASTWSPIPLITKTSDYKLVYYNKDLDIYCSELPLISNSIMESDDICDSEPKFPPNDHLVNLYTRDLRKNANIEDSSTRSKQSESEQNRSSLLMEKQDSKETDGNNNSINDDDNNNENNKNEFNEAGPSSLNSLSAPDLTQNIQSRVVAPSRSSILAKSDIFYHYSRDIKLWTELQDLTVYYTKTAHKMFLKENRLNFTKYFDLISDSIVFTQLGCRLMQHEIKAKSCSKEIKKIFKGLISSLSRISINSHLYFDSAFHRKKMDTMNDKDNDNQENNCSRTEGDDGKIEVDSVHDLVSVPLSGKRNVSTSTTDTLTPMRSSFSTVNENDMENFSVLGPRNSVNSVVTPRTSIQNSTLEDFSPSNKNFKSAKSIYEMVDVEFSKFLRHVQLLYFVLQSSVFSDDNTLPQLLPRFFKGSFSGGSWTNPFSTFITDEFGNATKNKAVTSNEVTASSSKNSSISRIPPKMADAIASASGYSANSETNSQIDLKASSAASGSVFTPFNRPSHNRTFSRARVSKRKKKYPLTVDTLNTMKKKSSQIFEKLNNATGEHLKIISKPKSRIRNLEINSSTYEQINQNVLLLEILENLDLSIFINLKNLIKTPSILLDLESEEFLVHAMSSVSSVLTEFFDIKQAFHDIVIRLIMTTQQTTLDDPYLFSSMRSNFPVGHHEPFKNISNTPLVKGPFHKKNEQLALSLFHVLVSQDVEFNNLEFLNNSDDFKDACEKYVEISNLACIIVDQLIEERENLLNYAARMMKNNLTAELLKGEQEKWFDIYSEDYSDDDSENDEAIIDDELGSEDYIERKAANIEKNLPWFLTSDYETSLVYDSRGKIRGGTKEALIEHLTSHELVDAAFNVTMLITFRSILTTREFFYALIYRYNLYPPEGLSYDDYNIWIEKKSNPIKCRVVNIMRTFLTQYWTRNYYEPGIPLILNFAKMVVSEKIPGAEDLLQKINEKLINENEKEPVDPKQQDSVSAVVQTTKRDNKSPIHMSSSSLPSSASSAFFRLKKLKLLDIDPYTYATQLTVLEHDLYLRITMFECLDRAWGTKYCNMGGSPNITKFIANANTLTNFVSHTIVKQADVKTRSKLTQYFVTVAQHCKELNNFSSMTAIVSALYSSPIYRLKKTWDLVSTESKDLLKNLNNLMDSKRNFVKYRELLRSVTDVACVPFFGVYLSDLTFTFVGNPDFLHNSTNIINFSKRTKIANIVEEIISFKRFHYKLKRLDDIQTVIEASLENVPHIEKQYQLSLQVEPRSGNTKGSTHASSASGTKTAKFLSEFTDDKNGNFLKLGKKKPPSRLFR

SEQ ID NO: 1809 - protein, 520 aa, Saccharomyces cerevisiae
MSLKEEQVSIKQDPEQEERQHDQFNDVQIKQESQDHDGVDSQYTNGTQNDDSERFEAAESDVKVEPGLGMGITSSQSEKGQVLPDQPEIKFIRRQINGYVGFANLPKQWHRRSIKNGFSFNLLCVGPDGIGKTTLMKTLFNNDDIEANLVKDYEEELANDQEEEEGQGEGHENQSQEQRHKVKIKSYESVIEENGVKLNLNVIDTEGFGDFLNNDQKSWDPIIKEIDSRFDQYLDAENKINRHSINDKRIHACLYFIEPTGHYLKPLDLKFMQSVYEKCNLIPVIAKSDILTDEEILSFKKTIMNQLIQSNIELFKPPIYSNDDAENSHLSERLFSSLPYAVIGSNDIVENYSGNQVRGRSYPWGVIEVDNDNHSDFNLLKNLLIKQFMEELKERTSKILYENYRSSKLAKLGIKQDNSVFKEFDPISKQLEEKTLHEAKLAKLEIEMKTVFQQKVSEKEKKLQKSETELFARHKEMKEKLTKQLKALEDKKKQLELSINSASPNVNHSPVPTKKKGFLR

SEQ ID NO: 1810 - protein, 788 aa, Saccharomyces cerevisiae
MKMAVDDPTYGTPKIKRTASSSSSIETTVTKLLMSTKHLLQVLTQWSKGTTSGRLVSDAYVQLGNDFKVVSKFFMHAKVDMSDVGDVPMALRRVLEVTLREPPSDETLNKHLPKIREIIVTLLDKLKVKQAILKNMQQEHRISVKSHHQQNPSFTSNLSLGSEGTREGTPLSSRKSSIVRDQRQSDSVENSYGEKVNSTSTGTPSAQSAEATLTKPRTNIKQNLKSNNAPNASDDDDALSQLKKGTNLQRRASKRYSAYHMAKLTNQSTTEAAAAAGLMTTPSPSMLHLEETVRKSKLYGNNNNDDDRNINSAENKGKSIDDVSKASPLAKTPLPIENVRASPRRLSSVVTTSPDKAMNGTCPVFLRIGDKTKKCHVQLPTTKNALRLLFIERFAYSPGANSFPDIYIMDPQYGVFYELEELNLLDIKEGFVIELKLEENPNNTIKEFIDTVKMEISNSQNDIIRHLKEMSFGSAISGKQTEVLPQPGLEANKHDLVGQNKKDDDKTIKDIQYELGKIKQVHNINRSNINETIFNILRKVDNFKSLSFSAKNSSNRMYMEKSQTELGDLSDTLLSKVDDLQDVIEIMRKDVAERRSQPAKKKLETVSKDLENAQADVLKLQEFIDTEKPHWKKTWEAELDKVCEEQQFLTLQEELILDLKEDLGKALETFDLIKLCCEEQEKNPSRSKSNPILPIMRPGTFNQVREQVMVAVQSLNPDHDSRVEAIDKAEKMWEMERKLKASNEFDDELENFVGNSNLKKSGGFEEVERIRKQKDEANLRAYFGPGFT

SEQ ID NO: 1811 - protein, 200 aa, Saccharomyces cerevisiae
MNDRLVTEEQELFTKLREIVGSSIRFWEEQLFYQVQDVSTIENHVILSLKCTILTDAQISTFISKPRELHTHAKGYPEIYYLSELSTTVNFFSKEGNYVEISQVIPHFNEYFSSLIVSQLEFEYPMVFSMISRLRLKWQQSSLAPISYALTSNSVLLPIMLNMIAQDKSSTTAYQILCRRRGPPIQNFQIFSLPAVTYNK

SEQ ID NO: 1812 - protein, 671 aa, Saccharomyces cerevisiae
MSSVDVLLTVGKLDASLALLTTQDHHVIEFPTVLLPENVKAGSIIKMQVSQNLEEEKKQRNHFKSIQAKILEKYGTHKPESPVLKIVNVTQTSCVLAWDPLKLGSAKLKSLILYRKGIRSMVIPNPFKVTTTKISGLSVDTPYEFQLKLITTSGTLWSEKVILRTHKMTDMSGITVCLGPLDPLKEISDLQISQCLSHIGARPLQRHVAIDTTHFVCNDLDNEESNEELIRAKHNNIPIVRPEWVRACEVEKRIVGVRGFYLDADQSILKNYTFPPVNEEELSYSKENEPVAEVADENKMPEDTTDVEQVASPNDNESNPSEAKEQGEKSGHETAPVSPVEDPLHASTALENETTIETVNPSVRSLKSEPVGTPNIEENKADSSAEAVVEEPNEAVAESSPNEEATGQKSEDTDTHSNEQADNGFVQTEEVAENNITTESAGENNEPADDAAMEFGRPEAEIETPEVNESIEDANEPAEDSNEPVEDSNKPVKDSNKPVEDSNKPVEDSNKPVEDSNKPVEDANEPVEDTSEPVEDAGEPVQETNEFTTDIASPRHQEEDIELEAEPKDATESVAVEPSNEDVKPEEKGSEAEDDINNVSKEAASGESTTHQKTEASASLESSAVTEEQETTEAEVNTDDVLSTKEAKKNTGNSNSNKKKNKKNKKKGKKK

SEQ ID NO: 1813 - protein, 817 aa, Saccharomyces cerevisiae
MAGAPAPPPPPPPPALGGSAPKPAKSVMQGRDALLGDIRKGMKLKKAETNDRSAPIVGGGVVSSASGSSGTVSSKGPSMSAPPIPGMGAPQLGDILAGGIPKLKHINNNASTKPSPSASAPPIPGAVPSVAAPPIPNAPLSPAPAVPSIPSSSAPPIPDIPSSAAPPIPIVPSSPAPPLPLSGASAPKVPQNRPHMPSVRPAHRSHQRKSSNISLPSVSAPPLPSASLPTHVSNPPQAPPPPPTPTIGLDSKNIKPTDNAVSPPSSEVPAGGLPFLAEINARRSERGAVEGVSSTKIQTENHKSPSQPPLPSSAPPIPTSHAPPLPPTAPPPPSLPNVTSAPKKATSAPAPPPPPLPAAMSSASTNSVKATPVPPTLAPPLPNTTSVPPNKASSMPAPPPPPPPPPGAFSTSSALSASSIPLAPLPPPPPPSVATSVPSAPPPPPTLTTNKPSASSKQSKISSSSSSSAVTPGGPLPFLAEIQKKRDDRFVVGGDTGYTTQDKQEDVIGSSKDDNVRPSPISPSINPPKQSSQNGMSFLDEIESKLHKQTSSNAFNAPPPHTDAMAPPLPPSAPPPPITSLPTPTASGDDHTNDKSETVLGMKKAKAPALPGHVPPPPVPPVLSDDSKNNVPAASLLHDVLPSSNLEKPPSPPVAAAPPLPTFSAPSLPQQSVSTSIPSPPPVAPTLSVRTETESISKNPTKSPPPPPSPSTMDTGTSNSPSKNLKQRLFSTGGSTLQHKHNTHTNQPDVDVGRYTIGGSNSIVGAKSGNERIVIDDSRFKWTNVSQMPKPRPFQNKTKLYPSGKGSSVPLDLTLFT

SEQ ID NO: 1814 - protein, 1876 aa, Saccharomyces cerevisiae
MNTDQQPYQGQTDYTQGPGNGQSQEQDYDQYGQPLYPSQADGYYDPNVAAGTEADMYGQQPPNESYDQDYTNGEYYGQPPNMAAQDGENFSDFSSYGPPGTPGYDSYGGQYTASQMSYGEPNSSGTSTPIYGNYDPNAIAMALPNEPYPAWTADSQSPVSIEQIEDIFIDLTNRLGFQRDSMRNMFDHFMVLLDSRSSRMSPDQALLSLHADYIGGDTANYKKWYFAAQLDMDDEIGFRNMSLGKLSRKARKAKKKNKKAMEEANPEDTEETLNKIEGDNSLEAADFRWKAKMNQLSPLERVRHIALYLLCWGEANQVRFTAECLCFIYKCALDYLDSPLCQQRQEPMPEGDFLNRVITPIYHFIRNQVYEIVDGRFVKRERDHNKIVGYDDLNQLFWYPEGIAKIVLEDGTKLIELPLEERYLRLGDVVWDDVFFKTYKETRTWLHLVTNFNRIWVMHISIFWMYFAYNSPTFYTHNYQQLVDNQPLAAYKWASCALGGTVASLIQIVATLCEWSFVPRKWAGAQHLSRRFWFLCIIFGINLGPIIFVFAYDKDTVYSTAAHVVAAVMFFVAVATIIFFSIMPLGGLFTSYMKKSTRRYVASQTFTAAFAPLHGLDRWMSYLVWVTVFAAKYSESYYFLVLSLRDPIRILSTTAMRCTGEYWWGAVLCKVQPKIVLGLVIATDFILFFLDTYLWYIIVNTIFSVGKSFYLGISILTPWRNIFTRLPKRIYSKILATTDMEIKYKPKVLISQVWNAIIISMYREHLLAIDHVQKLLYHQVPSEIEGKRTLRAPTFFVSQDDNNFETEFFPRDSEAERRISFFAQSLSTPIPEPLPVDNMPTFTVLTPHYAERILLSLREIIREDDQFSRVTLLEYLKQLHPVEWECFVKDTKILAEETAAYEGNENEAEKEDALKSQIDDLPFYCIGFKSAAPEYTLRTRIWASLRSQTLYRTISGFMNYSRAIKLLYRVENPEIVQMFGGNAEGLERELEKMARRKFKFLVSMQRLAKFKPHELENAEFLLRAYPDLQIAYLDEEPPLTEGEEPRIYSALIDGHCEILDNGRRRPKFRVQLSGNPILGDGKSDNQNHALIFYRGEYIQLIDANQDNYLEECLKIRSVLAEFEELNVEQVNPYAPGLRYEEQTTNHPVAIVGAREYIFSENSGVLGDVAAGKEQTFGTLFARTLSQIGGKLHYGHPDFINATFMTTRGGVSKAQKGLHLNEDIYAGMNAMLRGGRIKHCEYYQCGKGRDLGFGTILNFTTKIGAGMGEQMLSREYYYLGTQLPVDRFLTFYYAHPGFHLNNLFIQLSLQMFMLTLVNLSSLAHESIMCIYDRNKPKTDVLVPIGCYNFQPAVDWVRRYTLSIFIVFWIAFVPIVVQELIERGLWKATQRFFCHLLSLSPMFEVFAGQIYSSALLSDLAIGGARYISTGRGFATSRIPFSILYSRFAGSAIYMGARSMLMLLFGTVAHWQAPLLWFWASLSSLIFAPFVFNPHQFAWEDFFLDYRDYIRWLSRGNNQYHRNSWIGYVRMSRARITGFKRKLVGDESEKAAGDASRAHRTNLIMAEIIPCAIYAAGCFIAFTFINAQTGVKTTDDDRVNSVLRIIICTLAPIAVNLGVLFFCMGMSCCSGPLFGMCCKKTGSVMAGIAHGVAVIVHIAFFIVMWVLESFNFVRMLIGVVTCIQCQRLIFHCMTALMLTREFKNDHANTAFWTGKWYGKGMGYMAWTQPSRELTAKVIELSEFAADFVLGHVILICQLPLIIIPKIDKFHSIMLFWLKPSRQIRPPIYSLKQTRLRKRMVKKYCSLYFLVLAIFAGCIIGPAVASAKIHKHIGDSLDGVVHNLFQPINTTNNDTGSQMSTYQSHYYTHTPSLKTWSTIK

SEQ ID NO: 1815 - protein, 861 aa, Saccharomyces cerevisiae
MSTAEFAQLLENSILSPDQNIRLTSETQLKKLSNDNFLQFAGLSSQVLIDENTKLEGRILAALTLKNELVSKDSVKTQQFAQRWITQVSPEAKNQIKTNALTALVSIEPRIANAAAQLIAAIADIELPHGAWPELMKIMVDNTGAEQPENVKRASLLALGYMCESADPQSQALVSSSNNILIAIVQGAQSTETSKAVRLAALNALADSLIFIKNNMEREGERNYLMQVVCEATQAEDIEVQAAAFGCLCKIMSLYYTFMKPYMEQALYALTIATMKSPNDKVASMTVEFWSTICEEEIDIAYELAQFPQSPLQSYNFALSSIKDVVPNLLNLLTRQNEDPEDDDWNVSMSAGACLQLFAQNCGNHILEPVLEFVEQNITADNWRNREAAVMAFGSIMDGPDKVQRTYYVHQALPSILNLMNDQSLQVKETTAWCIGRIADSVAESIDPQQHLPGVVQACLIGLQDHPKVATNCSWTIINLVEQLAEATPSPIYNFYPALVDGLIGAANRIDNEFNARASAFSALTTMVEYATDTVAETSASISTFVMDKLGQTMSVDENQLTLEDAQSLQELQSNILTVLAAVIRKSPSSVEPVADMLMGLFFRLLEKKDSAFIEDDVFYAISALAASLGKGFEKYLETFSPYLLKALNQVDSPVSITAVGFIADISNSLEEDFRRYSDAMMNVLAQMISNPNARRELKPAVLSVFGDIASNIGADFIPYLNDIMALCVAAQNTKPENGTLEALDYQIKVLEAVLDAYVGIVAGLHDKPEALFPYVGTIFQFIAQVAEDPQLYSEDATSRAAVGLIGDIAAMFPDGSIKQFYGQDWVIDYIKRTRSGQLFSQATKDTARWAREQQKRQLSL

SEQ ID NO: 1816 - protein, 298 aa, Saccharomyces cerevisiae
MSTNAKESAGKNIKYPWWYGGAAGIFATMVTHPLDLAKVRLQAAPMPKPTLFRMLESILANEGVVGLYSGLSAAVLRQCTYTTVRFGAYDLLKENVIPREQLTNMAYLLPCSMFSGAIGGLAGNFADVVNIRMQNDSALEAAKRRNYKNAIDGVYKIYRYEGGLKTLFTGWKPNMVRGILMTASQVVTYDVFKNYLVTKLDFDASKNYTHLTASLLAGLVATTVCSPADVMKTRIMNGSGDHQPALKILADAVRKEGPSFMFRGWLPSFTRLGPFTMLIFFAIEQLKKHRVGMPKEDK

SEQ ID NO: 1817 - protein, 603 aa, Saccharomyces cerevisiae
MIQSDEDNLDSSETTASTSYSGTSSVSSRLQLRTSLFFENLNGAHGNPDAETEMATVAYETTSRGQGFAVYINNERFSQIMGASTSSSSSSNSSSITQFHDTQDNNIPSNTTVRPTSLRRDNEDTVPLRNVTPSQNAAVRPERAVNSPSSQRLSCALTISTSVLMGEDVEGSPIEQEHSRVVSSLYSSLANRGNDESKNGTPPRPTSIEPNETTEHSFFSYHYDDTLEPDVEEAVRLTKNKTSNVNFISSTGSKGEGETEDEVIDQYEPVNESKFIPHKLKIPEKAGSIKSSTSDDSHSPGAPGTSARKIKIPQSPSLIGNILIPSHNSDSSNESSPKDHIGHNNEEKFSSKSTRKPSTSLEEEGPPIGLPSIPVLRSVSGPSKWTKTPLRLESGNSTKSDPFSRYEGHKTPSPLTKMNKKKNKTLPEHGQPLVLAPIKSQSSESDTGQNSIIEKPARSIRRKQQEKTDNRKEDRHDAENIDLEARMPIQHIDTASIHSFDSGQNGFRDVYSIENIIVILLCCSIVPPLFFIIGCSSRRKLVSDYRLMRLLMNKEHRAALLQGFIWDVDLRWFRMFCLILGAAETVIVMAGIAIGFGVGITRE

SEQ ID NO: 1818 - protein, 335 aa, Saccharomyces cerevisiae
MSEPAQKKQKVANNSLEQLKASGTVVVADTGDFGSIAKFQPQDSTTNPSLILAAAKQPTYAKLIDVAVEYGKKHGKTTEEQVENAVDRLLVEFGKEILKIVPGRVSTEVDARLSFDTQATIEKARHIIKLFEQEGVSKERVLIKIASTWEGIQAAKELEEKDGIHCNLTLLFSFVQAVACAEAQVTLISPFVGRILDWYKSSTGKDYKGEADPGVISVKKIYNYYKKYGYKTIVMGASFRSTDEIKNLAGVDYLTISPALLDKLMNSTEPFPRVLDPVSAKKEAGDKISYISDESKFRFDLNEDAMATEKLSEGIRKFSADIVTLFDLIEKKVTA

SEQ ID NO: 1819 - protein, 482 aa, Saccharomyces cerevisiae
MPDYDNYTTPLSSRYASKEMSATFSLRNRFSTWRKLWLNLAIAEKELGLTVVTDEAIEQMRKHVEITDDEIAKASAQEAIVRHDVMAHVHTFGETCPAAAGIIHLGATSCFVTDNADLIFIRDAYDIIIPKLVNVINRLAKFAMEYKDLPVLGWTHFQPAQLTTLGKRATLWIQELLWDLRNFERARNDIGLRGVKGTTGTQASFLALFHGNHDKVEALDERVTELLGFDKVYPVTGQTYSRKIDIDVLAPLSSFAATAHKMATDIRLLANLKEVEEPFEKSQIGSSAMAYKRNPMRCERVCSLARHLGSLFSDAVQTASVQWFERTLDDSAIRRISLPSAFLTADILLSTLLNISSGLVVYPKVIERRIKGELPFMATENIIMAMVEKNASRQEVHERIRVLSHQAAAVVKEEGGENDLIERVKRDEFFKPIWEELDSLLEPSTFVGRAPQQVEKFVQKDVNNALQPFQKYLNDEQVKLNV

SEQ ID NO: 1820 - protein, 738 aa, Saccharomyces cerevisiae
MHKERPLNKASMIRSPVDEIYMEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 1821 - protein, 657 aa, Saccharomyces cerevisiae
MLKSGRLNFLKLNINSRLLYSTNPQLTKKVIGIDLGTTNSAVAYIRDSNDKKSATIIENDEGQRTTPSIVAFDVKSSPQNKDQMKTLVGMAAKRQNAINSENTFFATKRLIGRAFNDKEVQRDMAVMPYKIVKCESNGQAYLSTSNGLIQSPSQIASILLKYLKQTSEEYLGEKVNLAVITVPAYFNDSQRQATKDAGKLAGLNVLRVINEPTAAALSFGIDDKRNNGLIAVYDLGGGTFDISILDIEDGVFEVRATNGDTHLGGEDFDNVIVNYIIDTFIHENPEITREEITKNRETMQRLKDVSERAKIDLSHVKKTFIELPFVYKSKHLRVPMTEEELDNMTLSLINRTIPPVKQALKDADIEPEDIDEVILVGGMTRMPKIRSVVKDLFGKSPNSSVNPDETVALGAAIQGGILSGEIKNVLLLDVTPLTLGIETFGGAFSPLIPRNTTVPVKKTEIFSTGVDGQAGVDIKVFQGERGLVRNNKLIGDLKLTGITPLPKGIPQIYVTFDIDADGIINVSAAEKSSGKQQSITVIPNSGLSEEEIAKLIEEANANRAQDNLIRQRLELISKADIMISDTENLFKRYEKLISSEKEYSNIVEDIKALRQAIKNFKANENDMSIDVNGIKKATDALQGRALKLFQSATKNQQNQGK

SEQ ID NO: 1822 - protein, 1356 aa, Saccharomyces cerevisiae
MSETNVDSLGDRNDIYSQIFGVERRPDSFATFDSDSHGDISSQLLPNRIENIQNLNVLLSEDIANDIIIAKQRRRSGVEAAIDDSDIPNNEMKGKSSNYILSQQTNIKEVPDTQSLSSADNTPVSSPKKARDATSSHPIVHAKSMSHIYSTSNSASRQAKHYNDHPLPPMSPRNEVYQKNKSTTAFVPKRKPSLPQLALAGLKKQSSFSTGSASTTPTQARKSPLQGFGFFSRPSSKDLHEQHQHHQHIQHNNINNHNNNNTNNNGAHYQVGSSNSNYPQHSHSISSRSMSLNSSTLKNIASSFQSKTSNSRKATQKYDITSNPFSDPHHHHHHHHSSNSHSSLNNVHGSGNSSSVMGSSSNIGLGLKTRVSSTSLALKRYTSVSGTSLSSPRRSSMTPLSASRPVMSASSKKPQVYPALLSRVATKFKSSIQLGEHKKDGLVYRDAFTGQQAVDVICAIIRTSDRNLALLFGRSLDAQKLFHDVVYEHRLRDSPHEVYEFTDNSRFTGTGSTNAHDPLMLLPNSSSFNSGNHSYPNSGMVPSSSTSSLNSDQATLTGSRLHMSSSLSQQKNPAAIHNVNGVFTLLAECYSPTCTRDALCYSISCPRRLEQQARLNLKPNGGLKRNISMALDDDDEEKPSWTSSVSKEDWENLPKKEIKRQEAIYEVYITEKNFVKSLEITRDTFMKTLAETNIISADIRKNFIKHVFAHINDIYSVNRRFLKALTDRQRSSPVVRGIGDIVLRFIPFFEPFVSYVASRPYAKYLIETQRSVNPYFARFDDDMMSSSLRHGIDSFLSQGVSRPGRYMLLVKEIMKSTDPEKDKSDYEDLSKAMDALRDFMKRIDQASGAAQDRHDVKLLKQKILFKNEYVNLGLNDERRKIKHEGILSRKELSKSDGTVVGDIQFYLLDNMLLFLKAKAVNKWHQHKVFQRPIPLPLLFACPGEDMPALRKYIGDHPDCSGTVIQPEYNTSNPKNAITFLYYGAKQRYQVTLYAAQYAGLQTLLEKIKQGQAAIISKTEMFNVTKMSDRFFDYTNKINSVTSCDGGRKLLIATNSGLYMSNIKRQQNKDHRHKSSAFFSTPIQLVQRNNITQIAVLEEFKSIILLIDKKLYSCPLSLIEAEGNGTSFFKKHHKELINHVSFFAEGDCNGKRLIVTAHSSSHSIKYFEHEHPLLAEKNGSGSGNKKSLKKKITEVIFDSEPVSISFLKANLCIGCKKGFQIVSISQNAHESLLDPADTSLEFALRDTLKPMAIYRVGNMFLLCYTEFAFFVNNQGWRKKESHIIHWEGEPQKFAIWYPYILAFDSNFIEIRKIETGELIRCVLADKIRLLQTSTQEILYCYEDYRGYDTVASLDFWG

SEQ ID NO: 1823 - protein, 345 aa, Saccharomyces cerevisiae [sequence omitted]

SEQ ID NO: 1824 - protein, 348 aa, Saccharomyces cerevisiae
MPTLVNGPRRDSTEGFDTDIITLPRFIIEHQKQFKNATGDFTLVLNALQFAFKFVSHTIRRAELVNLVGLAGASNFTGDQQKKLDVLGDEIFINAMRASGIIKVLVSEEQEDLIVFPTNTGSYAVCCDPIDGSSNLDAGVSVGTIASIFRLLPDSSGTINDVLRCGKEMVAACYAMYGSSTHLVLTLGDGVDGFTLDTNLGEFILTHPNLRIPPQKAIYSINEGNTLYWNETIRTFIEKVKQPQADNNNKPFSARYVGSMVADVHRTFLYGGLFAYPCDKKSPNGKLRLLYEAFPMAFLMEQAGGKAVNDRGERILDLVPSHIHDKSSIWLGSSGEIDKFLDHIGKSQ

SEQ ID NO: 1825 - protein, 1114 aa, Saccharomyces cerevisiae
MISTTISGKRPIEQVDDELLSLTAQQENEEQQQQRKRRRHQFAPMTQFNSNTLDEDSGFRSSSDVATADQDNFLEESPSGYIKKVILRNFMCHEHFELELGSRLNFIVGNNGSGKSAILTAITIGLGAKASETNRGSSLKDLIREGCYSAKIILHLDNSKYGAYQQGIFGNEIIVERIIKRDGPASFSLRSENGKEISNKKKDIQTVVDYFSVPVSNPMCFLSQDAARSFLTASTSQDKYSHFMKGTLLQEITENLLYASAIHDSAQENMALHLENLKSLKAEYEDAKKLLRELNQTSDLNERKMLLQAKSLWIDVAHNTDACKNLENEISGIQQKVDEVTEKIRNRQEKIERYTSDGTTIEAQIDAKVIYVNEKDSEHQNARELLRDVKSRFEKEKSNQAEAQSNIDQGRKKVDALNKTIAHLEEELTKEMGGDKDQMRQELEQLEKANEKLREVNNSLVVSLQDVKNEERDIQHERESELRTISRSIQNKKVELQNIAKGNDTFLMNFDRNMDRLLRTIEQRKNEFETPAIGPLGSLVTIRKGFEKWTRSIQRAISSSLNAFVVSNPKDNRLFRDIMRSCGIRSNIPIVTYCLSQFDYSKGRAHGNYPTIVDALEFSKPEIECLFVDLSRIERIVLIEDKNEARNFLQRNPVNVNMALSLRDRRSGFQLSGGYRLDTVTYQDKIRLKVNSSSDNGTQYLKDLIEQETKELQNIRDRYEEKLSEVRSRLKEIDGRLKSTKNEMRKTNFRMTELKMNVGKVVDTGILNSKINERKNQEQAIASYEAAKEELGLKIEQIAQEAQPIKEQYDSTKLALVEAQDELQQLKEDINSRQSKIQKYKDDTIYYEDKKKVYLENIKKIEVNVAALKEGIQRQIQNACAFCSKERIENVDLPDTQEEIKRELDKVSRMIQKAEKSLGLSQEEVIALFEKCRNKYKEGQKKYMEIDEALNRLHNSLKARDQNYKNAEKGTCFDADMDFRASLKVRKFSGNLSFIKDTKSLEIYILTTNDEKARNVDTLSGGEKSFSQMALLLATWKPMRSRIIALDEFDVFMDQVNRKIGTTLIVKKLKDIARTQTIIITPQDIGKIADIDSSGVSIHRMRDPERQNNSNFYN

SEQ ID NO: 1826 - protein, 988 aa, Saccharomyces cerevisiae
MGVSLLASSSAFVTKPLLTQLVHLSPISLNFTVRRFKPFTCLSRYYTTNPYNMTSNFKTFNLDFLKPDLDERSYRFIELPNKLKALLIQDPKADKAAASLDVNIGAFEDPKNLPGLAHFCEHLLFMGSEKFPDENEYSSYLSKHGGSSNAYTASQNTNYFFEVNHQHLFGALDRFSGFFSCPLFNKDSTDKEINAVNSENKKNLQNDIWRIYQLDKSLTNTKHPYHKFSTGNIETLGTLPKENGLNVRDELLKFHKNFYSANLMKLCILGREDLDTLSDWTYDLFKDVANNGREVPLYAEPIMQPEHLQKIIQVRPVKDLKKLEISFTVPDMEEHWESKPPRILSHLIGHEGSGSLLAHLKKLGWANELSAGGHTVSKGNAFFAVDIDLTDNGLTHYRDVIVLIFQYIEMLKNSLPQKWIFNELQDISNATFKFKQAGSPSSTVSSLAKCLEKDYIPVSRILAMGLLTKYEPDLLTQYTDALVPENSRVTLISRSLETDSAEKWYGTAYKVVDYPADLIKNMKSPGLNPALTLPRPNEFVSTNFKVDKIDGIKPLDEPVLLLSDDVSKLWYKKDDRFWQPRGYIYLSFKLPHTHASIINSMLSTLYTQLANDALKDVQYDAACADLRISFNKTNQGLAITASGFNEKLIILLTRFLQGVNSFEPKKDRFEILKDKTIRHLKNLLYEVPYSQMSNYYNAIINERSWSTAEKLQVFEKLTFEQLINFIPTIYEGVYFETLIHGNIKHEEALEVDSLIKSLIPNNIHNLQVSNNRLRSYLLPKGKTFRYETALKDSQNVNSCIQHVTQLDVYSEDLSALSGLFAQLIHEPCFDTLRTKEQLGYVVFSSSLNNHGTANIRILIQSEHTTPYLEWRINNFYETFGQVLRDMPEEDFEKHKEALCNSLLQKFKNMAEESARYTAAIYLGDYNFTHRQKKAKLVANITKQQMIDFYENYIMSENASKLILHLKSQVETKSSMKMNWTPLSIQLAS

SEQ ID NO: 1827 - protein, 780 aa, Saccharomyces cerevisiae
MAPKSSSSGSKKKSSASSNSADAKASKFKLPAEFITRPHPSKDHGKETCTAYIHPNVLSSLEINPGSFCTVGKIGENGILVIARAGDEEVHPVNVITLSTTIRSVGNLILGDRLELKKAQVQPPYATKVTVGSLQGYNILECMEEKVIQKLLDDSGVIMPGMIFQNLKTKAGDESIDVVITDASDDSLPDVSQLDLNMDDMYGGLDNLFYLSPPFIFRKGSTHITFSKETQANRKYNLPEPLSYAAVGGLDKEIESLKSAIEIPLHQPTLFSSFGVSPPRGILLHGPPGTGKTMLLRVVANTSNAHVLTINGPSIVSKYLGETEAALRDIFNEARKYQPSIIFIDEIDSIAPNRANDDSGEVESRVVATLLTLMDGMGAAGKVVVIAATNRPNSVDPALRRPGRFDQEVEIGIPDVDARFDILTKQFSRMSSDRHVLDSEAIKYIASKTHGYVGADLTALCRESVMKTIQRGLGTDANIDKFSLKVTLKDVESAMVDIRPSAMREIFLEMPKVYWSDIGGQEELKTKMKEMIQLPLEASETFARLGISAPKGVLLYGPPGCSKTLTAKALATESGINFLAVKGPEIFNKYVGESERAIREIFRKARSAAPSIIFFDEIDALSPDRDGSSTSAANHVLTSLLNEIDGVEELKGVVIVAATNRPDEIDAALLRPGRLDRHIYVGPPDVNARLEILKKCTKKFNTEESGVDLHELADRTEGYSGAEVVLLCQEAGLAAIMEDLDVAKVELRHFEKAFKGIARGITPEMLSYYEEFALRSGSSS

SEQ ID NO: 1828 - protein, 1287 aa, Saccharomyces cerevisiae
MSEGFSSSSIQELYQSLKEITNNADVELFEDRITKLDFESTDEPKHANDIIKDRFLRPSNALPWSLLDMVQDVPHTSSPEDCSGKLDYKELLKVPDPINRTSYQFKRTGLEGKISGYKEEVDLKEVANANASNSLSITRSINHNQNSVRGSTAQLPFTPGGIPMKSVKTDSEQNGSSTMANATKLLHKDGQGLFDIPEGMNRGIKPMDSPAENEDQNGQFKELKQLNEIDNELDIRIEANEAKLKEEEKSAKSISEEIMEEATEETTADNADDAEIDELLPIGIDFGRTKPVSKSVPVKKEWAHVVDLNHKIENFDELIPNPARSWPFELDTFQKEAVYHLEQGDSVFVAAHTSAGKTVVAEYAIAMAHRNMTKTIYTSPIKALSNQKFRDFKETFDDVNIGLITGDVQINPDANCLIMTTEILRSMLYRGADLIRDVEFVIFDEVHYVNDQDRGVVWEEVIIMLPQHVKFILLSATVPNTYEFANWIGRTKQKNIYVISTPKRPVPLEINIWAKKELIPVINQNSEFLEANFRKHKEILNGESAKGAPSKTDNGRGGSTARGGRGGSNTRDGRGGRGNSTRGGANRGGSRGAGAIGSNKRKFFTQDGPSKKTWPEIVNYLRKRELLPMVVFVFSKKRCEEYADWLEGINFCNNKEKSQIHMFIEKSITRLKKEDRDLPQILKTRSLLERGIAVHHGGLLPIVKELIEILFSKGFIKVLFATETFAMGLNLPTRTVIFSSIRKHDGNGLRELTPGEFTQMAGRAGRRGLDSTGTVIVMAYNSPLSIATFKEVTMGVPTRLQSQFRLTYNMILNLLRIEALRVEEMIKYSFSENAKETLQPEHEKQIKVLQEELQTIEYKSCEICDNDIEKFLELMLAYKEATVNLMQEMVKSPSILHILKEGRLVAFRDPNDCLKLGFVFKVSLKDAVCVIMTFTKPYKLPNGEPNHLIYFPKADGYRRRNFPKFQKTDFYMEEVPVTAIEVITKRKFAAPLGKVIKKDVAALNEFNAETNNILDGKTLKEAINIEKQGLKIHQILLDRTNIRDEIFKLKSIKCPNLSQHIVPKFKAHVIKKKIEELYHLMSDQNLSLLPDYEKRLAVLKDTEFIDQNHNVLLKGRVACEINSGYELVLTELILDNFLGSFEPEEIVALLSVFVYEGKTREEEPPIVTPRLAKGKQRIEEIYKKMLCVFNTHQIPLTQDEAEFLDRKRFAMMNVVYEWARGLSFKEIMEMSPEAEGTVVRVITWLDEICREVKTASIIIGNSTLHMKMSRAQELIKRDIVFAASLYL

SEQ ID NO: 1829 - protein, 686 aa, Saccharomyces cerevisiae
MTDITPVQNDVDVNGNNVNDDVSSNLKRPIDQGDPSNGLAEEENPANNQLHLKKARLDGDALTSSPAGLAENGIEGATLAANGENGYNATGSGAEDEQQGLKKEEGGQGTKQEDLDENSKQELPMEVPKEPAPAPPPEPDMNNLPQNPIPKHQQKHALLAIKAVKRLKDARPFLQPVDPVKLDIPFYFNYIKRPMDLSTIERKLNVGAYEVPEQITEDFNLMVNNSIKFNGPNAGISQMARNIQASFEKHMLNMPAKDAPPVIAKGRRSSAQEDAPIVIRRAQTHNGRPKRTIHPPKSKDIYPYESKKPKSKRLQQAMKFCQSVLKELMAKKHASYNYPFLEPVDPVSMNLPTYFDYVKEPMDLGTIAKKLNDWQYQTMEDFERDVRLVFKNCYTFNPDGTIVNMMGHRLEEVFNSKWADRPNLDDYDSDEDSRTQGDYDDYESEYSESDIDETIITNPAIQYLEEQLARMKVELQQLKKQELEKIRKERRLARGSKKRGKRSKGRSGSKNASSKGRRDKKNKLKTVVTYDMKRIITERINDLPTSKLERAIDIIKKSMPNISEDDEVELDLDTLDNHTILTLYNTFFRQYESSSGASNGLDGTSGVTRDASSLSPTSAGSRKRRSKALSQEEQSRQIEKIKNKLAILDSASPLSQNGSPGQIQSAAHNGFSSSSDDDVSSESEEE

SEQ ID NO: 1830 - protein, 2231 aa, Saccharomyces cerevisiae
MNSNNPDNNNSNNINNNNKDKDIAPNSDVQLATVYTKAKSYIPQIEQVYQGTNPNIQEAKLLGELLQVLAEVPKGTHLFCDPILEPISIFSLTIFSFNEEATATWLKNHFNPILSVCDKCILNFARGKCKMLQHFAIQRHVPHEHVAKFNDIVCQWRVEAVFPILRNISVNDNTGINITNEIETAMYECLCNPHMLRLNKQLKATFEAIFKFFYDTKHRLLDVTNPLSIKTFISGVIFCWCEGSKEENEWSRAFLKDLYSRNFHINLSNLTPDIIEEVYIHILFLQNPANWTEIVVSQFWSRLLPVFNLFDKDVFIEYFQVPKNVESLKKTFKFPLEPIFKMWYNHLSKSYHDKPLDFLLRGLTMFLNKFGSEFWSKIEPFTFHSILDIIFNRDSFPIKLIKIQDNPIVEHQTEVYFQLTGSVTDLLSWTLPFYHALSPSKRIQMVRKVSMAFLRIIANYPSLKSIPKACLMNSATALLRAVLTIKENERAMLYKNDEFETVLLTKTDSRALLNNPLIQDIIIRSASNPNDFYPGLGAASASVATSTMMVLAECIDFDILLLCHRTFKLYSGKPISEIPISTNVLENVTNKIDLRSFHDGPLLAKQLLVSLKNINGLLIVPSNTAVAEAHNALNQKFLLLSTRLMEKFADILPGQLSKILADEDASQGFWSCIFSSDKHLYQAATNILYNTFDVEGRLEGILAILNSNLTVNLKNINVMLQRLINCEFYEPCPRAVRVLMDVVSAFVDPISGVFANFQTLKSQNTEKEFLKFWESCWLFLDTIYKFTLKWASKYDYSELENFTKDTLDLSRSLVDSFREFSDILHDQTKNLLLNVLETFKNMLYWLRLSDEVLLESCVRLIISTSDLAHEKHVKVDDSLVEMMAKYASKAKRFSNKLTEQQASEILQKAKIFNKALTEEVATEAENYRKEKELSRLGKVIDLTDSVPASPSLSPSLSSTIASSSAESRADYLQRKALSSSITGRPRVAQPKITSFGTFQSSANAKLHRTKPVKPLSKMELARMQLLNNRVVHPPSAPAFHTKSRGLSNKNDDSSSEESDNDIESARELFAIAKAKGKGIQTVDINGKVVKRQTAAELAKQELEHMRKRLNVDMNPLYEIILQWDYTRNSEYPDDEPIGNYSDVKDFFNSPADYQKVMKPLLLLESWQGLCSSRDREDYKPFSIIVGNRTAVSDFYDVYASVAKQVIQDCGISESDLIVMAYLPDFRPDKRLSSDDFKKAQHTCLAKVRTLKNTKGGNVDVTLRIHRNHSFSKFLTLRSEIYCVKVMQMTTIEREYSTLEGLEYYDLVGQILQAKPSPPVNVDAAEIETVKKSYKLNTSQAEAIVNSVSKEGFSLIQGPPGTGKTKTILGIIGYFLSTKNASSSNVIKVPLEKNSSNTEQLLKKQKILICAPSNAAVDEICLRLKSGVYDKQGHQFKPQLVRVGRSDVVNVAIKDLTLEELVDKRIGERNYEIRTDPELERKFNNAVTKRRELRGKLDSESGNPESPMSTEDISKLQLKIRELSKIINELGRDRDEMREKNSVNYRNRDLDRRNAQAHILAVSDIICSTLSGSAHDVLATMGIKFDTVIIDEACQCTELSSIIPLRYGGKRCIMVGDPNQLPPTVLSGAASNFKYNQSLFVRMEKNSSPYLLDVQYRMHPSISKFPSSEFYQGRLKDGPGMDILNKRPWHQLEPLAPYKFFDIISGRQEQNAKTMSYTNMEEIRVAIELVDYLFRKFDNKIDFTGKIGIISPYREQMQKMRKEFARYFGGMINKSIDFNTIDGFQGQEKEIILISCVRADDTKSSVGFLKDFRRMNVALTRAKTSIWVLGHQRSLAKSKLWRDLIEDAKDRSCLAYACSGFLDPRNNRAQSILRKFNVPVPSEQEDDYKLPMEYITQGPDEVKSNKDTKKRRVVDEGEEADKAVKKKKKEKKKEKKKSKADDKKKNNKKAESPSTSSGTKKKSSIFGGMSVPSAVVPKTFPDVDSNKKAAAVVGKKKNNKHVCFSDDVSFIPRNDEPEIKVTRSLSSVLKEKQLGLKETRTISPPEISNNEDDDDEDDYTPSISDSSLMKSEANGRNNRVASHNQNFSASIYDDPQVSQAKQTQVPAAITKHRSSNSVLSGGSSRILTASDYGEPNQNGQNGANRTLSQHVGNANQYSTAPVGTGELHETLPAHPQDSYPAEAEDPYDLNPHPQPQSSAFKGPGSGPTGTRNSSRRNASSSPFIPKKRKPRS

SEQ ID NO: 1831 - protein, 553 aa, Saccharomyces cerevisiae
MSKDLNSSRIKIIKPNDSYIKVDRKKDLTKYELENGKVISTKDRPIASVPAITGKIPSDEEVFDSKTGLPNHSFLREHFFHEGRLSKEQAIKILNMSTVALSKEPNLLKLKAPITICGDIHGQYYDLLKLFEVGGDPAEIDYLFLGDYVDRGAFSFECLIYLYSLKLNNLGRFWMLRGNHECKHLTSYFTFKNEMLHKYDMEVYDACCRSFNVLPLAALMNGQYFCVHGGISPELKSVEDVNKINRFREIPSRGLMCDLLWADPVENYDDARDGSEFDQSEDEFVPNSLRGCSFAFTFKASCKFLKANGLLSIIRAHEAQDAGYRMYKNNKVTGFPSLITMFSAPNYLDTYHNKAAVLKYEENVMNIRQFHMSPHPYWLPDFMDVFTWSLPFVGEKVTSMLVSILNICSEQELDPESEPKAAEETVKARANATKETGTPSDEKASSAILEDETRRKALRNKILAIAKVSRMFSVLREESEKVEYLKTMNAGVLPRGALARGTEGLNETLSTFEKARKEDLINEKLPPSLSEVEQEKIKYYEKILKGAEKKPQL

SEQ ID NO: 1832 - protein, 424 aa, Saccharomyces cerevisiae
MSEATLSSKQTIEWENKYSAHNYHPLPVVFHKAKGAHVWDPEGKLYLDFLSAYSAVNQGHCHPHIIKALTEQAQTLTLSSRAFHNDVYAQFAKFVTEFFGFETVLPMNTGAEAVETALKLARRWGYMKKNIPQDKAIILGAEGNFHGRTFGAISLSTDYEDSKLHFGPFVPNVASGHSVHKIRYGHAEDFVPILESPEGKNVAAIILEPIQGEAGIVVPPADYFPKVSALCRKHNVLLIVDEIQTGIGRTGELLCYDHYKAEAKPDIVLLGKALSGGVLPVSCVLSSHDIMSCFTPGSHGSTFGGNPLASRVAIAALEVIRDEKLCQRAAQLGSSFIAQLKALQAKSNGIISEVRGMGLLTAIVIDPSKANGKTAWDLCLLMKDHGLLAKPTHDHIIRLAPPLVISEEDLQTGVETIAKCIDLL

SEQ ID NO: 1833 - protein, 978 aa, Saccharomyces cerevisiae
MAKTLKDLDGWQVIITDDQGRVIDDNNRRRSRKRGGENVFLKRISDGLSFGKGESVIFNDNVTETYSVYLIHEIRLNTLNNVVEIWVFSYLRWFELKPKLYYEQFRPDLIKEDHPLEFYKDKFFNEVNKSELYLTAELSEIWLKDFIAVGQILPESQWNDSSIDKIEDRDFLVRYACEPTAEKFVPIDIFQIIRRVKEMEPKQSDEYLKRVSVPVSGQKTNRQVMHKMGVERSSKRLAKKPSMKKIKIEPSADDDVNNGNIPSQRGTSTTHGSISPQEESVSPNISSASPSALTSPTDSSKILQKRSISKELIVSEEIPINSSEQESDYEPNNETSVLSSKPGSKPEKTSTELVDGRENFVYANNPEVSDDGGLEEETDEVSSESSDEAIIPVNKRRGAHGSELSSKIRKIHIQETQEFSKNYTTETDNEMNGNGKPGIPRGNTKIHSMNENPTPEKGNAKMIDFATLSKLKKKYQIILDRFAPDNQVTDSSQLNKLTDEQSSLDVAGLEDKFRKACSSSGRETILSNFNADINLEESIRESLQKRELLKSQVEDFTRIFLPIYDSLMSSQNKLFYITNADDSTKFQLVNDVMDELITSSARKELPIFDYIHIDALELAGMDALYEKIWFAISKENLCGDISLEALNFYITNVPKAKKRKTLILIQNPENLLSEKILQYFEKWISSKNSKLSIICVGGHNVTIREQINIMPSLKAHFTEIKLNKVDKNELQQMIITRLKSLLKPFHVKVNDKKEMTIYNNIREGQNQKIPDNVIVINHKINNKITQLIAKNVANVSGSTEKAFKICEAAVEISKKDFVRKGGLQKGKLVVSQEMVPRYFSEAINGFKDETISKKIIGMSLLMRTFLYTLAQETEGTNRHTLALETVLIKMVKMLRDNPGYKASKEIKKVICGAWEPAITIEKLKQFSWISVVNDLVGEKLVVVVLEEPSASIMVELKLPLEINYAFSMDEEFKNMDCI

SEQ ID NO: 1834 - protein, 433 aa, Saccharomyces cerevisiae
MTIESTLARELESLILPADSIVNVVDQFQEELLSRLQTNTISMLPQCLVPDKRSRWNPEDKILTIDFGGTRLKFAIISLPQIVIEYNDAFELTYNIVDSNFFNQIIYTICTRLAANGYIKKKNESSEASKFFVSVTFSFPLNPEGEVVAMGKGFVMTDTLQGSTVKQLIQSSFHRIISENIEEFFCTMNVCHVINDAIAVSLTSKFICENDSISLIIGTGTNACFEVPYGYLPPFKRDALRETLPSSYNKETLNFKHVLINSEIGFIGKNVIALQPFDIHGAISYEMPLECVTSGKWLPLSLKNILLQYNIIPKNFPVEFNGELVCQLAEDCTNAWFENEHYALICQIARLLIKRAAFYVAAIVQAIDIITGCKNYNFIHIGYVGSFLHNSNFYREQIKYYSSIHIKLQFLNHSNLLGAAIATYLNKSDNQVQ

SEQ ID NO: 1835 - protein, 345 aa, Saccharomyces cerevisiae
MEGVYFNIDNGFIEGVVRGYRNGLLSNNQYINLTQCDTLEDLKLQLSSTDYGNFLSSVSSESLTTSLIQEYASSKLYHEFNYIRDQSSGSTRKFMDYITYGYMIDNVALMITGTIHDRDKGEILQRCHPLGWFDTLPTLSVATDLESLYETVLVDTPLAPYFKNCFDTAEELDDMNIEIIRNKLYKAYLEDFYNFVTEEIPEPAKECMQTLLGFEADRRSINIALNSLQSSDIDPDLKSDLLPNIGKLYPLATFHLAQAQDFEGVRAALANVYEYRGFLETGNLEDHFYQLEMELCRDAFTQQFAISTVWAWMKSKEQEVRNITWIAECIAQNQRERINNYISVY

SEQ ID NO: 1836 - protein, 1045 aa, Saccharomyces cerevisiae
MSLPLKTIVHLVKPFACTARFSARYPIHVIVVAVLLSAAAYLSVTQSYLNEWKLDSNQYSTYLSIKPDELFEKCTHYYRSPVSDTWKLLSSKEAADIYTPFHYYLSTISFQSKDNSTTLPSLDDVIYSVDHTRYLLSEEPKIPTELVSENGTKWRLRNNSNFILDLHNIYRNMVKQFSNKTSEFDQFDLFIILAAYLTLFYTLCCLFNDMRKIGSKFWLSFSALSNSACALYLSLYTTHSLLKKPASLLSLVIGLPFIVVIIGFKHKVRLAAFSLQKFHRISIDKKITVSNIIYEAMFQEGAYLIRDYLFYISSFIGCAIYARHLPGLVNFCILSTFMLVFDLLLSATFYSAILSMKLEINIIHRSTVIRQTLEEDGVVPTTADIIYKDETASEPHFLRSNVAIILGKASVIGLLLLINLYVFTDKLNATILNTVYFDSTIYSLPNFINYKDIGNLSNQVIISVLPKQYYTPLKKYHQIEDSVLLIIDSVSNAIRDQFISKLLFFAFAVSISINVYLLNAAKIHTGYMNFQPQSNKIDDLVVQQKSATIEFSETRSMPASSGLETPVTAKDIIISEEIQNNECVYALSSQDEPIRPLSNLVELMEKEQLKNMNNTEVSNLVVNGKLPLYSLEKKLEDTTRAVLVRRKALSTLAESPILVSEKLPFRNYDYDRVFGACCENVIGYMPIPVGVIGPLIIDGTSYHIPMATTEGCLVASAMRGCKAINAGGGATTVLTKDGMTRGPVVRFPTLIRSGACKIWLDSEEGQNSIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVKSVLKSDVSALVELNISKNLVGSAMAGSVGGFNAHAANLVTALFLALGQDPAQNVESSNCITLMKEVDGDLRISVSMPSIEVGTIGGGTVLEPQGAMLDLLGVRGPHPTEPGANARQLARIIACAVLAGELSLCSALAAGHLVQSHMTHNRKTNKANELPQPSNKGPPCKTSALL

SEQ ID NO: 1837 - protein, 491 aa, Saccharomyces cerevisiae
MKLSTKLCWCGIKGRLRPQKQQQLHNTNLQMTELKKQKTAEQKTRPQNVGIKGIQIYIPTQCVNQSELEKFDGVSQGKYTIGLGQTNMSFVNDREDIYSMSLTVLSKLIKSYNIDTNKIGRLEVGTETLIDKSKSVKSVLMQLFGENTDVEGIDTLNACYGGTNALFNSLNWIESNAWDGRDAIVVCGDIAIYDKGAARPTGGAGTVAMWIGPDAPIVFDSVRASYMEHAYDFYKPDFTSEYPYVDGHFSLTCYVKALDQVYKSYSKKAISKGLVSDPAGSDALNVLKYFDYNVFHVPTCKLVTKSYGRLLYNDFRANPQLFPEVDAELATRDYDESLTDKNIEKTFVNVAKPFHKERVAQSLIVPTNTGNMYTASVYAAFASLLNYVGSDDLQGKRVGLFSYGSGLAASLYSCKIVGDVQHIIKELDITNKLAKRITETPKDYEAAIELRENAHLKKNFKPQGSIEHLQSGVYYLTNIDDKFRRSYDVKK

SEQ ID NO: 1838 - protein, 188 aa, Saccharomyces cerevisiae
NPISSKLESGYLDLVVKAYVDGKVSKYFAGLNSGDTVDFKGPIGTLNYEPNSSKHLGIVAGGSGITPVLQILNEIITVPEDLTKVSLLYANETENDILLKDELDEMAEKYPHFQVHYVVHYPSDRWTGDVGYITKDQMNRYLPEYSEDNRLLICGPDGMNNLALQYAKELGWKVNSTRSSGDDQVFVF

SEQ ID NO: 1839 - protein, 312 aa, Saccharomyces cerevisiae
MSKEDIEGTNILDEPVHGIYIPAALFVVGVAITTYMSGELKILWSLPILFMIIFVRAYSAYKRRRSLYPDRWTSLELEDQTIISKNTALYRFKLKTRLESLDIPAGHHVAVRVPIDGKQEVRYYNPISSKLESGYLDLVVKAYVDGKVSKYFAGLNSGDTVDFKGPIGTLNYEPNSSKHLGIVAGGSGITPVLQILNEIITVPEDLTKVSLLYANETENDILLKDELDEMAEKYPHFQVHYVVHYPSDRWTGDVGYITKDQMNRYLPEYSEDNRLLICGPDGMNNLALQYAKELGWKVNSTRSSGDDQVFVF

SEQ ID NO: 1840 - protein, 445 aa, Saccharomyces cerevisiae
MREVISINVGQAGCQIGNACWELYSLEHGIKEDGHLEDGLSKPKGGEEGFSTFFHETGYGKFVPRAIYVDLEPNVIDEVRTGRFKELFHPEQLINGKEDAANNYARGHYTVGREIVDEVEERIRKMADQCDGLQGFLFTHSLGGGTGSGLGSLLLENLSYEYGKKSKLEFAVYPAPQLSTSVVEPYNTVLTTHTTLEHADCTFMVDNEAIYDICKRNLGISRPSFSNLNGLIAQVISSVTASLRFDGSLNVDLNEFQTNLVPYPRIHFPLVSYAPILSKKRATHESNSVSEITNACFEPGNQMVKCDPTKGKYMANCLLYRGDVVTRDVQRAVEQVKNKKTVQMVDWCPTGFKIGICYEPPSVIPSSELANVDRAVCMLSNTTAIADAWKRIDQKFDLMYAKRAFVHWYVGEGMEEGEFTEAREDLAALERDYIEVGADSYAEEF

SEQ ID NO: 1841 - protein, 587 aa, Saccharomyces cerevisiae
MSSVNKDTIHVAERSLHKEHLTEGGNMAFHNHLNDFAHIEDPLERRRLALESIDDEGFGWQQVKTISIAGVGFLTDSYDIFAINLGITMMSYVYWHGSMPGPSQTLLKVSTSVGTVIGQFGFGTLADIVGRKRIYGMELIIMIVCTILQTTVAHSPAINFVAVLTFYRIVMGIGIGGDYPLSSIITSEFATTKWRGAIMGAVFANQAWGQISGGIIALILVAAYKGELEYANSGAECDARCQKACDQMWRILIGLGTVLGLACLYFRLTIPESPRYQLDVNAKLELAAAAQEQDGEKKIHDTSDEDMAINGLERASTAVESLDNHPPKASFKDFCRHFGQWKYGKILLGTAGSWFTLDVAFYGLSLNSAVILQTIGYAGSKNVYKKLYDTAVGNLILICAGSLPGYWVSVFTVDIIGRKPIQLAGFIILTALFCVIGFAYHKLGDHGLLALYVICQFFQNFGPNTTTFIVPGECFPTRYRSTAHGISAASGKVGAIIAQTALGTLIDHNCARDGKPTNCWLPHVMEIFALFMLLGIFTTLLIPETKRKTLEEINELYHDEIDPATLNFRNKNNDIESSSPSQLQHEA

SEQ ID NO: 1842 - protein, 296 aa, Saccharomyces cerevisiae
MDSLEARLQFIQVLKNLQKTLHKTRDSITSSSTTTPPSSQQKLNNDPIQFYLRNYRHHYEDFHQCLFDTTMKMDPLDRLDVVIYYVRIIRNLYPHSHSNTNVTKVLNEVLLMDIDLVFELCLPCQDWKSLTNQATCKELFLDLSKLIHYDATSVTHTPSDTTLIDATTWYSVKTERTTKDYKESLQRTESLLKDRDLKKLAFFQQFNSDTTAINPDLQTQPTNANILLHRMEADRELHKRSKETSWYIERPSNDILDESEFKSLWTHFETTDSGFDKDDYKNIKALNDIAKASYIY

SEQ ID NO: 1843 - protein, 443 aa, Saccharomyces cerevisiae
MEKVSVSSGNSGLNPSQFYGSNNFRDNIASLTISIDQIEKELELLRHLILKADLTNNQMQLKILKKSQRTLLKELEMKELLKQQYMVQENGNSLFRKTKIYIRSYFSENSSNGLKEITYYIINIHHFNNGQVSSWDMARRYNEFFELNTYLKKNFRDLMRQLQDLFPSKVKMSLKYHVTKTLLYEERKQKLEKYLRELLSISEICEDNIFRRFLTDPTPFKLNKEYMHDDILEEPLHEPIGSSNSTSNSSSVVDLQSSEDGGELNFYEDERHFFTDSGYPFYSQNKSFVKQICDLFISLFALNKANAGWLRGRAIITVLQQLLGSTIEKYIKVSIQKLRSEDQVFEAIVTFKNMLWGDNGLFERKRNETAEATRSEGERLRTEQLALTSLQRLFADTCGRVVGLRDSHEAAGRVHAMLQNPYLNASLLLEALDAILLDIICND

SEQ ID NO: 1844 - protein, 1098 aa, Saccharomyces cerevisiae
MALIVASLFLPYQPQFELDTSLPENSQVDSSLVNIQAMANDQQQQRALSNNISQESLVAPAPEQGVPPAISRSATRSPSAFNRASSTTNTATLDDLVSSDIFMENLTANATTSHTPTSKTMLKPRKNGSVERFFSPSSNIPTDRIASPIQHEHDSGSRIASPIQQQQQDPTTNLLKNVNKSLLVHSLLNNTSQTSLEGPNNHIVTPKSRAGNRPTSAATSLVNRTKQGSASSGSSGSSAPPSIKRITPHLTASAAKQRPLLAKQPSNLKYSELADISSSETSSQHNESDPDDLTTAPDEEYVSDLEMDDAKQDYKVPKFGGYSNKSKLKKYALLRSSQELFSRLPWSIVPSIKGNGAMKNAINTAVLENIIPHRHVKWVGTVGIPTDEIPENILANISDSLKDKYDSYPVLTDDDTFKAAYKNYCKQILWPTLHYQIPDNPNSKAFEDHSWKFYRNLNQRFADAIVKIYKKGDTIWIHDYHLMLVPQMVRDVLPFAKIGFTLHVSFPSSEVFRCLAQREKILEGLTGADFVGFQTREYARHFLQTSNRLLMADVVHDEELKYNGRVVSVRFTPVGIDAFDLQSQLKDGSVMQWRQLIRERWQGKKLIVCRDQFDRIRGIHKKLLAYEKFLVENPEYVEKSTLIQICIGSSKDVELERQIMIVVDRINSLSTNISISQPVVFLHQDLDFSQYLALSSEADLFVVSSLREGMNLTCHEFIVCSEDKNAPLLLSEFTGSASLLNDGAIIINPWDTKNFSQAILKGLEMPFDKRRPQWKKLMKDIINNDSTNWIKTSLQDIHISWQFNQEGSKIFKLNTKTLMEDYQSSKKRMFVFNIAEPPSSRMISILNDMTSKGNIVYIMNSFPKPILENLYSRVQNIGLIAENGAYVSLNGVWYNIVDQVDWRNDVAKILEDKVERLPGSYYKINESMIKFHTENAEDQDRVASVIGDAITHINTVFDHRGIHAYVYKNVVSVQQVGLSLSAAQFLFRFYNSASDPLDTSSGQITNIQTPSQQNPSDQEQQPPASPTVSMNHIDFACVSGSSSPVLEPLFKLVNDEASEGQVKAGHAIVYGDATSTYAKEHVNGLNELFTIISRIIED

SEQ ID NO: 1845 - protein, 167 aa, Saccharomyces cerevisiae
MSRKLKKTNLFNKDVSSLLYAYGDVPQPLQATVQCLDELVSGYLVDVCTNAFHTAQNSQRNKLRLEDFKFALRKDPIKLGRAEELIATNKLITEAKKQFNETDNQNSLKRYREEDEEGDEMEEDEDEQQVTDDDEEAAGRNSAKQSTDSKATKIRKQGPKNLKKTKK

SEQ ID NO: 1846 - protein, 250 aa, Saccharomyces cerevisiae
MTDRYSFSLTTFSPSGKLGQIDYALTAVKQGVTSLGIKATNGVVIATEKKSSSPLAMSETLSKVSLLTPDIGAVYSGMGPDYRVLVDKSRKVAHTSYKRIYGEYPPTKLLVSEVAKIMQEATQSGGVRPFGVSLLIAGHDEFNGFSLYQVDPSGSYFPWKATAIGKGSVAAKTFLEKRWNDELELEDAIHIALLTLKESVEGEFNGDTIELAIIGDENPDLLGYTGIPTDKGPRFRKLTSQEINDRLEAL

SEQ ID NO: 1847 - protein, 312 aa, Saccharomyces cerevisiae
MSIVETCISFVSTNPFYPFCTGLLLNCVVTPLYFWKTQNGRIVVVSLLQFVVLYATAFISIGTDKSLYRNKWVALPLSKKTRISRNTSLYCFKLKYPFERLHIPMGYHLAVRVTINGERLVRYYTPVNVPNTEGHLELVVKTYKHGVVSKYFDKLKIRQYVEFKGPLGELEYDQDTATELGIIAGGSGITPVLQVLQEIIPSPEDLTHISLIYANETEDDILMKSQLDHMAKEYPHFKVHYVIHKPNGKWNGDVGYVTLEEMKRYLPKQAEDHRLLICGPPKMNEMVLNYAKELGWSNGFHKGNGTDKVFVF

SEQ ID NO: 1848 - protein, 447 aa, Saccharomyces cerevisiae
MREVISINVGQAGCQIGNACWELYSLEHGIKPDGHLEDGLSKPKGGEEGFSTFFHETGYGKFVPRAIYVDLEPNVIDEVRNGPYKDLFHPEQLISGKEDAANNYARGHYTVGREILGDVLDRIRKLADQCDGLQGFLFTHSLGGGTGSGLGSLLLEELSAEYGKKSKLEFAVYPAPQVSTSVVEPYNTVLTTHTTLEHADCTFMVDNEAIYDMCKRNLDIPRPSFANLNNLIAQVVSSVTASLRFDGSLNVDLNEFQTNLVPYPRIHFPLVSYSPVLSKSKAFHESNSVSEITNACFEPGNQMVKCDPRDGKYMATCLLYRGDVVTRDVQRAVEQVKNKKTVQLVDWCPTGFKIGICYEPPTATPNSQLATVDRAVCMLSNTTSIAEAWKRIDRKFDLMYAKRAFVHWYVGEGMEEGEFTEAREDLAALERDYIEVGADSYAEEEEF

SEQ ID NO: 1849 - protein, 1054 aa, Saccharomyces cerevisiae
MPPLFKGLKQMAKPIAYVSRFSAKRPIHIILFSLIISAFAYLSVIQYYFNGWQLDSNSVFETAPNKDSNTLFQECSHYYRDSSLDGWVSITAHEASELPAPHHYYLLNLNFNSPNETDSIPELANTVFEKDNTKYILQEDLSVSKEISSTDGTKWRLRSDRKSLFDVKTLAYSLYDVFSENVTQADPFDVLIMVTAYLMMFYTIFGLFNDMRKTGSNFWLSASTVVNSASSLFLALYVTQCILGKEVSALTLFEGLPFIVVVVGFKHKIKIAQYALEKFERVGLSKRITTDEIVFESVSEEGGRLIQDHLLCIFAFIGCSMYAHQLKTLTNFCILSAFILIFELILTPTFYSAILALRLEMNVIHRSTIIKQTLEEDGVVPSTARIISKAEKKSVSSFLNLSVVVIIMKLSVILLFVFINFYNFGANWVNDAFNSLYFDKERVSLPDFITSNASENFKEQAIVSVTPLLYYKPIKSYQRIEDMVLLLLRNVSVAIRDRFVSKLVLSALVCSAVINVYLLNAARIHTSYTADQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 1850 - protein, 584 aa, Saccharomyces cerevisiae
MSAKSFEVTDPVNSSLKGFALANPSITLVPEEKILFRKTDSDKIALISGGGSGHEPTHAGFIGKGMLSGAVVGEIFASPSTKQILNAIRLVNENASGVLLIVKNYTGDVLHFGLSAERARALGINCRVAVIGDDVAVGREKGGMVGRRALAGTVLVHKIVGAFAEEYSSKYGLDGTAKVAKIINDNLVTIGSSLDHCKVPGRKFESELNEKQMELGMGIHNEPGVKVLDPIPSTEDLISKYMLPKLLDPNDKDRAFVKFDEDDEVVLLVNNLGGVSNFVISSITSKTTDFLKENYNITPVQTIAGTLMTSFNGNGFSITLLNATKATKALQSDFEEIKSVLDLLNAFTNAPGWPIADFEKTSAPSVNDDLLHNEVTAKAVGTYDFDKFAEWMKSGAEQVIKSEPHITELDNQVGDGDCGYTLVAGVKGITENLDKLSKDSLSQAVAQISDFIEGSMGGTSGGLYSILLSGFSHGLIQVCKSKDEPVTKEIVAKSLGIALDTLYKYTKARKGSSTMIDALEPFVKEFTASKDFNKAVKAAEEGAKSTATFEAKFGRASYVGDSSQVEDPGAVGLCEFLKGVQSAL

SEQ ID NO: 1851 - protein, 914 aa, Saccharomyces cerevisiae
MAKTLKDLQGWEIITTDEQGNIIDGGQKRLRRRGAKTEHYLKRSSDGIKLGRGDSVVMHNEAAGTYSVYMIQELRLNTLNNVVELWALTYLRWFEVNPLAHYRQFNPDANILNRPLNYYNKLFSETANKNELYLTAELAELQLFNFIRVANVMDGSKWEVLKGNVDPERDFTVRYICEPTGEKFVDINIEDVKAYIKKVEPREAQEYLKDLTLPSKKKEIKRGPQKKDKATQTAQISDAETRATDITDNEDGNEDESSDYESPSDIDVSEDMDSGEISADELEEEEDEEEDEDEEEKEARHTNSPRKRGRKIKLGKDDIDASVQPPPKKRGRKPKDPSKPRQMLLISSCRANNTPVIRKFTKKNVARAKKKYTPFSKRFKSIAAIPDLTSLPEFYGNSSELMASRFENKLKTTQKHQIVETIFSKVKKQLNSSYVKEEILKSANFQDYLPARENEFASIYLSAYSAIESDSATTIYVAGTPGVGKTLTVREVVKELLSSSAQREIPDFLYVEINGLKMVKPTDCYETLWNKVSGERLTWAASMESLEFYFKRVPKNKKKTIVVLLDELDAMVTKSQDIMYNFFNWTTYENAKLIVIAVANTMDLPERQLGNKITSRIGFTRIMFTGYTHEELKNIIDLRLKGLNDSFFYVDTKTGNAILIDAAGNDTTVKQTLPEDVRKVRLRMSADAIEIASRKVASVSGDARRALKVCKRAAEIAEKHYMAKHGYGYDGKTVIEDENEEQIYDDEDKDLIESNKAKDDNDDDDDNDGVQTVHITHVMKALNETLNSHVITFMTRLSFTAKLFIYALLNLMKKNGSQEQELGDIVDEIKLLIEVNGSNKFVMEIAKTLFQQGSDNISEQLRIISWDFVLNQLLDAGILFKQTMKNDRICCVKLNISVEEAKRAMNEDETLRNL

SEQ ID NO: 1852 - protein, 245 aa, Saccharomyces cerevisiae
MATPSTGANNSIPAVRNQVEVQVGLVGDAQVGKTSLMVKYVQNIYDKEYTQTLGVNFLKRKVSIRSTDIIFSIMDLGGQREFINMLPIATVGSSVIIFLFDLTRPETLSSIKEWYRQAYGLNDSAIPILVGTKYDLLIDLDPEYQEQISRTSMKYAQVMNAPLIFCSTAKSINIQKIFKIALAKIFNLTLTIPEINEIGDPLLIYKHLGGQQHRHHNKSQDRKSHNIRKPSSSPSSKAPSPGVNT

SEQ ID NO: 1853 - protein, 750 aa, Saccharomyces cerevisiae
KNVMNFINKDSPLSWNDMFKPSIIQPPQLISENSFDQSSQKKSRSTGFKNPLRPALKKESSFDELQNNSISQERSLEMINENEKKKMQFGEKIAVLTQRPSFTELQNDQDDSNLNPHNGVKVKIPICLSKEQESIIKLAENGHNIFYTGSAGTGKSILLREMIKVLKGIYGRENVAVTASTGLAACNIGGITIHSFAGIGLGKGDADKLYKKVRRSRKHLRRWENIGALVVDEISMLDAELLDKLDFIARKIRKNHQPFGGIQLIFCGDFFQLPPVSKDPNRPTKFAFESKAWKEGVKMTIMLQKVFRQRGDVKFIDMLNRMRLGNIDDETEREFKKLSRPLPDDEIIPAELYSTRMEVERANNSRLSKLPGQVHIFNAIDGGALEDEELKERLLQNFLAPKELHLKVGAQVMMVKNLDATLVNGSLGKVIEFMDPETYFCYEALTNDPSMPPEKLETWAENPSKLKAAMEREQSDGEESAVASRKSSVKEGFAKSDIGEPVSPLDSSVFDFMKRVKTDDEVVLENIKRKEQLMQTIHQNSAGKRRLPLVRFKASDMSTRMVLVEPEDWAIEDENEKPLVSRVQLPLMLAWSLSIHKSQGQTLPKVKVDLRRVFEKGQAYVALSRAVSREGLQVLNFDRTRIKAHQKVIDFYLTLSSAESAYKQLEADEQVKKRKLDYAPGPKYKAKSKSKSNSPAPISATTQSNNGIAAMLQRHSRKRFQLKKESNSNQVHSLVSDEPRGQDTEDHILE

SEQ ID NO: 1854 - protein, 376 aa, Saccharomyces cerevisiae
MSYKFGKLAINKSELCLANVLQAGQSFRWIWDEKLNQYSTTMKIGQQEKYSVVILRQDEENEILEFVAVGDCGNQDALKTHLMKYFRLDVSLKHLFDNVWIPSDKAFAKLSPQGIRILAQEPWETLISFICSSNNNISRITRMCNSLCSNFGNLITTIDGVAYHSFPTSEELTSRATEAKLRELGFGYRAKYIIETARKLVNDKAEANITSDTTYLQSICKDAQYEDVREHLMSYNGVGPKVADCVCLMGLHMDGIVPVDVHVSRIAKRDYQISANKNHLKELRTKYNALPISRKKINLELDHIRLMLFKKWGSYAGWAQGVLFSKEIGGTSGSTTTGTIKKRKWDMIKETEAIVTKQMKLKVELSDLHIKEAKID

SEQ ID NO: 1855 - protein, 604 aa, Saccharomyces cerevisiae
MSSDAIRNTEQINAAIKIIENKTERPQSSTTPIDSKASTVAAANSTATETSRDLTQYTLDDGRVVSTNRRIMNKVPAITSHVPTDEELFQPNGIPRHEFLRDHFKREGKLSAAQAARIVTLATELFSKEPNLISVPAPITVCGDIHGQYFDLLKLFEVGGDPATTSYLFLGDYVDRGSFSFECLIYLYSLKLNFNDHFWLLRGNHECKHLTSYFTFKNEMLHKYNLDIYEKCCESFNNLPLAALMNGQYLCVHGGISPELNSLQDINNLNRFREIPSHGLMCDLLWADPIEEYDEVLDKDLTEEDIVNSKTMVPHHGKMAPSRDMFVPNSVRGCSYAFTYRAACHFLQETGLLSIIRAHEAQDAGYRMYKNTKTLGFPSLLTLFSAPNYLDTYNNKAAILKYENNVMNIRQFNMTPHPYWLPDFMDVFTWSLPFVGEKVTEMLVAILNICTEDELENDTPVIEELVGTDKKLPQAGKSEATPQPATSASPKHASILDDEHRRKALRNKILAVAKVSRMYSVLREETNKVQFLKDHNSGVLPRGALSNGVKGLDEALSTFERARKHDLINEKLPPSLDELKNENKKYYEKVWQKVHEHDAKNDSK

SEQ ID NO: 1856 - protein, 318 aa, Saccharomyces cerevisiae
YLFVEWALACSLDQAESIYKAAAERGVQTIISLQGRKSPYILRAKELISQGYIGDINSIEIAGNGGWYGYERPVKSPKYIYEIGNGVDLVTTTFGHTIDILQYMTSSYFSRINAMVFNNIPEQELIDERGNRLGQRVPKTVPDHLLFQGTLLNGNVPVSCSFKGGKPTKKFTKNLVIDIHGTKGDLKLEGDAGFAEISNLVLYYSGTRANDFPLANGQQAPLDPGYDAGKEIMEVYHLRNYNAIVGNIHRLYQSISDFHFNTKKIPELPSQFVMQGFDFEGFPTLMDALILHRLIESVYKSNMMGSTLNVSNISHYSL

SEQ ID NO: 1857 - protein, 670 aa, Saccharomyces cerevisiae
MRICHSRTLSNLKDLPITSRRAMHSAIVNYSTQKAQFPVETNNGEHYWAEKPNKFYQNKRPNFQGITFAKQQDLPSLPVPELKSTLDKYLQTIRPFCNDVETFERQQLLCKDFSEHMGPILQDRLKEYANDKRNWMAKFWDEQSYLQYNDPIVPYVSYFYSHMPLPNHLSKIDNDPLIKATAIISTVVKFIEAIKDESLPVEIIKGMPFCMNSFSLMFNTSRLPGKPEDNQDTNIFYSVYENNFVTIAYKGKFYKLMTHDGNDKPLSENEIWRQLYSVVFQGSQSDPKLGGIGSLTSLPRDQWREVHLELMKDPISQDSLETIHKSSFMLCLDLDQSPVTLEEKSRNCWHGDGINRFYDKSLQFLVTGNGSSGFLAEHSKMDGTPTLFLNNYVCQQLNKLDVDDFMRKVITPSSTVAMKPMELPFIITPKIHKAIESAQLQFKETIGEHDLRVWHYNKYGKTFIKRHGMSPDAFIQQVIQLAVFKYLKRQLPTYEAASTRKYFKGRTETGRSVSTASLEFVSKWQNGDVPIAEKIQALKHSAKEHSTYLKNAANGNGVDRHFFGLKNMLKSNDDQIPPLFKDPLFNYSSTWLISTSQLSSEYFDGYGWSQVNDNGFGLAYMLNNEWLHINIVNKPAKSGASVNRLHYYLSQAADEIFDALENENKRKAKL

SEQ ID NO: 1858 - protein, 655 aa, Saccharomyces cerevisiae [sequence omitted]

SEQ ID NO: 1859 - protein, 187 aa, Saccharomyces cerevisiae
MSIASYAQELKLALHQYPNFPSEGILFEDFLPIFRNPGLFQKLIDAFKLHLEEAFPEVKIDYIVGLESRGFLFGPTLALALGVGFVPVRKAGKLPGECFKATYEKEYGSDLFEIQKNAIPAGSNVIIVDDIIATGGSAAAAGELVEQLEANLLEYNFVMELDFLKGRSKLNAPVFTLLNAQKEALKK

SEQ ID NO: 1860 - protein, 359 aa, Saccharomyces cerevisiae
MWCMRRLPTNSVMTVARKRKQTTIEDFFGTKKSTNEAPNKKGKSGATFMTITNGAAIKTETKAVAKEANTDKYPANSNAKDVYSKNLSSNLRTLLSLELETIDDSWFPHLMDEFKKPYFVKLKQFVTKEQADHTVFPPAKDIYSWTRLTPFNKVKVVIIGQDPYHNFNQAHGLAFSVKPPTPAPPSLKNIYKELKQEYPDFVEDNKVGDLTHWASQGVLLLNTSLTVRAHNANSHSKHGWETFTKRVVQLLIQDREADGKSLVFLLWGNNAIKLVESLLGSTSVGSGSKYPNIMVMKSVHPSPLSASRGFFGTNHFKMINDWLYNTRGEKMIDWSVVPGTSLREVQEANARLESESKDP

SEQ ID NO: 1861 - protein, 346 aa, Saccharomyces cerevisiae
MTEPQGPLDTIPKVNYPPILTIANYFSTKQMIDQVISEDQDYVTWKLQNLRTGGTSINNQLNKYPKYKYQKTRINQQDPDSINKVPENLIFPQDILQQQTQNSNYEDTNTNEDENEKLAQDEQFKLLVTNLDKDQTNRFEVFHRTSLNKTQVKKLASTVANQTISENIRVFLQAVGKIYAGEIIELAMIVKNKWLTSQMCIEFDKRTKIGYKLKKYLKKLTFSIIENQQYKQDYQSDSVPEDEPDFYFDDEEVDKRETTLGNSLLQSKSLQQSDHNSQDLKLQLIEQYNKLVLQFNKLDVSIEKYNNSPLLPEHIREAWRLYRLQSDTLPNAYWRTQGEGQGSMFR

SEQ ID NO: 1862 - protein, 383 aa, Saccharomyces cerevisiae
MSETELRKRQAQFTRELHGDDIGKKTGLSALMSKNNSAQKEAVQKYLRNWDGRTDKDAEERRLEDYNEATHSYYNVVTDFYEYGWGSSFHFSRFYKGESFAASIARHEHYLAYKAGIQRGDLVLDVGCGVGGPAREIARFTGCNVIGLNNNDYQIAKAKYYAKKYNLSDQMDFVKGDFMKMDFEENTFDKVYAIEATCHAPKLEGVYSEIYKVLKPGGTFAVYEWVMTDKYDENNPEHRKIAYEIELGDGIPKMFHVDVARKALKNCGFEVLVSEDLADNDDEIPWYYPLTGEWKYVQNLANLATFFRTSYLGRQFTTAMVTVMEKLGLAPEGSKEVTAALENAAVGLVAGGKSKLFTPMMLFVARKPENAETPSQTSQEATQ

SEQ ID NO: 1863 - protein, 208 aa, Saccharomyces cerevisiae
MSSRKKNILKVIILGDSGVGKTSLMHRYVNDKYSQQYKATIGADFLTKEVTVDGDKVATMQVWDTAGQERFQSLGVAFYRGADCCVLVYDVTNASSFENIKSWRDEFLVHANVNSPETFPFVILGNKIDAEESKKIVSEKSAQELAKSLGDIPLFLTSAKNAINVDTAFEEIARSALQQNQADTEAFEDDYNDAINIRLDGENNSCSC

SEQ ID NO: 1864 - protein, 705 aa, Saccharomyces cerevisiae
MSLGPLKAINDKQLNTRSKLVHTPIKGNTADLVGKENHFKQTKRLDPNNDHHHQPAQKKKREKLSALCKTPPSLIKTRGKDYHRGHFLGEGGFARCFQIKDDSGEIFAAKTVAKASIKSEKTRKKLLSEIQIHKSMSHPNIVQFIDCFEDDSNVYILLEICPNGSLMELLKRRKVLTEPEVRFFTTQICGAIKYMHSRRVIHRDLKLGNIFFDSNYNLKIGDFGLAAVLANESERKYTICGTPNYIAPEVLMGKHSGHSFEVDIWSLGVMLYALLIGKPPFQARDVNTIYERIKCRDFSFPRDKPISDEGKILIRDILSLDPIERPSLTEIMDYVWFRGTFPPSIPSTVMSEAPNFEDIPEEQSLVNFKDCMEKSLLLESMSSDKIQRQKRDYISSIKSSIDKLEEYHQNRPFLPHSLSPGGTKQKYKEVVDIEAQRRLNDLAREARIRRAQQAVLRKELIATSTNVIKSEISLRILASECHLTLNGIVEAEAQYKMGGLPKSRLPKIKHPMIVTKWVDYSNKHGFSYQLSTEDIGVLFNNGTTVLRLADAEEFWYISYDDREGWVASHYLLSEKPRELSRHLEVVDFFAKYMKANLSRVSTFGREEYHKDDVFLRRYTRYKPFVMFELSDGTFQFNFKDHHKMAISDGGKLVTYISPSHESTTYPLVEVLKYGEIPGYPESNFREKLTLIKEGLKQKSTIVTVD

SEQ ID NO: 1865 - protein, 706 aa, Saccharomyces cerevisiae
MQLRNILQASSLISGLSLAADSSSTTGDGYAPSIIPCPSDDTSLVRNASGLSTAETDWLKKRDAYTKEALHSFLSRATSNFSDTSLLSTLFSSNSSNVPKIGIACSGGGYRAMLGGAGMIAAMDNRTDGANEHGLGGLLQSSTYLSGLSGGNWLTGTLAWNNWTSVQEIVDHMSESDSIWNITKSIVNPGGSNLTYTIERWESIVQEVQAKSDAGFNISLSDLWARALSYNFFPSLPDAGSALTWSSLRDVDVFKNGEMPLPITVADGRYPGTTVINLNATLFEFTPFEMGSWDPSLNAFTDVKYLGTNVTNGKPVNKDQCVSGYDNAGFVIATSASLFNEFSLEASTSTYYKMINSFANKYVNNLSQDDDDIAIYAANPFKDTEFVDRNYTSSIVDADDLFLVDGGEDGQNLPLVPLIKKERDLDVVFALDISDNTDESWPSGVCMTNTYERQYSKQGKGMAFPYVPDVNTFLNLGLTNKPTFFGCDAKNLTDLEYIPPLVVYIPNTKHSFNGNQSTLKMNYNVTERLGMIRNGFEAATMGNFTDDSNFLGCIGCAIIRRKQESLNATLPPECTKCFADYCWNGTLSTSANPELSGNSTYQSGAIASAISEATDGIPITALLGSSTSGNTTSNSTTSTSSNVTSNSNSSSNTTLNSNSSSSSISSSTARSSSSTANKANAAAISYANTNTLMSLLGAITALFGLI

SEQ ID NO: 1866 - protein, 664 aa, Saccharomyces cerevisiae
MKLQSLLVSAAVLTSLTENVNAWSPNNSYVPANVTCDDDINLVREASGLSDNETEWLKKRDAYTKEALHSFLNRATSNFSDTSLLSTLFGSNSSNMPKIAVACSGGGYRAMLSGAGMLAAMDNRTDGANEHGLGGLLQGATYLAGLSGGNWLTSTLAWNNWTSVQAIVDNTTESNSIWDISHSILTPDGINIFKTGSRWDDISDDVQDKKDAGFNISLADVWGRALAYNFWPSLHRGGVGYTWSTLREADVFKNGEMPFPITVADGRYPGTTVINLNATLFEFNPFEMGSWDPTLNAFTDVKYLGTNVTNGKPVNKGQCIAGFDNTGFITATSSTLFNQFLLRLNSTDLPSFIANLATDFLEDLSDNSDDIAIYAPNPFKEANFLQKNATSSIIESEYLFLVDGGEDNQNIPLVPLLQKERELDVIFALDNSADTDDYWPDGASLVNTYQRQFGSQGLNLSFPYVPDVNTFVNLGLNKKPTFFGCDARNLTDLEYIPPLIVYIPNSRHSFNGNQSTFKMSYSDSERLGMIKNGFEAATMGNFTDDSDFLGCVGCAIIRRKQQNLNATLPSECSQCFTNYCWNGTIDSRSVSGVGNDDYSSSASLSASAAAASASASASASASASASGSSTHKKNAGNALVNYSNLNTNTFIGVLSVISAVFGLI

SEQ ID NO: 1867 - protein, 541 aa, Saccharomyces cerevisiae
MSEFATSRVESGSQQTSIHSTPIVQKLETDESPIQTKSEYTNAELPAKPIAAYWTVICLCLMIAFGGFVFGWDTGTISGFVNQTDFKRRFGQMKSDGTYYLSDVRTGLIVGIFNIGCAFGGLTLGRLGDMYGRRIGLMCVVLVYIVGIVIQIASSDKWYQYFIGRIISGMGVGGIAVLSPTLISETAPKHIRGTCVSFYQLMITLGIFLGYCTNYGTKDYSNSVQWRVPLGLNFAFAIFMIAGMLMVPESPRFLVEKGRYEDAKRSLAKSNKVTIEDPSIVAEMDTIMANVETERLAGNASWGELFSNKGAILPRVIMGIMIQSLQQLTGNNYFFYYGTTIFNAVGMKDSFQTSIVLGIVNFASTFVALYTVDKFGRRKCLLGGSASMAICFVIFSTVGVTSLYPNGKDQPSSKAAGNVMIVFTCLFIFFFAISWAPIAYVIVAESYPLRVKNRAMAIAVGANWIWGFLIGFFTPFITSAIGFSYGYVFMGCLVFSFFYVFFFVCETKGLTLEEVNEMYVEGVKPWKSGSWISKEKRVSEE

SEQ ID NO: 1868 - protein, 538 aa, Saccharomyces cerevisiae
MSSVAENIIQHATHNSTLHQLAKDQPSVGVTTAFSILDTLKSMSYLKIFATLICILLVWDQVAYQIKKGSIAGPKFKFWPIIGPFLESLDPKFEEYKAKWASGPLSCVSIFHKFVVIASTRDLARKILQSSKFVKPCVVDVAVKILRPCNWVFLDGKAHTDYRKSLNGLFTKQALAQYLPSLEQIMDKYMDKFVRLSKENNYEPQVFFHEMREILCALSLNSFCGNYITEDQVRKIADDYYLVTAALELVNFPIIIPYTKTWYGKKTADMAMKIFENCAQMAKDHIAAGGKPVCVMDAWCKLMHDAKNSNDDDSRIYHREFTNKEISEAVFTFLFASQDASSSLACWLFQIVADRPDVLAKIREEQLAVRNNDMSTELNLDLIEKMKYTNMVIKETLRYRPPVLMVPYVVKKNFPVSPNYTAPKGAMLIPTLYPALHDPEVYENPDEFIPERWVEGSKASEAKKNWLVFGCGPHVCLGQTYVMITFAALLGKFALYTDFHHTVTPLSEKIKVFATIFPKDDLLLTFKKRDPITGEVFE

SEQ ID NO: 1869 - protein, 508 aa, Saccharomyces cerevisiae
MNTVSPAKKKVIIIGAGIAGLKAASTLHQNGIQDCLVLEARDRVGGRLQTVTGYQGRKYDIGASWHHDTLTNPLFLEEAQLSLNDGRTRFVFDDDNFIYIDEERGRVDHDKELLLEIVDNEMSKFAELEFHQHLGVSDCSFFQLVMKYLLQRRQFLTNDQIRYLPQLCRYLELWHGLDWKLLSAKDTYFGHQGRNAFALNYDSVVQRIAQSFPQNWLKLSCEVKSITREPSKNVTVNCEDGTVYNADYVIITVPQSVLNLSVQPEKNLRGRIEFQPPLKPVIQDAFDKIHFGALGKVIFEFEECCWSNESSKIVTLANSTNEFVEIVRNAENLDELDSMLEREDSQKHTSVTCWSQPLFFVNLSKSTGVASFMMLMQAPLTNHIESIREDKERLFSFFQPVLNKIMKCLDSEDVIDGMRPIENIANANKPVLRNIIVSNWTRDPYSRGAYSACFPGDDPVDMVVAMSNGQDSRIRFAGEHTIMDGAGCAYGAWESGRREATRISDLLK

SEQ ID NO: 1870 - protein, 165 aa, Saccharomyces cerevisiae
MSKTAQKRLLKELQQLIKDSPPGIVAGPKSENNIFIWDCLIQGPPDTPYADGVFNAKLEFPKDYPLSPPKLTFTPSILHPNIYPNGEVCISILHSPGDDPNMYELAEERWSPVQSVEKILLSVMSMLSEPNIESGANIDACILWRDNRPEFERQVKLSILKSLGF

SEQ ID NO: 1871 - protein, 669 aa, Saccharomyces cerevisiae
MSYSYEACFWDPNDNGVNILLGHISQGIRSCDSMILFFKQRSELEKDYARRLGAITGKLDKDIGTNMDYGKLNETFNVVLSVEKARAQSHSKQSEILFRQIYTDTKAFAANLQARYTTLSGKIERLRMDKFNKKKGCEVLQKKLQDAQIRFRDLQLNENNMIGAKRVEHNKRELLKWESNSQEYKVQLDVLKQEYKASQKFWIHEWAQLSCELQEMENARISFLQSKLQQFATSSMETYILEQTKMDMLTNHLNSFTAADEISTFSKENGTGRLKHKTSKGDMNSSANWAQMSSISTTSKKTESYMDNIRKLSSQLKETENKRKLASIDKYEKPLPSPEVTMATQFRNSTPVIRNETKVVANPTLSLRSSPVQLQSNVDDSVLRQKPDKPRPIVGEEQLKPDEDSKNPDEKGLMVHKRNQSLSSPSESSSSNPTDFSHIKKRQSMESMTTSVSSMANSIDDSQRFAKSWNSSNRKRKSMSHLQVPSSASSRSDDGGRTPNSAHNLNEDDYNTRRDTSTSTILFKPPVAVRGTSRGHTHRQSMIMQDSSNPIEDALYEMERIQSSSKPGTKTGNIMDERGVVRDRGITVTLPIVTSEGFPVIEYAKAMYPLIGNEAPGLANFHKGDYLLITEIVNKDWYKGEVYDNDRIDRNHRIGLIPYNFIQLLHQGL

SEQ ID NO: 1872 - protein, 177 aa, Saccharomyces cerevisiae
MFRAGSSKRFLRNTLIAISWVPVLLTINNNVVHIAQVKGTSMQPTLNPQTETLATDWVLLWKFGVKNPSNLSRDDIILFKAPTNPRKVYCKRVKGLPFDTIDTKFPYPKPQVNLPRGHIWVEGDNYFHSIDSNTFGPISSGLVIGKAITIVWPPSRWGTDLKLSTGRDCISKRAILE

SEQ ID NO: 1873 - protein, 204 aa, Saccharomyces cerevisiae
MNSGGSDSFDYLLQLTKALSAECRANRQETDRIELLLKRLAKQSGISYDNLSKNIIPDSWKDNASQKASPPTEAQKLISENFKLIYEIEKQEYFNTKAVALINNINEHFSYIKNFIDEQNAIRERNIATFSSEKLDERNKSLQQNYESLKTENEETKKKLHSIIKQFEKLLKEVDWDRISKDSRDYSRFKKQLEYLQDTYQVLK

SEQ ID NO: 1874 - protein, 890 aa, Saccharomyces cerevisiae
MNQEEAIFRSADMTYVQLYIPLEVIREVTFLLGKMSVFMVMDLNKDLTAFQRGYVNQLRRFDEVERMVGFLNEVVEKHAAETWKYILHIDDEGNDIAQPDMADLINTMEPLSLENVNDMVKEITDCESRARQLDESLDSLRSKLNDLLEQRQVIFECSKFIEVNPGIAGRATNPEIEQEERDVDEFRMTPDDISETLSDAFSFDDETPQDRGALGNDLTRNQSVEDLSFLEQGYQHRYMITGSIRRTKVDILNRILWRLLRGNLIFQNFPIEEPLLEGKEKVEKDCFIIFTHGETLLKKVKRVIDSLNGKIVSLNTRSSELVDTLNRQIDDLQRILDTTEQTLHTELLVIHDQLPVWSAMTKREKYVYTTLNKFQQESQGLIAEGWVPSTELIHLQDSLKDYIETLGSEYSTVFNVILTNKLPPTYHRTNKFTQAFQSIVDAYGIATYKEINAGLATVVTFPFMFAIMFGDMGHGFILFLMALFLVLNERKFGAMHRDEIFDMAFTGRYVLLLMGAFSVYTGLLYNDIFSKSMTIFKSGWQWPSTFRKGESIEAKKTGVYPFGLDFAWHGTDNGLLFSNSYKMKLSILMGYAHMTYSFMFSYINYRAKNSKVDIIGNFIPGLVFMQSIFGYLSWAIVYKWSKDWIKDDKPAPGLLNMLINMFLAPGTIDDQLYSGQAKLQVVLLLAALVCVPWLLLYKPLTLRRLNKNGGGGRPHGYQSVGNIEHEEQIAQQRHSAEGFQGMIISDVASVADSINESVGGGEQGPFNFGDVMIHQVIHTIEFCLNCISHTASYLRLWALSLAHAQLSSVLWDMTISNAFSSKNSGSPLAVMKVVFLFAMWFVLTVCILVFMEGTSAMLHALRLHWVEAMSKFFEGEGYAYEPFSFRAIIE

SEQ ID NO: 1875 - protein, 306 aa, Saccharomyces cerevisiae
MTSIEDLISNPPLLLHSSLSQLRYLILSEGLPISEDKQQQRTRCYVWTVLSQTSMEASTQRYLALLKLGPPSTTIYQKIKNDTSRTFQTDPNFRNRVSEDALIRCLSCFAWQTQQRRQKTRFGRIPVSTYVQGMNVLLAPLLYSCPSEPMAYQLFTKLCYEMIPTYLTKNLNGAQNGAKLLDISLRIIDPKLSKFLSDNLLTAEIYGMPSILTLSSCNKPLDQVIKLWDFMFAYGFHMNILFVVAFLVKMRSKVFKSDSPVNLLRQFPDFDADEIIRLGVGFIAKIPAQIYDLLVDHLTDPDIYIP

SEQ ID NO: 1876 - protein, 309 aa, Saccharomyces cerevisiae
MSHTETQTQQSHFGVDFLMGGVSAAIAKTGAAPIERVKLLMQNQEEMLKQGSLDTRYKGILDCFKRTATHEGIVSFWRGNTANVLRYFPTQALNFAFKDKIKSLLSYDRERDGYAKWFAGNLFSGGAAGGLSLLFVYSLDYARTRLAADARGSKSTSQRQFNGLLDVYKKTLKTDGLLGLYRGFVPSVLGIIVYRGLYFGLYDSFKPVLLTGALEGSFVASFLLGWVITMGASTASYPLDTVRRRMMMTSGQTIKYDGALDCLRKIVQKEGAYSLFKGCGANIFRGVAAAGVISLYDQLQLIMFGKKFK

SEQ ID NO: 1877 - protein, 428 aa, Saccharomyces cerevisiae
LIDKYALYVPKTGSFPKGFEVGYTASGVKKNGSLDLGVILNTNKSRPSTAAAVFTTNKFKAAPVLTSKKVLETARGKNINAIVVNSGCANSVTGDLGMKDAQVMIDLVNDKIGQKNSTLVMSTGVIGQRLQMDKISTGINKIFGEEKFGSDFNSWLNVAKSICTTDTFPKLVTSRFKLPSGTEYTLTGMAKGAGMICPNMATLLGFIVTDLPIESKALQKMLTFATTRSFNCISVDGDMSTNDTICMLANGAIDTKEINEDSKDFEQVKLQVTEFAQRLAQLVVRDGEGSTKFVTVNVKNALHFEDAKIIAESISNSMLVKTALYGQDANWGRILCAIGYAKLNDLKSLDVNKINVSFIATDNSEPRELKLVANGVPQLEIDETRASEILALNDLEVSVDLGTGDQAAQFWTCDLSHEYVTINGDYRS

SEQ ID NO: 1878 - protein, 375 aa, Saccharomyces cerevisiae [sequence omitted]

SEQ ID NO: 1879 - protein, 471 aa, Saccharomyces cerevisiae
HLFKEVTPLRSQYLRNSTTSTFNHGSSTETPAENGLPRPMEFYLSSDCASLARYVSKVVYLEDNDIAHIYDGELHIHCSKIGSEDFSFRTVQKLELELSKIKKGPYDNFMQKEIYEQCETTKNVMRGRVDAFTNRVVLGGLENWLTELRRAKRIIMIASKASFHSCLAARPIFEELMEVPVNVELALDFVDRNCCIFRNDVCIFVSRSGETTDTINALNYCIKKEAVTIGVVNCSGSSISRFTHCGVHTNTGPEKGIATTKSYTSQYIALVMIALWMSEDLVSKIERRKEIIQALTIVPSQIKEVLELEPLIIELCDKKLKQHDTFLLLGRGYQFASALEGASKMKEISYVHSESILTNELGHRVLAVASDNPPIIAFATKDAFSPKIASCIDQIIERKGNPIIICNKGHKIWEQDKQKGNVVTLEVPQTVDCLQGILNVIPLQLISYWLAIKKDIGVDLPRDSAMSAPDI

SEQ ID NO: 1880 - protein, 825 aa, Saccharomyces cerevisiae
MLLLSWSRIATKVVRRPVRFRSYYGLTHIKSLHTQYRLLNRLQENKSGNKNEDNNEDAKLNKEIPTDEEVEAIRKQVEKYIEQTKNNTIPANWKEQKRKIDESIRRLEDAVLKQESNRIQEERKEKEEENGPSKAKSNRTKEQGYFEGNNSRNIPPPPPPPPPKPPLNDPSNPVSKNVNLFQIGLTFFLLSFLLDLLNSLEEQSEITWQDFREKLLAKGYVAKLIVVNKSMVKVMLNDNGKNQADNYGRNFYYFTIGSIDSFEHKLQKAQDELDIDKDFRIPVLYVQEGNWAKAMFQILPTVLMIAGIIWLTRRSAQAAGGSRGGIFGLSRSKAKKFNTETDVKIKFKDVAGCDEAKEEIMEFVSFLKEPSRYEKMGAKIPRGAILSGPPGTGKTLLAKATAGEAGVPFYFVSGSEFVEMFVGVGAARVRDLFKTARENAPSIVFIDEIDAIGKARQKGNFSGANDERENTLNQMLVEMDGFTPADHVVVLAGTNRPDILDKALLRPGRFDRHINIDKPELEGRKAIFAVHLHHLKLAGEIFDLKNRLAALTPGFSGADIANVCNEAALIAARSDEDAVKLNHFEQAIERVIGGVERKSKLLSPEEKKVVAYHEAGHAVCGWYLKYADPLLKVSIIPRGQGALGYAQYLPGDIFLLTEQQLKDRMTMSLGGRVSEELHFPSVTSGASDDFKKVTSMATAMVTELGMSDKIGWVNYQKRDDSDLTKPFSDETGDIIDSEVYRIVQECHDRCTKLLKEKAEDVEKIAQVLLKKEVLTREDMIDLLGKRPFPERNDAFDKYLNDYETEKIRKEEEKNEKRNEPKPSTN

SEQ ID NO: 1881 - protein, 615 aa, Saccharomyces cerevisiae
MSSISLKEIIPPQPSTQRNFTTHLSYDPTTNAIAYPCGKSAFVRCLDDGDSKVPPVVQFTGHGSSVVTTVKFSPIKGSQYLCSGDESGKVIVWGWTFDKESNSVEVNVKSEFQVLAGPISDISWDFEGRRLCVVGEGRDNFGVFISWDSGNSLGEVSGHSQRINACHLKQSRPMRSMTVGDDGSVVFYQGPPFKFSASDRTHHKQGSFVRDVEFSPDSGEFVITVGSDRKISCFDGKSGEFLKYIEDDQEPVQGGIFALSWLDSQKFATVGADATIRVWDVTTSKCVQKWTLDKQQLGNQQVGVVATGNGRIISLSLDGTLNFYELGHDEVLKTISGHNKGITALTVNPLISGSYDGRIMEWSSSSMHQDHSNLIVSLDNSKAQEYSSISWDDTLKVNGITKHEFGSQPKVASANNDGFTAVLTNDDDLLILQSFTGDIIKSVRLNSPGSAVSLSQNYVAVGLEEGNTIQVFKLSDLEVSFDLKTPLRAKPSYISISPSETYIAAGDVMGKILLYDLQSREVKTSRWAFHTSKINAISWKPAEKGANEEEIEEDLVATGSLDTNIFIYSVKRPMKIIKALNAHKDGVNNLLWETPSTLVSSGADACIKRWNVVLE

SEQ ID NO: 1882 - protein, 677 aa, Saccharomyces cerevisiae
MHSWRISKFKLGRSKEDDGSSEDENEKSWGNGLFHFHHGEKHHDGSPKNHNHEHEHHIRKINTNETLPSSLSSPKLRNDASFKNPSGIGNDNSKASERKASQSSTETQGPSSESGLMTVKVYSGKDFTLPFPITSNSTILQKLLSSGILTSSSNDASEVAAIMRQLPRYKRVDQDSAGEGLIDRAFATKFIPSSILLPGSTNSSPLLYFTIEFDNSITTISPDMGTMEQPVFNKISTFDVTRKLRFLKIDVFARIPSLLLPSKNWQQEIGEQDEVLKEILKKINTNQDIHLDSFHLPLNLKIDSAAQIRLYNHHWISLERGYGKLNITVDYKPSKNKPLSIDDFDLLKVIGKGSFGKVMQVRKKDTQKIYALKALRKAYIVSKCEVTHTLAERTVLARVDCPFIVPLKFSFQSPEKLYLVLAFINGGELFYHLQHEGRFSLARSRFYIAELLCALDSLHKLDVIYRDLKPENILLDYQGHIALCDFGLCKLNMKDNDKTDTFCGTPEYLAPEILLGQGYTKTVDWWTLGILLYEMMTGLPPYYDENVPVMYKKILQQPLLFPDGFDPAAKDLLIGLLSRDPSRRLGVNGTDEIRNHPFFKDISWKKLLLKGYIPPYKPIVKSEIDTANFDQEFTKEKPIDSVVDEYLSASIQKQFGGWTYIGDEQLGDSPSQGRSIS

SEQ ID NO: 1883 - protein, 569 aa, Saccharomyces cerevisiae
MSFQIETVPTKPYEDQKPGTSGLRKKTKVFKDEPNYTENFIQSIMEAIPEGSKGATLVVGGDGRYYNDVILHKIAAIGAANGIKKLVIGQHGLLSTPAASHIMRTYEEKCTGGIILTASHNPGGPENDMGIKYNLSNGGPAPESVTNAIWEISKKLTSYKIIKDFPELDLGTIGKNKKYGPLLVDIIDITKDYVNFLKEIFDFDLIKKFIDNQRSTKNWKLLFDSMNGVTGPYGKAIFVDEFGLPADEVLQNWHPSPDFGGMHPDPNLTYASSLVKRVDREKIEFGAASDGDGDRNMIYGYGPSFVSPGDSVAIIAEYAAEIPYFAKQGIYGLARSFPTSGAIDRVAKAHGLNCYEVPTGWKFFCALFDAKKLSICGEESFGTGSNHVREKDGVWAIMAWLNILAIYNKHHPENEASIKTIQNEFWAKYGRTFFTRYDFEKVETEKANKIVDQLRAYVTKSGVVNSAFPADESLKVTDCGDFSYTDLDGSVSDHQGLYVKLSNGARFVLRLSGTGSSGATIRLYIEKYCDDKSQYQKTAEEYLKPIINSVIKFLNFKQVLGTEEPTVRT

SEQ ID NO: 1884 - protein, 687 aa, Saccharomyces cerevisiae [sequence omitted]

SEQ ID NO: 1885 - protein, 1219 aa, Saccharomyces cerevisiae
MAILKRGARKKVHQEPAKRSANIKKATFDSSKKKEVGVSDLTLLSKISDEAINENLKKRFLNATIYTYIGHVLISVNPFRDLGIYTDAVMNEYKGKNRLEVPPHVFAIAESMYYNMKSYNENQCVIISGESGAGKTEAAKRIMQYIAAASSTHTESIGKIKDMVLATNPLLESFGCAKTLRNNNSSRHGKYLEIKFNNQFEPCAGNITNYLLEKQRVVSQIKNERNFHIFYQFTKGASDAYRQTFGVQKPEQYVYTAAAGCISAETIDDLQDYQETLKAMRVIGLGQEEQDQIFRMLAAILWIGNVSFIENEEGNAQVRDTSVTDFVAYLLQIDSQLLIKSLVERIMETNHGMKRGSVYHVPLNIVQADAVRDALAKAIYNNLFDWIVSRVNKSLQAFPGAEKSIGILDIYGFEIFEHNSFEQICINYVNEKLQQIFIQLTLKSEQETYEREKIQWTPIKYFDNKVVCDLIEARRPPGIFAAMNDSVATAHADSNAADQAFAQRLNLFTTNPHFDLRSNKFVIKHYAGDVTYDIDGITDKNKDQLQKDLVELIGTTTNTFLATIFPDTVDRESKRRPPTAGDKIIKSANDLVETLSKAQPSYIRTIKPNETKSPNDYDDRQVLHQIKYLGLQENVRIRRAGFAYRQVFEKFVERFYLLSPHCSYAGDYTWQGDTLDAVKYILQDSSIPQQEYQLGVTSVFIKTPETLFALEHMRDRYWHNMAARIQRAWRRFLQRRIDAATKIQRTIRERKEGNKYEKLRDYGTKVLGGRKERRSMSLLGYRAFMGDYLSCNESKSKGAYIKRQVSIKEKVIFSIHGEALHTKFGRSAQRLKKTFLLTPTTLYIVGQTLVQNAMTYTQDYKIDVRNIQAVSLTNLQDDWVAIKLASSGQPDPLINTYFKTELITHLKRLNDKIQIKIGSAIEYQKKPGKLHSVKCQINESAPKYGDIYKSSTISVRRGNPPNSQVHKKPRKKSSISSGYHASSSQATRRPVSIAAAQHVPTAPASRHSKKPAPPPPGMQNKAATRRSVPNPASTLTASQSNARPSPPTAATRATPAATPAAAAMGSGRQANIPPPPPPPPPSSKPKEPMFEAAYDFPGSGSPSELPLKKGDVIYITREEPSGWSLGKLLDGSKEGWVPTAYMKPHSGNNNIPTPPQNRDVPKPVLNSVQHDNTSANVIPAAAQASLGDGLANALAARANKMRLESDDEEANEDEEEDDW

SEQ ID NO: 1886 - protein, 319 aa, Saccharomyces cerevisiae
MASNEVLVLRGTLEGHNGWVTSLATSAGQPNLLLSASRDKTLISWKLTGDDQKFGVPVRSFKGHSHIVQDCTLTADGAYALSASWDKTLRLWDVATGETYQRFVGHKSDVMSVDIDKKASMIISGSRDKTIKVWTIKGQCLATLLGHNDWVSQVRVVPNEKADDDSVTIISAGNDKMVKAWNLNQFQIEADFIGHNSNINTLTASPDGTLIASAGKDGEIMLWNLAAKKAMYTLSAQDEVFSLAFSPNRYWLAAATATGIKVFSLDPQYLVDDLRPEFAGYSKAAEPHAVSLAWSADGQTLFAGYTDNVIRVWQVMTAN

SEQ ID NO: 1887 - protein, 196 aa, Saccharomyces cerevisiae
MKATIQRVTSVFGVPRASVFVPRISTPFILHNYISNGRMDLFSKEFHNGRVSKSDLWSSNKEEELLVSQRKKRPISPHLTVYEPEMSWYLSSLHRISGVLLALGFYAFTITLGVTTIMGMDTTFQDLNKWYHEKMPKWSQWVAKGSAAYLFAFHFGNGIRHLIWDMGYELTNRGVIKTGSIVLAGTLVLGTYLLAQ

SEQ ID NO: 1888 - protein, 511 aa, Saccharomyces cerevisiae
MSKRSIEVNEEQDRVVSAKTESHSVPAIPASEEQDAPKNDLEEQLSDEFDSDGEIIEIDGDDEINDEDDLRKKQEEAETLVQKDQSEGNKEKIQELYLPHMSRPLGPDEVLEADPTVYEMLHNVNMPWPCLTLDVIPDTLGSERRNYPQSILLTTATQSSRKKENELMVLALSNLAKTLLKDDNEGEDDEEDDEDDVDPVIENENIPLRDTTNRLKVSPFAISNQEVLTATMSENGDVYIYNLAPQSKAFSTPGYQIPKSAKRPIHTVKNHGNVEGYGLDWSPLIKTGALLSGDCSGQIYFTQRHTSRWVTDKQPFTVSNNKSIEDIQWSRTESTVFATAGCDGYIRIWDTRSKKHKPAISVKASNTDVNVISWSDKIGYLLASGDDNGTWGVWDLRQFTPSNADAVQPVAQYDFHKGAITSIAFNPLDESIVAVGSEDNTVTLWDLSVEADDEEIKQQAAETKELQEIPPQLLFVHWQKEVKDVKWHKQIPGCLVSTGTDGLNVWKTISV

SEQ ID NO: 1889 - protein, 435 aa, Saccharomyces cerevisiae
MYEYCSVVIKKYSKYTIPSFAPNGFQSMLEPPQIDKWQHLSANCTLQFRVLLMDSRQILINVVLNNSTLLENIRLPLGDNQDLIQFSCKSPIISCKYISEEFGPRMLRRFQMNLPNDVEFNRTVVSLKNLNFVLRTARTSIAQSTITSQVQGNNNGTKVCFTEGPKVSSYTNPNTQFQTQNMIMDFSQRYQEESERESNNRSNITLPHDSIQIAQQIWPNTDLNVVQSSQDLNTPMATQTVLGRPESLIVQPLEVSQSPPNTTNCLPNAENKKKKVDTTSDFTSRKEIALCKTGLLETIHIPKERESQMQSVTGLDATPTIIWSPGKDNTAKKNTSNKKNIDDKLTNPQKSGNTHTPDRNKEVLPNGTLNETRKEASPSEGLTIRVKNVNRNASRKISKRLIKEKLKDEEFMKWVCMHLQETELFPPLIHSFSLT

SEQ ID NO: 1890 - protein, 191 aa, Saccharomyces cerevisiae
MGLLSIIRKQKLRDKEIRCLILGLDNSGKSTIVNKLLPKDEQNNDGIMPTVGFQIHSLMIKDVTISLWDIGGQRTLRPFWDNYFDKTQAMIWCIDVSLSMRFDETLQELKELINRDENRIGYECAVIVVLNKIDLVEDKSELHRRCLLVESELKCLFKPDIRIELVKCSGVTGEGIDNLRDRLVESCHFTQ

SEQ ID NO: 1891 - protein, 370 aa, Saccharomyces cerevisiae
MNIQSNNSPNLSNNIVSKQVYYAHPPPTIDPNDPVQISFPTTEVVGHGSFGVVFATVIQETNEKVAIKKVLQDKRFKNRELEIMKMLSHINIIDLKYFFYERDSQDEIYLNLILEYMPQSLYQRLRHFVHQRTPMSRLEIKYYMFQLFKSLNYLHHFANVCHRDIKPQNLLVDPETWSLKLCDFGSAKQLKPTEPNVSYICSRYYRAPELIFGATNYTNQIDIWSSGCVMAELLLGQPMFPGESGIDQLVEIIKILGTPSKQEICSMNPNYMEHKFPQIKPIPLSRVFKKEDDQTVEFLADVLKYDPLERFNALQCLCSPYFDELKLDDGKINQITTDLKLLEFDENVELGHLSPDELSSVKKKLYPKSK

SEQ ID NO: 1892 - protein, 190 aa, Saccharomyces cerevisiae
MTVGTLPIWSKTFSYAIRSLCFLHIIHMYAYEFTETRGESMLPTLSATNDYVHVLKNFQNGRGIKMGDCIVALKPTDPNHRICKRVTGMPGDLVLVDPSTIVNYVGDVLVDEERFGTYIKVPEGHVWVTGDNLSHSLDSRTYNALPMGLIMGKIVAANNFDKPFWDGSIRNIWGFKWINNTFLDVQAKSN

SEQ ID NO: 1893 - protein, 316 aa, Saccharomyces cerevisiae
MSDEIVTNKSVTYVNNTTPVTITSSELDLRSCYQDDEVVIEVHAAALNPIDFITHQLCNSYIFGKYPKTYSRDYSGVIIKAGKDVDNRWKVGDKVNGMYSHIYGERGTLTHYLILNPAKDVPITHMVEVPKDENDPYDDFVYAAAWPLTFGTAFSTLYDFKKDWTSDSKVLVIGASTSVSYAFVHIAKNYFNIGTVVGICSKNSIERNKKLGYDYLVPYDEGSIVENVKKLKQSVLENDKFDMIFDSVGNHDFFPVIDQFLKPKAKNSFYVTIAGNNKADYKNISWRDFVSLSSILKAINPFKKYNWRFGHPYPPN

SEQ ID NO: 1894 - protein, 1656 aa, Saccharomyces cerevisiae
MGIADGQRRRSSSLRTQMFNKHLYDKYRGRTDDEIELEDINESKTFSGSDNNDKDDRDETSGNYAAEEDYEMEEYGSPDVSYSIITKILDTILDRRRTFHSKDGRHIPIILDHNAIEYKQAATKRDGHLIDERFNKPYCDNRITSSRYTFYSFLPRQLYAQFSKLANTYFFIVAVLQMIPGWSTTGTYTTIIPLCVFMGISMTREAWDDFRRHRLDKEENNKPVGVLVKDGNNDAQEVYTLPSSVVSSTAYLTKSAAAENNPPLNDDRNSSQGHFLDTHFNNFELLKNKYNVHIHQKKWEKLRVGDFVLLTQDDWVPADLLLLTCDGENSECFVETMALDGETNLKSKQPHPELNKLTKAASGLANINAQVTVEDPNIDLYNFEGNLELKNHRNDTIMKYPLGPDNVIYRGSILRNTQNVVGMVIFSGEETKIRMNALKNPRTKAPKLQRKINMIIVFMVFVVATISLFSYLGHVLHKKKYIDQNKAWYLFQADAGVAPTIMSFIIMYNTVIPLSLYVTMEIIKVVQSKMMEWDIDMYHAETNTPCESRTATILEELGQVSYIFSDKTGTLTDNKMIFRKFSLCGSSWLHNVDLGNSEDNFEDNRDNTNSLRLPPKAHNGSSIDVVSIGDQNVLDRLGFSDAPIEKGHRPSLDNFPKSRNSIEYKGNSSAIYTGRPSMRSLFGKDNSHLSKQASVISPSETFSENIKSSFDLIQFIQRYPTALFSQKAKFFFLSLALCHSCLPKKTHNESIGEDSIEYQSSSPDELALVTAARDLGYIVLNRNAQILTIKTFPDGFDGEAKLENYEILNYIDFNSQRKRMSVLVRMPNQPNQVLLICKGADNVIMERLHDRELAAKKMADICTSTKERKDAEAELVLQQRKSLERMVDEEAMARTSLRNSLSSVPRASLSLQAVRKSLSMKNSRTRDPEKQIDSIDQFLETVKKSDQEIGSVVNKSRKSLHKQQIEKYGPRISIDGTHFPNNNVPIDTRKEGLQHDYDTEILEHIGSDELILNEEYVIERTLQAIDEFSTEGLRTLVYAYKWIDIGQYENWNKRYHQAKTSLTDRKIKVDEAGAEIEDGLNLLGVTAIEDKLQDGVSEAIEKIRRAGIKMWMLTGDKRETAINIGYSCMLIKDYSTVVILTTTDENIISKMNAVSQEVDSGNIAHCVVVIDGATMAMFEGNPTYMSVFVELCTKTDSVICCRASPSQKALMVSNIRNTDPNLVTLAIGDGANDIAMIQSADIGVGIAGKEGLQASRVSDYSIGQFRFLLKLLFVHGRYNYIRTSKFMLCTFYKEITFYFTQLIYQRYTMFSGSSLYEPWSLSMFNTLFTSLPVLCIGMFEKDLKPMTLLTVPELYSYGRLSQGFNWLIFMEWVILATTNSLIITFLNVVMWGMSSLSDNTMYPLGLINFTAIVALINVKSQFVEMHNRNWLAFTSVVLSCGGWLVWCCALPILNNTDQIYDVAYGFYNHFGKDITFWCTSLVLALLPITLDIVYKTFKVMIWPSDSDIFAELEQKSDIRKKLELGAYSEMRQGWTWDKDPSTFTRYTDKVLSRPRTNSRASAKTHNSSIYSMSNGNVDHSSKKNFFGNSSKKSSERYEVLPSGKLIKRPSLKTQSSKDSIGGNITTKLTKKLKLPSRNVEDEDVNQIIQARLKDLE

SEQ ID NO: 1895 - protein, 368 aa, Saccharomyces cerevisiae
MNSWNLSSSIPIIHTPHDHPPTSEGTPDQPNNNRKDDKLHKKRGDSDEDLSPIWHCVVSGGIGGKIGDSAMHSLDTVKTRQQGAPNVKKYRNMISAYRTIWLEEGVRRGLYGGYMAAMLGSFPSAAIFFGTYEYTKRTMIEDWQINDTITHLSAGFLGDFISSFVYVPSEVLKTRLQLQGRFNNPFFQSGYNYSNLRNAIKTVIKEEGFRSLFFGYKATLARDLPFSALQFAFYEKFRQLAFKIEQKDGRDGELSIPNEILTGACAGGLAGIITTPMDVVKTRVQTQQPPSQSNKSYSVTHPHVTNGRPAALSNSISLSLRTVYQSEGVLGFFSGVGPRFVWTSVQSSIMLLLYQMTLRGLSNAFPTD

SEQ ID NO: 1896 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPFHSNAKQDLAQIIELTRYYAGAVDKFNMGETIPLTFNKFAYTLKVPFGVVAQIVPWNYPLAMACRKMQGALAAGNTVIIKPAENTSLSLLYFATLIKKAGFPPGVVNVIPGYGSVVGKALGTHMDIDKISFTGSTKVGGSVLEASGQSNLKDITLECGGKSPALVFEDADLDKAIEWVANGIFFNSGQICTANSRVYVQSSIYDKFVEKFKETAKKEWDVAGKFDPFDEKCIVGPVISSTQYDRIKSYIERGKKEEKLDMFQTSEFPIGGAKGYFIPPTIFTDVPETSKLLRDEIFGPVVVVSKFTNYDDALKLANDTCYGLASAVFTKDVKKAHMFARDIKAGTVWINQTNQEEAKVPFGGFKMSGIGRESGDTGVDNYLQIKSVHVDLSLDK

SEQ ID NO: 1897 - protein, 506 aa, Saccharomyces cerevisiae
MPTLYTDIEIPQLKISLKQPLGLFINNEFCPSSDGKTIETVNPATGEPITSFQAANEKDVDKAVKAARAAFDNVWSKTSSEQRGIYLSNLLKLIEEEQDTLAALETLDAGKPYHSNAKGDLAQILQLTRYFAGSADKFDKGATIPLTFNKFAYTLKVPFGVVAQIVPWNYPLAMACWKLQGALAAGNTVIIKPAENTSLSLLYFATLIKKAGFPPGVVNIVPGYGSLVGQALASHMDIDKISFTGSTKVGGFVLEASGQSNLKDVTLECGGKSPALVFEDADLDKAIDWIAAGIFYNSGQNCTANSRVYVQSSIYDKFVEKFKETAKKEWDVAGKFDPFDEKCIVGPVISSTQYDRIKSYIERGKREEKLDMFQTSEFPIGGAKGYFIPPTIFTDVPQTSKLLQDEIFGPVVVVSKFTNYDDALKLANDTCYGLASAVFTKDVKKAHMFARDIKAGTVWINSSNDEDVTVPFGGFKMSGIGRELGQSGVDTYLQTKAVHINLSLDN

SEQ ID NO: 1898 - protein, 68 aa, Saccharomyces cerevisiae
MNTDQQKVSEIFQSSKEKLQGDAKVVSDAFKKMASQDKDGKTTDADESEKHNYQEQYNKLKGAGHKKE

SEQ ID NO: 1899 - protein, 705 aa, Saccharomyces cerevisiae
MAGETFEFQAEITQLMSLIINTVYSNKEIFLRELISNASDALDKIRYQALSDPKQLETEPDLFIRITPKPEEKVLEIRDSGIGMTKAELINNLGTIAKSGTKAFMEALSAGADVSMIGQFGVGFYSLFLVADRVQVISKNNEDEQYIWESNAGGSFTVTLDEVNERIGRGTVLRLFLKDDQLEYLEEKRIKEVIKRHSEFVAYPIQLLVTKEVEKEVPIPEEEKKDEEKKDEDDKKPKLEEVDEEEEEKKPKTKKVKEEVQELEELNKTKPLWTRNPSDITQEEYNAFYKSISNDWEDPLYVKHFSVEGQLEFRAILFIPKRAPFDLFESKKKKNNIKLYVRRVFITDEAEDLIPEWLSFVKGVVDSEDLPLNLSREMLQQNKIMKVIRKNIVKKLIEAFNEIAEDSEQFDKFYSAFAKNIKLGVHEDTQNRAALAKLLRYNSTKSVDELTSLTDYVTRMPEHQKNIYYITGESLKAVEKSPFLDALKAKNFEVLFLTDPIDEYAFTQLKEFEGKTLVDITKDFELEETDEEKAEREKEIKEYEPLTKALKDILGDQVEKVVVSYKLLDAPAAIRTGQFGWSANMERIMKAQALRDSSMSSYMSSKKTFEISPKSPIIKELKKRVDEGGAQDKTVKDLTNLLFETALLTSGFSLEEPTSFASRINRLISLGLNIDEDEETETAPEASTEAPVEEVPADTEMEEVD

SEQ ID NO: 1900 - protein, 594 aa, Saccharomyces cerevisiae
MNNSKIPKLSFHSDPNNVTRDFPKTKRQKVQKREMDMILTPNNNKLNILHSSGSGIRRCYTDDTSATYTKKLTFGGDPKIIERVKNNERKVRKDIDSLLNAISEIEKESVRIHARELPAITLELDAKVKACRELQNEIDGLSTEMDLKDNQCDLQRKNVELSSKNIVSMHAVKVQEFENDLEEELSNAKREWTYKLMEVENLKPDERLTDEMRQLKTEFEEVNRKLFILQNENENECKNYKKELDKKFEIFKKVKNDARIELDGEQERLSKVLKDLQDTHGELKENIKTCRDEFNDFEKRIGEAEVNFHSMELAVVPLKKKLASTSQALTQVQEEKKQVEGEANNWKKKYVNELEKVQQELYTRQNLATSIEEIKGYTRCFAYANERQMPDEFHINYVDRCICENSGEKRVQVFDRVVLEEIHKDHKRLYNECIPFLEKYISKLINCSIIVVSQQPTAPMKKTLLKQLIEQYGENYKMTLNILHLDGSIKHSDVGLDNPTEIRDLSQDEECMNILTLDTKLGKDEESHSMNIYIGSMSTVQLNRELDDAPSVLSHILTKTKQCFVFKINAGENIEKALALAGKLKRTITLPQLD

SEQ ID NO: 1901 - protein, 546 aa, Saccharomyces cerevisiae
MNHSEVKTGLIVTAKQTYYPIELSNAELLTHYETIQEYHEEISQNVLVQSSKTKPDIKLIDQQPEMNPHQTREAIVTFLYQLSVMTRVSNGIFFHAVRFYDRYCSKRVVLKDQAKLVVGTCLWLAAKTWGGCNHIINNVSIPTGGRFYGPNPRARIPRLSELVHYCGGSDLFDESMFIQMERHILDTLNWDVYEPMINDYILNVDENCLIQYELYKNQLQNNNSNGKEWSCKRKSQSSDDSDATVEEHISSSPQSTGLDGDTTTMDEDEELNSKIKLINLKRFLIDLSCWQYNLLKFELYEICNGMFSIINKFTNQDQGPFLSMPIGNDINSNTQTQVFSIIINGIVNSPPSLVEVYKEQYGIVPFILQVKDYNLELQKKLQLASTIDLTRKIAVNSRYFDQNASSSSVSSPSTYSSGTNYTPMRNFSAQSDNSVFSTTNIDHSSPITPHMYTFNQFKNESACDSAISVSSLPNQTQNGNMPLSSNYQNMMLEERNKENRIPNSSSAEIPQRAKFMTTGIFQNTGELTNRASSISLSLRNHNSSQL

SEQ ID NO: 1902 - protein, 222 aa, Saccharomyces cerevisiae [sequence omitted]

SEQ ID NO: 1903 - protein, 959 aa, Saccharomyces cerevisiae
MTVTTPFVNGTSYCTVTAYSVQSYKAAIDFYTKFLSLENRSSPDENSTLLSNDSISLKILLRPDEKINKNVEAHLKELNSITKTQDWRSHATQSLVFNTSDILAVKDTLNAMNAPLQGYPTELFPMQLYTLDPLGNVVGVTSTKNAVSTKPTPPPAPEASAESGLSSKVHSYTDLAYRMKTTDTYPSLPKPLNRPQKAIAVMTSGGDAPGMNSNVRAIVRSAIFKGCRAFVVMEGYEGLVRGGPEYIKEFHWEDVRGWSAEGGTNIGTARCMEFKKREGRLLGAQHLIEAGVDALIVCGGDGSLTGADLFRSEWPSLIEELLKTNRISNEQYERMKHLNICGTVGSIDNDMSTTDATIGAYSALDRICKAIDYVEATANSHSRAFVVEVMGRNCGWLALLAGIATSADYIFIPEKPATSSEWQDQMCDIVSKHRSRGKRTTIVVVAEGAIAADLTPISPSDVHKVLVDRLGLDTRITTLGHVQRGGTAVAYDRILATLQGLEAVNAVLESTPDTPSPLIAVNENKIVRKPLMESVKLTKAVAEAIQAKDFKRAMSLRDTEFIEHLNNFMAINSADHNEPKLPKDKRLKIAIVNVGAPAGGINSAVYSMATYCMSQGHRPYAIYNGWSGLARHESVRSLNWKDMLGWQSRGGSEIGTNRVTPEEADLGMIAYYFQKYEFDGLIIVGGFEAFESLHQLERARESYPAFRIPMVLIPATLSNNVPGTEYSLGSDTALNALMEYCDVVKQSASSTRGRAFVVDCQGGNSGYLATYASLAVGAQVSYVPEEGISLEQLSEDIEYLAQSFEKAEGRGRFGKLILKSTNASKALSATKLAEVITAEADGRFDAKPAYPGHVQQGGLPSPIDRTRATRMAIKAVGFIKDNQAAIAEARAAEENFNADDKTISDTAAVVGVKGSHVVYNSIRQLYDYETEVSMRMPKVIHWQATRLIADHLVGRKRVD

SEQ ID NO: 1904 - protein, 1312 aa, Saccharomyces cerevisiae
VVYVALQPLLKISERYSEGLANHECEIFLKLIKKYYAVEKIFENHDIHEERNLLNLRRKDLTNLKKILCISLSHANVVAKNKLVTAILHEYEPLCQDSSKMSLKFRAVIHDLASLESKWAKEVAVKARSVLLRGIFPPIKKRKEHIKTLLQLHIKDTGAENIHSRNIYSCMRDFGNLIHSNLIQLQDLFFFFGHQDTALSSIASEIYARYAYGNYQLKSIKIHKGAPDLLMSWQFSSLRNYLVNSDGESDEFTKLSKPPSTSGKSSANSFGLLVNMRALESLEKTLDEVYEQIHIPEERLSSGENSLIVNILSPIRYRSENDLIKTLKIKLHENERGLSKLKVNRITFAFIAANAPAVKFYSFDGTTYDEISQIRNMDPSYEAPLELGKMSNYKIRSLPTYDSSIRIFEGISKFTPLDKRFFVRKIINSFMYNDQKTTEENLKAEINAQVVYMLEHLGAVDISNSDLNHIFLSFNTVLNIPVHRLEEIVSTILKTHETRLFQERITDVEICISVECLETKKPAPLRLLISNKSGYVVKIETYYEKIGKNGNLILEPCSEQSHYSQKSLSLPYSVKDWLQPKRYKAQFMGTTYVYDFPGLFHQAAIQQWKRYFPKHKLNDSFFSWVELIEQNGNLIKVNREPGLNNIGMVAFEIMVQTPEYPEGRNMIVISNDITYNIGSFGPREDLFFDRVTNYARERGIPRIYLAANSGAKLGIAEELIPLFRVAWNDPSDPTKGFQYLYLAPKDMQLLKDSGKGNSVVVEHKMVYGEERYIIKAIVGFEEGLGVECLQGSGLIAGATSKAYRDIFTITAVTCRSVGIGSYLVRLGQRTIQVEDKPIILTGASAINKVLGTDIYTSNLQIGGTQIMYKNGIAHLTASNDMKAIEKIMTWLSYVPAKRDMSPPLLETMDRWDRDVDFKPAKQVPYEARWLIEGKWDSNNNFQSGLFDKDSFFETLSGWAKGVIVGRARLGGIPVGVIAVETKTIEEIIPADPANLDSSEFSVKEAGQVWYPNSAFKTAQTINDFNYGEQLPLIILANWRGFSGGQRDMYNEVLKYGSFIVDALVDYKQPILIYIPPFGELRGGSWVVIDPTINPEQMEMYADVESRGGVLEPDGVVSIKYRKEKMIETMIRLDSTYGHLRRTLTEKKLSLEKQNDLTKRLKIRERQLIPIYNQISIQFADLHDRSTRMLVKGVIRNELEWKKSRRFLYWRLRRRLNEGQVIKRLQKKTCDNKTKMKYDDLLKIVQSWYNDLDVNDDRAVVEFIERNSKKIDKNIEEFEISLLIDELKKKFEDRRGNIVLEELTRLVDSKRKR

SEQ ID NO: 1905 - protein, 983 aa, Saccharomyces cerevisiae
KGKTITHGQSWGARRIHSHFYITIFTITCIRIGQYKLALYLDPYRFYNITGSQIVRLKGQRPEYRKRIFAHSYRHSSRIGLNFPSRRRYSNYVDRGNIHKHTRLPPQFIGLNTVESAQPSILRDFVDLRGGHTVISKILIANNGIAAVKEMRSIRKWAYETFNDEKIIQFVVMATPDDLHANSEYIRMADQYVQVPGGTNNNNYANIDLILDVAEQTDVDAVWAGWGHASENPCLPELLASSQRKILFIGPPGRAMRSLGDKISSTIVAQSAKIPCIPWSGSHIDTIHIDNKTNFVSVPDDVYVRGCCSSPEDALEKAKLIGFPVMIKASEGGGGKGIRRVDNEDDFIALYRQAVNETPGSPMFVMKVVTDARHLEVQLLADQYGTNITLFGRDCSIQRRHQKIIEEAPVTITKPETFQRMERAAIRLGELVGYVSAGTVEYLYSPKDDKFYFLELNPRLQVEHPTTEMISGVNLPATQLQIAMGIPMHMISDIRKLYGLDPTGTSYIDFKNLKRPSPKGHCISCRITSEDPNEGFKPSTGKIHELNFRSSSNVWGYFSVGNNGAIHSFSDSQFGHIFAVGNDRQDAKQNMVLALKDFSIRGEFKTPIEYLIELLETRDFESNNISTGWLDDLILKNLSSDSKLDPTLAIICGAAMKAYVFTEKVRNKYLELLRRGQVPPKDFLKTKFPVDFIFDNNRYLFNVAQSSEEQFILSINKSQCEVNVQKLSSDCLLISVDGKCHTVYWKDDIRGTRLSIDSNTIFLEAELNPTQVISPTPGKLVKYLVRSGDHVFAGQQYAEIEIMKMQMPLVAKSDGVIELLRQPGSIIEAGDVIAKLTLDSPSKANESSLYRGELPVLGPPLIEGSRPNHKLRVLINRLENILNGYHENSGIETTLKELIKILRDGRLPYSEWDSQISTVRNRLPRQLNEGLGNLVKKSVSFPAKELHKLMKRYLEENTNDHVVYVALQPLLKISERYSEGLAN

SEQ ID NO: 1906 - protein, 443 aa, Saccharomyces cerevisiae
MSLPFLTSAPGKVIIFGEHSAVYNKPAVAASVSALRTYLLISESSAPDTIELDFPDISFNHKWSINDFNAITEDQVNSQKLAKAQQATDGLSQELVSLLDPLLAQLSESFHYHAAFCFLYMFVCLCPHAKNIKFSLKSTLPIGAGLGSSASISVSLALAMAYLGGLIGSNDLEKLSENDKHIVNQWAFIGEKCIHGTPSGIDNAVATYGNALLFEKDSHNGTINTNNFKFLDDFPAIPMILTYTRIPRSTKDLVARVRVLVTEKFPEVMKPILDAMGECALQGLEIMTKLSKCKGTDDEAVETNNELYEQLLELIRINHGLLVSIGVSHPGLELIKNLSDDLRIGSTKLTGAGGGGCSLTLLRRDITQEQIDSFKKKLQDDFSYETFETDLGGTGCCLLSAKNLNKDLKIKSLVFQLFENKTTTKQQIDDLLLPGNTNLPWTS

SEQ ID NO: 1907 - protein, 404 aa, Saccharomyces cerevisiae
MVIRCSTDKTWWIGQKSVHWLAKRSRTMIPKLYIHLILSLLLLPLILAQDYYAILEIDKDATEKEIKSAYRQLSKKYHPDKNAGSEEAHQKFIEVGEAYDVLSDPEKKKIYDQFGADAVKNGGGGGGPGGPGAGGFHDPFDIFERMFQGGHGGPGGGFGQRQRQRGPMIKVQEKLSLKQFYSGSSIEFTLNLNDECDACHGSGSADGKLAQCPDCQGRGVIIQVLRMGIMTQQIQQMCGRCGGTGQIIKNECKTCHGKKVTKKNKFFHVDVPPGAPRNYMDTRVGEAEKGPDFDAGDLVIEFKEKDTENMGYRRRGDNLYRTEVLSAAEALYGGWQRTIEFLDENKPVKLSRPAHVVVSNGEVEVVKGFGMPKGSKGYGDLYIDYVVVMPKTFKSGQNMLKDEL

SEQ ID NO: 1908 - protein, 742 aa, Saccharomyces cerevisiae
MGSSINYPGFVTKSAHLADTSTDASISCEEATSSQEAKKNFFQRDYNMMKKAPAPTKSKLSLALQTSKSSSSANGTVQEDTSSKTEDFSTKSIKKKPDSGVESHVSIQSDSGPQSDSDLDSDSSISSCDERNEESLKDYRPGGYHPAFKGEPYKDARYILVRKLGWGHFSTVWLAKDMVNNTHVAMKIVRGDKVYTEAAEDEIKLLQRVNDADNTKEDSMGANHILKLLDHFNHKGPNGVHVVMVFEVLGENLLALIKKYEHRGIPLIYVKQISKQLLLGLDYMHRRCGIIHTDIKPENVLMEIGDVEGIVQMVEALDKQKREAKRLQRHVSRSSDITANDSSDEKWAECQTSMPCGSSSNSKSRSIEKDLSKRCFRRPRRHTIITGSQPLPSPISSSNFFEMRAHFCGSSHNSFSSVSGNRNIPSSINNNSINNGIGIKNSNNSFLNSVPHSVTRMFINEDSNDNNNNDNSKNKNNNNNNSNNNNNEDIMNTPLHEEQLADSLSTFDISNISQSSDTNGPYISNTMDSNSNVSTDINSPENLIQIKIADLGNACWYDEHYTNSIQTREYRSPEVLLGAPWGCGADIWSTACLIFELITGDFLFEPDEGHSYTKDDDHIAQIIELLGELPSYLLRNGKYTRTFFNSRGLLRNISKLKFWPLEDVLTEKYKFSKDEAKEISDFLSPMLQLDPRKRADAGGLVNHPWLKDTLGMEEIRVPDRELYGSGSDIPGWFEEVRDHKRH

SEQ ID NO: 1909 - protein, 451 aa, Saccharomyces cerevisiae
MSELRAFSAPGKALLAGGYLVLDTKYEAFVVGLSARMHAVAHPYGSLQGSDKFEVRVKSKQFKDGEWLYHISPKSGFIPVSIGGSKNPFIEKVIANVFSYFKPNMDDYCNRNLFVIDIFSDDAYHSQEDSVTEHRGNRRLSFHSHRIEEVPKTGLGSSAGLVTVLTTALASFFVSDLENNVDKYREVIHNLAQVAHCQAQGKIGSGFDVAAAAYGSIRYRRFPPALISNLPDIGSATYGSKLAHLVDEEDWNITIKSNHLPSGLTLWMGDIKNGSETVKLVQKVKNWYDSHMPESLKIYTELDHANSRFMDGLSKLDRLHETHDDYSDQIFESLERNDCTCQKYPEITEVRDAVATIRRSFRKITKESGADIEPPVQTSLLDDCQTLKGVLTCLIPGAGGYDAIAVITKQDVDLRAQTANDKRFSKVQWLDVTQADWGVRKEKDPETYLDK

SEQ ID NO: 1910 - protein, 471 aa, Saccharomyces cerevisiae
MSICPHIQQVFQNEKSKDGVLKTCNAARYILNHSVPKEKFLNTMKCGTCHEINSGATFMCLQCGFCGCWNHSHFLSHSKQIGHIFGINSNNGLLFCFKCEDYIGNIDLINDAILAKYWDDVCTKTMVPSMERRDGLSGLINMGSTCFMSSILQCLIHNPYFIRHSMSQIHSNNCKVRSPDKCFSCALDKIVHELYGALNTKQASSSSTSTNRQTGFIYLLTCAWKINQNLAGYSQQDAHEFWQFIINQIHQSYVLDLPNAKEVSRANNKQCECIVHTVFEGSLESSIVCPGCQNNSKTTIDPFLDLSLDIKDKKKLYECLDSFHKKEQLKDFNYHCGECNSTQDAIKQLGIHKLPSVLVLQLKRFEHLLNGSNRKLDDFIEFPTYLNMKNYCSTKEKDKHSENGKVPDIIYELIGIVSHKGTVNEGHYIAFCKISGGQWFKFNDSMVSSISQEEVLKEQAYLLFYTIRQVN

SEQ ID NO: 1911 - protein, 692 aa, Saccharomyces cerevisiae
MDYPDPDTIRILITTDNHVGYNENDPITGDDSWKTFHEVMMLAKNNNVDMVVQSGDLFHVNKPSKKSLYQVLKTLRLCCMGDKPCELELLSDPSQVFHYDEFTNVNYEDPNFNISIPVFGISGNHDDASGDSLLCPMDILHATGLINHFGKVIESDKIKVVPLLFQKGSTKLALYGLAAVRDERLFRTFKDGGVTFEVPTMREGEWFNLMCVHQNHTGHTNTAFLPEQFLPDFLDMVIWGHEHECIPNLVHNPIKNFDVLQPGSSVATSLCEAEAQPKYVFILDIKYGEAPKMTPIPLETIRTFKMKSISLQDVPHLRPHDKDATSKYLIEQVEEMIRDANEETKQKLADDGEGDMVAELPKPLIRLRVDYSAPSNTQSPIDYQVENPRRFSNRFVGRVANGNNVVQFYKKRSPVTRSKKSGINGTSISDRDVEKLFSESGGELEVQTLVNDLLNKMQLSLLPEVGLNEAVKKFVDKDEKTALKEFISHEISNEVGILSTNEEFLRTDDAEEMKALIKQVKRANSVRPTPPKENDETNFAFNGNGLDSFRSSNREVRTGSPDITQSHVDNESRITHISQAESSKPTSKPKRVRTATKKKIPAFSDSTVISDAENELGDNNDAQDDVDIDENDIIMVSTDEEDASYGLLNGRKTKTKTRPAASTKTASRRGKGRASRTPKTDILGSLLAKKRK

SEQ ID NO: 1912 - protein, 267 aa, Saccharomyces cerevisiae
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 1913 - protein, 590 aa, Saccharomyces cerevisiae
MAVIRIKKPRGPGEKDQPLEGEPKLKRIRIKTKVTDEDIKPKPKLKINLKKKKESADGKEKKNSLKLKLNLKKNEEPVKKIHKAPKLRLKPIRIPGEAYDSEASDIEDDPLIESGVILRILPDIQLEFVKNSLESGDYSGISIKWKNERHAVVTINDVMYGAILVDLPTVIEVNKSVDRKNLLKTFDVSQMLLCIRPIQEEEEVYALEAPDTEDLVVKHFEGIEDEIWENKETFLKGYNGAPLSDMEAKHLKEIALKGYDYKHGISPPLYNVRNRRFRRKMDPNEIDYVEKVVDMLLKQDKQAEEVSYDLVDKSELQARQERVSSWENFKEEPGEPLSRPALKKEEIHTIASAVGKQGAEEEGEEGMEEEEEEDLDLGAAFESEEEGSGAEGDKEQQQEEVGDEVDQDTGGEDDDDDDDGDIEAAGGESESDDEKDENRQHTELLADELNELETTLAHTKHKLSKATNPLLKSRFIDSIKKLEKEAELKRKQLQQTEDSVQKQHQHRSDAETANNVEEEEEEEEEEEEEDEVDEDEEDDEENDEDEDNVHEREHIQENKVVRELDEAPAEETLDQNDLDMMMLFGAEGDE

SEQ ID NO: 1914 - protein, 348 aa, Saccharomyces cerevisiae
MARQGNFYAVRKGRETGIYNTWNECKNQVDGYGGAIYKKFNSYEQAKSFLGQPNTTSNYGSSTHAGGQVSKPHTTQKRVHRRNRPLHYSSLTSSSACSSLSSANTNTFYSVKSNVPNIESKIFNNWKDCQAYVKHKRGITFKKFEDQLAAENFISGMSAHDYKLMNISKESFESKYKLSSNTMYNKSMNVYCDGSSFGNGTSSSRAGYGAYFEGAPEENISEPLLSGAQTNNRAEIEAVSEALKKIWEKLTNEKEKVNYQIKTDSEYVTKLLNDRYMTYDNKKLEGLPNSDLIVPLVQRFVKVKKYYELNKECFKNNGKFQIEWVKGHDGDPGNEMADFLAKKGASRR

SEQ ID NO: 1915 - protein, 157 aa, Saccharomyces cerevisiae
MNGGGKNVLNKNSVGSVSEVGPDSTQEETPRDVRLLHLLLASQSIHQYEDQVPLQLMDFAHRYTQGVLKDALVYNDYAGSGNSAGSGLGVEDIRLAIAARTQYQFKPTAPKELMLQLAAERNKKALPQVMGTWGVRLPPEKYCLTAKEWDLEDPKSM

SEQ ID NO: 1916 - protein, 314 aa, Saccharomyces cerevisiae
MPSTTNTAAANVIEKKPVSFSNILLGACLNLSEVTTLGQPLEVVKTTMAANRNFTFLESVKHVWSRGGILGYYQGLIPWAWIEASTKGAVLLFVSAEAEYRFKSLGLNNFASGILGGVTGGVTQAYLTMGFCTCMKTVEITRHKSASAGGVPQSSWSVFKNIYKKEGIRGINKGVNAVAIRQMTNWGSRFGLSRLVEDGIRKITGKTNKDDKLNPFEKIGASALGGGLSAWNQPIEVIRVEMQSKKEDPNRPKNLTVGKTFKYIYQSNGLKGLYRGVTPRIGLGIWQTVFMVGFGDMAKEFVARMTGETPVAKH

SEQ ID NO: 1917 - protein, 694 aa, Saccharomyces cerevisiae
MTEQYSVAVGEAANEHETAPRRNIRVKDQPLIRPINSSASTLYEFALECFTKGGKRDGMAWRDIIDIHETKKTIVKRVDGKDKPIEKTWLYYELTPYITMTYEEMICVMHDIGRGLIKIGVKPNGENKFHIFASTSHKWMKTFLGCMSQGIPVVTAYDTLGESGLIHSMVETDSVAIFTDNQLLSKLAVPLKTAKNVKFVIHNEPIDPSDKRQNGKLYKAAKDAVDKIKEVRPDIKIYSFDEIIEIGKKAKDEVELHFPKPEDPACIMYTSGSTGTPKGVVLTHYNIVAGIGGVGHNVIGWIGPTDRIIAFLPLAHIFELTFEFEAFYWNGILGYANVKTLTPTSTRNCQGDLMEFKPTVMVGVAAVWETVRKGILAKINELPGWSQTLFWTVYALKERNIPCSGLLSGLIFKRIREATGGNLRFILNGGSAISIDAQKFLSNLLCPMLIGYGLTEGVANACVLEPEHFDYGIAGDLVGTITAKLVDVEDLGYFAKNNQGELLFKGAPICSEYYKNPEETAAAFTDDGWFRTGDIAEWTPKGQVKIIDRKKNLVKTLNGEYIALEKLESIYRSNPYVQNICVYADENKVKPVGIVVPNLGHLSKLAIELGIMVPGEDVESYIHEKKLQDAVCKDMLSTAKSQGLNGIELLCGIVFFEEEWTPENGLVTSAQKLKRRDILAAVKPDVERVYKENT

SEQ ID NO: 1918 - protein, 1054 aa, Saccharomyces cerevisiae
MTIIVASLFLPYTPQFEADVTNSDTAKLVESSMIKVDCNNQELSNNKQERSSSVTSASSHYIGLPQEAQINGEPLQRANVGSPATGVNYHNEMEMLSSEQFLEELTANATHAANSGIPPANNPVSSGSTAQRPSVEEFFSAPSARVCSPSQEASASSISASRSSAHHNDLSSSLMKNPNLSFDSHPPRVRSSSKSAVITPVSKSVPDVDPAVVDVAKVREEFQQQASLPSMKRVSGSTAGDSSIASSSSNLRYSQQFQDNFIEDTDSEDDIDSDLETDATKKYNVPKFGGYSNNAKLRASLMRNSYELFKHLPWTIVDSDKGNGSLKNAVNIAVAEKTVKEPVSWVGTMGIPTDELPHEVCHKISKKLEQDFSSFPVVTDDITFKGAYKNYAKQILWPTLHYQIPDNPNSKAFEDHSWDYYQKVNQKFSDRIVSVYKPGDTIWIHDYHLMLVPQMVREKLPKAKIGFFLHVSFPSSEVFRCLANRERILEGIIGANFVGFQTKEYKRHFLQTCNRLLAADVSNDEVKYHCNIVSVMYAPIGIDYYHLTSQLRNGSVLEWRQLIKERWRNKKLIVCRDQFDRIRGLQKKMLAYERFLIENPEYIEKVVLIQICIGKSSDPEYERQIMVVVDRINSLSSNISISQPVVFLHQDLDFAQYLALNCEADVFLVDALREGMNLTCHEFIVSSFEKNAPLLLSEFTGSSSVLKEGAILINPWDINHVAQSIKRSLEMSPEEKRRRWKKLFKSVIEHDSDNWITKCFEYINNAWESNQETSTVFNLAPEKFCADYKASKKHLFIFKISEPPTSRMLSLLSELSSNNIVYVLSSFTKNTFESLYNGVLNIGLIAENGAYVRVNGSWYNIVEELDWMKEVAKIFDEKVERLPGSYYKIADSMIRFHTENADDQDRVPTVIGEAITHINTLFDDRDIHAYVHKDIVFVQQTGLALAAAEFLMKFYNSGVSPTDNSRISLSRTSSSMSVGNNKKHFQNQVDFVCVSGSTSPIIEPLFKLVKQEVEKNNLKFGYTILYGSSRSTYAKEHINGVNELFTILHDLTAA

SEQ ID NO: 1919 - protein, 373 aa, Saccharomyces cerevisiae
MSLNIHIKSGQDKWEVNVAPESTVLQFKEAINKANGIPVANQRLIYSGKILKDDQTVESYHIQDGHSVHLVKSQPKPQTASAAGANNATATGAAAGTGATPNMSSGQSAGFNPLADLTSARYAGYLNMPSADMFGPDGGALNNDSNNQDELLRMMENPIFQSQMNEMLSNPQMLDFMIQSNPQLQAMGPQARQMLQSPMFRQMLTNPDMIRQSMQFARMMDPNAGMGSAGGAASAFPAPGGDAPEEGSNTNTTSSSNTGNNAGTNAGTNAGANTAANPFASLLNPALNPFANAGNAASTGMPAFDPALLASMFQPPVQASQAEDTRPPEERYEHQLRQLNDMGFFDFDRNVAALRRSGGSVQGALDSLLNGDV

SEQ ID NO: 1920 - protein, 622 aa, Saccharomyces cerevisiae
MLQGILETVPSDLKDPISLWFKQDRNPKTIEEVTALCKKSDWNELHKRFDSRIQFGTAGLRSQMQAGFSRMNTLVVIQASQGLATYVRQQFPDNLVAVVGHDHRFHSKEFARATAAAFLLKGFKVHYLNPDHEFVHTPLVPFAVDKLKASVGVMITASHNPKMDNGYKVYYSNGCQIIPPHDHAISDSIDANLEPWANVWDFDDVLNKALKQGKLMYSREEMLKLYLEEVSKNLVEINPLKLEVKAKPWFVYTPMHGVGFDIFSTIVKKTLCLVEGKDYLCVPEQQNPDPSFPTVGFPNPEEKGALDIGINLAEKHDIDLLVANDPDADRFSVAVKDMQSGEWRQLTGNEIGFLFAFYEYQKYKSMDKEFQHVHPLAMLNSTVSSQMIKKMAEIEGFHYEDTLTGFKWIGNRAILLEKKGYYVPFGFEEAIGYMFPAMEHDKDGISASIVFLQAYCKWKIDHNLDPLNVLENGFKKYGVFKEYNGYYVVPNPTVTKDIFDYIRNVYTPEGASYPSSIGEEIEVLYYRDLTTGYQSDTINHKPTLPVDPTSQMITVSARPSNGSENEHIRFTIRGSGTEPKLKVYIEACANEEQRASFLAKLTWNVLRREWFRPDEMNIVTKF

SEQ ID NO: 1921 - protein, 304 aa, Saccharomyces cerevisiae
MKMLRRTKVNFSKLLYKITKLAIVLTILYIYFTPKIVSRNNASLQHIFPHKYGDYEINLVIAHPDDEVMFFSPIISQLNSYFPRTVPFNIICLSKGNAEGLGETRVRELNESAALLLHNERAVSVQVMDFQDGMDEIWDIDSITSSLSQKIDIKNHNLNQIIVTFDSYGVSNHINHKSCYAAVKKLVDDYAQPKTKRNEQPPHVTALYLRSYKNNIVLKYNSFIWEILKILYDLISPFRRIIQALPPNTAAEKDKLSLMNTHAQYVLAFATMLNAHESQVVWFRYGWWIFSRFVFVNEFDVYTY

SEQ ID NO: 1922 - protein, 602 aa, Saccharomyces cerevisiae
MRSVTNAFGNSGELNDQVDETGYRKFDIHEGILFCIELSETMFKESSDLEYKSPLLEILESLDELMSQLVITRPGTAIGCYFYYCNREDAKEGIYELFPLRDINATFMKKLNDLLEDLSSGRISLYDYFMFQQTGSEKQVRLSVLFTFMLDTFLEEIPGQKQLSNKRVFLFTDIDKPQEAQDIDERARLRRLTIDLFDNKVNFATFFIGYADKPFDNEFYSDILQLGSHTNENTGLDSEFDGPSTKPIDAKYIKSRILRKKEVKRIMFQCPLILDEKTNFIVGVKGYTMYTHEKAGVRYKLVYEHEDIRQEAYSKRKFLNPITGEDVTGKTVKVYPYGDLDINLSDSQDQIVMEAYTQKDAFLKIIGFRSSSKSIHYFNNIDKSSFIVPDEAKYEGSIRTLASLLKILRKKDKIAILWGKLKSNSHPSLYTLSPSSVKDYNEGFYLYRVPFLDEIRKFPSLLSYDDGSEHKLDYDNMKKVTQSIMGYFNLRDGYNPSDFKNPLLQKHYKVLHDYLLQIETTFDENETPNTKKDRMMREDDSLRKLYYIRNKILESEKSEDPIIQRLNKYVKIWNMFYKKFNDDNISIKEEKKPFDKKPKFNI

SEQ ID NO: 1923 - protein, 505 aa, Saccharomyces cerevisiae
MATPSNKRSRDSESTEEPVVDEKSTSKQNNAAPEGEQTTCVEKFEELKLSQPTLKAIEKMGFTTMTSVQARTIPPLLAGRDVLGAAKTGSGKTLAFLIPAIELLHSLKFKPRNGTGIIVITPTRELALQIFGVARELMEFHSQTFGIVIGGANRRQEAEKLMKGVNMLIATPGRLLDHLQNTKGFVFKNLKALIIDEADRILEIGFEDEMRQIIKILPNEDRQSMLFSATQTTKVEDLARISLRPGPLFINVVPETDNSTADGLEQGYVVCDSDKRFLLLFSFLKRNQKKKIIVFLSSCNSVKYYAELLNYIDLPVLELHGKQKQQKRTNTFFEFCNAERGILICTDVAARGLDIPAVDWIIQFDPPDDPRDYIHRVGRTARGTKGKGKSLMFLTPNELGFLRYLKASKVPLNEYEFPENKIANVQSQLEKLIKSNYYLHQTAKDGYRSYLQAYASHSLKTVYQIDKLDLAKVAKSYGFPVPPKVNITIGASGKTPNTKRRKTHK

SEQ ID NO: 1924 - protein, 586 aa, Saccharomyces cerevisiae
MTTASSSASQLQQRLPEEKPWPQLSGSNADAQTFKCKYVTNHNSLGDGNFSVVKECMNIHTKDLYAMKLIKKQTVKNKIQLIQREFDLLRSISEKIRDMEKKNEHSLDIFEGHHHILQLFDYFETADNIVLITQLCQKGDLYEKIVENQCLDLETQVTSYCACLVSVLEFLHSQGIVHRDLKAENVLFRLRVNENEKNLQGEHHGDFKYDLLAHDLVLADFGLAAEYNTSKVNSLKEFVGTISYIAPEIVKCKGVGEMTPDQVGKLDKYGCPVDIWALGVLTYFMAFGYTPFDCTTDDETLECISKCDYYVDEQMMHDPKYEQFWNFVQCCFTIDPAVRRSAKNLKQHPFIKDYFATSNSLNTKDTPNFSFHPTIRRVSSTASMHTLRSPSKSRKTTTLAYLNMDGGSSETSTAFSSKMDLPDLYVDRTINSRERSLNRIRDTLKKTLSMTSLKPAGTFDYLHANKNGTSLSSSKSGLVKKNSTFVLDPKPPKNSLMNGCFSTTPESRSNFNTPKTLSRQGSSTSVKKYVNEVDLLLTPRTASMSSNDTTAINDYDTTNDKNPARKHAASFQVNVDDSDGDETMQI

SEQ ID NO: 1925 - protein, 373 aa, Saccharomyces cerevisiae
MNVIDLSDPAINVDYDSLIGIDNEESQEIFENEVKEDGQQEEQEEASSRKDGLIVEPGRDVESLRRAIRDQLLFKIHRQNQSDCADARKLSNDEEDESRQQKLERIREELEELKIENLTSEMQTEIKELCEIQSKLATESSSRLTNLRKKLLETYEGQDTVILPNIILDTSNIKRLQKLDQKISLMERFVGIPEALEAEEDRKSVHSKVNELYRSIQLLQGDDKAEGKLQKFRDRLVELNEEFENSLLGKKIQQDLRLKDDTVSKLVMPENKVKEINSMYSMFKQYQDSLPLLAERMKSLNKMNNRVIEVYETTKGLDSQITSIQEQGKVWLKALNELDKKFDEQEVKIRENMEQIRRKIDTLEDEALQRNSK

SEQ ID NO: 1926 - protein, 532 aa, Saccharomyces cerevisiae
MKAFTSLLCGLGLSTTLAKAISLQRPLGLDKDVLLQAAEKFGLDLDLDHLLKELDSNVLDAWAQIEHLYPNQVMSLETSTKPKFPEAIKTKKDWDFVVKNDAIENYQLRVNKIKDPKILGIDPNVTQYTGYLDVEDEDKHFFFWTFESRNDPAKDPVILWLNGGPGCSSLTGLFFELGPSSIGPDLKPIGNPYSWNSNATVIFLDQPVNVGFSYSGSSGVSNTVAAGKDVYNFLELFFDQFPEYVNKGQDFHIAGESYAGHYIPVFASEILSHKDRNFNLTSVLIGNGLTDPLTQYNYYEPMACGEGGEPSVLPSEECSAMEDSLERCLGLIESCYDSQSVWSCVPATIYCNNAQLAPYQRTGRNVYDIRKDCEGGNLCYPTLQDIDDYLNQDYVKEAVGAEVDHYESCNFDINRNFLFAGDWMKPYHTAVTDLLNQDLPILVYAGDKDFICNWLGNKAWTDVLPWKYDEEFASQKVRNWTASITDEVAGEVKSYKHFTYLRVFNGGHMVPFDVPENALSMVNEWIHGGFSL

SEQ ID NO: 1927 - protein, 690 aa, Saccharomyces cerevisiae
MLLLPRCPVIGRIVRSKFRSGLIRNHSPVIFTVSKLSTQRPLLFNSAVNLWNQAQKDITHKKSVEQFSSAPKVKTQVKKTSKAPTLSELKILKDLFRYIWPKGNNKVRIRVLIALGLLISAKILNVQVPFFFKQTIDSMNIAWDDPTVALPAAIGLTILCYGVARFGSVLFGELRNAVFAKVAQNAIRTVSLQTFQHLMKLDLGWHLSRQTGGLTRAMDRGTKGISQVLTAMVFHIIPISFEISVVCGILTYQFGASFAAITFSTMLLYSIFTIKTTAWRTHFRRDANKADNKAASVALDSLINFEAVKYFNNEKYLADKYNGSLMNYRDSQIKVSQSLAFLNSGQNLIFTTALTAMMYMGCTGVIGGNLTVGDLVLINQLVFQLSVPLNFLGSVYRDLKQSLIDMETLFKLRKNEVKIKNAERPLMLPENVPYDITFENVTFGYHPDRKILKNASFTIPAGWKTAIVGSSGSGKSTILKLVFRFYDPESGRILINGRDIKEYDIDALRKVIGVVPQDTPLFNDTIWENVKFGRIDATDEEVITVVEKAQLAPLIKKLPQGFDTIVGERGLMISGGEKQRLAIARVLLKNARIMFFDEATSALDTHTEQALLRTIRDNFTSGSRTSVYIAHRLRTIADADKIIVLDNGRVREEGKHLELLAMPGSLYRELWTIQEDLDHLENELKDQQEL

SEQ ID NO: 1928 - protein, 348 aa, Saccharomyces cerevisiae
MSIPETQKAIIFYESNGKLEHKDIPVPKPKPNELLINVKYSGVCHTDLHAWHGDWPLPTKLPLVGGHEGAGVVVGMGENVKGWKIGDYAGIKWLNGSCMACEYCELGNESNCPHADLSGYTHDGSFQEYATADAVQAAHIPQGTDLAEVAPILCAGITVYKALKSANLRAGHWAAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 1929 - protein, 1230 aa, Saccharomyces cerevisiae
MSSEDELGSIGTVFPGSPIDKSIGSILPQFDEEVETLLEDSFTWNIPDWNELTNPKYNSPRFRIGDFEWDILLFPQGNHNKGVAVYLEPHPEEKLDETTGEMVPVDPDWYCCAQFAIGISRPGNGDTINLINKSHHRFNALDTDWGFANLIDLNNLKHPSKGRPLSFLNEGTLNITAYVRILKDPTGVLWHNFLNYDSKKVTGYVGFRNQGATCYLNSLLQSYFFTKYFRKLVYEIPTEHESPNNSVPLALQRAFYQLQVSDIPLDTLELTRSFGWDTAESFTQHDVQELNRILMDRLENNMKGTPVEGKLNEIFVGKMKSYIKCINVDYESARVEDFWDLQLNVKNFKNLQESFDNYIEMELMNGENQYAAQDYGLQDAQKGVIFESFPPVLHLQLKRFEYDFNYDQMVKVNDKYEFPETIDLSPFVDKDVLKKTLDSENKDKNPYVYNLHGVLVHSGDISTGHYYTLIKPGVEDQWYRFDDERVWRVTKKQVFQENFGCDRLPDEKVRTMTRGEYQNYIIQRHTSAYMLVYIRQEQEEDLLRPVLESDVPKHVITRVREEIKERETKEKEIREAHLYVTLRLHSIKEFIHYEGFDYFAHDGFRLFAEELNDSGLQQINLKVLRTTKLSDIFASIKETMNIPQERDVKYWKMDYRRNSTLRLTQPINFESVNITLQEALKKEKKRTMQTQYGEEGVASTEEDDKALLETVSFLDLFIEEPYLELQFLNKLKEASLISKAQLDDELISTIRTNLPELTKGGIEPVFATDNKSNLLFVKSYDPHTQKLLGFGHFAVNQLQQLSDISAIIEDSISSNEKLTFYEEVQPGTINEIYMKETIYDADIDTGDIVSFEVPGAVLPDTFPVYATIKDFYSYLRYRVKLKFSKFDGSSEEYGVSNEIPESFEFWISAYAPYDDLARMVSKYAHVKPEYLKIIALYSNGRFVLKSTSLLNDYLLKDFNCDQIPPFAFEVLSVPLKELERLRPIKLYWLKNSYIHYQCFEFEVANDYTESQFLEKVQHKIGFTDEEKENILLWTNTNFQFQGLLSDQNTFKDVSKHSLLFGRILPEESKLFKELNRLENVQTSSLEDFMDDENATDRPMDDEQDLGMAIEHSEDMKGRIVVVQQYFKDLENRHGISFLFNLIPDETFPKTKDRLHAKFGLGQKEFSKIKLSIGYSTEEGTVFRSLQGFSDEELDKVILYDIMSNLDYIYMDHPDRLRSHSSYDRPMIIKN

SEQ ID NO: 1930 - protein, 1785 aa, Saccharomyces cerevisiae
MDFMSPKFSLTDVEYPAWCQDDEVPITMQEIREIFVELMDKFGFQKSSMENMYQHLMGQLDSRASRTGAQNALVSLHVSYIGGEHANYRKWYFAAQLDLDEEIGFQNMRLHGKARQRNVKMAKKRGVSIKEQIKQWNEKEQEFINNHPKITLTQEQLEDQTNLKSADYKWKLKMKKLTPENMIRQLALYLLCWGEANQVRFAPECLCFIFKCALDYDISTSSSEKTVKSPEYSYLNDVITPLYEFLRGQVYKKDAKGNWKRREKDHKNIIGYDDINQLFWYPEGFERIILNNGERLVDKPLEERYLYFKDVAWSKVFYKTYRETRSWKHCFTNFNRFWIIHFAPFWFFTTFNSPTLYTKNYIQLLNNQPTPQVRLSVIAFGGTIACLVQILATVFEWGFVPREWPGAQHLSSRMIGLLFCLAINLGPSVYVLGFFEWDVHSKSAYIVSIVQLIIAFLTTFFFAVRPLGGLFRPYLNKDKKHRRYISSQTFTASFPKLTGRSKWFSYGLWVFVYLAKYIESYFFLTLSLRDPIRVLSIMDLSRCQGEYLLGPILCKWQAKITLVLMLLSDLGLFFLDTYLWYIICNCIFSIVLSFSLGTSILTPWKNVYSRLPKRIYSKILATSEMDVKFKAKILISQVWNAIVISMYREHLLSIEHLQRLLFQQVDSLMGDTRTLKSPTFFVAQDDSTFKSMEFFPSNSEAKRRISFFAQSLATPISEPVPVDCMPTFTVLVPHYSEKILLGLKEIIREESPKSKITVLEYLKHLHPTEWECFVKDTKLLSMEKSFLKEAESSHDEDRLEIPDALYDPRSSPLSDHTESRKLPTEDDLIKEKINDLPFSYFGFNSSEPSYTLRTRIWASLRTQTLYRTLSGFMNYSKAIKLLYRIENPSLVSLYRGNNEALENDLENMASRKFRMVVAMQRYAKFNKDEVEATELLLRAYPNMFISYLLEELEQNESEKTYYSCLTNGYAEFDEESGLRKPIFKIRLSGNPILGDGKSDNQNHSIIFYRGEYIQVIDANQDNYLEECLKIRSVLSEFEELELNPTIPYIPGIEYEEEPPPIAIVGSREYIFSENIGVLGDIAAGKEQTFGTLFARTLAEIGGKLHYGHPDFLNGIFMTTRGGLSKAQRGLHLNEDIYAGMNAICRGGKIKHSDYYQCGKGRDLGFGSILNFTTKIGAGMGEQLLSREYYYLGTQLPMDRFLSFFYAHPGFHLNNLFISFSVQLFFVLLLNLGALNHEIIACFYDKDAPITNLETPVGCYNIQPALHWVSIFVLSIFIVFFIAFAPLLIQEVLEKGIWRAASRFLHHLLSMAPLFEVFVCQVYSNSLLMDLTFGGAKYISTGRGFAITRLDFFTLYSRFVNISIYSGFQVFFMLLFAIISMWQPALLWFWITVISMCFAPFIFNPHQFAFMDFFIDYKTFIHWLFSGNTKYQKESWANFVKSSRSRFTGYKSKTVDDISEDSGHDSKKARFWNVFFAELFLPFCVFLFNFTAFSFINAQTGVSDSTPTSAVFRLLLVTFLPIFLNSIVLFLLFWVSLFVVPGLSYCCKDAGAVIAFIAHTFSVLVYLLDFELMWFLQGWNFTRTLILLITCINMHLILFKVFTTIFLTREYKNNKAHLAWWNGKWYNTGMGWSIILQPIREYFVKIMESSYFAADFFLGHFLLFIQTPIILLPFIDYWHTMVLFWMNPRSIIAHKRILTRKQRALRSRIVSKYFSLYFVMLGVLLFMLIAPFFAGDFVSSPQELLEGTLFEGIFQPNNQNNNDTGPNAPSTILTTTPTLPTFRTVA

SEQ ID NO: 1931 - protein, 234 aa, Saccharomyces cerevisiae
MFRNNYDGDTVTFSPTGRLFQVEYALEAIKQGSVTVGLRSNTHAVLVALKRNADELSSYQKKIIKCDEHMGLSLAGLAPDARVLSNYLRQQCNYSSLVFNRKLAVERAGHLLCDKAQKNTQSYGGRPYGVGLLIIGYDKSGAHLLEFQPSGNVTELYGTAIGARSQGAKTYLERTLDTFIKIDGNPDELIKAGVEAISQSLRDESLTVDNLSIAIVGKDTPFTIYDGEAVAKYI

SEQ ID NO: 1932 - protein, 360 aa, Saccharomyces cerevisiae
MSYPEKFEGIAIQSHEDWKNPKKTKYDPKPFYDHDIDIKIEACGVCGSDIHCAAGHWGNMKMPLVVGHEIVGKVVKLGPKSNSGLKVGQRVGVGAQVFSCLECDRCKNDNEPYCTKFVTTYSQPYEDGYVSQGGYANYVRVHEHFVVPIPENIPSHLAAPLLCGGLTVYSPLVRNGCGPGKKVGIVGLGGIGSMGTLISKAMGAETYVISRSSRKREDAMKMGADHYIATLEEGDWGEKYFDTFDLIVVCASSLTDIDFNIMPKAMKVGGRIVSISIPEQHEMLSLKPYGLKAVSISYSALGSIKELNQLLKLVSEKDIKIWVETLPVGEAGVHEAFERMEKGDVRYRFTLVGYDKEFSD

SEQ ID NO: 1933 - protein, 437 aa, Saccharomyces cerevisiae [sequence omitted]

SEQ ID NO: 1934 - protein, 433 aa, Saccharomyces cerevisiae
MVYEATPFDPITVKPSDKRRVAYFYDADVGNYAYGAGHPMKPHRIRMAHSLIMNYGLYKKMEIYRAKPATKQEMCQFHTDEYIDFLSRVTPDNLEMFKRESVKFNVGDDCPVFDGLYEYCSISGGGSMEGAARLNRGKCDVAVNYAGGLHHAKKSEASGFCYLNDIVLGIIELLRYHPRVLYIDIDVHHGDGVEEAFYTTDRVMTCSFHKYGEFFPGTGELRDIGVGAGKNYAVNVPLRDGIDDATYRSVFEPVIKKIMEWYQPSAVVLQCGGDSLSGDRLGCFNLSMEGHANCVNYVKSFGIPMMVVGGGGYTMRNVARTWCFETGLLNNVVLDKDLPYNEYYEYYGPDYKLSVRPSNMFNVNTPEYLDKVMTNIFANLENTKYAPSVQLNHTPRDAEDLGDVEEDSAEAKDTKGGSQYARDLHVEHDNEFY

SEQ ID NO: 1935 - protein, 1041 aa, Saccharomyces cerevisiae
MNKLLLHLVRVISILGLANALTQTQPILKDIQITDSYTKTKECTDPDHWFIIEGQLSIPKGSQQNITFQVPDAFSSFPQEPFSIKHNSNSVATISRPDKSTNNFTISIPEKSSEDITTTFNFLAQLTSDAKSKVTEPKSIVYSFYSENTMFNDVIDYVAKNTSAITTDGGIYKTNNTAWFTVDLPMRTFRNPVYLTSQTSSSSDYVFDTSLTKFEVVTAVDSFNEPINAIPYTTVHDYSTEDEIRCLFNSTISGGLYFRVTYFTKKLSTSSISNTVELTYPDEGTSVRLLGKRDTSTTLASELYSESAANIDSTTSDDTTSSDAAITPTYSNSTLSSYTSQSSAIPEVAVTASLSSGILSSTVDGASTSADASMSAVSTVSSSSEQASSSSISLSAPSSSNSTFTTPSSSLSATETYSIISSASISVTQASYIDNSTTTAVTQSTSTIAVSSAEKLSSTLSYTSNVTISVSSATQHTTTPSYVSNSTTLSSSSVLESVISSPYLANTTVSGASSASQSTNPPYVSNSTTSSATQLATIAPFAINITGTSISSSITNTSSVSSTTSSLSSGPFVSNTAVASGSYILTTTTESAQLTEIGSLIPISTITTSTTTSGTDKTGSNKVASSTEIAQSIVNNSSLSVSTINTNAATAAANARNATFTHATHSGSLQPSYHSSSLLSSTIDTKVTTATTSTSRDGSSSLAFTTGLNQSVVTGTDKSDTYSVISSTESAQVTEYDSLLPISTLKPTVVTGTSRNSTFSMVSSTKLTEATATDKGDAYSVISSTQSAQVTEYGSMLPISTLETPTVIMSTDESGYFTLTTCTESGQATEYGSLIPISTLDGSVIYTFTGESVVVGYSTTVGAAQYAQHTSLVPVSTIKGSKTSLSTEESVVAGYSTTVGAAQYAQHTSLVPVSTIKGSKTSLSTEESVVAGYSTTVDSAQYAEHTNLVAIDTLKTSTFQKATATEVCVTCTALSSPHSATLDAGTTISLPTSSSTSLSTIITWYSSSTIKPPSISTYSGAAGQLTIRIGSLLLGLISFLL

SEQ ID NO: 1936 - protein, 540 aa, Saccharomyces cerevisiae
MTAQIPYQHSSGYISHFHNNELDAGRGRDYNVTIKYLDDKEENIEGQAAKISHNASLHIPVLLCLVISLGGFIFGWDIGTIGGMTNMVSFQEKFGTTNIIHDDETIFVSTKKLTDLQIGLIISIFNISCGVGALTLSKIGDWIGRKGGIWFALVVYCIGITIQILSYGRWYFLTLGRAVTGIGVGVTTVLVPMFLSENSPLKIRGSMVSTYQLIVTFGILMGNILNFICERCYKDPTQNIAWQLPLFLGYIWAIIIGMSLVYVPESPQYLAKIKNDVPSAKYSFARMNGIPATDSMVIEFIDDLLENNYNNEETNNESKKQSLVKRNTFEFIMGKPKLWLRLIIGMMIMAFQQLSGINYFFYYGTSVFKGVGIKDPYITSIILSSVNFLSTILGIYYVEKWGHKTCLLYGSTNLLFYMMTYATVGTFGRETDFSNIVLIIVTCCFIFWFAITLGPVTFVLVSELFPLRTRAISMAICTFINWMFNFLISLLTPMIVSKIDFKLGYIFAACLLALIIFSWILVPETRKKNEQEINKIFEPE

SEQ ID NO: 1937 - protein, 273 aa, Saccharomyces cerevisiae
MATYQPYNEYSSVTGGGFENSESRPGSGESETNTRVNTLTPVTIKQILESKQDIQDGPFVSHNQELHHVCFVGVVRNITDHTANIFLTIEDGTGQIEVRKWSEDANDLAAGNDDSSGKGYGSQVAQQFEIGGYVKVFGALKEFGGKKNIQYAVIKPIDSFNEVLTHHLEVIKCHSIASGMMKQPLESASNNNGQSLFVKDDNDTSSGSSPLQRILEFCKKQCEGKDANSFAVPIPLISQSLNLDETTVRNCCTTLTDQGFIYPTFDDNNFFAL

SEQ ID NO: 1938 - protein, 375 aa, Saccharomyces cerevisiae
MSTEEQNGVPLQRGSEFIADDVTSNKSNNTRRMLVKEYRKIGRGAFGTVVQAYLTQDKKNWLGPFAIKKVPAHTEYKSRELQILRIADHPNIVKLQYFFTHLSPQDNKVYQHLAMECLPETLQIEINRYVTNKLEMPLKHIRLYTYQIARGMLYLHGLGVCHRDIKPSNVLVDPETGVLKICDFGSAKKLEHNQPSISYICSRFYRAPELIIGCTQYTTQIDIWGLGCVMGEMLIGKAIFQGQEPLLQLREIAKLLGPPDKRFIFFSNPAYDGPLFSKPLFSGSSQQRFEKYFGHSGPDGIDLLMKILVYEPQQRLSPRRILAHQFFNELRNDDTFLPRGFTEPIKLPNLFDFNDFELQILGEFADKIKPTKVAE

SEQ ID NO: 1939 - protein, 625 aa, Saccharomyces cerevisiae
MTRLKAKYSPTKGKRKEDKHTKRMRKSSFTRTQKMLEVFNDNRSHFNKYESLAIDVEDDDTFGNLVLMENDKSDVDIPVIEEVTSSEDEQRAESSKRNNSLEDNQDFIAFSDSSEDETEQIKEDDDERSSFLLTDEHEVSKLTSQQSLNTESACNVEYPWIRNHCHSKQRRIADWLTSEIKDFVHYISPSKNEIKCRNRTIDKLRRAVKELWSDADLHVFGSFATDLYLPGSDIDCVVNSRNRDKEDRNYIYELARHLKNKGLAIRMEVIVKTRVPIIKFIEPQSQLHIDVSFERTNGLEAAKLIREWLRDSPGLRELVLIIKQFLHSRRLNNVHTGGLGGFTVICLVYSFLNMHPRIKSNDIDVLDNLGVLLIDFFELYGKNFGYDDVAISISDGYASYIPKSCWRTLEPSRSKFSLAIQDPGDPNNNISRGSFNMKDIKKAFAGAFELLVNKCWELNSATFKDRVGKSILGNVIKYRGQKRDFNDERDLVQNKAIIENERYHKRRTRIVQEDLFINDTEDLPVEEIYKLDEPAKKKQKAKKDKREGEIKKSAIPSPPPDFGVSRSKLKRKVKKTDQGSLLHQNNLSIDDLMGLSENDQESDQDQKGRDTLRDKMRNHHWKLRQ

SEQ ID NO: 1940 - protein, 842 aa, Saccharomyces cerevisiae
MSLSAAANKISDNDFQNIGPAPRPPSSNSQGRTCYNQTQPITKLMSQLDLTSASHLGTSTSKKKSGWVSYKDDGILSFIWQKRYLMLHDSYVALYKNDKQNDDAILKIPLTSIISVSRTQLKQYCFELVRCSDRNSVSSGSSSSLNVSSDSNSKKSIYIATKTESDLHSWLDAIFAKCPLLSGVSSPTNFTHKVHVGFDPETGSFVGMPTNWEKLLKHSRITGEDWNNNSAAVIQVLQFYQEYNGAGNPTNTLDKPQSGETSSSQKSLPNSYNDNKLRNNSVNSKSSSGVSSSMVSQRKTSQPPNTKSPVSLGSGSLPPINTKLPTSQSNIPRHLQNVPNQQYPKMRNGHSPTNGQFPRGPMHPNNSQRSLQQQQQQQQQQKQQHQQYPYHHQGPSPSPSPSPSPLNPYRPHHNMINPYSKQPQSPLSSQSTQNQAIPRYAQNSSPTAAHFQPQRTAPKPPISAPRAPYPSNQNATSNTHVQPVAPKNDQSTPQTMRQAPKRPDADVAQPGGVAKPKKPARPTMSTAEIMSKLKKVTVNADPSQCFKVIEKAGQGASGSVYLAERTHIPTESNMIELINNDIDEPHVGDKVAIKQMVLSKQPRKELIVNEILVMKDSRHKNIVNFLEAYLRTDDDLWVVMEFMEGGSLTDIIENSPTNDNSHSPLTEPQIAYIVRETCQGLKFLHDKHIIHRDIKSDNVLLDTRARVKITDFGFCARLTDKRSKRATMVGTPYWMAPEVVKQREYDEKIDVWSLGIMTIEMLEGEPPYLNEDPLKALYLIATNGTPKLKHPESLSLEIKRFLSVCLCVDVRYRASTEELLHHGFFNMACDPKDLTSLLEWKE

SEQ ID NO: 1941 - protein, 340 aa, Saccharomyces cerevisiae
MSTSTEKRSKENLPWVEKYRPETLDEVYGQNEVITTVRKFVDEGKLPHLLFYGPPGTGKTSTIVALAREIYGKNYSNMVLELNASDDRGIDVVRNQIKDFASTRQIFSKGFKLIILDEADAMTNAAQNALRRVIERYTKNTRFCVLANYAHKLTPALLSRCTRFRFQPLPQEAIERRIANVLVHEKLKLSPNAEKALIELSNGDMRRVLNVLQSCKATLDNPDEDEISDDVIYECCGAPRPSDLKAVLKSILEDDWGTAHYTLNKVRSAKGLALIDLIEGIVKILEDYELQNEETRVHLLTKLADIEYSISKGGNDQIQGSAVIGAIKASFENETVKANV

SEQ ID NO: 1942 - protein, 279 aa, Saccharomyces cerevisiae
MCEYSKALHILLKSPVTDDIIKFLTDTTLRVVPSSNYPTPPGSPGEKHLTRLPSLMTFITRLVRYTNVYTPTLLTAACYLNKLKRILPRDATGLPSTIHRIFLACLILSAKFHNDSSPLNKHWARYTDGLFTLEDINLMERQLLQLLNWDLRVNTEDLILDLQPLLEPIKQDLARSSDQRKRINMMMSMNRRTCAGTSPIRSNNRFKLYEKQRNVSIASDLSSATLVDSCNDLRRLKDVTNIANNTVANTNYVRTVEKWNDNVNRQSWDLEQIMSQHGF

SEQ ID NO: 1943 - protein, 503 aa, Saccharomyces cerevisiae
MHLDLIHKSFILVWLIYIRAALADQFTYKACYSASDIRKLGLTYKGVYEYQSVSYCQNECPGQAVVALFNGTGCYCGGSVAQLQSLTQVDSSKCDVSCAGWPYQNCGGSSAMNVYINNAASTADSTSSTATSTSTTSSSSTSVSSKTSTKLDTKTSTSSSATHSSSSSSTTSTTTSSSETTTSSSSSSSSSSTSTTSTTSTTSSTTSTSSSPSTTSSSTSASSSSETSSTQATSSSTTSTSSSTSTATVTSTPSSTSIGTSTHYTTRVVTQSVVSQANQQASTIFTTRTSVYATVSSTSSSTSSLLNGKSSSSKSKGLSGGAIAGVVVGVVCGTVALLALALFFFVWKKRRQSSQHVDLEETKQYQPYSLGDADANPVIPPSASSTNWHIPSRNNTALSKNTASTFATYDLPTRAPGGRDSIITGDAHNISKRSHFPSVVYEEPPSIYNGNQRFSATSLPDMMEERQLHIVNPDNVSSNIGSNVSDGDDDYDDAKDSNNSSLR

SEQ ID NO: 1944 - protein, 438 aa, Saccharomyces cerevisiae
MVSALNPRTTEFEFGGLIGALGISIGLPVFTIILNQMIRPDYFIKGFFQNFDIVELWNGIKPLRYYLGNRELWTVYCLWYGILAVLDVILPGRVMKGVQLRDGSKLSYKINGIAMSTTLVLVLAIRWKLTDGQLPELQYLYENHVSLCIISILFSFFLATYCYVASFIPLIFKKNGNGKREKILALGGNSGNIIYDWFIGRELNPRLGPLDIKMFSELRPGMLLWLLINLSCLHHHYLKTGKINDALVLVNFLQGFYIFDGVLNEEGVLTMMDITTDGFGFMLAFGDLSLVPFTYSLQARYLSVSPVELGWVKVVGILAIMFLGFHIFHSANKQKSEFRQGKLENLKSIQTKRGTKLLCDGWWAKSQHINYFGDWLISLSWCLATWFQTPLTYYYSLYFATLLLHRQQRDEHKCRLKYGENWEEYERKVPYKIIPYVY

SEQ ID NO: 1945 - protein, 1953 aa, Saccharomyces cerevisiae
MLKNSGSKHSNSKESHSNSSSGIFQNLKRLANSNATNSNTGSPTYASQQQHSPVGNEVSTSPASSSSFRKLNAPSRSTSTEARPLNKKSTLNTQNLSQYMNGKLSGDVPVSSQHARSHSMQSKYSYSKRNSSQASNKLTRQHTGQSHSASSLLSQGSLTNLSKFTTPDGKIYLEMPSDPYEVEVLFEDIMYKRNIFQSLSEDKQEALMGYSIEKKWLIVKQDLQNELKKMRANTTSSSTASRTSMASDHHPILTANSSLSSPKSVLMTSASSPTSTVYSNSLNHSTTLSSVGTSTSKGKKLVSGSLKKQPSLNNIYRGGAENNTSASTLPGDRTNRPPIHYVQRILADKLTSDEMKDLWVTLRTEQLDWVDAFIDHQGHIAMANVLMNSIYKTAPRENLTKELLEKENSFFKCFRVLSMLSQGLYEFSTHRLMTDTVAEGLFSTKLATRKMATEIFVCMLEKKNKSRFEAVLTSLDKKFRIGQNLHMIQNFKKMPQYFSHLTLESHLKIIQAWLFAVEQTLDGRGKMGSLVGASDEFKNGGGENAILEYCQWTMVFINHLCSCSDNINQRMLLRTKLENCGILRIMNKIKLLDYDKVIDQIELYDNNKLDDFNVKLEANNKAFNVDLHDPLSLLKNLWDICKGTENEKLLVSLVQHLFLSSSKLIEENQNSSKLTKQLKLMDSLVTNVSVASTSDEETNMNMAIQRLYDAMQTDEVARRAILESRALTKKLEEIQAERDSLSEKLSKAEHGLVGQLEDELHERDRILAKNQRVMQQLEAELEELKKKHLLEKHQQEVELRKMLTILNSRPEESFNKNEGTRGMNSSLNSSEKANIQKVLQDGLSRAKKDYKDDSKKFGMTLQPNKRLKMLRMQMENIENEARQLEMTNFAEFEKDRLEPPIHIKKPKVKKMKNKDRKPLVKPQEADVNKLNDLRRALTEIQMESNDISKFNVEERVNELFNEKKSLALKRLKELETKYKGFGIDFNVDEIMDSPKKNTGDVETEEDANYASLDPKTYQKKLDEINRITDQLLDIQTQTEHEIQVEEDGESDLSSSSSDDESEEIYQDASPTQELRSEHSELSSGSGPGSFLDALSQKYGTGQNVTASAAFGENNNGSGIGPLHSKVEKTFMNRLRKSTVSSAPYLEELTQKVNKVEPYEQNEDEGLDKKSLPENSTASAASAFDKAEKDMRQHVENGKQGRVVNHEEDKTADFSAVSKLNNTDGAEDLSTQSSVLSSQPPPPPPPPPPVPAKLFGESLEKEKKSEDDTVKQETTGDSPAPPPPPPPPPPPPMALFGKPKGETPPPPPLPSVLSSSTDGVIPPAPPMMPASQIKSAVTSPLLPQSPSLFEKYPRPHKKLKQLHWEKLDCTDNSIWGTGKAEKFADDLYEKGVLADLEKAFAAREIKSLASKRKEDLQKITFLSRDISQQFGINLHMYSSLSVADLVKKILNCDRDFLQTPSVVEFLSKSEIIEVSVNLARNYAPYSTDWEGVRNLEDAKPPEKDPNDLQRADQIYLQLMVNLESYWGSRMRALTVVTSYEREYNELLAKLRKVDKAVSALQESDNLRNVFNVILAVGNFMNDTSKQAQGFKLSTLQRLTFIKDTTNSMTFLNYVEKIVRLNYPSFNDFLSELEPVLDVVKVSIEQLVNDCKDFSQSIVNVERSVEIGNLSDSSKFHPLDKVLIKTLPVLPEARKKGDLLEDEVKLTIMEFESLMHTYGEDSGDKFAKISFFKKFADFINEYKKAQAQNLAAEEEERLYIKHKKIVEEQQKRAQEKEKQKENSNSPSSEGNEEDEAEDRRAVMDKLLEQLKNAGPAKSDPSSARKRALVRKKYLSEKDNAPQLLNDLDTEEGSILYSPEAMDPTADTVIHAESPTPLATRGVMNTSEDLPSPSKTSALEDQEEISDRARMLLKELRGSDTPVKQNSILDEHLEKLRARKERSIGEASTGNRLSFK

SEQ ID NO: 1946 - protein, 573 aa, Saccharomyces cerevisiae
MDETVNIQMSKEGQYEINSSSIIKEEEFVDEQYSGENVTKAITTERKVEDDAAKETESSPQERREVKRKLKQRHIGMIALGGTIGTGLIIGIGPPLAHAGPVGALISYLFMGTVIYSVTQSLGEMVTFIPVTSSFSVFAQRFLSPALGATNGYMYWLSWCFTFALELSVLGKVIQYWTEAVPLAAWIVIFWCLLTSMNMFPVKYYGEFEFCIASIKVIALLGFIIFSFCVVCGAGQSDGPIGFRYWRNPGAWGPGIISSDKNEGRFLGWVSSLINAAFTYQGTELVGITAGEAANPRKALPRAIKKVVVRILVFYILSLFFIGLLVPYNDPKLDSDGIFVSSSPFMISIENSGTKVLPDIFNAVVLITILSAGNSNVYIGSRVLYSLSKNSLAPRFLSNVTRGGVPYFSVLSTSVFGFLAFLEVSAGSGKAFNWLLNITGVAGFFAWLLISFSHIRFMQAIRKRGISRDDLPYKAQMMPFLAYYASFFIALIVLIQGFTAFAPTFQPIDFVAAYISIFLFLAIWLSFQVWFKCRLLWKLQDIDIDSDRRQIEELVWIEPECKTRWQRVWDVLS

SEQ ID NO: 1947 - protein, 611 aa, Saccharomyces cerevisiae
MGRFSNIITSNKWDEKQNNIGEQSMQELPEDQIEHEMEAIDPSNKTTPYSIDEKQYNTKKKHGSLQGGAIADVNSITNSLTRLQVVSHETDINEDEEEAHYEDKHVKRALKQRHIGMIALGGTIGTGLFVGISTPLSNAGPVGSLIAYIFMGTIVYFVTQSLGEMATFIPVTSSITVFSKRFLSPAFGVSNGYMYWFNWAITYAVEVSVIGQVIEYWTDKVPLAAWIAIFWVIITLMNFFPVKVYGEFEFWVASVKVLAIMGYLIYALIIVCGGSHQGPIGFRYWRNPGAWGPGIISSDKSEGRFLGWVSSLINAAFTYQGTELVGITAGEAANPRKTVPRAINKVVFRIVLFYIMSLFFIGLLVPYNDSRLSASSAVIASSPFVISIQNAGTYALPDIFNAVVLITVVSAANSNVYVGSRVLYSLARTGNAPKQFGYVTRQGVPYLGVVCTAALGLLAFLVVNNNANTAFNWLINISTLAGLCAWLFISLAHIRFMQALKHRGISRDDLPFKAKLMPYGAYYAAFFVTVIIFIQGFQAFCPFKVSEFFTSYISLILLAVVFIGCQIYYKCRFIWKLEDIDIDSDRREIEAIIWEDDEPKNLWEKFWAAVA

SEQ ID NO: 1948 - protein, 1066 aa, Saccharomyces cerevisiae
MHKASSSKKSFDDTIELKKNEQLLKLINSSEFTLHNCVELLCKHSENIGIHYYLCQKLATFPHSELQFYIPQLVQVLVTMETESMALEDLLLRLRAENPHFALLTFWQLQALLTDLSTDPASYGFQVARRVLNNLQTNLFNTSSGSDKNVKIHENVAPALVLSSMIMSAIAFPQLSEVTKPLVESQGRRQKAFVFKLARSAMKDFTKNMTLKNTLLNKKTSRSKRVSSNRSSTPTSPIDLIDPIKTKEDASFRKSRHSEVKLDFDIVDDIGNQVFEERISSSIKLPKRKPKYLDNSYVHRTYDGKNINRDGSISNTAKALDGNKGDYISPKGRNDENNEIGNNEDETGGETEEDADALNSDHFTSSMPDLHNIQPRTSSASSASLEGTPKLNRTNSQPLSRQAFKNSKKANSSLSQEIDLSQLSTTSKIKMLKANYFRCETQFAIALETISQRLARVPTEARLSALRAELFLLNRDLPAEVDIPTLLPPNKKGKLHKLVTITANEAQVLNSAEKVPYLLLIEYLRDEFDFDPTSETNERLLKKISGNQGGLIFDLNYMNRKENNENRNESTLTSNNTRSSVYDSNSFNNGASRNEGLSSTSRSDSASTAHVRTEVNKEEDLGDMSMVKVRNRTDDEAYRNALVIQSAANVPILPDDSQDRSPELNFGSNLDEVLIENGINSKNIHSQTDALADQMRVSAVMLAQLDKSPQQLSESTKQIRAQIISSMKEVQDKFGYHDLEALHGMAGERKLENDLMTGGIDTSYLGEDWATKKERIRKTSEYGHFENWDLCSVIAKTGDDLRQEAFAYQMIQAMANIWVKEKVDVWVKRMKILITSANTGLVETITNAMSVHSIKKALTKKMIEDAELDDKGGIASLNDHFLRAFGNPNGFKYRRAQDNFASSLAAYSVICYLLQVKDRHNGNIMIDNEGHVSHIDFGFMLSNSPGSVGFEAAPFKLTYEYIELLGGVEGEAFKKFVELTKSSFKALRKYADQIVSMCEIMQKDNMQPCFDAGEQTSVQLRQRFQLDLSEKEVDDFVENFLIGKSLGSIYTRIYDQFQLITQGIYS

SEQ ID NO: 1949 - protein, 479 aa, Saccharomyces cerevisiae
MNVTTPEVAFREYQTNCLASYISADPDITPSNLILQGYSGTGKTYTLKKYFNANPNLHAVWLEPVELVSWKPLLQAIARTVQYKLKTLYPNIPTTDYDPLQVEEPFLLVKTLHNIFVQYESLQEKTCLFLILDGFDSLQDLDAALFNKYIKLNELLPKDSKINIKFIYTMLETSFLQRYSTHCIPTVMFPRYNVDEVSTILVMSRCGELMEDSCLRKRIIEEQITDCTDDQFQNVAANFIHLIVQAFHSYTGNDIFALNDLIDFKWPKYVSRITKENIFEPLALYKSAIKLFLSTDDNLSENGQGESAITTNRDDLENSQTYDLSIISKYLLIASYICSYLEPRYDASIFSRKTRIIQGRAAYGRRKKKEVNPRYLQPSLFAIERLLAIFQAIFPIQGKAESGSLSALREESLMKANIEVFQNLSELHTLKLIATTMNKNIDYLSPKVRWKVNVPWEIIKEISESVHFNISDYFSDIHE

SEQ ID NO: 1950 - protein, 1312 aa, Saccharomyces cerevisiae
MSAIYKLSIQGIRSFDSNDRETIEFGKPLTLIVGMNGSGKTTIIECLKYATTGDLPPNSKGGVFIHDPKITGEKDIRAQVKLAFTSANGLNMIVTRNIQLLMKKTTTTFKTLEGQLVAINNSGDRSTLSTRSLELDAQVPLYLGVPKAILEYVIFCHQEDSLWPLSEPSNLKKKFDEIFQAMKFTKALDNLKSIKKDMSVDIKLLKQSVEHLKLDKDRSKAMKLNIHQLQTKIDQYNEEVSEIESQLNEITEKSDKLFKSNQDFQKILSKVENLKNTKLSISDQVKRLSNSIDILDLSKPDLQNLLANFSKVLMDKNNQLRDLETDISSLKDRQSSLQSLSNSLIRRQGELEAGKETYEKNRNHLSSLKEAFQHKFQGLSNIENSDMAQVNHEMSQFKAFISQDLTDTIDQFAKDIQLKETNLSDLIKSITVDSQNLEYNKKDRSKLIHDSEELAEKLKSFKSLSTQDSLNHELENLKTYKEKLQSWESENIIPKLNQKIEEKNNEMIILENQIEKFQDRIMKTNQQADLYAKLGLIKKSINTKLDELQKITEKLQNDSRIRQVFPLTQEFQRADLEMDFQKLFINMQKNIAINNKKMHELDRRYTNALYNLNTIEKDLQDNQKSKEKVIQLLSENLPEDCTIDEYNDVLEETELSYKTALENLKMHQTTLEFNRKALEIAERDSCCYLCSRKFENESFKSKLLQELKTKTDANFEKTLKDTVQNEKEYLHSLRLLEKHIITLNSINEKIDNSQKCLEKAKEETKTSKSKLDELEVDSTKLKDEKELAESEIRPLIEKFTYLEKELKDLENSSKTISEELSIYNTSEDGIQTVDELRDQQRKMNDSLRELRKTISDLQMEKDEKVRENSRMINLIKEKELTVSEIESSLTQKQNIDDSIRSKRENINDIDSRVKELEARIISLKNKKDEAQSVLDKVKNERDIQVRNKQKTVADINRLIDRFQTIYNEVVDFEAKGFDELQTTIKELELNKAQMLELKEQLDLKSNEVNEEKRKLADSNNEEKNLKQNLELIELKSQLQHIESEISRLDVQNAEAERDKYQEESLRLRTRFEKLSSENAGKLGEMKQLQNQIDSLTHQLRTDYKDIEKNYHKEWVELQTRSFVTDDIDVYSKALDSAIMKYHGLKMQDINRIIDELWKRTYSGTDIDTIKIRSDEVSSTVKGKSYNYRVVMYKQDVELDMRGRCSAGQKVLASIIIRLALSETFGANCGVIALDEPTTNLDEENIESLAKSLHNIINMRRHQKNFQLIVITHDEKFLGHMNAAAFTDHFFKVKRDDRQKSQIEWVDINRVTY

SEQ ID NO: 1951 - protein, 968 aa, Saccharomyces cerevisiae
MSRIDSDLQKALKKACSVEETAPKRKHVRACIVYTWDHQSSKAVFTTLKTLPLANDEVQLFKMLIVLHKIIQEGHPSALAEAIRDRDWIRSLGRVHSGGSSYSKLIREYVRYLVLKLDFHAHHRGFNNGTFEYEEYVSLVSVSDPDEGYETILDLMSLQDSLDEFSQIIFASIQSERRNTECKISALIPLIAESYGIYKFITSMLRAMHRQLNDAEGDAALQPLKERYELQHARLFEFYADCSSVKYLTTLVTIPKLPVDAPDVFLINDVDESKEIKFKKREPSVTPARTPARTPTPTPPVVAEPAISPRPVSQRTTSTPTGYLQTMPTGATTGMMIPTATGARNAIFPQATAQMQPDFWANQQAQFANEQNRLEQERVQQLQQQQAQQELFQQQLQKAQQDMMNMQLQQQNQHQNDLIALTNQYEKDQALLQQYDQRVQQLESEITTMDSTASKQLANKDEQLTALQDQLDVWERKYESLAKLYSQLRQEHLNLLPRFKKLQLKVNSAQESIQKKEQLEHKLKQKDLQMAELVKDRDRARLELERSINNAEADSAAATAAAETMTQDKMNPILDAILESGINTIQESVYNLDSPLSWSGPLTPPTFLLSLLESTSENATEFATSFNNLIVDGLAHGDQTEVIHCVSDFSTSMATLVTNSKAYAVTTLPQEQSDQILTLVKRCAREAQYFFEDLMSENLNQVGDEEKTDIVINANVDMQEKLQELSLAIEPLLNIQSVKSNKETNPHSELVATADKIVKSSEHLRVDVPKPLLSLALMIIDAVVALVKAAIQCQNEIATTTSIPLNQFYLKNSRWTEGLISAAKAVAGATNVLITTASKLITSEDNENTSPEQFIVASKEVAASTIQLVAASRVKTSIHSKAQDKLEHCSKDVTDACRSLGNHVMGMIEDDHSTSQQQQPLDFTSEHTLKTAEMEQQVEILKLEQSLSNARKRLGEIRRHAYYNQDDD

SEQ ID NO: 1952 - protein, 505 aa, Saccharomyces cerevisiae
MSEGPVKFEKNTVISVFGASGDLAKKKTFPALFGLFREGYLDPSTKIFGYARSKLSMEEDLKSRVLPHLKKPHGEADDSKVEQFFKMVSYISGNYDTDEGFDELRTQIEKFEKSANVDVPHRLFYLALPPSVFLTVAKQIKSRVYAENGITRVIVEKPFGHDLASARELQKNLGPLFKEEELYRIDHYLGKELVKNLLVLRFGNQFLNASWNRDNIQSVQISFKERFGTEGRGGYFDSIGIIRDVMQNHLLQIMTLLTMERPVSFDPESIRDEKVKVLKAVAPIDTDDVLLGQYGKSEDGSKPAYVDDDTVDKDSKCVTFAAMTFNIENERWEGVPIMMRAGKALNESKVEIRLQYKAVASGVFKDIPNNELVIRVQPDAAVYLKFNAKTPGLSNATQVTDLNLTYASRYQDFWIPEAYEVLIRDALLGDHSNFVRDDELDISWGIFTPLLKHIERPDGPTPEIYPYGSRGPKGLKEYMQKHKYVMPEKHPYAWPVTKPEDTKDN

SEQ ID NO: 1953 - protein, 814 aa, Saccharomyces cerevisiae
MKVRKYITLCFWWAFSTSALVSSQQIPLKDHTSRQYFAVESNETLSRLEEMHPNWKYEHDVRGLPNHYVFSKELLKLGKRSSLEELQGDNNDHILSVHDLFPRNDLFKRLPVPAPPMDSSLLPVKEAEDKLSINDPLFERQWHLVNPSFPGSDINVLDLWYNNITGAGVVAAIVDDGLDYENEDLKDNFCAEGSWDFNDNTNLPKPRLSDDYHGTRCAGEIAAKKGNNFCGVGVGYNAKISGIRILSGDITTEDEAASLIYGLDVNDIYSCSWGPADDGRHLQGPSDLVKKALVKGVTEGRDSKGAIYVFASGNGGTRGDNCNYDGYTNSIYSITIGAIDHKDLHPPYSEGCSAVMAVTYSSGSGEYIHSSDINGRCSNSHGGTSAAAPLAAGVYTLLLEANPNLTWRDVQYLSILSAVGLEKNADGDWRDSAMGKKYSHRYGFGKIDAHKLIEMSKTWENVNAQTWFYLPTLYVSQSTNSTEETLESVITISEKSLQDANFKRIEHVTVTVDIDTEIRGTTTVDLISPAGIISNLGVVRPRDVSSEGFKDWTFMSVAHWGENGVGDWKIKVKTTENGHRIDFHSWRLKLFGESIDSSKTETFVFGNDKEEVEPAATESTVSQYSASSTSISISATSTSSISIGVETSAIPQTTTASTDPDSDPNTPKKLSSPRQAMHYFLTIFLIGATFLVLYFMFFMKSRRRIRRSRAETYEFDIIDTDSEYDSTLDNGTSGITEPEEVEDFDFDLSDEDHLASLSSSENGDAEHTIDSVLTNENPFSDPIKQKFPNDANAESASNKLQELQPDVPPSSGRS

SEQ ID NO: 1954 - protein, 892 aa, Saccharomyces cerevisiae
MSDSISDSKSSELLNSTFYSSTSINTLDHARTFRNSLILKEISDQSLNSSIKPCESVLDRDVESSVLQRSFGESNARDSEVQTVNMTTSPSLSALADILNERSKYADQKTRKAQNIESSIIEEEEEAEEQNNSINYHEDITGSRLSVREEANENLAMTSPNLIDIDGSNSIQVAPLSLPSFEEPDFLSTPRVKPDSQGPRSKVSTRRTILERDNNLPVKREENTIINSETESTTHSAPFLKEDPKPSPPSSKLYNPKVRLNKAEARKYTDSSAQRTTSAGSVLEDTSMHKKKKSIFSFLKKKEPKPVIGNNSVTNEKNKMSSSSTFSMNIQTSLKTPEKLKKKSHSSSSIFNSFLKGKIETSDSPRKEPMRQKKRTPKSKDKKQDTEQIIDAASVLSTESPLLRKNHDDTPVKIDHVTRSIDQRKPTPLNMDLILGGDKQINTPLQEHVREDDDAKNDLQLPTKDNFLSLDYEAPSPAFSKHDTGEVLFPKFLDNHEVDSIVSLERTRSTKSNKRSSMNSQRRSLTDTLSIKAQSEGMFITEASSVVLSTPDLTKSPASSILKNGRFEYSDNFSREHSYEGTTNEDFLDIKDDSGPLKKDDIFLESIEQKFDQLVMASDEEKTEVERDVPKPREEPLKKDSERQSVFADDDNELISDIMEFASFINFGDDDLNLDLDLGDTTASYATETPEPVGNDEVNRSGTFDTRNNKEDSYKERETQSYSAAGATTYGDERQGQLHTFEQDGSEINDNEFENEDFNKHIEQPIEVTPRNNAYLPEFEPNRPVSMSFKGLKAPRMNTSFIDSMTPDSPVKSDLTSLGEVYVNSNNDQGVRFSSQIILYDTYGEFEYDRHPEISTCNQLTPQLAQMIKLELNELKSAMEVHDDSRCYTHFY

SEQ ID NO: 1955 - protein, 433 aa, Saccharomyces cerevisiae
MVNVVLGSQWGDEGKGKLVDLLVGKYDIVARCAGGNNAGHTIVVDGVKYDFHMLPSGLVNPNCQNLLGNGVVIHVPSFFKELETLEAKGLKNARSRLFVSSRAHLVFDFHQVTDKLRELELSGRSKDGKNIGTTGKGIGPTYSTKASRSGLRVHHLVNDQPGAWEEFVARYKRLLETRRQRYGDFEYDFEAKLAEYKKLREQLKPFVVDSVVFMHNAIEAKKKILVEGANALMLDIDFGTYPYVTSSNTGIGGVLTGLGIPPRTIDEIYGVVKAYTTRVGEGPFPTEQLNENGEKLQTIGAEFGVTTGRKRRCGWLDLVVLKYSTLINGYTSLNITKLDVLDTFKEIPVGISYSIQGKKLDLFPEDLNILGKVEVEYKVLPGWDQDITKITKYEDLPENAKKYLKYIEDFVGVPVEWVGTGPARESMLHKEIK

SEQ ID NO: 1956 - protein, 613 aa, Saccharomyces cerevisiae
MAEGVFQGAIGIDLGTTYSCVATYESSVEIIANEQGNRVTPSFVAFTPQERLIGDAAKNQAALNPRNTVFDAKRLIGRRFDDESVQKDMKTWPFKVIDVDGNPVIEVQYLEETKTFSPQEISAMVLTKMKEIAEAKIGKKVEKAVITVPAYFNDAQRQATKDAGAISGLNVLRIINEPTAAAIAYGLGAGKSEKERHVLIFDLGGGTFDVSLLHIAGGVYTVKSTSGNTHLGGQDFDTNLLEHFKAEFKKKTGLDISDDARALRRLRTAAERAKRTLSSVTQTTVEVDSLFDGEDFESSLTRARFEDLNAALFKSTLEPVEQVLKDAKISKSQIDEVVLVGGSTRIPKVQKLLSDFFDGKQLEKSINPDEAVAYGAAVQGAILTGQSTSDETKDLLLLDVAPLSLGVGMQGDIFGIVVPRNTTVPTIKRRTFTTVSDNQTTVQFPVYQGERVNCKENTLLGEFDLKNIPMMPAGEPVLEAIFEVDANGILKVTAVEKSTGKSSNITISNAVGRLSSEEIEKMVNQAEEFKAADEAFAKKHEARQRLESYVASIEQTVTDPVLSSKLKRGSKSKIEAALSDALAALQIEDPSADELRKAEVGLKRVVTKAMSSR

SEQ ID NO: 1957 - protein, 300 aa, Saccharomyces cerevisiae
MRLFENSKDMENRKRLLRAKKAAGNNNCFECKSVNPQFVSCSFGIFICVNCANLLRGMGTNIFCVKSITMDNFEEKDVRRVEKSGNNRFGSFLSKNGILQNGIPLREKYDNLFAKSYKRRLANEVRSNDINRNMYLGFNNFQQYTNGATSQIRDRTLREISNNSNASEGAEFVLPEKVLGSDNFQDCERFPACLSSERNLDENNVTSATSTLTIEKFQNDPIGTISRSWQLLSDALYKSYEDFKGSVVQPTIENIQQRNLPNDIKRSFVHFNEKLHETPHLPSPVFSCFTGGDILPPEFN

SEQ ID NO: 1958 - protein, 295 aa, Saccharomyces cerevisiae
MDTMNTANTLDGKFVTEGSWRPDLFKGKVAFVTGGAGTICRVQTEALVLLGCKAAIVGRDQERTEQAAKGISQLAKDKDAVLAIANVDVRNFEQVENAVKKTVEKFGKIDFVIAGAAGNFVCDFANLSPNAFKSVVDIDLLGSFNTAKACLKELKKSKGSILFVSATFHYYGVPFQGHVGAAKAGIDALAKNLAVELGPLGIRSNCIAPGAIDNTEGLKRLAGKKYKEKALAKIPLQRLGSTRDIAESTVYIFSPAASYVTGTVLVVDGGMWHLGTYFGHELYPEALIKSMTSKL

SEQ ID NO: 1959 - protein, 1131 aa, Saccharomyces cerevisiae
MSDQNNRSRNEYHSNRKNEPSYELQNAHSGLFHSSNEELTNRNQRYTNQNASMGSFTPVQSLQFPEQSQQTNMLYNGDDGNNNTINDNERDIYGGFVNHHRQRPPPATAEYNDVFNTNSQQLPSEHQYNNVPSYPLPSINVIQTTPELIHNGSQTMATPIERPFFNENDYYYNNRNSRTSPSIASSSDGYADQEARPILEQPNNNMNSGNIPQYHDQPFGYNNGYHGLQAKDYYDDPEGGYIDQRGDDYQINSYLGRNGEMVDPYDYENSLRHMTPMERREYLHDDSRPVNDGKEELDSVKSGYSHRDLGEYDKDDFSRDDEYDDLNTIDKLQFQANGVPASSSVSSIGSKESDIIVSNDNLTANRALKRSGTEIRKFKLWNGNFVFDSPISKTLLDQYATTTENANTLPNEFKFMRYQAVTCEPNQLAEKNFTVRQLKYLTPRETELMLVVTMYNEDHILLGRTLKGIMDNVKYMVKKKNSSTWGPDAWKKIVVCIISDGRSKINERSLALLSSLGCYQDGFAKDEINEKKVAMHVYEHTTMINITNISESEVSLECNQGTVPIQLLFCLKEQNQKKINSHRWAFEGFAELLRPNIVTLLDAGTMPGKDSIYQLWREFRNPNVGGACGEIRTDLGKRFVKLLNPLVASQNFEYKMSNILDKTTESNFGFITVLPGAFSAYRFEAVRGQPLQKYFYGEIMENEGFHFFSSNMYLAEDRILCFEVVTKKNCNWILKYCRSSYASTDVPERVPEFILQRRRWLNGSFFASVYSFCHFYRVWSSGHNIGRKLLLTVEFFYLFFNTLISWFSLSSFFLFFRILTVSIALAYHSAFNVLSVIFLWLYGICTLSTFILSLGNKPKSTEKFYVLTCVIFAVMMIYMIFCSIFMSVKSFQNILKNDTISFEGLITTEAFRDIVISLGSTYCLYLISSIIYLQPWHMLTSFIQYILLSPSYINVLNIYAFCNVHDLSWGTKGAMANPLGKINTTEDGTFKMEVLVSSSEIQANYDKYLKVLNDFDPKSESRPTEPSYDEKKTGYYANVRSLVIIFWVITNFIIVAVVLETGGIADYIAMKSISTDDTLETAKKAEIPLMTSKASIYFNVILWLVALSALIRFIGCSIYMIVRFFKKVTFR

SEQ ID NO: 1960 - protein, 542 aa, Saccharomyces cerevisiae
MDNGTDSSTSKFVPEYRRTNFKNKGRFSADELRRRRDTQQVELRKAKRDEALAKRRNFIPPTDGADSDEEDESSVSADQQFYSQLQQELPQMTQQLNSDDMQEQLSATVKFRQILSREHRPPIDVVIQAGVVPRLVEFMRENQPEMLQLEAAWALTNIASGTSAQTKVVVDADAVPLFIQLLYTGSVEVKEQAIWALGNVAGDSTDYRDYVLQCNAMEPILGLFNSNKPSLIRTATWTLSNLCRGKKPQPDWSVVSQALPTLAKLIYSMDTETLVDACWAISYLSDGPQEAIQAVIDVRIPKRLVELLSHESTLVQTPALRAVGNIVTGNDLQTQVVINAGVLPALRLLLSSPKENIKKEACWTISNITAGNTEQIQAVIDANLIPPLVKLLEVAEYKTKKEACWAISNASSGGLQRPDIIRYLVSQGCIKPLCDLLEIADNRIIEVTLDALENILKMGEADKEARGLNINENADFIEKAGGMEKIFNCQQNENDKIYEKAYKIIETYFGEEEDAVDETMAPQNAGNTFGFGSNVNQQFNFN

SEQ ID NO: 1961 - protein, 433 aa, Saccharomyces cerevisiae
MNVTSPKDGNHSFSKKNRFNTNKPRFHKLNEQAQSINLPEDRDSIVSSNTTSIMTDDAFDYNEGIASRTKNINSDSDRSNDTIKQNNYNKRETGYNPFYNGSGINQRYTQFRKREFEPTLAENKAEEYISDEDNVKIDEDNIENELQFTPKIKEASILRSSLLGQRNVLNTRNPKSKESHIKVKPIINNKSSSQRKSSAALRKQLGKPLPLPYLNSPNSDSTPTLQRKEEVFTDEVLQKKRELIESKWHRLLFHDKKMVEKKLESLREYERKRMPPRGTDVSSSEQDNSFKISTPTKSYVSLEQKPLPNLSAMNNFNDVTDNKEKEETNNNILKFQAQRDPLQILQSEIEMHTKKLDTIIELLKDDTDSKEKRKVVTNDNAAPEQMVNKGWRKNVMMIYKKSGNIMKKYREYFLWTICILILLYCNIYVYYRF

SEQ ID NO: 1962 - protein, 792 aa, Saccharomyces cerevisiae
MTTQESIKPLVDRILSNPLQFNAAMISNKSNNNDTSAAPENSSYIVIGKQHNNNSNSTAIAATAESKQIKENNLIDRPNGKKTNTVPKSMAEALLLYTSKNDKDAADATGAKKSAELSTELSTEPPSSSSEDDKVGKEEEEEGEIFHEARDYVEPRKASLKERDNADKGDGEDIGEDIGEDIGEDIGEDIGEDIGENLGSPLATIDDSSNENEKEKRKELSTSISSDDEIEDDEDEDDMDYDSSAMEKELPEEEENDSSSKISEGEKKSLYQDLMENSTVEVNRYEPVNNTKENGNRNPKGEEEEEEEEDLKHKSRSITPPVTISNLSNFYQFNENINDRGSLNSTRIVKNWGDKFTNLKPRGLLNHGVTCYTNAAVQAMLHIPSIQHYLFDILMGKYDSTISKNSVSYTLAETSKKMWLPVSKNPRKNVSASYINPKHLISRLDDINCMMSEWQQEDSHEYFMSLMSRLQEDSVPKGHKLIESIIYDIFGGLLKQIVTCKSCGSISKTEQPFYDLSLHLKGKKKLDPNSDLSSDSINGTSATTSTTTSNAATKPSLSSSSSVNLNNGSPFAAASDLSSANRRFSIEKSIKDFFNPELIKVDKEQKGYVCEKCHKTTNAVKHSSILRAPETLLVHLKKFRFNGTSSSKMKQAVSYPMFLDLTEYCESKELPVKYQLLSVVVHEGRSLSSGHYIAHCKQPDGSWATYDDEYINIISERDVLKEPNAYYLLYTRLTPKSVPLPLAKSAMATGNVTSKSKQEQAVNEPNNRPLKINSKKNNRKKWKKNKKRKFTK

SEQ ID NO: 1963 - protein, 329 aa, Saccharomyces cerevisiae
MRSIKCVIIGDGAVGKTSLLISYTTNSFPTDYVPTVFDNYSTTIAIPNGTASSPLELDNGNDKRGSLSSASSSPSTDRKLYKINLWDTAGQEDYDRLRPLCYPQTDIFLICFSVSEHASFANVTEKWLPELKQTSNIEGTSLYTKLGKYPILLVGTKSDLRDDPATQKKLQEANSDYVSQEEIDELVQRCGFMGYTECSAATQAGVREVFEQAVRYAIYEPESPNQKSANHTLTDELTTATTNTNGDKNIREQKQQPHHNNSTDSTLPKGSLQQEKEALNIKPTKKGQKDKIHEQSKSKGSKIASNNIITTSKLNQRRETTRRKRSQSV

SEQ ID NO: 1964 - protein, 366 aa, Saccharomyces cerevisiae
MQSSLPQFTFKWPKGPEAIILTGTFDDWKGTLPMVKDPSGAFEITLPVTFDSPSSKFYFKFIVDGQWLPSKDYKVNIDEGVENNFITEEDVIKQRENGSSTLVPESAGLAVSKNAPLIEPEAEKRAKKLRKFKIKRVIKTNKQTGERSIFSQEVVELPDSEDETQQVNKTGKNADGLSGTTTIIENNVGVNEEKAIKPYEENHPKVNLVKSEGYVTDGLGKTQSSESRLYELSAEDLEKEEEEEDEDKGGGKDTSTSADAEASEDQNKEPLSKSAKFEKPEEKVPVSSITSHAKETSVKPTGKVATETQTYETKQGAPTAAAKKIEAKKATRPSKPKGTKETPNKGVQKNPAKNGGFFKKLAQLLK

SEQ ID NO: 1965 - protein, 1748 aa, Saccharomyces cerevisiae
MTSKPSTRNDYLPRETHNGEYTGDSPEWQLQINITNKIGGINGDIWLSRDGRSVKWCIEDQCLRQFTYNQKIIKAGYIDFEKTPDCFVVVLSDIAHVYMLKNGGSTTVCFPFQIGNAFWYANGVILERETSASFMDGGYDLKPIEFDLKHKYITLTDPMAPFGLISITNTFKGGINSASGNKTDILQDFQLVLFPSDKDKCIAVFLDRNSKVLRFYYSRILSSDQSRKGELTISSTKKTGLDAAGNSQKSGGISKDLRKFSHLTRRSTSINSNSHDFNAAERVLSGNVGNASGRTDIFALPSSCSRRSLSATLDRMGNNIAPTNRAAPSGFFDSSSANTATHSNITPVSQPMQQQQQEYLNQTATSSKDIVLTEISSLKLPDDIIFTSRRLSSILSKLKFLSLRFERREGLLIFHEPTHFCKIWLIDLLPDVLDSIPFKIYGNSPQNMIRLENLKLKEPSRIQAMYIHELLESCLILVSEGQNKEEYKACLYDPFVKITSPSKNISEELTKQNSLPSLQKLFPYPETSFTKLCFEAVKYITSPAFNISFIFLWQSAYSILLSRANDDVVGGLKMEHDAFSLVLSLLILPIPSSSAQEYQEYKEIYERDLFQHLKQDSEITSSVLPRIVIGLHLIREEYSLNVLCRNEHALLGQFLRFATAAMGWPDLWQSYYVPKMDSESKTFLHPREQNSTFFHPLDEPPSITKSLYSITENSSIPLCPFISFSRLVATDTQVELRITPRSFKILGLYELVHSPNFLPDYVLGILSSFKVDKDELQTYPLGILVPLQNILKILEDKLSEVRDNLELLDRADLQRCSAIINSIRSDSKEVLKRGQRDSYMLCKVPLAKNRSSLSKKPSDIYSILSEIVKSASQVPLDGSAMRMSNIQDDEDIDEGRSLKLNAGLIFSEDKRFTHVVSLLAYYRPTKTQFFTTKTEYAQILAQKKYFAKIMALRTCTNGVGWGAVAYATEKPISTQKWVIQPLNLISVFPDDTKITVKAPEDIAHDIVEWGQFHAGVSSGLRISKKATGITGSWIAFNKPKELDAYHGGFLLGLGLNGHLKNLEEWHIYNYLSPRNTHISIGLLLGMSSSMKGSMDSKLIKVISVHLVAFLPSGSSDLNIDLKLQTAGIIGMGMLYLNSRHKRMSDSIFAQLVSLLNVNDEMVADEEYRLAAGISLGLINLGAGQTKLRKWDSSLLGLGDDLPEDVYDSSDVEQNVMYEDLTTKLLEIVTSTYDVENDWIPENSQIGAVIAIMFLFLKSNNFGISNMLKVDLKEILKANINTRPELLMYREWASNMILWEFIGDDLSFIMKDVDIGVKFSELNTDLLPIYYTMAGRILAMGIRFASTGNLKIRNILLSLVDKFLPLYQYPGKQNLDFRLTISVINVLTNVIVVSLSMVMCASGDLEVLRRVKYLHEVASGPYSDLFQEIPSSKSDVSGVTQVTSNTNTPGNSDRERVDETAASLDDERSSNGSDISDPTAYLEDKKDIDDHYGKFISTNLALGFLFLGSGQYALNTSTLESIAFLSMSVLPTYTTPHPLQELKHFWSIAVEPRCLVIKDISTGDAVNNVPIELVVEEDVEKEEVIREISTPCLLPDFSKIKSIRVKMHGYFPLEVNFTKDYSASDFFSGGTIIYIQRKSESVFENKASFRNVEDIHVALKRKAAESKNYSRLNLKNEQGNTTSSQLVESLGIQDLTMVELDTLLSAGNNTALTDSESYNLGLLCSDKNSGDILDCQLELWYKSFGPHDE

SEQ ID NO: 1966 - protein, 500 aa, Saccharomyces cerevisiae
MSIMPVKNALAQGRTLLMGRMPAVKFSTRMQLRNRTAVLWNRKFSTRLFVQQRRSSGEIVDRAKAAAANSGRKQVSMKWVVLTSFTIVLGTILLVSRNDSTEEDATEGKKGRRTRKIKIFNNNWLFFCYSTLPLNAMSRLWGQVNSLTLPIWVRPWGYRLYSFLFGVNLDEMEDPDLTHYANLSEFFYRNIKPGTRPVAQGEDVIASPSDGKILQVGIINSETGEIEQVKGMTYSIKEFLGTHSHPLMSKSASSLDLTSDEEKHREFARVNRIQLAGSEDTEQPLLNFKNEGDQSVREFKPSVSKNIHLLSQLSLNYFSNGFSCSEPHDTELFFAVIYLAPGDYHHFHSPVDWVCKVRRHFPGDLFSVAPYFQRNFPNLFVLNERVALLGSWKYGFFSMTPVGATNVGSIKLNFDQEFVTNSKSDKHLEPHTCYQAVYENASKILGGMPLVKGEEMGGFELGSTVVLCFEAPTEFKFDVRVGDKVKMGQKLGIIGKNDLK

SEQ ID NO: 1967 - protein, 756 aa, Saccharomyces cerevisiae
MYNSSTNHHEGAPTSGHGYYMSQQQDQQHQQQQQYANEMNPYQQIPRPPAAGFSSNYMKEQGSHQSLQEHLQRETGNLGSGFTDVPALNYPATPPPHNNYAASNQMINTPPPSMGGLYRHNNNSQSMVQNGNGSGNAQLPQLSPGQYSIESEYNQNLNGSSSSSPFHQPQTLRSNGSYSSGLRSVKSFQRLQQEQENVQVQQQLSQAQQQNSRQQQQQLQYQQQQQQQQQQQHMQIQQQQQQQQQQQQSQSPVQSGFNNGTISNYMYFERRPDLLTKGTQDKAAAVKLKIENFYQSSVKYAIERNERRVELETELTSHNWSEERKSRQLSSLGKKESQFLRLRRTRLSLEDFHTVKVIGKGAFGEVRLVQKKDTGKIYAMKTLLKSEMYKKDQLAHVKAERDVLAGSDSPWVVSLYYSFQDAQYLYLIMEFLPGGDLMTMLIRWQLFTEDVTRFYMAECILAIETIHKLGFIHRDIKPDNILIDIRGHIKLSDFGLSTGFHKTHDSNYYKKLLQQDEATNGISKPGTYNANTTDTANKRQTMVVDSISLTMSNRQQIQTWRKSRRLMAYSTVGTPDYIAPEIFLYQGYGQECDWWSLGAIMYECLIGWPPFCSETPQETYRKIMNFEQTLQFPDDIHISYEAEDLIRRLLTHADQRLGRHGGADEIKSHPFFRGVDWNTIRQVEAPYIPKLSSITDTRFFPTDELENVPDSPAMAQAAKQREQMTKQGGSAPVKEDLPFIGYTYSRFDYLTRKNAL

SEQ ID NO: 1968 - protein, 546 aa, Saccharomyces cerevisiae
MSQVQSPLTATNSGLAVNNNTMNSQMPNRSNVRLVNGTLPPSLHVSSNLNHNTGNSSASYSGSQSRDDSTIVGLHYKIGKKIGEGSFGVLFEGTNMINGLPVAIKFEPRKTEAPQLKDEYRTYKILAGTPGIPQEYYFGQEGLHNILVIDLLGPSLEDLFDWCGRRFSVKTVVQVAVQMITLIEDLHAHDLIYRDIKPDNFLIGRPGQPDANKVHLIDFGMAKQYRDPKTKQHIPYREKKSLSGTARYMSINTHLGREQSRRDDMEAMGHVFFYFLRGQLPWQGLKAPNNKQKYEKIGEKKRLTNVYDLAQGLPIQFGRYLEIVRNLSFEETPDYEGYRMLLLSVLDDLGETADGQYDWMKLNGGRGWDLSINKKPNLHGYGHPNPPNEKSKRHRSKNHQYSSPDHHHHYNQQQQQQQAQAQAQAQAQAKVQQQQLQQAQAQQQANRYQLQPDDSHYDEEREASKLDPTSYEAYQQQTQQKYAQQQQKQMQQKSKQFANTGANGQTNKYPYNAQPTANDEQNAKNAAQDRNSNKSSKGFFSKLGCC

SEQ ID NO: 1969 - protein, 38 aa, Saccharomyces cerevisiae
MQPITTASTQATQKDKSSEKKDNYIIKGLFWDPACVIA

SEQ ID NO: 1970 - protein, 526 aa, Saccharomyces cerevisiae
MPDSKYTMQGYNLVKLLKRLEEATARLEDVTIYQEGYIQNKLEASKNNKPSDSGADANTTNEPSAENAPEVEQDPKCITAFQSYIGENIDPLVELSGKIDTVVLDALQLLKGGFQSQLTFLRAAVRSRKPDYSSQTFADSLRPINENIIKLGQLKESNRQSKYFAYLSALSEGAPLFSWVAVDTPVSMVTDFKDAAQFWTNRILKEYRESDPNAVEWVKKFLASFDNLKAYIKEYHTTGVSWKKDGMDFADAMAQSTKNTGATSSPSPASATAAPAPPPPPPAPPASVFEISNDTPATSSDANKGGIGAVFAELNQGENITKGLKKVDKSQQTHKNPELRQSSTVSSTGSKSGPPPRPKKPSTLKTKRPPRKELVGNKWFIENYENETESLVIDANKDESIFIGKCSQVLVQIKGKVNAISLSETESCSVVLDSSISGMDVIKSNKFGIQVNHSLPQISIDKSDGGNIYLSKESLNTEIYTSCSTAINVNLPIGEDDDYVEFPIPEQMKHSFADGKFKSAVFEHAG

SEQ ID NO: 1971 - protein, 386 aa, Saccharomyces cerevisiae
MRIARIVKHLYQSDDRSFLSNHVLRPFWRKFATIFPLWMAPNLVTLLGFCFIIFNVLTTLYYDPYFDQESPRWTYFSYAIGLFLYQTFDACDGMHARRTGQQGPLGELFDHCIDSINTTLSMIPVCSMTGMGYTYMTIFSQFAILCSFYLSTWEEYHTHKLYLAEFCGPVEGIIVLCISFIAVGIYGPQTIWHTKVAQFSWQDFVFDVETVHLMYAFCTGALIFNIVTAHTNVVRYYESQSTKSATPSKTAENISKAVNGLLPFFAYFSSIFTLVLIQPSFISLALILSIGFSVAFVVGRMIIAHLTMQPFPMVNFPFLIPTIQLVLYAFMVYVLDYQKGSIVSALVWMGLGLTLAIHGMFINDIIYDITTFLDIYALSIKHPKEI

SEQ ID NO: 1972 - protein, 846 aa, Saccharomyces cerevisiae
MELEPTLFGIIEALAPQLLSQSHLQTFVSDVVNLLRSSTKSATQLGPLIDFYKLQSLDSPETTIMWHKIEKFLDALFGIQNTDDMVKYLSVFQSLLPSNYRAKIVQKSSGLNMENLANHEHLLSPVRAPSIYTEASFENMDRFSERRSMVSSPNRYVPSSTYSSVTLRQLSNPYYVNTIPEEDILKYVSYTLLATTSALFPFDHEQIQIPSKIPNFESGLLHLIFEAGLLYQSLGYKVEKFRMLNISPMKKALIIEISEELQNYTAFVNNLVSSGTVVSLKSLYREIYENIIRLRIYCRFTEHLEELSGDTFLIELNIFKSHGDLTIRKIATNLFNSMISLYYEYLMNWLTKGLLRATYGEFFIAENTDTNGTDDDFIYHIPIEFNQERVPAFIPKELAYKIFMIGKSYIFLEKYCKEVQWTNEFSKKYHVLYQSNSYRGISTNFFEIINDQYSEIVNHTNQILNQKFHYRDVVFALKNILLMGKSDFMDALIEKANDILATPSDSLPNYKLTRVLQEAVQLSSLRHLMNSPRNSSVINGLDARVLDLGHGSVGWDVFTLDYILYPPLSLVLNVNRPFGRKEYLRIFNFLWRFKKNNYFYQKEMLKSNDIIRSFKKIRGYNPLIRDIINKLSRISILRTQFQQFNSKMESYYLNCIIEENFKEMTRKLQRTENKSQNQFDLIRLNNGTIELNGILTPKAEVLTKSSSSKPQKHAIEKTLNIDELESVHNTFLTNILSHKLFATNTSEISVGDYSGQPYPTSLVLLLNSVYEFVKVYCNLNDIGYEIFIKMNLNDHEASNGLLGKFNTNLKEIVSQYKNFKDRLYIFRADLKNDGDEELFLLSKSLR

SEQ ID NO: 1973 - protein, 673 aa, Saccharomyces cerevisiae
MSTHSNDYFSASSGMVSETSSEVSSINSSQPVSFSKASIAAPVPCSDLHSTKSNDASRKLSISRTLTNRLNDIKKAVDDDNLQTEENSADVNKILESRFDVADAIRLQHNESVQSKLNIPVTHTTTAGASLSAPSSSAFSASSIQNDTTEHKASMDSKLMRNRLYPASTKHSGKDLEAQGITEFEPDEPTVKKVFTNKSTGQLELPPDGGYGWVVTFCVFLTMFSTWGCNASFGVDLAYYLNHDTYPGASKYDYALIAGLTVFLGQLLSPLVMALMRIIGLRTTMLFGDAVMLAAYLLASFTTKLWQLYVTQGFMVGCSISLIFVPATTVLPGWFLKKRAVAMGVSLLGTGAGGVVYGLATNKMLSDFGNTRWCLRIIGISCSISVLVAIALLKERNPTPAIGLKSPRAMFEQLKAMFSLKVITKPFVVLIALWFMFALFAYNMMVFTLSSYAISKGLSSHDASTLTAILNGSQSIGRPLMGLAGDKFGRANVTIVLTTLLTIYMFAFWIPAHTFVQLIFFSILVGSCVGVANVMNTVLIADMVKPEEFLPAWAFVNYCGAPFLLVCEVIAQALTVEKDKSNPYLHAQIFCGCCFIAALILISILREYSIRMKLTERQAMTNEKLKEWKASEYDTDSADEDWGKLKERKTKYDLLLGPGIKKYFLRMVYPMKV

SEQ ID NO: 1974 - protein, 546 aa, Saccharomyces cerevisiae
MTYGGRDQQYNKTNYKSRGGDFRGGRNSDRNSYNDRPQGGNYRGGFGGRSNYNQPQELIKPNWDEELPKLPTFEKNFYVEHESVRDRSDSEIAQFRKENEMTISGHDIPKPITTFDEAGFPDYVLNEVKAEGFDKPTGIQCQGWPMALSGRDMVGIAATGSGKTLSYCLPGIVHINAQPLLAPGDGPIVLVLAPTRELAVQIQTECSKFGHSSRIRNTCVYGGVPKSQQIRDLSRGSEIVIATPGRLIDMLEIGKTNLKRVTYLVLDEADRMLDMGFEPQIRKIVDQIRPDRQTLMWSATWPKEVKQLAADYLNDPIQVQVGSLELSASHNITQIVEVVSDFEKRDRLNKYLETASQDNEYKTLIFASTKRMCDDITKYLREDGWPALAIHGDKDQRERDWVLQEFRNGRSPIMVATDVAARGIDVKGINYVINYDMPGNIEDYVHRIGRTGRAGATGTAISFFTEQNKGLGAKLISIMREANQNIPPELLKYDRRSYGGGHPRYGGGRGGRGGYGRRGGYGGGRGGYGGNRQRDGGWGNRGRSNY

SEQ ID NO: 1975 - protein, 120 aa, Saccharomyces cerevisiae
MPKVYSYQEVAEHNGPENFWIIIDDKVYDVSQFKDEHPGGDEIIMDLGGQDATESFVDIGHSDEALRLLKGLYIGDVDKTSERVSVEKVSTSENQSKGSGTLVVILAILMLGVAYYLLNE

SEQ ID NO: 1976 - protein, 1468 aa, Saccharomyces cerevisiae
MSSKSEKLEKLRKLQAARNGTSIDDYEGDESDGDRIYDEIDEKEYRARKRQELLHDDFVVDDDGVGYVDRGVEEDWREVDNSSSDEDTGNLASKDSKRKKNIKREKDHQITDMLRTQHSKSTLLAHAKKSQKKSIPIDNFDDILGEFESGEVEKPNILLPSKLRENLNSSPTSEFKSSIKRVNGNDESSHDAGISKKVKIDPDSSTDKYLEIESSPLKLQSRKLRYANDVQDLLDDVENSPVVATKRQNVLQDTLLANPPSAQSLADEEDDEDSDEDIILKRRTMRSVTTTRRVNIDSRSNPSTSPFVTAPGTPIGIKGLTPSKSLQSNTDVATLAVNVKKEDVVDPETDTFQMFWLDYCEVNNTLILFGKVKLKDDNCVSAMVQINGLCRELFFLPREGKTPTDIHEEIIPLLMDKYGLDNIRAKPQKMKYSFELPDIPSESDYLKVLLPYQTPKSSRDTIPSDLSSDTFYHVFGGNSNIFESFVIQNRIMGPCWLDIKGADFNSIRNASHCAVEVSVDKPQNITPTTTKTMPNLRCLSLSIQTLMNPKENKQEIVSITLSAYRNISLDSPIPENIKPDDLCTLVRPPQSTSFPLGLAALAKQKLPGRVRLFNNEKAMLSCFCAMLKVEDPDVIIGHRLQNVYLDVLAHRMHDLNIPTFSSIGRRLRRTWPEKFGRGNSNMNHFFISDICSGRLICDIANEMGQSLTPKCQSWDLSEMYQVTCEKEHKPLDIDYQNPQYQNDVNSMTMALQENITNCMISAEVSYRIQLLTLTKQLTNLAGNAWAQTLGGTRAGRNEYILLHEFSRNGFIVPDKEGNRSRAQKQRQNEENADAPVNSKKAKYQGGLVFEPEKGLHKNYVLVMDFNSLYPSIIQEFNICFTTVDRNKEDIDELPSVPPSEVDQGVLPRLLANLVDRRREVKKVMKTETDPHKRVQCDIRQQALKLTANSMYGCLGYVNSRFYAKPLAMLVTNKGREILMNTRQLAESMNLLVVYGDTDSVMIDTGCDNYADAIKIGLGFKRLVNERYRLLEIDIDNVFKKLLLHAKKKYAALTVNLDKNGNGTTVLEVKGLDMKRREFCPLSRDVSIHVLNTILSDKDPEEALQEVYDYLEDIRIKVETNNIRIDKYKINMKLSKDPKAYPGGKNMPAVQVALRMRKAGRVVKAGSVITFVITKQDEIDNAADTPALSVAERAHALNEVMIKSNNLIPDPQYYLEKQIFAPVERLLERIDSFNVVRLSEALGLDSKKYFRREGGNNNGEDINNLQPLETTITDVERFKDTVTLELSCPSCDKRFPFGGIVSSNYYRVSYNGLQCKHCEQLFTPLQLTSQIEHSIRAHISLYYAGWLQCDDSTCGIVTRQVSVFGKRCLNDGCTGVMRYKYSDKQLYNQLLYFDSLFDCEKNKKQELKPIYLPDDLDYPKEQLTESSIKALTEQNRELMETGRSVVQKYLNDCGRRYVDMTSIFDFMLN

SEQ ID NO: 1977 - protein, 322 aa, Saccharomyces cerevisiae
MPLNKSNIREYKLVVVGGGGVGKSALTIQLTQSHFVDEYDPTIEDSYRKQVVIDDEVSILDILDTAGQEEYSAMREQYMRNGEGFLLVYSITSKSSLDELMTYYQQILRVKDTDYVPIVVVGNKSDLENEKQVSYQDGLNMAKQMNAPFLETSAKQAINVEEAFYTLARLVRDEGGKYNKTLTENDNSKQTSQDTKGSGANSVPRNSGGHRKMSNAANGKNVNSSTTVVNARNASIESKTGLAGNQATNGKTQTDRTNIDNSTGQAGQANAQSANTVNNRVNNNSKAGQVSNAKQARKQQAAPGGNTSEASKSGSGGCCIIS

SEQ ID NO: 1978 - protein, 220 aa, Saccharomyces cerevisiae
MDKHTAAIPTLTIKVVLLGESAVGKSSIVLRFVSDDFKESKEPTIGAAFLTKRITRDGKVIKFEIWDTAGQERFAPLAPMYYRNAQAALVVFDVTNEGSFYKAQNWVEELHEKVGHDIVIALVGNKMDLLNNDDENENRAMKAPAVQNLCERENLLYFEASAKTGENIYQIFQTLGEKVPCPEQNTRQSSTHDRTITDNQRIDLESTTVESTRETGGCNC

SEQ ID NO: 1979 - protein, 192 aa, Saccharomyces cerevisiae
MSEKAVRRKLVIIGDGACGKTSLLYVFTLGKFPEQYHPTVFENYVTDCRVDGIKVSLTLWDTAGQEEYERLRPFSYSKADIILIGFAVDNFESLINARTKWADEALRYCPDAPIVLVGLKKDLRQEAHFKENATDEMVPIEDAKQVARAIGAKKYMECSALTGEGVDDVFEVATRTSLLMKKEPGANCCIIL

SEQ ID NO: 1980 - protein, 1428 aa, Saccharomyces cerevisiae
MSTEPVSASDKYQKISQLEHILKRPDTYIGSVETQEQLQWIYDEETDCMIEKNVTIVPGLFKIFDEILVNAADNKVRDPSMKRIDVNIHAEEHTIEVKNDGKGIPIEIHNKENIYIPEMIFGHLLTSSNYDDDEKKVTGGRNGYGAKLCNIFSTEFILETADLNVGQKYVQKWENNMSICHPPKITSYKKGPSYTKVTFKPDLTRFGMKELDNDILGVMRRRVYDINGSVRDINVYLNGKSLKIRNFKNYVELYLKSLEKKRQLDNGEDGAAKSDIPTILYERINNRWEVAFAVSDISFQQISFVNSIATTMGGTHVNYITDQIVKKISEILKKKKKKSVKSFQIKNNMFIFINCLIENPAFTSQTKEQLTTRVKDFGSRCEIPLEYINKIMKTDLATRMFEIADANEENALKKSDGTRKSRITNYPKLEDANKAGTKEGYKCTLVLTEGDSALSLAVAGLAVVGRDYYGCYPLRGKMLNVREASADQILKNAEIQAIKKIMGLQHRKKYEDTKSLRYGHLMIMTDQDHDGSHIKGLIINFLESSFPGLLDIQGFLLEFITPIIKVSITKPTKNTIAFYNMPDYEKWREEESHKFTWKQKYYKGLGTSLAQEVREYFSNLDRHLKIFHSLQGNDKDYIDLAFSKKKADDRKEWLRQYEPGTVLDPTLKEIPISDFINKELILFSLADNIRSIPNVLDGFKPGQRKVLYGCFKKNLKSELKVAQLAPYVSECTAYHHGEQSLAQTIIGLAQNFVGSNNIYLLLPNGAFGTRATGGKDAAAARYIYTELNKLTRKIFHPADDPLYKYIQEDEKTVEPEWYLPILPMILVNGAEGIGTGWSTYIPPFNPLEIIKNIRHLMNDEELEQMHPWFRGWTGTIEEIEPLRYRMYGRIEQIGDNVLEITELPARTWTSTIKEYLLLGLSGNDKIKPWIKDMEEQHDDNIKFIITLSPEEMAKTRKIGFYERFKLISPISLMNMVAFDPHGKIKKYNSVNEILSEFYYVRLEYYQKRKDHMSERLQWEVEKYSFQVKFIKMIIEKELTVTNKPRNAIIQELENLGFPRFNKEGKPYYGSPNDEIAEQINDVKGATSDEEDEESSHEDTENVINGPEELYGTYEYLLGMRIWSLTKERYQKLLKQKQEKETELENLLKLSAKDIWNTDLKAFEVGYQEFLQRDAEARGGNVPNKGSKTKGKGKRKLVDDEDYDPSKKNKKSTARKGKKIKLEDKNFERILLEQKLVTKSKAPTKIKKEKTPSVSETKTEEEENAPSSTSSSSIFDIKKEDKDEGELSKISNKFKKISTIFDKMGSTSATSKENTPEQDDVATKKNQTTAKKTAVKPKLAKKPVRKQQKVVELSGESDLEILDSYTDREDSNKDEDDAIPQRSRRQRSSRAASVPKKSYVETLELSDDSFIEDDEEENQGSDVSFNEED

SEQ ID NO: 1981 - protein, 349 aa, Saccharomyces cerevisiae
MPKLEQFEIKKYWQIFSGLKPIENKVNHDQVLPILYNSKLDSSVLNKIWFLADIDDDDNLDFEEFVICMRLIFDMVNKNISSVPDELPDWLIPGSKVNLIKERKKRKQIENADLPPKKEIKVDWYMSPDDLNQYEKIYNSCAKLTDGTITFNELSTKLSTKFFNISKTDLNKVWSLINPQNLPSIDRDPTFYFIHCLRQRNDLGAEIPASLPNSLAEVCNKKQLSYDLRSSQPPTKRKEEANEVDNLRDNGQNSSSDSSGSNVLSNEDSIKQKYASLTDDQVANMREQLEGLLNYKKSEKTQGGSKLSKRINIRSITDDLDNIEQQVEVLENYLNNKRHELQALQAEIN

SEQ ID NO: 1982 - protein, 307 aa, Saccharomyces cerevisiae
MVPPTVEASLESPYTKSYFSPVPSALLEQNDSPIIMGIDEAGRGPVLGPMVYAVAYSTQKYQDETIIPNYEFDDSKKLTDPIRRMLFSKIYQDNEELTQIGYATTCITPLDISRGMSKFPPTRNYNLNEQAHDVTMALIDGVIKQNVKLSHVYVDTVGPPASYQKKLEQRFPGVKFTVAKKADSLYCMVSVASVVAKVTRDILVESLKRDPDEILGSGYPSDPKTVAWLKRNQTSLMGWPANMVRFSWQTCQTLLDDASKNSIPIKWEEQYMDSRKNAAQKTKQLQLQMVAKPVRRKRLRTLDNWYR

SEQ ID NO: 1983 - protein, 482 aa, Saccharomyces cerevisiae
MSAFVRVVPRISRSSVLTRSLRLQLRCYASYPEHTIIGMPALSPTMTQGNLAAWTKKEGDQLSPGEVIAEIETDKAQMDFEFQEDGYLAKILVPEGTKDIPVNKPIAVYVEDKADVPAFKDFKLEDSGSDSKTSTKAQPAEPQAEKKQEAPAEETKTSAPEAKKSDVAAPQGRIFASPLAKTIALEKGISLKDVHGTGPRGRITKADIESYLEKSSKQSSQTSGAAAATPAAATSSTTAGSAPSPSSTASYEDVPISTMRSIIGERLLQSTQGIPSYIVSSKISISKLLKLRQSLNATANDKYKLSINDLLVKAITVAAKRVPDANAYWLPNENVIRKFKNVDVSVAVATPTGLLTPIVKNCEAKGLSQISNEIKELVKRARINKLAPEEFQGGTICISNMGMNNAVNMFTSIINPPQSTILAIATVERVAVEDAAAENGFSFDNQVTITGTFDHRTIDGAKGAEFMKELKTVIENPLEMLL

SEQ ID NO: 1984 - protein, 420 aa, Saccharomyces cerevisiae
MKLSATTLTAASLIGYSTIVSALPYAADIDTGCTTTAHGSHQHKRAVAVTYVYETVTVDKNGQTVTPTSTEASSTVASTTTLISESSVTKSSSKVASSSESTEQIATTSSSAQTTLTSSETSTSESSVPISTSGSASTSSAASSATGSIYGDLADFSGPYEKFEDGTIPCGQFPSGQGVIPISWLDEGGWSGVENTDTSTGGSCKEGSYCSYACQPGMSKTQWPSDQPSDGRSIGGLLCKDGYLYRSNTDTDYLCEWGVDAAYVVSELSNDVAICRTDYPGTENMVIPTYVQAGDSLPLTVVDQDTYYTWQGLKTSAQYYVNNAGISVEDACVWGSSSSGVGNWAPLNFGAGSSDGVAYLSLIPNPNNGNALNFNVKIVAADDSSTVNGECIYENGSFSGGSDGCTVSVTAGKAKFVLYN

SEQ ID NO: 1985 - protein, 755 aa, Saccharomyces cerevisiae
MSSRDASLTPLKAVVIDDPPLRQTPEPFDEQSAYNPQSPIAIDFGSSKLRAGFVNHATPTHIFPNALTKFRDRKLNKNFTFVGNDTLLDQAVRSQSRSPFDGPFVTNWNLTEEILDYTFHHLGVVPDNGIPNPILLTERLATVQSQRTNWYQILFETYNVPGVTFGIDSLFSFYNYNPSGNKTGLVISCGHEDTNVIPVVDGAGILTDAKRINWGGHQAVDYLNDLMALKYPYFPTKMSYLQYETMYKDYCYVSRNYDEDIEKILTLENLDTNDVVVEAPFTEVLQPQKTEEELRIQAEKRKETGKRLQEQARLKRMEKLVQKQEEFEYFSKVRDQLIDEPKKKVLSVLQNAGFDDERDFKKYLHSLEQSLKKAQMVEAEDDSHLDEMNEDKTAQKFDLLDIADEDLNEDQIKEKRKQRFLKASQDARQKAKEEKERVAKEEEEKKLKEQQWRETDLNGWIKDKRLKLNKLIKRRKEKLKLRDEMKDRKSQVSQNRMKNLASLAEDNVKQGAKRNRHQATIDNDPNDTFGANDEDWLIYTDITQNPEAFEEALEYEYKDIVELERLLLEHDPNFTEEDTLEAQYDWRNSILHLFLRGPRPHDSENIHEQHQMHLNVERIRVPEVIFQPTMGGQDQAGICELSETILLKKFGSQPGKLSQTSIDMVNNVLITGGNAKVPGLKERIVKEFTGFLPTGTNITVNMSSDPSLDAWKGMAALARNEEQYRKTVISKKEYEEYGPEYIKEHKLGNTKYFED

SEQ ID NO: 1986 - protein, 489 aa, Saccharomyces cerevisiae
MQFHSDKQHLDSKTDIDFKPNSPRSLQNRNTKNLSLDIAALHPLMEFSSPSQDVPGSVKFPSPTPLNLFMKPKPIVLEKCPPKVSPRPTPPSLSMRRSEASIYTLPTSLKNRTVSPSVYTKSSTVSSISKLSSSSPLSSFSEKPHLNRVHSLSVKTKDLKLKGIRGRSQTISGLETSTPISSTREGTLDSTDVNRFSNQKNMQTTLIFPEEDSDLNIDMVHAEIYQRTVYLDGPLLVLPPNLYLYSEPKLEDILSFDLVINVAKEIPNLEFLIPPEMAHKIKYYHIEWTHTSKIVKDLSRLTRIIHTAHSQGKKILVHCQCGVSRSASLIVAYIMRYYGLSLNDAYNKLKGVAKDISPNMGLIFQLMEWGTMLSKNSPGEEGETVHMPEEDDIGNNEVSSTTKSYSSASFRSFPMVTNLSSSPNDSSVNSSEVTPRTPATLTGARTALATERGEDDEHCKSLSQPADSLEASVDNESISTAPEQMMFLP

SEQ ID NO: 1987 - protein, 671 aa, Saccharomyces cerevisiae
MFLLPFVIRHSSSIYLPTLRFRGLLTVISRNIHISTPHKMLPLSIEQRRPSRSPEYDQSTLSNYKDFAVLHTDLNLSVSFEKSAISGSVTFQLKKLHEGKNKSDELHLDTSYLDVQEVHIDGSKADFQIEQRKEPLGSRLVINNASCNDNFTLNIQFRTTDKCTALQWLNSKQTKGGKPYVFSQLEAIHARSLFPCFDTPSVKSTFTASIESPLPVVFSGIRIEDTSKDTNIYRFEQKVPIPAYLIGIASGDLSSAPIGPRSTVYTEPFRLKDCQWEFENDVEKFIQTAEKIIFEYEWGTYDILVNVDSYPYGGMESPNMTFATPTLIAHDRSNIDVIAHELAHSWSGNLVTNCSWNHFWLNEGWTVYLERRIIGAIHGEPTRHFSALIGWSDLQNSIDSMKDPERFSTLVQNLNDNTDPDDAFSTVPYEKGFNLLFHLETILGGKAEFDPFIRHYFKKFAKKSLDTFQFLDTLYEFYPEKKEILDSVDWETWLYKPGMPPRPHFITALADNVYQLADKWVEMAQHLKTTEDFRSEFNAIDIKDFNSNQLVLFLETLTQNGHSNKKPKDFDWAKFPVASRALLDIYQDNIVKSQNAEVVFKMFKFQIFAKLQEEYKHLADWLGTVGRMKFVRPGYRLLNSVDRRLALATFDKFKDTYHPICKALVKQDLGL

SEQ ID NO: 1988 - protein, 360 aa, Saccharomyces cerevisiae
MLNRTIAKRTLATAAQAERTLPKKYGGRFTVTLIPGDGVGKEITDSVRTIFEAENIPIDWETINIKQTDHKEGVYEAVESLKRNKIGLKGLWHTPADQTGHGSLNVALRKQLDIYANVALFKSLKGVKTRIPDIDLIVIRENTEGEFSGLEHESVPGVVESLKVMTRPKTERIARFAFDFAKKYNRKSVTAVHKANIMKLGDGLFRNIITEIGQKEYPDIDVSSIIVDNASMQAVAKPHQFDVLVTPSMYGTILGNIGAALIGGPGLVAGANFGRDYAVFEPGSRHVGLDIKGQNVANPTAMILSSTLMLNHLGLNEYATRISKAVHETIAEGKHTTRDIGGSSSTTDFTNEIINKLSTM

SEQ ID NO: 1989 - protein, 522 aa, Saccharomyces cerevisiae
MLLIRRTINAFLGCIHCNLTATCILIAFVITMYVVLVSEPASVDGTMGNFLPFSKMDLATKRDRPFYSNCVNTQDYLLNPSYIKQNASFVMLTRNGELEDVIKTINSIEEHFNQWFHYPYVFLNDQPFEEDFKAKVRDVTVGALVEFGTIDEISWNFPSDVKDTFEFYNAIEDQGDRSILYGNLESYHKMCRFYSGLFYKHPLVQKYEWYWRLEPDVEFFCDITYDPFLEMLRTNKKYGFTIIIPELYWTVPNLFRHTKSFISQKGVTLGSLWKLFTKDYDIFESDDPELRDWINYDFQAKAKISEKIAIEQLLKKGDDFQQINDDKEGIMNLIHKARSRKHIVEDKFFNEEYNLCHFWSNFEIARLSVFDNDIYNSFFQYLEKSGGFWKERWGDAPVHSIGLSLTLDLDDVHYFRDIGYRHSTIQHCPHNAMGNEEFSYLASDSKFKRKNAAYDEGREFGCGCRCRCPKKKREIEDSMGFCVNIWVNLLNQQRGHERHVEALNGNEMEEHIREDYLRQFGN

SEQ ID NO: 1990 - protein, 323 aa, Saccharomyces cerevisiae
MSGSFWTSTQRHHWQYTKASLAKERQKLWLLECQLFPQGLNIVMDSKQNGIEQSITKNIPITHRDLHYDKDYNLRIYCYFLIMKLGRRLNIRQYALATAHIYLSRFLIKASVREINLYMLVTTCVYLACKVEECPQYIRTLVSEARTLWPEFIPPDPTKVTEFEFYLLEELESYLIVHHPYQSLKQIVQVLKQPPFQITLSSDDLQNCWSLINDSYINDVHLLYPPHIIAVACLFITISIHGKPTKGSSLASAASEAIRDPKNSSSPVQIAFNRFMAESLVDLEEVMDTIQEQITLYDHWDKYHEQWIKFLLHTLYLRPASAI

SEQ ID NO: 1991 - protein, 638 aa, Saccharomyces cerevisiae
MNQPQIGTYNVGTQLTVGSHQVEIIKYLTSGGFAQVYSALINPPDPHSNSSVACLKRVIVPDKPSLNTLRAEVDAMRLLKNNRYVVSYIDSHAAKAMLHNGSYEVFVLMEYCERGGLIDFMNTRLQNRLHEFEILQIMSQVTQGVAAMHALQPPLIHRDIKIENVLISANNEYKLCDFGSVCGIIRPPRNSQELSYVQQDILKNTTAQYRSPEMIDTFRGLPIDEKSDIWALGIFLYKLCYYTTPFEKGGDLAILSGKFEFPLYPNYSEQLKGLIRDILVQDPRHRPNVYQLLKRISIMQNVPCPINDIQVVQAPSSHLNLTELHQLSATQNILSLNSPTTMENTMPNATFQISMADNTTTAQMHPNRKPSQIAYDASFSNSAKGSQPLFDKSQNMYHALDPPLVEPLASSVSNNDNELKANSATKLKQAIVSEAHTFRQNNSIDFPLQNIIPQYEDSSSSSDESYSGDVDELKKTRSLGSYSTRGNIKKNQSVKESLTSSSLPGTSFTPTSTKVNLKHENSPFKSTFVNTIDNSKDDLNKPSYEDLDVSKQNLKNSIQQRMIDKLNSSEESFNARKMSKVKLHEKGEIDKPTMLKSSGPISKDKKTKPTPPPKPSHLKPKPPPKPLLLAGRKLSLDK

SEQ ID NO: 1992 - protein, 536 aa, Saccharomyces cerevisiae
MLVGTGFISQMNDYGLFEYSDYIAGLSGGSWILMDLVVQNFEVKSLLQEWDLEEDLLLGIPEFDISEEEIVTNAKKEYNDNDLKMKKRQGGSLITSSSNFYEQIEEIMNSIEEIPEDYMITKRNLNPLARLKKIFFPNNTFTGTDAKIETFKKVLDFYKSLHLKIKPKKMEGFQISFTDYWGKAIVQRLKKNFDDDPNHSFSFSKLVNSSKKFKECSVPIPIFVANCKNGLLSNVIFEFTPFEFGSWENILRLFVKLPYLGSKIVSGKAEKCINNFDDLGFITATSSSIFNNVLIFIWNLASQSSREAMKALNMVMGIFGLGKEEIFSISKDSSRLETDYAVYQPNPFYLYPEKDNVLTNKNHLYLVDGGEDGENIPLRTLVIPERELDVIFVLDSSSDIDNYPNGSKLKRIFEKLDEENVHYQFPNNVKTFTHPIVIGCNATKRTGHDSFLPIIIYHANANHGNASNTSTFKITYNQSEVSSMLPTGRGVFSNDYDLYYKNCLGCILTKRTMDRLPRKKKFSPFCLQCFKDYCYS

SEQ ID NO: 1993 - protein, 420 aa, Saccharomyces cerevisiae
MSKIKVVHPIVEMDGDEQTRVIWKLIKEKLILPYLDVDLKYYDLSIQERDRTNDQVTKDSSYATLKYGVAVKCATITPDEARMKEFNLKEMWKSPNGTIRNILGGTVFREPIIIPKIPRLVPHWEKPIIIGRHAFGDQYRATDIKIKKAGKLRLQFSSDDGKENIDLKVYEFPKSGGIAMAMFNTNDSIKGFAKASFELALKRKLPLFFTTKNTILKNYDNQFKQIFDNLFDKEYKEKFQALKITYEHRLIDDMVAQMLKSKGGFIIAMKNYDGDVQSDIVAQGFGSLGLMTSILITPDGKTFESEAAHGTVTRHFRKHQRGEETSTNSIASIFAWTRAIIQRGKLDNTDDVIKFGNLLEKATLDTVQVGGKMTKDLALMLGKTNRSSYVTTEEFIDEVAKRLQNMMLSSNEDKKGMCKL

SEQ ID NO: 1994 - protein, 284 aa, Saccharomyces cerevisiae
MNTFFLSLLSGAAAGTSTDLVFFPIDTIKTRLQAKGGFFANGGYKGIYRGLGSAVVASAPGASLFFISYDYMKVKSRPYISKLYSQGSEQLIDTTTHMLSSSIGEICACLVRVPAEVVKQRTQVHSTNSSWQTLQSILRNDNKEGLRKNLYRGWSTTIMREIPFTCIQFPLYEYLKKTWAKANGQSQVEPWKGAICGSIAGGIAAATTTPLDFLKTRLMLNKTTASLGSVIIRIYREEGPAVFFSGVGPRTMWISAGGAIFLGMYETVHSLLSKSFPTAGEMRA

SEQ ID NO: 1995 - protein, 479 aa, Saccharomyces cerevisiae
MSAILSTTSKSFLSRGSTRQCQNMQKALFALLNARHYSSASEQTLKERFAEIIPAKAEEIKKFKKEHGKTVIGEVLLEQAYGGMRGIKGLVWEGSVLDPEEGIRFRGRTIPEIQRELPKAEGSTEPLPEALFWLLLTGEIPTDAQVKALSADLAARSEIPEHVIQLLDSLPKDLHPMAQFSIAVTALESESKFAKAYAQGVSKKEYWSYTFEDSLDLLGKLPVIASKIYRNVFKDGKITSTDPNADYGKNLAQLLGYENKDFIDLMRLYLTIHSDHEGGNVSAHTTHLVGSALSSPYLSLAAGLNGLAGPLHGRANQEVLEWLFKLREEVKGDYSKETIEKYLWDTLNAGRVVPGYGHAVLRKTDPRYTAQREFALKHFPDYELFKLVSTIYEVAPGVLTKHGKTKNPWPNVDSHSGVLLQYYGLTEASFYTVLFGVARAIGVLPQLIIDRAVGAPIERPKSFSTEKYKELVKKIESKN

SEQ ID NO: 1996 - protein, 149 aa, Saccharomyces cerevisiae
MNLQNNVLNQIHQILLPTNPTLDKPNAEATKEEFSSAENRDEKDYLTNQQPKNLSTPSTSSNGEFIPHIFYSLHQIRKDPNNLSNQLETLTGSIRHRLKLCKSLISENEDTKDLLSKSPSEWQDIIHQREQELQIKRDVLDDLYRKLQR

SEQ ID NO: 1997 - protein, 876 aa, Saccharomyces cerevisiae
MSSITSETGKRRVKRTYEVTRQNDNAVRIEPSSLGEEEDKEAKDKNSALQLKRSRYDPNKVFSNTNQGPEKNNLKGEQLGSQKKSSKYDEKITSNNELTTKKGLLGDSENETKYASSNSKFNVEVTHKIKNAKEIDKINRQRMWEEQQLRNAMAGQSDHPDDITLEGSDKYDYVFDTDAMIDYTNEEDDLLPEEKLQYEARLAQALETEEKRILTIQEARKLLPVHQYKDELLQEIKKNQVLIIMGETGSGKTTQLPQYLVEDGFTDQGKLQIAITQPRRVAATSVAARVADEMNVVLGKEVGYQIRFEDKTTPNKTVLKYMTDGMLLREFLTDSKLSKYSCIMIDEAHERTLATDILIGLLKDILPQRPTLKLLISSATMNAKKFSEFFDNCPIFNVPGRRYPVDIHYTLQPEANYIHAAITTIFQIHTTQSLPGDILVFLTGQEEIERTKTKLEEIMSKLGSRTKQMIITPIYANLPQEQQLKIFQPTPENCRKVVLATNIAETSLTIDGIRYVIDPGFVKENSYVPSTGMTQLLTVPCSRASVDQRAGRAGRVGPGKCFRIFTKWSYLHELELMPKPEITRTNLSNTVLLLLSLGVTDLIKFPLMDKPSIPTLRKSLENLYILGALNSKGTITRLGKMMCEFPCEPEFAKVLYTAATHEQCQGVLEECLTIVSMLHETPSLFIGQKRDAAASVLSEVESDHILYLEIFNQWRNSKFSRSWCQDHKIQFKTMLRVRNIRNQLFRCSEKVGLVEKNDQARMKIGNIAGYINARITRCFISGFPMNIVQLGPTGYQTMGRSSGGLNVSVHPTSILFVNHKEKAQRPSKYVLYQQLMLTSKEFIRDCLVIPKEEWLIDMVPQIFKDLIDDKTNRGRR

SEQ ID NO: 1998 - protein, 2233 aa, Saccharomyces cerevisiae
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLSDGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 1999 - protein, 642 aa, Saccharomyces cerevisiae
MDKKKDLLENEQFLRIQKLNAADAGKRQSITVDDEGELYGLDTSGNSPANEHTATTITQNHSVVASNGDVAFIPGTATEGNTEIVTEEVIETDDNMFKTHVKTLSSKEKARYRQGSSNFISYFDDMSFEHRPSILDGSVNEPFKTKFVGPTLEKEIRRREKELMAMRKNLHHRKSSPDAVDSVGKNDGAAPTTVPTAATSETVVTVETTIISSNFSGLYVAFWMAIAFGAVKALIDYYYQHNGSFKDSEILKFMTTNLFTVASVDLLMYLSTYFVVGIQYLCKWGVLKWGTTGWIFTSIYEFLFVIFYMYLTENILKLHWLSKIFLFLHSLVLLMKMHSFAFYNGYLWGIKEELQFSKSALAKYKDSINDPKVIGALEKSCEFCSFELSSQSLSDQTQKFPNNISAKSFFWFTMFPTLIYQIEYPRTKEIRWSYVLEKICAIFGTIFLMMIDAQILMYPVAMRALAVRNSEWTGILDRLLKWVGLLVDIVPGFIVMYILDFYLIWDAILNCVAELTRFGDRYFYGDWWNCVSWADFSRIWNIPVHKFLLRHVYHSSMSSFKLNKSQATLMTFFLSSVVHELAMYVIFKKLRFYLFFFQMLQMPLVALTNTKFMRNRTIIGNVIFWLGICMGPSVMCTLYLTF

SEQ ID NO: 2000 - protein, 1579 aa, Saccharomyces cerevisiae
MSHSDYFNYKPYGDSTEKPSSSKMRQSSSSSSSRLRSESLGRNSNTTQARVASSPISPGLHSTQYFRSPNAVYSPGESPLNTVQLFNRLPGIPQGQFFHQNAISGSSSSSARSSRRPSNIGLPLPKNPQQSLPKLSTQPVPVHKKVEASKTESEIIKKPAPVNSNQDPLLTTPTLVISPELASLNTTNTSIMSTPQNITNQTSNKHIPTRSQPNGSTSSSTLQDIVTTNSSQRSVGHHGGSTTSLRTYKKQYVLNEQLYLRKMRNRANDDYYTRGIVASSNFEDDEENFSNKGEDDLELEMDDLLKVEGEDKDNDFNFGYNFITSSTKNNENVVSMSLNYLKGKLDWLRDVNNDQPCEIEDEEWHSILGSEDLLSKLLQNPMVNNRFEWQTMLSKVLKGDIVRNEKTKIANQGKGPGFNTQFSDDIWIELKAWMNGRTVEDQNKSLRIFRDSTDSVFQEIMAFKLEDNMSADEAAETIKSLVDKYYRVLNLWPNIKRMHAEKPITKTEAFRNRIDTLNSWLNFKFNFDTNIAYLKKWIVGNKELESTTEVDNTTVNLDDPAVFATNCKRFAEQIMKEKDIELIFQKKIFFPLAPWILKAKFFFLKYQKTWNELNLSYLDQDLEFLLMFPMRLVKDIILIRLSYAKKIQNPTLMMIDQMMDDFSTYIKLAVQMKFTVASYCNDWFFKVKIDPEFDHTVVEGLEYFFSILELRILYSGKNSFKTSKEPDLLLKYWEMFRNVGYYIDDAGELIAAEFTKLTLRLVHRLHAYLLRQQNTPPKLENEAAAEKWLVQIFEILGSMKRKLNRFTNILTKAFQNFVRYKIEDHNYLLKQLKETGHFLIYTGGYLEQNGTYLIGSPELLGCKDDDILRIIKNSDIGCDLVPKLEINNSLTIYNALDDNWNSNSSLGSDISNDGTPFYYIKNDLTTQPRSYNGNRVNREPDFENSRSTEEEFYELETRLNSLGYVLVLTPQEPLLWEGEMYNLSDNKTIKPEGLNLKVIPNSIDLMCQGSSYALEYQCDRFQQISGSSVSFLEKKSSSETVKNNLQRINKAYFRCTYSVLKNYTKIVTTFKKVSPVNDLLNNIFLFGRDFGLNFLRINVANNEKRSIIILLMMRLSIGWLKFLAEDCDPTDQRVFRWCVTSMEFAMHMVSGWNILALDECQFSSLKQKISECMSLLISHFDIIGARSIEVEKINQQARSNLDLEDVFDDDMMLQVNSEFRVQSIMELEERIKRNPHQTGKVIDDSDKGNKYLVSLASSISNVSMRWQKRNFIGGGTFGRVYSAVDLDNGEILAVKEINIQDSKSMQKIFPLIKEEMSVLEILNHPNIVSYYGVEVHRDKVNIFMEYCEGGSLAALLEHGRIEDEMVTQVYTLQLLEGLAYLHESGIVHRDVKPENILLDFNGVIKYVDFGAAKKIANNGTRLASMNKIENADGEHEDVTHVSDSKAVKNNENALLDMMGTPMYMAPESITGSTTKGKLGADDVWSLGCVVLEMITGRRPWANLDNEWAIMYHVAAGHTPQFPTKDEVSSAGMKFLERCLIQNPSKRASAVELLMDPWIVQIREIAFGDDSSSTDTEERE

SEQ ID NO: 2001 - protein, 368 aa, Saccharomyces cerevisiae
MELDECLERLYKAQLLPEVTVRALCFKLKEMLVKESNVIHIQTPVTVVGDMHGQFHDMLEIFQIGGPVPDTNYLFLGDYVDRGLYSVETIMLLIVLKLRYPSRIHLLRGNHESRQITQSYGFYTECLNKYGGNSRVWQYLTDIFDYLVLCCIIDDEIFCVHGGLSPNVQTIDQIKIIDRFREIPHDGAMADLVWSDPEENNNPTLDHPDNSGQHFQVSPRGAGYTFGRSVVEKFLRMNDMNRIYRAHQLCNEGYQIYFDGLVTTVWSAPNYCYRCGNKASILELYSKDQFYFNVFEEAPENKLLKENSMNDNALEDSISNPVANRKLIADYFEDDSASADGSTDPEMYIFSDVYQARSASNRHVDYFL

SEQ ID NO: 2002 - protein, 629 aa, Saccharomyces cerevisiae
MFASRFDPSQLTAPAASAPEGIVGTTPPAIVPLKRQATESDNEEYGSHQDSDESSNSSSEEDEDRMQVDYGASEEDSSEVEEEESKPSTHSTVLSRFKQTVSLQERLGASDIAESKEDEGIEDEAASTHQLKQIPQPEFVKNPMNLNTNSLQFKSTGWLNTEKIYYDNSLIKPFSDYANELEAKLLQNICKNFSTNTFPIQSIILDSILPVLNFTLNVSKRNFTRRIGDILVNAATGSGKTLAYSIPIVQTLFKRQINRLRCIIIVPTKLLINQVYTTLTKLTQGTSLIVSIAKLENSLKDEHKKLSNLEPDILITTPGRLVDHLNMKSINLKNLKFLIIDEADRLLNQSFQGWCPKLMSHLKTDKLDTLPGNVIKMIFSATLTTNTEKLNGLNLYKPKLFLKQTDKLYQLPNKLNEFNINIPTAKSVYKPLILLYSICQFMAHSPIAAKILIFVKSNESSIRLSKLLQLICESRSQSSVLKNLQNLAVSINSVNSNNSKAENKKIVANFSHHSESAGITILITTDIMSRGIDINDITQVINYDPPMSSQQYVHRVGRTARANELGSAYNLLVGRGERTFFDDLNKDLDRDGKSVQPLELDFTLLESDSELYTSSLESLKNYHNNTAQA

SEQ ID NO: 2003 - protein, 396 aa, Saccharomyces cerevisiae
MTVYTASVTAPVNIATLKYWGKRDTKLNLPTNSSISVTLSQDDLRTLTSAATAPEFERDTLWLNGEPHSIDNERTQNCLRDLRQLRKEMESKDASLPTLSQWKLHIVSENNFPTAAGLASSAAGFAALVSAIAKLYQLPQSTSEISRIARKGSGSACRSLFGGYVAWEMGKAEDGHDSMAVQIADSSDWPQMKACVLVVSDIKKDVSSTQGMQLTVATSELFKERIEHVVPKRFEVMRKAIVEKDFATFAKETMMDSNSFHATCLDSFPPIFYMNDTSKRIISWCHTINQFYGETIVAYTFDAGPNAVLYYLAENESKLFAFIYKLFGSVPGWDKKFTTEQLEAFNHQFESSNFTARELDLELQKDVARVILTQVGSGPQETNESLIDAKTGLPKE

SEQ ID NO: 2004 - protein, 725 aa, Saccharomyces cerevisiae
MTLSFAHFTYLFTILLGLTNIALASDPETILVTITKTNDANGVVTTTVSPALVSTSTIVQAGTTTLYTTWCPLTVSTSSAAEISPSISYATTLSRFSTLTLSTEVCSHEACPSSSTLPTTTLSVTSKFTSYICPTCHTTAISSLSEVGTTTVVSSSAIEPSSASIISPVTSTLSSTTSSNPTTTSLSSTSTSPSSTSTSPSSTSTSSSSTSTSSSSTSTSSSSTSTSPSSTSTSSSLTSTSSSSTSTSQSSTSTSSSSTSTSPSSTSTSSSSTSTSPSSKSTSASSTSTSSYSTSTSPSLTSSSPTLASTSPSSTSISSTFTDSTSSLGSSIASSSTSVSLYSPSTPVYSVPSTSSNVATPSMTSSTVETTVSSQSSSEYITKSSISTTIPSFSMSTYFTTVSGVTTMYTTWCPYSSESETSTLTSMHETVTTDATVCTHESCMPSQTTSLITSSIKMSTKNVATSVSTSTVESSYACSTCAETSHSYSSVQTASSSSVTQQTTSTKSWVSSMTTSDEDFNKHATGKYHVTSSGTSTISTSVSEATSTSSIDSESQEQSSHLLSTSVLSSSSLSATLSSDSTILLFSSVSSLSVEQSPVTTLQISSTSEILQPTSSTAIATISASTSSLSATSISTPSTSVESTIESSSLTPTVSSIFLSSSSAPSSLQTSVTTTEVSTTSISIQYQTSSMVTISQYMGSGSQTRLPLGKLVFAIMAVACNVIFS

SEQ ID NO: 2005 - protein, 480 aa, Saccharomyces cerevisiae
MSQEISYTPDVAELLDFDKKHIWHPYTSLSSPLNVYPVKSAHGCKLVLDTDSPVDVEVIDAMSSWWCVIHGYNNPELNEALTKQMLKFSHVLLGGFTHKGAVNLVQKLLKVIDEPSLQYCFLADSGSVAVEVALKMALQSNMSGEATKNRTKFLTIKNGYHGDTFGAMSVCDPENSMHHIYNDRLSENIFAQAPSIVDGLPTSQNGFEDHWNAEEVTDLKKQFELHSDKICAVILEPILQGAGGLRPYHPQFLIEVQKLCNQYDVLFIMDEIATGFGRTGEIFAFKHCQKYQDQHGISPSDQIKVVPDILCVGKGLTSGYMTMSAVVVNDKVASRISSPNSPTGGCFMHGPTFMGNALACSVAEKSMDILLRGEWRKQVSAIENQIYRELYQYIKNPDNGLIGTVVKRVSVIGAVGIVELYKKTDPEWFQKKFISKGVHIRPFNCLCYIMPPYVITTEELTKVNQVLIEVLHEWKSHINQ

SEQ ID NO: 2006 - protein, 564 aa, Saccharomyces cerevisiae
MQSSTESDRDIQDGPDADIHVAPPVEKEWSDGFDDNEVINGDNVEPPKRGLIGYLVIYLLCYPISFGGFLPGWDSGITAGFINMDNFKMNFGSYKHSTGEYYLSNVRMGLLVAMFSIGCAIGGLIFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYDNTAQWRVPLGLCFLWTLIIIIGMLLVPESPRYLIECERHEEARASIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAAGMMACMVIFASIGVKCLYPHGQDGPSSKGAGNAMIVFTCFYIFCFATTWAPVAYIVVAESFPSKVKSRAMSISTACNWLWQFLIGFFTPFITGSIHFYYGYVFVGCLVAMFLYVFFFLPETIGLSLEEIQLLYEEGIKPWKSASWVPPSRRGIPSEESKTEKKDWKKFLKFSKGSD

SEQ ID NO: 2007 - protein, 589 aa, Saccharomyces cerevisiae
MTISSAHPETEPKWWKEATIYQIYPASFKDSNNDGWGDMKGIASKLEYIKELGADAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWRSYFGGSAWTFDEKTQEFYLRLFCSTQPDLNWENEDCRKAIYESAVGYWLDHGVDGFRIDVGSLYSKVAGLPDAPVIDENSKWQPSDPFTMNGPRIHEFHQEMNKFIRNRVKDGREIMTVGEMQHATDETKRLYTSASRHELSELFNFSHTDVGTSPKFRQNLIPYELKDWKVALAELFRYVNGTDCWSTIYLENHDQPRSITRFGDDSPKNRVISGKLLSVLLVSLSGTLYVYQGQELGEINFKNWPIEKYEDVEVRNNYDAIKEEHGENSKEMKRFLEAIALISRDHARTPMQWSREEPNAGFSGPNAKPWFYLNESFREGINAEDESKDPNSVLNFWKEALRFRKAHKDITVYGYDFEFIDLDNKKLFSFTKKYDNKTLFAALNFSSDSIDFTIPNNSSSFKLEFGNYPRSEVDASSRTLKPWEGRIYISE

SEQ ID NO: 2008 - protein, 567 aa, Saccharomyces cerevisiae
MSGVNNTSANELSTTMSNSNSAVGAPSVKTEHGDSKNSLNLDANEPPIDLPQKPLSAYTTVAILCLMIAFGGFIFGWDTGTISGFVNLSDFIRRFGQKNDKGTYYLSKVRMGLIVSIFNIGCAIGGIVLSKVGDIYGRRIGLITVTAIYVVGILIQITSINKWYQYFIGRIISGLGVGGIAVLSPMLISEVAPKHIRGTLVQLYQLMGTMGIFLGYCTNYGTKNYHNATQWRVGLGLCFAWATFMVSGMMFVPESPRYLIEVGKDEEAKRSLSKSNKVSVDDPALLVEYDTIKAGIELEKLAGNASWSELLSTKTKVFQRVLMGVMIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCYVIVSETFPLRVKSRGMAIATAANWMWGFLISFFTPFITGAINFYYGYVFLGCLVFAYFYVFFFVPETKGLTLEEVNTMWLEGVPAWKSASWVPPERRTADYDADAIDHDNRPIYKRFFSS

SEQ ID NO: 2009 - protein, 1077 aa, Saccharomyces cerevisiae
MTNAMKVEGYPSMEWPTSLDIPLKASEELVGIDLETDLPDDPTDLKTLLVEENSEKEHWLTIALAYCNHGKTNEGIKLIEMALDVFQNSERASLHTFLTWAHLNLAKGQSLSVETKEHELTQAELNLKDAIGFDPTWIGNMLATVELYYQRGHYDKALETSDLFVKSIHAEDHRSGRQSKPNCLFLLLRAKLLYQKENYMASLKIFQELLVINPVLQPDPRIGIGLCFWQLKDSKMAIKSWQRALQLNPKNTSASILVLLGEFRESFTNSTNDKTFKEAFTKALSDLNNIFSENQHNPVLLTLLQTYYYFKGDYQTVLDIYHHRILKMSPMIAKIVLSESSFWCGRAHYALGDYRKSFIMFQESLKKNEDNLLAKLGLGQTQIKNNLLEESIITFENLYKTNESLQELNYILGMLYAGKAFDAKTAKNTSAKEQSNLNEKALKYLERYLKLTLATKNQLVISRAYLVISQLYELQNQYKTSLDYLSKALEEMEFIKKEIPLEVLNNLACYHFINGDFIKADDLFKQAKAKVSDKDESVNITLEYNIARTNEKNDCEKSESIYSQVTSLHPAYIAARIRNLYLKFAQSKIEDSDMSTEMNKLLDLNKSDLEIRSFYGWYLKNSKERKNNEKSTTHNKETLVKYNSHDAYALISLANLYVTIARDGKKSRNPKEQGKSKHSYLKAIQLYQKVLQVDPFNIFAAQGLAIIFAESKRLGPALEILRKVRDSLDNEDVQLNLAHCYLEMREYGKAIENYELVLKKFDNEKTRPHILNLLGRAWYARAIKETSVNFYQKALENAKTALDLFVKESSKSKFIHSVKFNIALLHFQIAETLRRSNPKFRTVQQIKDSLEGLKEGLELFRELNDLKEFNMIPKEELEQRIQLGETTMKSALERSLNEQEEFKKEQRAKIDEARKILEENELKEQGWMKQEEEARRLKLEKQAEEYRKLQDEAQKIFQVREAMAISEHNVKDDSDLSDKDNEYDEEQPRQKRKRSTKTKNSGESKRRKAAKKTLSDSDEDDDDVVKKPSHNKGKKSQLSNEFIEDSDEEEAQMSGSEQNKNDDNDENNDNDDNDGLF

SEQ ID NO: 2010 - protein, 423 aa, Saccharomyces cerevisiae
MFKRYLSSTSSRRFTSILEEKAFQVTTYSRPEDLCITRGKNAKLYDDVNGKEYIDFTAGIAVTALGHANPKVAEILHHQANKLVHSSNLYFTKECLDLSEKIVEKTKQFGGQHDASRVFLCNSGTEANEAALKFAKKHGIMKNPSKQGIVAFENSFHGRTMGALSVTWNSKYRTPFGDLVPHVSFLNLNDEMTKLQSYIETKKDEIAGLIVEPIQGEGGVFPVEVEKLTGLKKICQDNDVIVIHDEIQCGLGRSGKLWAHAYLPSEAHPDIFTSAKALGNGFPIAATIVNEKVNNALRVGDHGTTYGGNPLACSVSNYVLDTIADEAFLKQVSKKSDILQKRLREIQAKYPNQIKTIRGKGLMLGAEFVEPPTEVIKKARELGLLIITAGKSTVRFVPALTIEDELIEEGMDAFEKAIEAVYA

SEQ ID NO: 2011 - protein, 213 aa, Saccharomyces cerevisiae
MSVEEVSKKFEENVSVDDTTATPKTVLSDSAHFDVKHPLNTKWTLWYTKPAVDKSESWSDLLRPVTSFQTVEEFWAIIQNIPEPHELPLKSDYHVFRNDVRPEWEDEANAKGGKWSFQLRGKGADIDELWLRTLLAVIGETIDEDDSQINGVVLSIRKGGNKFALWTKSEDKEPLLRIGGKFKQVLKLTDDGHLEFFPHSSANGRHPQPSITL

SEQ ID NO: 2012 - protein, 375 aa, Saccharomyces cerevisiae
MLKVNNVFGSNPNRMTKLEDEHYFIDDIVSIKNRQKSKMYVREGKRIGHGSFGTVTQSILSSNSIEWLGPYAIKRVVKSPKVQSLELEILQNIRHPNLVTLEFFFESHCTTKDGGHLYQKNFVMEYIPQTLSSEIHEYFDNGSKMPTKHIKLYTFQILRALLTLHSMSICHGDLKPSNILIIPSSGIAKVCDFGSAQRLDDNTELKTYFCSRFYRAPELLLNSKDYTTQIDIWSLGCIIGEMIKGQPLFKGDSANSQLEEIAKLLGRFPKSSIKNSQELQDSLNDQKFKKFMHWFPSIEFFDVEFLLKVLTYDATERCDARQLMAHEFFDALRNETYFLPRGSSMPVHLPDLFNFSASEKRALGEYYNLIVPSLD

SEQ ID NO: 2013 - protein, 423 aa, Saccharomyces cerevisiae
MILLLILFPCIYFLPFCINRTVRSSPEYSAADYYKSSIQYHKSYSNMPHSVTPSIEQDSLKIAILGAAGGIGQSLSLLLKAQLQYQLKESNRSVTHIHLALYDVNQEAINGVTADLSHIDTPISVSSHSPAGGIENCLHNASIVVIPAGVPRKPGMTRDDLFNVNAGIISQLGDSIAECCDLSKVFVLVISNPVNSLVPVMVSNILKNHPQSRNSGIERRIMGVTKLDIVRASTFLREINIESGLTPRVNSMPDVPVIGGHSGETIIPLFSQSNFLSRLNEDQLKYLIHRVQYGGDEVVKAKNGKGSATLSMAHAGYKCVVQFVSLLLGNIEQIHGTYYVPLKDANNFPIAPGADQLLPLVDGADYFAIPLTITTKGVSYVDYDIVNRMNDMERNQMLPICVSQLKKNIDKGLEFVASRSASS

SEQ ID NO: 2014 - protein, 501 aa, Saccharomyces cerevisiae
MLNIPIIANSKRFLFSKDHEAQSTRDHDVELETREGPSSGYNPNFNAADAILKKNSDQVDLDVNKLTNVTSRVLNTPEASLIYDDDREFPDGGLKAWLVVFGAFMGLVPVFGLINSLGAIESYISKHQLANISSSTISWIFSLYLAISFLSCILSGGYFDRNGSIGLMCTGTVIYAGGLFALANCKSVWQFILAFSVCSGLGTGILMTPLIGTVATWFLKRRGIATSISTMGGSIGGIVFPIMLRKLYKEVGFQWAIRILSFICLTCLICASVLARERTKPVVQPFKSKAEVAKWYISSVFNWRYFLEGKFLFVAIGASFAESSLTSCATYLASYSMTRGNTENVAYTMITASNAVGILGRYIPGYFADKFIGRFNVEIITISMAALFNFVMWLPFGGNTKVLWAYVCLWGFSTGSILSLTPVCIGQISKTTDFGKRYATVYLLQALVTIPVLPIGGTLIGKGTVANYNHFIIFNSALMAAGAACYIISRHICVGAKLCKF

SEQ ID NO: 2015 - protein, 584 aa, Saccharomyces cerevisiae
MGAKSVTASSSKKIKNRHNGKVKKSKKIKKVRKPQKSISLNDENEVEILPSRNEQETNKLPKDHVTADGILVLEHKSDDDEGFDVYDGHFDNPTDIPSTTEESKTPSLAVHGDEKDLANNDDFISLSASSEDEQAEQEEEREKQELEIKKEKQKEILNTDYPWILNHDHSKQKEISDWLTFEIKDFVAYISPSREEIEIRNQTISTIREAVKQLWPDADLHVFGSYSTDLYLPGSDIDCVVTSELGGKESRNNLYSLASHLKKKNLATEVEVVAKARVPIIKFVEPHSGIHIDVSFERTNGIEAAKLIREWLDDTPGLRELVLIVKQFLHARRLNNVHTGGLGGFSIICLVFSFLHMHPRIITNEIDPKDNLGVLLIEFFELYGKNFGYDDVALGSSDGYPVYFPKSTWSAIQPIKNPFSLAIQDPGDESNNISRGSFNIRDIKKAFAGAFDLLTNRCFELHSATFKDRLGKSILGNVIKYRGKARDFKDERGLVLNKAIIENENYHKKRSRIIHDEDFAEDTVTSTATATTTDDDYEITNPPAKKAKIEEKPESEPAKRNSGETYITVSSEDDDEDGYNPYTL

SEQ ID NO: 2016 - protein, 655 aa, Saccharomyces cerevisiae
MKGVKKEGWISYKVDGLFSFLWQKRYLVLNDSYLAFYKSDKCNEEPVLSVPLTSITNVSRIQLKQNCFEILRATDQKENISPINSYFYESNSKRSIFISTRTERDLHGWLDAIFAKCPLLSGVSSPTNFTHKVHVGFDPKVGNFVGVPDSWAKLLQTSEITYDDWNRNSKAVIKALQFYEDYNGLDTMQFNDHLNTSLDLKPLKSPTRYIINKRTNSIKRSVSRTLRKGKTDSILPVYQSELKPFPRPSDDDYKFTNIEDNKVREEGRVHVSKESTADSQTKQLGKKEQKVIQSHLRRHDNNSTFRPHRLAPSAPATKNHDSKTKWHKEDLLELKNNDDSNEIIMKMKTVAIDVNPRPYFQLVEKAGQGASGAVYLSKRIKLPQENDPRFLKSHCHRVVGERVAIKQIRLSEQPKKQLIMNELLVMNDSRQENIVNFLEAYIIDDEELWVIMEYMEGGCLTDILDAVARSNTGEHSSPLNENQMAYIVKETCQGLKFLHNKKIIHRDIKSDNILLNSQGLVKITDFGFCVELTEKRSKRATMVGTPYWMAPEIVNQKGYDEKVDVWSLGIMLIEMIEGEPPYLNEDPLKALYLIANNGSPKLRHPESVSKQTKQFLDACLQVNVESRASVRKLLTFEFLSMACSPEQLKVSLKWH

SEQ ID NO: 2017 - protein, 237 aa, Saccharomyces cerevisiae
MCDSHQKEEDNANTSERALFFNYHEFSYSFYEDLGSEDAKPTEHDEDHKLCITHFPNVYAARGSAEFQVTRVVRVPRRFDESRSSLETPQFSTQLPGSEPAAIVGDDGTSFVRCGRYDIGDHVFGCSSVSPLSEYLSAAELAEVVHRVNGFLLREEGEVFGWRNLSGLLLDMLTGGLWSWVLGPLLSRPVFQESLALEQYVAQLNSPGGLLHERGVRLVLPRRSGCLSLDFVVPRPK

SEQ ID NO: 2018 - protein, 556 aa, Saccharomyces cerevisiae
MERVWFAKLTNKGTIKIGYISFILLSLLCQSLIGLVNADFNYEGCYSAADIQSAGLSLKNSYIYQSVSYCQNQCPESAVVALFNGSDCYCGNSVSFLTSLTKSTDSNCGTKCSGWPYQMCGGSSYMNVYVNAETFVSSVESSSSKEGSSTSYMPSTTSSLSSAQISSTTRRTSTDMKSSEMIATTVSTTSTTSSSTSSTTSSTTSSTTSSTTSSTTSSSTSSTTSSTTSSTTSSTTSSTTSSTTSSTTSSTTSSTTSIFSVTSSSSSITLSSSEHTTVDSRTSSPSSTLVPVSSSSSTLSTPKVTSMTPSTSSTIPIVTSVELVTSVVTKAIVSTSDQHQETIFVTRTSVVERSSEVATATAAASNNRSNSTSKQRLSGGAIAGIVIGVVFGVIFIILILLFLIWRRRKSHDQLDLEETKHYQPYSFGDEDANPIGPPPSSGTTNWMRHSRGNTAGSIGTSNMYGFSMSNGANYSSPSSNTSGSIINNLAGLQDATVQKQNLPSTVFEEANTLNSANERFSANSLPDMMMSGPLQVVNPDNPDNPELSSTVSHNRA

SEQ ID NO: 2019 - protein, 612 aa, Saccharomyces cerevisiae
MAEMKNSTAASSRWTKSRLSHFFPSYTNSSGMGAASTDQSSTQGEELHHRKHCEEDNDGQKPKKSPVSTSTMQIKSRQDEDEDDGRIVIKPVNDEDDTSVIITFNQSISPFIITLTFVASISGFMFGYDTGYISSALISINRDLDNKVLTYGEKELITAATSLGALITSVGAGTAADVFGRRPCLMFSNLMFLIGAILQITAHKFWQMAAGRLIMGFGVGIGSLISPLFISEIAPKMIRGRLTVINSLWLTGGQLIAYGCGAGLNHVKNGWRILVGLSLIPTVLQFSFFCFLPDTPRYYVMKGDLKRAKMVLKRSYVNTEDEIIDQKVEELSSLNQSIPGKNPITKFWNMVKELHTVPSNFRALIIGCGLQAIQQFTGWNSLMYFSGTIFETVGFKNSSAVSIIVSGTNFVFTLIAFFCIDKIGRRYILLIGLPGMTVALVICAIAFHFLGIKFNGADAVVASDGFSSWGIVIIVFIIVYAAFYALGIGTVPWQQSELFPQNVRGVGTSYATATNWAGSLVIASTFLTMLQNITPTGTFSFFAGVACLSTIFCYFCYPELSGLELEEVQTILKDGFNIKASKALAKKRKQQVAEGAAHHKLKFEPTQEIVES

SEQ ID NO: 2020 - protein, 323 aa, Saccharomyces cerevisiae
MSKTLSLQLPWVEKYRPQVLSDIVGNKETIDRLQQIAKDGNMPHMIISGMPGIGKTTSVHCLAHELLGRSYADGVLELNASDDRGIDVVRNQIKHFAQKKLHLPPGKHKIVILDEADSMTAGAQQALRRTMELYSNSTRFAFACNQSNKIIEPLQSRCAILRYSKLSDEDVLKRLLQIIKLEDVKYTNDGLEAIIFTAEGDMRQAINNLQSTVAGHGLVNADNVFKIVDSPHPLIVKKMLLASNLEDSIQILRTDLWKKGYSSIDIVTTSFRVTKNLAQVKESVRLEMIKEIGLTHMRILEGVGTYLQLASMLAKIHKLNNKA

SEQ ID NO: 2021 - protein, 609 aa, Saccharomyces cerevisiae
MDNILKASNMEGTSTMTVTSRSSEDSSCISNHEQDTDTHKDGDTSGLENSKISKRKWMKEFFKLSKSPASKSSRSIGSMKSNQSLVSMKSSDDGNSYKNDYSSICGNSLPSAGLSRSNSVKELKLDSTGSQRSKNNVAMLARSSTTSQTTCSSSSSSSSYNSIKGNENDILLQNNNHFRHNKEIPQSKGSSNINTASIMSQYNVDTQATAIMSDMQKQYDSQQMTSPFVNEDLHFDPNGEVSHVIKAIFKEIGYKYDDFSDIPVFQLMQEMYQLVKKNSSARRTKITDYASKLKEKEAQLKSQNDKILKLETTNKAYKTKYKEVSLENKKIKEAFKELDNESYNHDEELLKKYKYTRETLDRVNREQQLIIDQNEFLKKSVNELQNEVNATNFKFSLFKEKYAKLADSITELNTSTKKREALGENLTFECNELKEICLKYKKNIENISNTNKNLQNSFKNERKKVLDLRNERNLLKKEILLIECHGSYSLLLVSNILTCYRFLLPSDTIIETESLIKELLNMNNSLSNHVSSSDEPPAEYSKRLELKCVEFEEKLLYFYQELVTKKIIDVIYKCFINYYKKSRQTDQKSNQNSSTPYKQSQRQVPHSIK

SEQ ID NO: 2022 - protein, 964 aa, Saccharomyces cerevisiae [sequence omitted]

SEQ ID NO: 2023 - protein, 348 aa, Saccharomyces cerevisiae
MSIPETQKGVIFYESHGKLEYKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQQYATADAVQAAHIPQGTDLAQVAPILCAGITVYKALKSANLMAGHWVAISGAAGGLGSLAVQYAKAMGYRVLGIDGGEGKEELFRSIGGEVFIDFTKEKDIVGAVLKATDGGAHGVINVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 2024 - protein, 3079 aa, Saccharomyces cerevisiae
MSQPTKNKKKEHGTDSKSSRMTRTLVNHILFERILPILPVESNLSTYSEVEEYSSFISCRSVLINVTVSRDANAMVEGTLELIESLLQGHEIISDKGSSDVIESILIILRLLSDALEYNWQNQESLHYNDISTHVEHDQEQKYRPKLNSILPDYSSTHSNGNKHFFHQSKPQALIPELASKLLESCAKLKFNTRTLQILQNMISHVHGNILTTLSSSILPRHKSYLTRHNHPSHCKMIDSTLGHILRFVAASNPSEYFEFIRKSVQVPVTQTHTHSHSHSHSLPSSVYNSIVPHFDLFSFIYLSKHNFKKYLELIKNLSVTLRKTIYHCLLLHYSAKAIMFWIMARPAEYYELFNLLKDNNNEHSKSLNTLNHTLFEEIHSTFNVNSMITTNQNAHQGSSSPSSSSPSSPPSSSSSDNNNQNIIAKSLSRQLSHHQSYIQQQSERKLHSSWTTNSQSSTSLSSSTSNSTTTDFSTHTQPGEYDPSLPDTPTMSNITISASSLLSQTPTPTTQLQQRLNSAAAAAAAAASPSNSTPTGYTAEQQSRASYDAHKTGHTGKDYDEHFLSVTRLDNVLELYTHFDDTEVLPHTSVLKFLTTLTMFDIDLFNELNATSFKYIPDCTMHRPKERTSSFNNTAHETGSEKTSGIKHITQGLKKLTSLPSSTKKTVKFVKMLLRNLNGNQAVSDVALLDTMRALLSFFTMTSAVFLVDRNLPSVLFAKRLIPIMGTNLSVGQDWNSKINNSLMVCLKKNSTTFVQLQLIFFSSAIQFDHELLLARLSIDTMANNLNMQKLCLYTEGFRIFFDIPSKKELRKAIAVKISKFFKTLFSIIADILLQEFPYFDEQITDIVASILDGTIINEYGTKKHFKGSSPSLCSTTRSRSGSTSQSSMTPVSPLGLDTDICPMNTLSLVGSSTSRNSDNVNSLNSSPKNLSSDPYLSHLVAPRARHALGGPSSIIRNKIPTTLTSPPGTEKSSPVQRPQTESISATPMAITNSTPLSSAAFGIRSPLQKIRTRRYSDESLGKFMKSTNNYIQEHLIPKDLNEATLQDARRIMINIFSIFKRPNSYFIIPHNINSNLQWVSQDFRNIMKPIFVAIVSPDVDLQNTAQSFMDTLLSNVITYGESDENISIEGYHLLCSYTVTLFAMGLFDLKINNEKRQILLDITVKFMKVRSHLAGIAEASHHMEYISDSEKLTFPLIMGTVGRALFVSLYSSQQKIEKTLKIAYTEYLSAINFHERNIDDADKTWVHNIEFVEAMCHDNYTTSGSIAFQRRTRNNILRFATIPNAILLDSMRMIYKKWHTYTHSKSLEKQERNDFRNFAGILASLSGILFINKKILQEMYPYLLDTVSELKKNIDSFISKQCQWLNYPDLLTRENSRDILSVELHPLSFNLLFNNLRLKLKELACSDLSIPENESSYVLLEQIIKMLRTILGRDDDNYVMMLFSTEIVDLIDLLTDEIKKIPAYCPKYLKAIIQMTKMFSALQHSEVNLGVKNHFHVKNKWLRQITDWFQVSIAREYDFENLSKPLKEMDLVKRDMDILYIDTAIEASTAIAYLTRHTFLEIPPAASDPELSRSRSVIFGFYFNILMKGLEKSSDRDNYPVFLRHKMSVLNDNVILSLTNLSNTNVDASLQFTLPMGYSGNRNIRNAFLEVFINIVTNYRTYTAKTDLGKLEAADKFLRYTIEHPQLSSFGAAVCPASDIDAYAAGLINAFETRNATHIVVAQLIKNEIEKSSRPTDILRRNSCATRSLSMLARSKGNEYLIRTLQPLLKKIIQNRDFFEIEKLKPEDSDAERQIELFVKYMNELLESISNSVSYFPPPLFYICQNIYKVACEKFPDHAIIAAGSFVFLRFFCPALVSPDSENIIDISHLSEKRTFISLAKVIQNIANGSENFSRWPALCSQKDFLKECSDRIFRFLAELCRTDRTIDIQVRTDPTPIAFDYQFLHSFVYLYGLEVRRNVLNEAKHDDGDIDGDDFYKTTFLLIDDVLGQLGQPKMEFSNEIPIYIREHMDDYPELYEFMNRHAFRNIETSTAYSPSVHESTSSEGIPIITLTMSNFSDRHVDIDTVAYKFLQIYARIWTTKHCLIIDCTEFDEGGLDMRKFISLVMGLLPEVAPKNCIGCYYFNVNETFMDNYGKCLDKDNVYVSSKIPHYFINSNSDEGLMKSVGITGQGLKVLQDIRVSLHDITLYDEKRNRFTPVSLKIGDIYFQVLHETPRQYKIRDMGTLFDVKFNDVYEISRIFEVHVSSITGVAAEFTVTFQDERRLIFSSPKYLEIVKMFYYAQIRLESEYEMDNNSSTSSPNSNNKDKQQKERTKLLCHLLLVSLIGLFDESKKMKNSSYNLIAATEASFGLNFGSHFHRSPEVYVPEDTTTFLGVIGKSLAESNPELTAYMFIYVLEALKNNVIPHVYIPHTICGLSYWIPNLYQHVYLADDEEGPENISHIFRILIRLSVRETDFKAVYMQYVWLLLLDDGRLTDIIVDEVINHALERDSENRDWKKTISLLTVLPTTEVANNIIQKILAKIRSFLPSLKLEAMTQSWSELTILVKISIHVFFETSLLVQMYLPEILFIVSLLIDVGPRELRSSLHQLLMNVCHSLAINSALPQDHRNNLDEISDIFAHQKVKFMFGFSEDKGRILQIFSASSFASKFNILDFFINNILLLMEYSSTYEANVWKTRYKKYVLESVFTSNSFLSARSIMIVGIMGKSYITEGLCKAMLIETMKVIAEPKITDEHLFLAISHIFTYSKIVEGLDPNLDLMKHLFWFSTLFLESRHPIIFEGALLFVSNCIRRLYMAQFENESETSLISTLLKGRKFAHTFLSKIENLSGIVWNEDNFTHILIFIINKGLSNPFIKSTAFDFLKMMFRNSYFEHQINQKSDHYLCYMFLLYFVLNCNQFEELLGDVDFEGEMVNIENKNTIPKILLEWLSSDNENANITLYQGAILFKCSVTDEPSRFRFALIIRHLLTKKPICALRFYSVIRNEIRKISAFEQNSDCVPLAFDILNLLVTHSESNSLEKLHEESIERLTKRGLSIVTSSGIFAKNSDMMIPLDVKPEDIYERKRIMTMILSRMSCSA

SEQ ID NO: 2025 - protein, 1095 aa, Saccharomyces cerevisiae
MISNPSIMFLDEPTTGLDAYSAFLVIKTLKKLAKEDGRTFIMSIHQPRSDILFLLDQVCILSKGNVVYCDKMDNTIPYFESIGYHVPQLVNPADYFIDLSSVDSRSDKEEAATQSRLNSLIDHWHDYERTHLQLQAESYISNATEIQIQNMTTRLPFWKQVTVLTRRNFKLNFSDYVTLISTFAEPLIIGTVCGWIYYKPDKSSIGGLRTTTACLYASTILQCYLYLLFDTYRLCEQDIALYDRERAEGSVTPLAFIVARKISLFLSDDFAMTMIFVSITYFMFGLEADARKFFYQFAVVFLCQLSCSGLSMLSVAVSRDFSKASLVGNMTFTVLSMGCGFFVNAKVMPVYVRWIKYIAFTWYSFGTLMSSTFTNSYCTTDNLDECLGNQILEVYGFPRNWITVPAVVLLCWSVGYFVVGAIILYLHKIDITLQNEVKSKQKKIKKKSPTGMKPEIQLLDDVYHQKDLEAEKGKNIHITIKLEDIDLRVIFSAPFSNWKEGNFHHETKEILQSVNAIFKPGMINAIMGPSGSGKSSLLNLISGRLKSSVFAKFDTSGSIMFNDIQVSELMFKNVCSYVSQDDDHLLAALTVKETLKYAAALRLHHLTEAERMERTDNLIRSLGLKHCENNIIGNEFVKGISGGEKRRVTMGVQLLNDPPILLLDEPTSGLDSFTSATILEILEKLCREQGKTIIITIHQPRSELFKRFGNVLLLAKSGRTAFNGSPDEMIAYFTELGYNCPSFTNVADFFLDLISVNTQNEQNEISSRARVEKILSAWKANMDNESLSPTPISEKQQYSQESFFTEYSEFVRKPANLVLAYIVNVKRQFTTTRRSFDSLMARIAQIPGLGVIFALFFAPVKHNYTSISNRLGLAQESTALYFVGMLGNLACYPTERDYFYEEYNDNVYGIAPFFLAYMTLELPLSALASVLYAVFTVLACGLPRTAGNFFATVYCSFIVTCCGERLGIMTNTFFERPGFVVNCISIILSIGTQMSGLMSLGMSRVLKGFNYLNPVGYTSMIIINFAFPGNLKLTCEDGGKNSDGTCEFANGHDVLVSYGLVRNTQKYLGIIVCVAIIYRLIAFFILKAKLEWIKW

SEQ ID NO: 2026 - protein, 694 aa, Schizosaccharomyces pombe
MYVNYIGLFAFVQISLTLAYPPGRVEISEIYDFEESSSYKGQDIDTSVLYTLSKRKPALVKRSTDASYAPFNVTCSNDNLLRPASEGLNEGEQSYINKRISKVNSELRSFISKTGLNVDLDKVVNSSDGPRLGIAFSGGGLRAMVNGGGAFNAFDSRFESDSPLSGLLQSAMYISGLSGGSWLVGSVAINNFTNITYLRDNVWNLEHSVFAPHGDNVIENLNYYNDLRKEIDQKKHAGFDCSLTDLWGRALSRKLVDAERGGPGITYSSMRNQSWFQNADYPYPIIVADSRLEEETAIPANTSIFEFTAYEFGTWDNGIKAFIPMEYVGTHLLDGVPPDKSCIHNYDNAGFVMGTSATLFNSFLLDWNENVKKNDTYYDILHAILEDLSKHQDDIAPYPNPYQNYTTSNTSVVNAFEPYDTIDLVDGGEDRENIPLWPLLHPQRFVDVVFAIDSTYNDPYGWPLGSSIVATYERVVTFNANKSVDVRGFPYIPDENTIISLGLNTRPTFFGCDGKNTTAGNHDVDNNTPPLLVYFPNYPWTYYSNISTFTMSMDDKMANGILENAFMSTTQNNNESFAVCLACAIIQRSLERKKLSTPTQCSSCFQEYCWDGTLATSTASVYDPTVMSAATTSRAPSGTTSGTASSTTSSSVCSQKFTLIKLFFFSSLTFVLGASATPTHKHWWDSIFEAKENP

SEQ ID NO: 2027 - protein, 594 aa, Schizosaccharomyces pombe
MTKDAESTMTVGTYLAQRLVEIGIKNHFVVPGDYNLRLLDFLEYYPGLSEIGCCNELNCAFAAEGYARSNGIACAVVTYSVGALTAFDGIGGAYAENLPVILVSGSPNTNDLSSGHLLHHTLGTHDFEYQMEIAKKLTCAAVAIKRAEDAPVMIDHAIRQAILQHKPVYIEIPTNMANQPCPVPGPISAVISPEISDKESLEKATDIAAELISKKEKPILLAGPKLRAAGAESAFVKLAEALNCAAFIMPAAKGFYSEEHKNYAGVYWGEVSSSETTKAVYESSDLVIGAGVLFNDYSTVGWRAAPNPNILLNSDYTSVSIPGYVFSRVYMAEFLELLAKKVSKKPATLEAYNKARPQTVVPKAAEPKAALNRVEVMRQIQGLVDSNTTLYAETGDSWFNGLQMKLPAGAKFEVEMQWGHIGWSVPSAMGYAVAAPERRTIVMVGDGSFQLTGQEISQMIRHKLPVLIFLLNNRGYTIEIQIHDGPYNRIQNWDFAAFCESLNGETGKAKGLHAKTGEELTSAIKVALQNKEGPTLIECAIDTDDCTQELVDWGKAVAPPTPVLLPLITRLKRTLFGKNMLHLDYKNYLDIRNT

SEQ ID NO: 2028 - protein, 556 aa, Schizosaccharomyces pombe
  unsure (1)..(556): unsure at all Xaa locations
MNRFITSILVVFISMSGWLQGADTGSISGILGMRDFQSRFADRYNPISNSYSYSAWRQALLTGTINAGCLFGAMLSSPFTERIGKKYSICFFSGVYIIAELLLVTAVPSWIQVLVGKILAGVGIGALSVLSPGYQSEVAPPQIRGAVVATYQIFSTGAALVAACINMGTHKLRKTASWRTSFGINMLWGILLMVGVLFLPESPRYLIYKGRDEEALRIMCNMAELSPESEIIQTNFNTIKSDIEIEMAGGKARWIEIFGKDIRYRTCLGFLVMLFRELIGNNYYFYYATQVFKGTGMTDIFLPAVILGAINFGTTFGALYTIDNLGRRNPLIFGAAFQSICFFIYAAVGDRKLIYKNGTSDHRAGSVMIVFSCLFLFSYCCSWGPMGWVIVGETFPIRYRSKCASVATSGNWLGNFMISFFTPFINNAIGFKLGYIYACINLFSSFMIFFLAKETKGLTLEEVNDLYMSNIKPWESYKYVREIESHRIHFSKEEEKREREKSKGIRGQEEEFIENADEDNNDSSSSSGSVVSAVKPRRSAVSNDRFSEDSHPTYIX

SEQ ID NO: 2029 - protein, 394 aa, Schizosaccharomyces pombe
MALQSLFLILLAGAAQLAQAHPKIFEQSRANAVETFDDAFPGDGETQADSVFSGIATFGRLPYWKCLNDKSQSFDIAFLGAPFDTGTSYRPGARFGPSGIREGSRRLNLYGGYNVPMETNPFNNWAKIVDCGDIPLTSYDNAVAIKQIENGHFELLTRKPTSYSEKDGYALDGSVLPRVITLGGDHTIVLPILRSVSRAYGPVSIIHFDSHLDSWKPKVFGGGKSSVGSINHGTYFYHASQEGLVSNDSNIHAGIRTTLSGLSDYDNDADCGFEIIEAREIDTIGIDAIIKRIRDRVGDGIAYLSIDIDVLDPAYAPATGTPESAGWTTRELRTILRGLDGIKLVGADIVEVAPAYDFAEVTTLAAADILFEVMSIMVKTPVYKEQAKQQSRFY

SEQ ID NO: 2030 - protein, 498 aa, Schizosaccharomyces pombe
MSDQSEYKISKDDEHSIYASEINKEKLQNTASPDVDYGDTASLKIDPKVEKKLLLKMDLVISPIIGFLYLMAFLDRSNIGNAAVAGMTEALSLYGERLNVAVSIFYVLYILVETPSVVLVKRIKASRMLAFISFAWSMTVLFSGFMSSYGGLIATRLILGLLEGCLFPALNLYLTTHYTRKEQCQRLSYLFASAGLAGAFGGLFAYALEQVHAGNKEGWQWIYIVEGLVSFIGVPLCLFALPDKMENAWFLTREEREVAIIRRDINARYHGEQHFEWSEVRKAFKDPKVYVSATSQFCADMVLYGFSSFLPVIIKGLGFVGLQTNYMTIPVYIAGVISFLFVAWLSDRTQLRAVYLISASTVVAVGYIIMLASDSNAAKYTATYIIAIGCYIGPGLNLGWLNNNVAGHYKRATAIGIQQTLANSSGIVAGQIYRSKNAPKYILGNAFTLGCVIVGGLAYVVMFFSLRYVNKKRDERCARGEFDPSAIGDFADDFRYYL

SEQ ID NO: 2031 - protein, 422 aa, Schizosaccharomyces pombe
MSILRSPFRLIRSPARFFPSLFHSSCNQSFTNGLKHQSTSSKAMPVSAFYIPSFNLFGKGCLAEAAKQIKMSGFKNTLIVTDPGIIKVGLYDKVKALLEEQSITVHLYDGVQPNPTVGNVNQGLEIVKKENCDSMVSIGGGSAHDCAKGIALLATNGGKIADYEGVDKSSKPQLPLIAINTTAGTASEMTRFAIITEETRHIKMAIIDKHTMPILSVNDPETMYGLPPSLTAATGMDALTHAVEAYVSTAANPITDACAVKCIELVNKYLKRAVDNGKDEEARDNMAYAEFLGGMAFNNASLGYVHAMAHQLGGFYGIPHGVCNAVLLAHVQKFNSRDPRANARLGDIAFHLGCEEHTAEAALDRISQLVLEVKIRPHLVDLGVKEKDFDVLVDHAMKDACGATNPIQPTHDEVKAIFKSAM

SEQ ID NO: 2032 - protein, 1070 aa, Schizosaccharomyces pombe
MKRKVQKIIDEAPLEENSPPRFFDSDVEADSKPNDLTAANSIVDLKTNSQHENANAAGKEYGDSGVSESWVLDFLSVTGEKTISEFLAQKIWKTSNGDLNVAVDMYFDESFNIKNSNPDSESQKDTDASLTQMDQLSNTVSVKDLSINRNTNKKALNAVSPSLNLSSNSSVQDVSIDKEEMMKKQSRNALTPLDFIMKKNELMKYIGCFGVEAYSTASGTRTLQAGERIYLERQKLSIKSQSRNSRKKSKLLSINSSCYSNIVRFCNSDHHEIGKLPTEVASVISTLMEQGFWSFEAICIYSDNIIRFGSNVTLQVYCFINVNHPSLNRSPFTLATNSMQEEEEHLKASFAQNKRDHLLRLFTWIALEPDLEDCNTKESIHIDDILKTSSLPEARDESNSDLTPSSTEDEEDVVSDQLAILYDKVKTSGAELPSAPKPSTFALDLREYQKQALYWMCCKEEGVQSDGSAPKLHPLWSRFRFPKDSEFPEFFKCSSDDDNTHFYVNLYTGETTMLFPNSMPYHRGGILADEMGLGKTIEVLSLIHSRPCFSTDEIPEAFRHSKPSLPVASRTTLVVAPMSLLDQWHSEACKVSQGTKFRSMIYYGSEKPLDLKSCVIDTSTAPLIIITSYGVLLSEFSQQSHSSGLFSVHWFRVVLDEGHNIRNRESKTAKACHSISSQNRWVITGTPIVNKLDDLYSLIKFMRYEPWCNYTYWQTFVSLPYQSKDVLKALNVVQSILEFLVLRRTKETKDRNGNSIVTLPPKTVKIEYLDFSDSERKIYDSLYTKAKSTVNANIVAGTLFRNYTTILGLLLRLRQACCDPVLLSNMTINSETFDDFEFSVEQFNSLINQFVVTGKPIPSDILKIDTLKSFEALITECPICCNEPIQNPLLLNCKHACCGDCLSEHIQYQKRRNIIPPLCHTCRQPFNEQDVYKPFFVKNNGTQSTLLVGEEVKWKYWNRLQSVKLNGLLGQLRQLTHSSEPEKVVIFSQFTTFLDIIADVLESEKMGYARFDGTMSQQMRSTALETFRNDPDVNVLIISLKAGGVGLNLTCANHVFIMDPWWSWSVEAQA

SEQ ID NO: 2033 - protein, 535 aa, Schizosaccharomyces pombe
MSTLYQVNKIKEILIRFLETIIINGMNSFSSTVYGQNAERSNTPTLIDPSNKETANVCPISKNLFQSYPKGSYRNSQRLTSRNGLDRFIPMTSNKDTISLGRHSSLSRNLVNKTKNASETYQQLLEYALEVERDDNVFTYAKLQKSDMTQKCPTMVASEKDNKGKLNEKKNRSPENLLPFRILDAPELRDDFYTSLLSWSPKGDLAIGLAENIYLWSKELGPTRVLEESIYDVSSVAYSYNGDILAVGRVDGTLQFWQDNERVPRISIHHPGDIGVLAWKPVLETNRLLVGKGNGNIFVYDIIWSESTSKAVLVATITNAHDEQVCGLTWNHDGSQFASGGNDNRVCLFKGSDLRQPLYVWQQNAAVKALSFCPWQRSLLATGAGSHDKHIRFYNCFNGKKIDELYCGAQITSIHWSPKYREFSVTFGYSLETVQHRFAVYSWPQLECLVSVLPSVPDIRCVHSVLTSQLNETTGRCEMTDSIIIASSNETIKFFDLSEESSWHNSRVLTWHGIFDSQILEMLEGIDGKIDSHLR

SEQ ID NO: 2034 - protein, 379 aa, Schizosaccharomyces pombe
TALAAAVSLRSYCKLQTTNNNEIVIVMSDIGTERRWNLQSLPWQHVTVENVQHPASSPNLDLLQGLGELLKNEENGLIHSAMLCTLYLFTSLSSPSQGCTLTISSQVPLGAGLGSSATISVVVATSLLLAFGNIEPPSSNSLQNNKALALIEAWSFLGECCIHGTPSGIDNAVATNGGLIAFRKATAHQSAMKEFLKPKDTLSVMITDTKQPKSTKKLVQGVFELKERLPTVIDSIIDAIDGISKSAVLALTSESDKNSSAKKLGEFIVLNQKLLECLGVSHYSIDRVLQATKSIGWTKLTGAGGGGCTITLLTPECKEEEFKLCKESLLAHKNSIYDVQLGGPGVSVVTDSDSFFPQYESDFDFKKLNLLSKFNKYYI

SEQ ID NO: 2035 - protein, 874 aa, Schizosaccharomyces pombe
  unsure (1)..(874): unsure at all Xaa locations
MRRWFKKTLPRPPDEEESAGLTNKDIVETNHLYPTITNLSLNSDTSSILFDKNKKPLKPKIIIPDKEFDLDYYLKDETESIQSPFEGFTAQPNFSNFNKQGNTMNREANFQRTNEKIQRNKSIKRVKLFHGNLILDCPIPKKLLVTLPQQTEREFAYMRYSAATCDPQDFSKSLFTLRQPLFFQPRKTEICIAITMYNEDEVLFARTMHSVMKNISHLCTRKNSQVWGKDAWKKVVVCIISDGRTKIHPRTLAYLAAIGVYQDGIAKNQVNDKEVKAHIYEYTTQLSIDPNLKFKGSDRGIVPVQMIFCLKEKNQKKLNSHLWFFQAFCPILKPEVCILLDAGTRPGDQSIYHLWKSFDLNPQVAGACGEIVVMKGKLGSGLINPLVATQNFEYKMSNILDKPVESVFGFISVLPGAFSAYRFEALQNDSQGNGPLASYFKGELQNTGKSGIFEANMYLAEDRILCFELVSKKNEAWILHYVKSAYADTDVPDRIPEFVLQRRRWLNGSFFAAAYAICHYYRFFRTSHTISRKFMLSIEFIYQLATIVFGWFNIGNFFIIFYILTSSLASTSANFLPGEILFRIAIWIYASLLVTCFVLALGNRPHGSPNFYLSMVIMYSILMGYLLFCSGWIAYRAISDAIHNASSTSSSYTSALLNSNVFINIVISLSSTYGMYLVVSIISFDPWHMFTSFVQYIFLSIMYTNVLNVYAFCNTHDVSWGTKGDHFTNNDLGVARLLQKGADVEIAIPTNQSDIDAKYEDAVKLLASPSLEFNSPIINHGEQEDFYKNFRTYVVLTWILSNLFLVGIVLSIPKINGISISNNETSAYLSFLYVDFKTVLSVDXLXXLWSVVAFSVFRFIGCIFYLFIRLCTGE

SEQ ID NO: 2036 - protein, 349 aa, Schizosaccharomyces pombe
MAEFIRTQIFGTCFEITTRYSDLQPIGMGAFGLVCSAKDQLTGMNVAVKKIMKPFSTPVLAKRTYRELKLLKHLRHENIISLSDIFISPFEDIYFVTELLGTDLHRLLTSRPLETQFIQYFLYQILRGLKFVHSAGVIHRDLKPSNILINENCDLKICDFGLARIQDPQMTGYVSTRYYRAPEIMLTWQKYNVEVDIWSAGCIFAEMIEGKPLFPGRDHVNQFSIITELLGTPPMEVIETICSKNTLRFVQSLPQKEKVPFAEKFKNADPDAIDLLEKMLVFDPRKRISAADALAHNYLAPYHDPTDEPVADEVFDWSFQDNDLPVETWKVMMYSEVLSFHNMDNELQS

SEQ ID NO: 2037 - protein, 390 aa, Schizosaccharomyces pombe
MQFRSPLRRFDAFQKTVEDARIKTASGGLITLVSGLIVIFIVLMEWINYRRVIAVHEIIVNPSHGDRMEINFNITFPRIPCQILTVDVLDVSGEFQRDIHHTVSKTRLSPSGEIISVDDLDIGNQQSISDDGAAECGDCYGAADFAPEDTPGCCNTCDAVRDAYGKAHWRIGDVDAFKQCKDENFKELYEAQKVEGCNLAGQLSVNRMAGNFHIAPGRSTQNGNQHVHDTRDYINELDLHDMSHSIHHLSFGPPLDASVHYSNPLDGTVKKVSTADYRYEYFIKCVSYQFMPLSKSTLPIDTNKYAVTQHERSIRGGREEKVPTHVNFHGGIPGVWFQFDISPMRVIERQVRGNTFGGFLSNVLALLGGCVTLASFVDRGYYEVQKLKKN

SEQ ID NO: 2038 - protein, 932 aa, Schizosaccharomyces pombe
MKDSHSSRRKYEKEKLVFATNNGKRTEGTPAFLKSGNTASSSSPTLQFRPTSRYPTLSHEPVYTNVLDLSSRIDANRASIMSATMGTPPSALKFSKKKISRPVVSEDTFKDKLPRATIPVKPEPQPQYKIPAAPAPTSKRVVNRGLKLNTNLRQASPILPSPSLKLDRQDAPIQINHEQKEDFLVSIPRPTPMTNLDDGKDEIGQPDPHRKYMAPPRVNSISRVQRRMSYIPYGGFDDFLDNYYKDDDTVLEDNQLKSNSRIETLEEEDGAESDSITNTVSNASSDAEPAHRHLGPVYENSGHLPSKSHFSSTDSNTDSFGLESDERSLPSVSNDLKSSETLKNPRNDDLLTLQQPPRYPHSQMVMLPARSPVEVPAPTFDRRNVSRNSNNNSPEGYDNNRTNPTVNNLPSYPTNLARPKAIKPMPTSIHGQTSPLSPIPPVHTTHGLVSDIRPLPSVSSPIMRADSTPISHNLAVTPSFSPIPQQSNKSIGNHKNTSVANVSSKVANSKFERNISMMSNSNASSPAIFEVGAEAKEKTKDAIPCHPDDKLMIPSPKIVTHGDAMQEEQRLRQKSQITPDDEVELAKVYLNALETLENKPSLAPDQASYNTRINVYRTRAVELLKKNAYPSKTQNTVPEALFLIGQFHSQGVLGFRRDLGKAFELYSLAAKKGHPLSNYRVAVCLQTGTGVKPDTSKCVAIYKKAAEMDVVEAMFRIALIYLNGLLGQKRNISLGVQWLERACKSKGPESVRAMYELAKIYEQPDRYGVSATPERKFELYKQSAVYGYAAAQCKLGECYEHGLLGCLAEPRRSIFWYTRAAEQDYGEAELGLSGWYLTGSEGILPKNGEEALLWAHKAACKGLAKAQYAVGFMMEQGIGVAADPSSAHNWYIRAAKQGFPKAKKRLEEQALSSKQTHSKAPKKKQQEQCVVM

SEQ ID NO: 2039 - protein, 607 aa, Schizosaccharomyces pombe
MNRVNDMSPVEGDLGLQLSSEADKKFDAYMKRHGLFEPGNLSNNDKERNLEDQFNSMKLSPVASSKENYPDNHMHSKHISKLPIASPIPRGLDRSGELSYKDNNHWSDRSSTGSPRWENGSMNLSVEEMEKVVQPKVKRMATICQMFFLDHYFEQLHYLYTRKQRARLFEEQLLKEPDSRRDELVKRYNGRERVYLRKRRTRISHGDFQTITQVGQGGYGSVWLARKRDTKEIVALKIMNKSVLHKMDEIRHVLTERDILTTANSEWLVRLLYAFQDTSNIYLAMEFVPGGDFRTLLSNSGVLRDHHAKFYATEMFLAIDALHQLGYIHRDLKPENFLVGASGHIKLTDFGLSSGIISKKKIESMKIRLQEVNNVVVPERSMRERRQVFRTLLSQDPVYAHSVVGSPDYMAPEVLRGENYNHSVDYWSLGCIMYECLSGFPPFSGSNVNETWSNLKNWRKCFQRPHYDDPRDLEFNWRDDAWDFVCHCITDPKDRFCSLKQVMQHPYFSKIDWKNVRTAYRPPFVPDLNSEIDAGYFDDFTNENDMSKYKEVHEKQAAIANMVNTFNKPKRNAFIGFTFRHQKNSHPTSSSSALSSPLSAPSFGTLL

SEQ ID NO: 2040 - protein, 1428 aa, Schizosaccharomyces pombe
MESVEEKSKQRRWLPNFKALRLKVYRLADRLNIPLADAARVELEEYDGSDPQSLRGLQKLPRTLYFGLPLPDSELDDTGEAKRWFPRNKIRTAKYTPIDFIPKNIFLQFQNVANLFFLFLVILQVCFLILITIEITNYLGSFFSLLTFYVSISIFGEQVNPGLAAVPLIVVVGITAVKDAIEDFRRTMLDIHLNNTPTLRLSHYQNPNIRTEYISYFRRFKKRISALFRVFLAKQEEKKRAKRLNDAVPLEDMAGSESRPSYDSIFRESFEAKRSFEDSKGKVPLSALDGTATILQSRPMDIIDYEAEATGECHFKKTYWKDVRVGDFVKVMDNDEIPADIVIINSSDPEGICYIETKNLDGETNLKMRHALTCGKNVVDEASCERCRFWIESEPPHANLYEYNGACKSFVHSEAGGSDTSQTVSEPISLDSMLLRGCVLRNTKWVIGVVVFTGDDTKIMLNSGAPPLKRSRITRNLNWNVYLNFIILFSMCFVCAVVEGIAWRGHSRSSYYFEFGSIGGSPAKDGVVTFFTGVILFQNLVPISLYISIEIVKTIQAIFIYFDKDMYYKKLKYACTPKSWNISDDLGQVEYIFSDKTGTLTQNVMEFKKCTINGVAYGEAFTEAMAGMAKREGKDTEELTLQKQSFIERDRMQMISQMRNMHDNKYLVDDNLTFISSQFVHDLAGKAGEEQSLACYEFFLALALCHSVVADRVGDRIVYKAQSPDEAALVGTARDVGFVFLDQRRDIMVTRALGETQRFKLMDTIEFSSARKRMSVIVKGPDNRYVLICKGADSIIFERLEPNEQVELRKTTSEHLRIFALEGLRTLCIAKRELTEEEYYEWKEKYDIAASAIENREEQIEEVADLIESHLTLLGGTAIEDRLQEGVPDSIALLAQAGIKLWVLTGDKMETAINIGFSCNLLDAGMDMIKFDVDQEVSTPELEVILADYLYRYFGLSGSVEELEAAKKDHDTPSGSHALVIDGSVLKRVLDGPMRTKFLLLCKRCKAVLCCRVSPAQKADVVQLVRESLEVMTLAIGDGANDVAMIQKADIGVGIVGEEGRAAAMSADYAIGQFRFLSKLVLVHGRWDYNRVAEMVNNFFYKSVVWTFTLFWYQIYNNFDANYLFDYTYVMLFNLIFSSLPVIVMGVYDQDVNADLSLRIPQLYKRGILQLNSARKIFIGYMLDGFYQSVICFFFSFLVINNVTTAAQNGRDTMAVQDLGVYVAAPTIMVVDTYVILNQSNWDVFSIGLWALSCLTFWFWTGVYSQSLYTYEFYKSASRIFRTPNFWAVLCGTIVSCLFPKFLFMTTQKLFWPYDVDIIRESYRTKRLHELDEEEEIENAEQSPDWASSTLQVPFNASSSSLATPKKEPLRLDTNSLTLTSSMPRSFTPSYTPSFLEGSPVFSDEILNRGEYMPHRGSISSSEQPLRP

SEQ ID NO: 2041 - protein, 336 aa, Schizosaccharomyces pombe
MPSCTSFPIGTRKSKLAVIQSEIIREELEKHYPHLEFPIISRDTIGDEILSKALFEFKRQLAKSLWTRELEALLVTNQCRILVHSLKDLPSEMPDGMVIACIPKRSCPLDAIVFKAGSHYKTVADLPPGSVVGTSSIRRRALLARNFPHLRFVDIRGNVGTRLAKLDAPDSQFDCLVLAAAGLFRLGLKDRIAQMLTAPFVYYAVGQGALAVEVRADDKEMIEMLKPLQHQETLYACLAERALMKRLQGGCAIPIGVQTDVLAISNSSYRISLLGTVLSADGLRAAFGNAEAVVSSEEEAEELGITVALALLKNGAGPILEEHQRSSDSEESLKNY

SEQ ID NO: 2042 - protein, 151 aa, Schizosaccharomyces pombe
MSTEQTFIAVKPDAVQRGLIGYIISKFELKGYKLRALKFLVPSRDLVEEHYAEHKGKPFYEKLVGFMASGPVCAMIWEGKQAVKTGRLMLGASNPLDSAPGTIRGDYGIDLGRNVCHGSDSIESANREIKLWFQPSEIQVYDRTIEPWIYE

SEQ ID NO: 2043 - protein, 341 aa, Schizosaccharomyces pombe
  unsure (1)..(341): unsure at all Xaa locations
SWLNSLADATFGKRPSSFEFIVNKTRFSSAPVVATIIISYYLLILVGGRIMRNRQPIRLQKIFQYYNLTFSIASAILALLIFEQVAPAIYKHGFFFSICNEKAWTQPLVFLYYCAYISKFVRLHRFLTILFSFXHTFXLELTDTFFLVLRKKPLQFLHCYHHGATAVLVYTQIVGRTSISWLIIEINLLVHVTMYYYYYLVAKGIRVPWKKWVTRFQIVQFFADLGFIYFAVYTEVAYRLKFYKACMGHCSGHPLAAFCGLATISSYLVLFIVFYHNTYKKNAALKMKAKAAAATKGNSSESSKNADLKRLSKSNASIAEVKCNNIVTNLYPISSGLNNEK

SEQ ID NO: 2044 - protein, 151 aa, Schizosaccharomyces pombe; identical to SEQ ID NO: 2042

SEQ ID NO: 2045 - protein, 341 aa, Schizosaccharomyces pombe; identical to SEQ ID NO: 2043
  unsure (1)..(341): unsure at all Xaa locations

SEQ ID NO: 2046 - protein, 1841 aa, Schizosaccharomyces pombe
MRNSSKGQDPNFSYDSILSTPTPSARRTIGPRAPKSKTTYHKPPSSIESVSTLIQPNKSQSVTSPYVKQFTFSSKEYNSHNKHALQNSQLPLPKTPEKSTVHRPKANKVEVTDLPSSSSVEHLHTSKHLKGPRLPKNIIKSSEDVQIAPVTPPVHSRSFDPLPKPPVPSVPVSKTKRRTKHKLAPVVEVPEITNEVSPKFTSTNDEQVYRLRSIRAGSPNSVCSFQFEIPSTRPPSLDQLIHLFNDFLRHPVFDFDENAIEMLQSCTPDEKWCFIRSNFAGFDDPSFQIPELAAVHRPVSWFVIQLWNKTISNLQLITLSSLLSTQSDRWISLFLELQGLRALHNLLTYFNSSAVVQPQQAEVPRCMLTLLKKKPTLVTSNSYIFQAITVTLISPNLLPRKVAADLLTWVLSLKEPLVVSILETGFKEINAEYEKEVPLFFGWIKSFKDIILEKELARTPPSSPARNSASSSPSNIAFLEYCTSTMEFINQLIVACEELEQGFDLDILDSLRESGIHEVIQLLRNFPDQQLEKQLNIYESEEERRTISQTTHEDVDSFMSNESSILSSFNEFASNEVGRLLESTIQNILLAKGTEKQKVKLIKVFNSLLQRILLNSKVSNESFEDSLQASLNMLTERFYSDDTARNALKEAKASRAMAEKMVIERDAMAAQVNLGAEDLIAKLNKEVEDQKDVILSQKRTNETLKTEIDALQKSHVTQIQRSEVELRELYLLINSDSFQGSTNSKERIIEYLLDKLDLRKKEIAAESTLWSNDGIDDKLRDLREQMSRQSSQPSTVSTILQIPDKKFHRPFPRHLHRYVGRSASESLTSEKDESIKSMKGIDDFANLEIPGKGIESNVVIKDISNQTHEINSVENKAETVSNNSKITNFDIPNDATSLPTIITHPTPPPPPPLPVKTSLNTFSHPDSVNIVANDTSVAGVMPAFPPPPPPPPPLVSAAGGKFVSPAVSNNISKDDLHKTTGLTRRPTRRLKQMHWEKLNSGLEFTFWTGPSDEANKILETLHTSGVLDELDESFAMKEAKTLVKKTCARTDYMSSELQKLFGIHFHKLSHKNPNEIIRMILHCDDSMNECVEFLSSDKVLNQPKLKADLEPYRIDWANGGDLVNSEKDASELSRWDYLYVRLIVDLGGYWNQRMNALKVKNIIETNYENLVRQTKLIGRAALELRDSKVFKGLLYLILYLGNYMNDYVRQAKGFAIGSLQRLPLIKNANNTKSLLHILDITIRKHFPQFDNFSPELSTVTEAAKLNIEAIEQECSELIRGCQNLQIDCDSGALSDPTVFHPDDKILSVILPWLMEGTKKMDFLKEHLRTMNTTLNNAMRYFGEQPNDPNSKNLFFKRVDSFIIDYSKARSDNLKSEEEEASQHRRLNLVNNHKEHVLERAMSENNKMDNEAMDGFLDKLRNVKLESHHKPRNRSAITMGKEHLIEAPNTSTKSSPAKNELFVPKRSSVKSDLAKVRPRYPKGSESTDGLSDALNITPTKKGEVSSKAKKGYNYEKRRSGRQVSDSYVLNKNSKNKSNKGRSASYTFSDPSSLEDSNRQKPFNGEKFRRFSSKSRRGSQNRDSKKTGKARKDKGINNNQTSPQNKPSKESLKSDTISNEKKVFPQKASKVNLLTPTISNGTRASKHANEKENTFPRGVENNLVAPMIPNNTELNEDTSAVSRNLENATNDLKETFPTTTTISTARAKPGNNDINTILRRNNSRGRRRMLQQMSPLKSNKFSGTNDLNFQQATKPDGSNKSSYMERLEKLKQNSERHLQSVGGKKVYSSEETPVNKILVSPSVSILDHNRILSQSTPIKSPQRAQEMLAGLLSGKLAPKENEK

SEQ ID NO: 2047 - protein, 848 aa, Schizosaccharomyces pombe
MKRSVLTIILFFSCQFWHAFASSVLAIDYGTEWTKAALIKPGIPLEIVLTKDTRRKEQSAVAFKGNERIFGVDASNLATRFPAHSIRNVKELLDTAGLESVLVQKYQSSYPAIQLVENEETTSGISFVISDEENYSLEEIIAMTMEHYISLAEEMAHEKITDLVLTVPPHFNELQRSILLEAARILNKHVLALIDDNVAVAIEYSLSRSFSTDPTYNIIYDSGSGSTSATVISFDTVEGSSLGKKQNITRIRALASGFTLKLSGNEINRKLIGFMKNSFYQKHGIDLSHNHRALARLEKEALRVKHILSANSEAIASIEELADGIDFRLKITRSVLESLCKDMEDAAVEPINKALKKANLTFSEINSIILFGGASRIPFIQSTLADYVSSDKISKNVNADEASVKGAAFYGASLTKSFRVKPLIVQDIINYPYLLSLGTSEYIVALPDSTPYGMQHNVTIHNVSTIGKHPSFPLSNNGELIGEFTLSNITDVEKVCACSNKNIQISFSSDRTKGILVPLSAIMTCEHGELSSKHKLGDRVKSLFGSHDESGLRNNESYPIGFTYKKYGEMSDNALRLASAKLERRLQIDKSKAAHDNALNELETLLYRAQAMVDDDEFLEFANPEETKILKNDSVESYDWLIEYGSQSPTSEVTDRYKKLDDTLKSISFRFDQAKQFNTSLENFKNALERAESLLTNFDVPDYPLNVYDEKDVKRVNSLRGTSYKKLGNQYYNDTQWLKDNLDSHLSHTLSEDPLIKVEELEEKAKRLQELTYEYLRRSLQQPKLKAKKGASSSSTAESKVEDETFTNDIEPTTALNSTSTQETEKSRASVTQRPSSLQQEIDDSDEL

SEQ ID NO: 2048 - protein, 490 aa, Schizosaccharomyces pombe
MSIAICGGGIAGLSTAFYLARLIPKCTIDLYEKGPRLGGWLQSVKIPCADSPTGTVLFEQGPRTLRPAGVAGLANLDLISKLGIEDKLLRISSNSPSAKNRYIYYPDRLNEIPSSILGSIKSIMQPALRPMPLAMMLEPFRKSKRDSTDESVGSFMRRRFGKNVTDRVMSAMINGIYAGDLNDLSMHSSMFGFLAKIEKKYGNITLGLIRALLAREILSPAEKALKAALLAEPKTAELSNSMKSTSMFAFKEGIETITLSIADELKKMPNVKIHLNKPAKTLVPHKTQSLVDVNGQAYEYVVFANSSRNLENLISCPKMETPTSSVYVVNVYYKDPNVLPIRGFGLLIPSCTPNNPNHVLGIVFDSEQNNPENGSKVTVMMGGSAYTKNTSLIPTNPEEAVNNALKALQHTLKISSKPTLTNATLQQNCIPQYRVGHQDNLNSLKSWIEKNMGGRILLTGSWYNGVSIGDCIMNGHSTARKLASLMNSSS

SEQ ID NO: 2049 - protein, 589 aa, Schizosaccharomyces pombe
MLLSVRGVPVEIPSLKDTKKSKGIIRSGWVMLKEDKMKYLPWTKKWLVLSSNSLSIYKGSKSESAQVTLLLKDIQKVERSKSRTFCFKLRFKSSTKNFEIQACELSVADNMECYEWMDLISSRALASKVSSPMNPKHQVHVGIDNEGNYVGLPKEWILLLQSSSITKQECMEEPKAVIQALDFYSKQLDTTSETKDSFSFCKETLPRSSTTSYSIRDADKHHKLTTSGVTKMNITERCKPKTTIQTDKKHIIRPFIEDKSHVESIMTGKVTKVPVKADSKNTLSRRMTDRQALAMLKDSVTSHDPVEYFNVKHKLGQGASGSVYLAKVVGGKQLGIFDSVAIKSIDLQCQTRKELILNEITVMRESIHPNIVTYLDSFLVRERHLWVVMEYMNAGSLTDIIEKSKLTEAQIARICLETCKGIQHLHARNIIHRDIKSDNVLLDNSGNIKITDFGFCARLSNRTNKRVTMVGTPYWMAPEVVKQNEYGTKVDIWSLGIMIIEMIENEPPYLREDPIRALYLIAKNGTPTLKKPNLVSKNLKSFLNSCLTIDTIFRATAAELLTHSFLNQACPTEDLKSIIFSRKANTHIN

SEQ ID NO: 2050 - protein, 434 aa, Schizosaccharomyces pombe
  unsure (1)..(434): unsure at all Xaa locations
MADEIMENVELTTSEDVNAVSSCKXIIFFYNMNTYCEXCXHCFAVEEMNLKGXLMNXXKFPXFCSNNMQEDLLRGIYAYGYETPSAVQSRAIIQICKGRDVIAQAQSGTGKTATFSIGILQSIDLSVRDTQALILSPTRELAVQIQNVVLALGDHMNVQCHACIGGTSVGNDIKKLDYGQHVVSGTPGRVTDMIRRRNLRTRNVKMLILDEADELLNQGFKEQIYDIYRYLPPGTQVVVVSATLPQDVLEMTNKFTTNPVRILVKRDELTLEGLKQYFIAVEKEEWKFDTLCDLYDTLTITQAVIFCNSRRKVDWLTEKMREANFTVTSMHGEMPQKERDAIMQDFRQGNSRVLICTDIWARGIDVQQVSLVINYDLPANRENYIHRIGRSGRFGRKGVAINFVTNEDVRILRDIEQYYSTVIDEMPMNIGDMV

SEQ ID NO: 2051 - protein, 257 aa, Schizosaccharomyces pombe
  unsure (1)..(257): unsure at all Xaa locations
MGKSQSKLSQDQLQDLVRSTRCTFCKTSQYXQIQVDKKELQQWYKGMTAILKKLILHPHHGSAIXIRFLIAAKLNVXRXIXQVCRFFKDCPSGHLNKSEFQKIYKQFFPFGDPSAFAEYVFNVFDADKNGYIDFKEFICALSVTSRGELNDKLIWAFQLYDLDNNGLISYDEMLRIVDAIYKMVGSMVKLPEDEDTPEKVXIFSMLSIMSNNFLAVNKIFNMMDKNKDGQLTLEEFCEGSKRDPTIVSALSLYDGLV

SEQ ID NO: 2052 - protein, 289 aa, Schizosaccharomyces pombe
  unsure (1)..(289): unsure at all Xaa locations
MSTTARRRLMRDFKVRQLWIREDLYXPILRRMQQDPPAGVSASPVSDNVMLWXVFTYVNSFFSYCYATXWXIYVLYIECLFCHIFRKEIVSKFLQEAIFLCLLVSGLIAFVFYYXCWTNHLSRNAVIIGPADTPFEDGTFKLVLSFDEQYPNKPPLVKFVSTMVCLVIVFRQVLNXIIXFVVIYFFLGFFCLLTYWLXFHPNVYANGELCLDILQNRWSPTYDVAAILTSIQRFAFQKYYLNFSXLTFSLLNDPNNASPANAEAAQLHRENKKEYVRRVRKTVEDSWES

SEQ ID NO: 2053 - protein, 582 aa, Schizosaccharomyces pombe
MVSFLSSSVSRLPLRIAGRRIPGRFAVPQVRTYAKDLKFGVDARASLLTGVDTLARAVSVTLGPKGRNVLIDQPFGSPKITKDGVTVARSVSLKDKFENLGARLVQDVASKTNEVAGDGTTTATVLTRAIFSETVRNVAAGCNPMDLRRGIQLAVDNVVEFLQANKRDITTSEEISQVATISANGDTHIGELLAKAMERVGKEGVITVKEGRTISDELEVTEGMKFDRGYISPYFITDVKSQKVEFENPLILLSEKKVSAVQDILPSLELAAQQRRPLVIIAEDVDGEALAACILNKLRGQLQVVAIKAPGFGDNRRNMLGDLAVLTDSAVFNDEIDVSIEKAQPHHLGSCGSVTVTKEDTIIMKGAGDHVKVNDRCEQIRGVMADPNLTEYEKEKLQERLAKLSGGIAVIKVGGSSEVEVNEKKDRIVDALNAVKAAVSEGVLPGAGTSFVKASLRLGDIPTNNFDQKLGVEIVRKAITRPAQTILENAGLEGNLIVGKLKELYGKEFNIGYDIAKDRFVDLNEIGVLDPLKVVRTGLVDASGVASLMGTTECAIVDAPEESKAPAGPPGMGGMGGMPGMM

SEQ ID NO: 2054 - protein, 163 aa, Schizosaccharomyces pombe
MSSPGISDESIKGPKDVRLIHLILSSLGVPSYSQTVPLQLLTFAHRYTQQLIQDSQVYAEHSRGQNAPISVEDVRLAVASQINHSFTGPPPKEFLLELAMERNRKPLPQIQPSYGFRLPPEKYCLTQPNWIVSNETQQNQPKEENSSDSRMEEDKLDFSVKSE

SEQ ID NO: 2055 - protein, 616 aa, Schizosaccharomyces pombe
MVEIGSKKSRNDNDSEGIRDKGGVEISNKNDPYIQFGKADPLEPLEKPDLPEEAIKRGEPTILLGIPKREGRKTNPVHDKAVENNSDFIKFDWNSDEDEDSVSNDKSKNNESLKKSSKNEIPGFMRQRGRFFHEANEKSDSNRKRKRQAYELDSQSCPWHRQYKVEREVSRIFHQDILHFIDYITPTPEEHAVRKTLVSRINQAVLQKWPDVSLYVFGSFETKLYLPTSDLDLVIISPEHHYRGTKKDMFVLAHHLKKLKLASEVQVITTANVPIIKFVDPLTKVHVDISFNQPGGLKTCLVVNGFMKKYPALRPLVIIIKHFLNMRALNEVFLGGLSSYAIVCLVVSFLQLHPRLSTGSMREEDNFGVLLLEFLELYGKQFYYDAVGIAVHNGGFYFSKKKMGWLKPNQPYLLSIQDPVDFQNDVSKSSRGLLRVKATFANGFDLLTSKLYALASRIEREGVNRVKDFPSILSTILSVDEGVRQHREHMLKCYKNNPVPLEPLVEVDALASIDVDKLPLQDVGLQYVEDESDSDETDAAKDDLFKVNESIETNGHENFQKQALTSTGEQSSSNSRANPSKLFNISSDDSEDEVPIIEDTTASDEESRAKKIRKRF

SEQ ID NO: 2056 - protein, 422 aa, Schizosaccharomyces pombe
MKVGRFLVIIAFCFYVLYLEKIIHTRPHKKCDWRSWEQWESTGNPVRIALVADPQLVDDLTYDYPRPLIGIVKWISDQFLRRHWRYLHKSLKPDITFIMGDLMDTGREFATEEFKKDYFRMMNVLDPKFTNKLEIYPGNHDIGFGNHAIVKDIQRFESLFGPTSRSIDVGNHTLVIVDGIRLSNNVNPQVYQPARDFLKSFETNKDNSRPRILLSHVPLFRPAINSCGELREKDDVIKYGLGYQYQNLLLPELSESILKAVEPIAAFAGDDHDYCEVVHNYQVDTREAATTEYNVKAFSMTSGILYPGYQLLSLNYPYDNPKADQKSSYQTKLCILPNQIQIYVWYGASISIFFALILLRTAIFFFGTDRYSLPLYKTHARRFSLSTTIHLFKKIVRITLSTFISYTWIPFLLFIFLNIFII

SEQ ID NO: 2057 - protein, 194 aa, Schizosaccharomyces pombe
MESLLAVQGQDFVLTASSSSAVRGITVLKPDDDKSQILNSHNLMLYCGEAGDTTNFAEYIAANISLYTLRHNLNLSPEATASFTRKQLATSLRSRKPYQVNILLAGYETNLGKPELFWLDYLATCVRVPYACQGYSSFYCLSIFDRYYKPDLTIDEAVRIMKLCFDELKKRMPIDFKGFICKVVDKDGIREINI

SEQ ID NO: 2058 - protein, 881 aa, Schizosaccharomyces pombe
  unsure (1)..(881): unsure at all Xaa locations
MSGFQTSDEVDISNSLKAFPVDIATDNQKDKHENVGENVSDEDDGNYIASKLLESNRRTKGKKGNGKASNFQSMGMLTSXLLAIRSLCIMLQDTVIXITLIFFXLNYRLNQTLLRAIFKKGFKAPTPIQRKTIPLLLEGRDVVGMARTGSGKTAAFVIPMIEHLKSTLANSNTRALILSPNRELALQTVKVVKDFSKGTDLRSVAIVGGVSLEEQFSLLSGKPDIVVATPGRFLHLKVEMKLELSSIEYVVFDEADRLFEMGFAAQLTEILHALPTSRQTLLFSATLPRTLVDFAKAGLQDPVLVRLDVESKVSADLQSAFFSVKTAEREAALLCILQDIIKLPLKDNVRPREIGNVNNPKKRKRALELALKGSESGSPDSTLVFVPTKHHVEYVSELLVQAGYSVSKIYGSLDQEARLNEINNFRLGKTNLLVVTDVASRGIDIPLLANVINYDFPPQPKVFVHRVGRTARAGRTGWAYSLVRAEDAGYLLDLQLFLNRPLVTSSKQVKTDSDCDFTKQIVLGSLPQELVAELLEWVQRIVSRDVELQQLSNVAARGEKLYFRTRATCSAESAKRAKELVDSKGWSSNNPLFGDVSVIEAEEKYAELLSKVSSYRPSETVFEIGQRGHLKTEAAEIMRKRRNKVKPKGIKSEVASDKITDSSPGNMSEASESELEEVFKNPKELSKKKTTDFKDKEYYMSHYAPKESIQETGYAINSGENFTTAARHAILDLTNDEGIEQSRKGGQRWDPKKKKFVNIINDEDGSKGSPKIIRGESGVKLPATYRSGRFDEWKASKAFGANDSPIRENKRYKHNKLQTPKPADKFRDNYHKQNKRNREAKERGIGIKVNSELKSAVEIRKARELKEKRLAKNNRPSKKHR

SEQ ID NO: 2059 - protein, 248 aa, Schizosaccharomyces pombe
MSRSYDSRTTIFSPEGRLYQVEYALEAINHAGVALGIVAKDGIVLAAEKKVTSKLLEQEESAEKLYHIGDNMLCAVAGLTADANILINYARRVGQQYLQTFNEEMPCEQLVRRVCDLKQGYTQYGGLRPFGVSFLYAGWDHIRGYQLFQSNPSGNYGSWQANSIGGNSTSVQSLMRQEYKDDINLDEASAMAVKFLSKTLDSNSLTHEKIEFATITKDTTKNKMVCKIWKSDEINEVLNKYQETQRQS

SEQ ID NO: 2060 - protein, 717 aa, Schizosaccharomyces pombe
  unsure (1)..(717): unsure at all Xaa locations
MPNDPSDMNNELHNENTIRILISSDPHVGYGEKDPVRGNDSFVSFNEILEIARERDVGIIXXLFTLIYXLSXVDMILLGGDIFHDNKPSRKALYQALRSLRLNCLGDKPCELELLSDTSLTTGDTAVCNINYLDPNINVAIPVFSIHGNHDDPSGDGRYSALDILQVTGLVNYFGRVPENDNIVVSPILLQKGFTKLALYGISNVRDERLYHSFRENKVKFLRPDLYRDEWFNLLTVHQNQXVXKNFIYFFLFTIKYIFYXCFKSAHTPTSYLPESFIQDFYDFVLWGHEHECLIDGSYNPTQKFTVVQPGSTIATSLSPGETAPKHCGILNITGKDFHLEKIRLRTVRPFIMKDIILSEVSSIPPMVENKKEVLTYLISKVEEAITEANAQWYEAQGTVPVVENEKPPLPLIRLRVDYTGGYQTENPQRFSNRFVGRVANATDVVQFYLKKKYTSKKILITEYLLTNFRVKRNDGLYTSAVEDIKINSLRVESLVNEYLKTNRLECLPEDSLGEAVVNFVEKDDRDAIKEXVXFFSSYVLTDYIRCVETQLNKQINLLVKKRVTEENLEQEISSIINDLPKISTTKRKDYEELPEEVSETSINIAEHTPVLKHTSSLLDHHSPLATSSSEHEMEATPSPALLKKTNKRRELPSSLTKKNTRTPQRSKEVKKVPARKLSQSTKKSDKNTQSTLLFYDPSSTTEAQYLDNEDDEILDD

SEQ ID NO: 2061 - protein, 885 aa, Schizosaccharomyces pombe
  unsure (1)..(885): unsure at all Xaa locations
MQRSAKLKIRAPRKSKCTXCMLSLLFSSHTDIXFSANQVDFATHWEVLQRAIGDIFQKSTSQLSFEELYRNAYILVLHKYGEKLYNHVQDVIRSRLKEETVPAIYKNYDASLLGNALLDIRKNDSYSTSWSRSLEAAHRFLSSLVNSWKDHIVSMQMISSVLKYLDKVYSKSADKVPVNENGIYIFREVVLLNSFEIGEKCVETILILVYLERKGNTINRPLINDCLDMLNSLPSENKKETLYDVLFAPKFLSYTRNFYEIESSTVIGVFGVVEYLKKAEKRFEEEKERSKNYLFTKIASPLLSVVEDELLSKHLDDLLENQSTGFFSMIDSSNFEGLQLVYESFSRVELGVKSLKKYLAKYVAHHGKLINETTSQALEGKMAVGRLSSNATMATLWVQKVLALWDRLNTIISTTMDADRSILNSLSDAFVTFVDGYTRAPEYISLFIDDNLKKDARKAIEGSIEATLQNSVTLFRFISEKDVFEKYYKTHLAKRYALIVFTVFNTFRLLNNRSISSDAELGMISRLKQEAGNVFTQKLEGMFNGKYSDFSKFFCVPLLMLRMNLSQELLQEYKHNSALQSAKVSGNFYXXSFILTVSLLLDLNVSILASTFWPIDLSPHKIKCNFPKVLLAQIDQFTDFYLSKHTGRKLLWYPSMVXXTFICLLRHTNNPIXGSADVRVNFKDRKYDLNVSTIASVILLLFQDLKENQCLIFEEILEKTNIEVGDLKRNLQSLACAKYKILLKDPKGREVNAGDKFYFNENFVSNLARIKISTVAQTRVEDDSERKRTLEKVDESRKHQADACIVRVMKYVFFLFFFFQTFLLTVNXGIAKVCEHNQLMAEVTRQLNPRFHPSPMMIKRRIEALIEREYLQRQADNGRIYEYLA

SEQ ID NO: 2062 - protein, 484 aa, Schizosaccharomyces pombe
MSLHDAYHWPSRTPSRKGSNIKLNKTLQDHLDELEEQFTIPTELLHRVTDRFVSELYKGLTTNPGDVPMVPTWIIGTPDGNEHGSYLALDLGGTNLRVCAVEVQGNGKFDITQSKYRLPQELKVGTREALFDYIADCIKKFVEEVHPGKSQNLEIGFTFSYPCVQRSINDASLVAWTKGFDIDGVEGESVGPLLSAALKRVGCNNVRLNAILSDTTGTLVASNYASPGTEIGVIFGTGCNACYIEKFSEIPKLHKYDFPEDMNMIINCEWCDFDNQHVVLPRTKYDVAIDEESPRPGLQTYEKMIAGCYLGDILRRILLDLYEQGALFNGQDVTKIRDPLAMDTSVLSAIEVDPFENLDETQTLFEETYGLKTTEEERQFIRRACELIGTRSARLSACGVCALVRKMNKPSMIVGTDGSVYNLYPRFKDRLAQAFKDILGEEIGSKVVTIPAEDGSGVGAALVSALEAKGKALTSDILAEHLKN

SEQ ID NO: 2063 - protein, 368 aa, Schizosaccharomyces pombe
MDKHTPLLPGDSVFSRCKTEDSRIKGYDPVISPALIQSELAASDETLAFVSDQRRQAADIIAGRDDRLLLIVGPCSLHDPVAAKEYAIRLQKEAIKHKKDLHIIMRAYLEKPRTTVGWKGLINDPDLDGSYNINKGIRVARRIFLELLETGVGIASEMLDTISPQYLADLICWGAIGARTTESQLHRELASGLSFPIGFKNATDGNIGIAIDAMNSSANPHHFLSVTKQGVVAIVTTTGNPDTHIILRGGKSGTNFDADSVAGAKAKLEECNKLPSIMIDCSHGNSSKNHKNQPKVAACIAEQVANGQKAITGVMIESHLNEGKQAIPEDDLSSMKYGVSVTDACIGWDDTTAVFEQLAAAVRSRRSH

SEQ ID NO: 2064 - protein, 368 aa, Schizosaccharomyces pombe; identical to SEQ ID NO: 2063

SEQ ID NO: 2065 - protein, 642 aa, Schizosaccharomyces pombe
MGSLFLAASQGELDTVKNLISSEKIDVNATDEGGATALHWAALNQQIPICKFLLEHGADVNAIGGDLQAAPIHWAAKRGSVKTVHYLVQHGADPLLKDKQGFNCLHLAVHAASPLLVVYLLHLDISVDLRDDQQHTPLMWASYHGNEPITNCLLRWGADVLATDEDKMTPLHWSIVGGNLKCMKLILKEGGIPCTAVTANLSGQLKTPWALASELRVSHLFKQALISNGLKVKETSEEPEKWVVVPSKFQFSQKTFIIFCFLSSFIITGVFFFIMSICPMVISLIIAPLWIYFTFKYITTCIHANIDIVHFYLETPFLAGIFSSIFFWVWCHSLLYIVPKTLPIKPLSSLLFVLISFTCIGLYVRTAFQNPGYVDKIGAVVQRREEISKLLDKDLFNQSHYCLKCFQVKPPRSYHCGACKRCINRYDHHCPWTGNCVGARNHRTFLLFVFTLSTLIPIYFYVAFYYLQNIPIQKKYESYRCLFISGTICQWSLKDMFVLVASLTLFVNWCWVVVLAFTQICQVAHNVTTAEFRLFKRYGTLVPPTKQNSSPKNGHGIHGSFLRTVCGILGLDQCILLIRESNCFVRCFPSRAELGSQNSTSLSRNLSTVNPYDEGSIIKNCKTFWKQNFLNDGRQDEATRHV

SEQ ID NO: 2066 - protein, 1369 aa, Schizosaccharomyces pombe
MTIHQGGNSVIDNVPYSLNTNVNDSIYSEKGTGRKDAEDHTPSKITDLEKNVDHSIPSFPENDPKNYSEFVNLNPPKRPDLEHTRGSSWHTASENVNDLAANDSTRVQTPEFITQTMEDENVEVPPLERDERDAAAAHTSKANRNSARQMWAQLMASVRKFKREDEKPILKENLPAINLFEAGIPASLPIAKHFIRDKSGQPVLPIITDLIKVSVLDVEPKHNRIHSTFTIQVEYGTGPHAIRWLIYRQLRDFINLHSHFLFFEFQHRFSGRRMKLPKFPKEVLPYLVKLRGYQKILYSNPSDQLIDETHSISDISWESHSQDGDRTTGQPRHANNGRKKHGNFWTIQGNTLGVYLQEMIHNLQFFPEVNVLYSFLEFSSLGLYLAGAGTFHGKEGFATLKRNYSPTQYMLCCNTTMMKTRSQPFWIIVSESCIILCDNMLSMQPADVFIWDVDFEITRKNFRKAHSKDTNEKIRLSHHSFKIKNRQKVMKLSVRSGRWLQQFINSVQVAQGLTAWCEIHRFDSFAPVRTNVAVQWMVDARDHMWNVSRAIKNAKRCIMIHGWWLSPELQMRRPYSMAHKWRIDRILNEKAHEGVMVYIMIYRNIDATIPIDSFHTKEHLQSLHPNIYVIRSPSHFRQNALFWAHHEKLVVVDDAITFIGGIDLCFGRYDTPQHILYDDKPVADKTGLCEQTWRGKDYSNARVHDFFDLTEPYKDMYDRLAVPRMGWHDVSMCIIGQPARDAARHFVQRWNYLIQCKKPARKTPLLIPPPDFTTDQLTDSQLTGTCEVQVLRSAGLWSLGLVDTVEQSIQNAYVTCIEKSEHFIYIENQFFVTSTTCEGTTIENRVGDALVERIIRAHKNNEKWRGVIMIPLLPGFEGQIDLQEGGSLRLIVECQYRSICHGEHSIFGRLNAKGIDGSKYLRFYGLRGWAHLGENHELVTEMIYVHAKILIADDRVAVIGSANINERSLLGNRDSEIAAVIRDTLTIDSKMDGKPYKVGKFAHTLRKRLMREHLGLETDVLEQREYNMDGLDRDTEWKRVEVWTPDEGNAINGSAYTAEELKMKYRSQSQFTTTPDILRKAEKSMKKLDQRVSLIPSSIEFNIKTQKDKVEFEKNYEKSKKGPDVIANALVGGIPLSLKTKEDSLYELSKFSQCGEDQRPMVLKDPDHLVPEPSRPHCGNGLVFYDDIPLLEVNPISGETIPKFDASSFEDPVCDEFFEDIWSKVASNNTTIYRHIFRCVPDDEMLTWESYNEWKKYGKRFKEEQARWRQEELSNLHETHEKSENDPKNPKAGSQGSGNTSASEDSKTEKPKTRTNNGLQVPDKRVVYDLLRGIRGQLVELPLKWMSTESNARNWLSSIDKIPPLEIYD

SEQ ID NO: 2067 - protein, 556 aa, Schizosaccharomyces pombe
  unsure (1)..(556): unsure at all Xaa locations
MPGDVEGCQHLKLKPADVENYQKICTQIFSCHVRLVNNTSYSSIFFFHSIPFNISFIXFVPRRCSTCKRINKRSIRCLSCHSVGCLWGHHGEEHAMEHTHMIGTFSXKHSYXFSNETFLRISSXDAIPEYQLLILRVDVKNGHTYCFGCQDYVYQTELETLRFKIKNIKAWQSDHKRLPEKYNQMVCLEAYRKYPPVCATAGLRGIQNLGATCFMSVILQSILHNPLVRNLFFSGFHTSTDCKRPTCMTCAIDDMFSSIYNSKNKSTFYGPTAVLNLMWKLSKSLCGYSQQDGHEFFVYLLDQMHTESGGGTSMPCTCPIHRIFSGSLKNVVTCLDCKKERVAVDPLMDISLDINEPTLQGCLERXNLLVFRFFNKYYFRFVSKEKVQYSCHSCGSKNAIKQLVFDKLPPTICMQLKRFEQNNFAMSTKIDKQVSYPAFLRMRYNFNQDDVDYQLYSVVCHKGTLDTGHYIAYTYYQNQVYXIFFEFFMEIFTNFCSGFLLDDTTIVEVKESEVLNSQAXALCCYFFTYXPDYSYLLFYHERQILYSDEMTVKTEN

SEQ ID NO: 2068 - protein, 460 aa, Schizosaccharomyces pombe
TGALLHHTLGDGDFRTFMDMFKKVSAYSIMIDNGNDAAEKIDEALSICYKKARPVYIGIPSDAGYFKASSSNLGKRLKLEEDTNDPAVEQEVINHISEMVVNAKKPVILIDACAVRHRVVPEVHELIKLTHFPTYVTPMGKSAIDETSQFFDGVYVGSISDPEVKDRIESTDLLLSIGALKSDFNTGSFSYHLSQKNAVEFHSDHMRIRYALYPNVAMKYILRKLLKVLDASMCHSKAAPTIGYNIKPKHAEGYSSNEITHCWFWPKFSEFLKPRDVLITETGTANFGVLDCRFPKDVTAISQVLWGSIGYSVGAMFGAVLAVHDSKEPDRRTILVVGDGSLQLTITEISTCIRHNLKPIIFIINNDGYTIERLIHGLHASYNEINTKWGYQQIPKFFGAAENHFRTYCVKTPTDVEKLFSDKEFANADVIQVVELVMPMLDAPRVLVEQAKLTSKINKQ

SEQ ID NO: 2069 - protein, 1116 aa, Schizosaccharomyces pombe
MAADIGSQSSGSLEERFEQSLHLQNVDKQDWSLNSVLQFLKLYKFNKEWEDVFIKSRIEMDLFINLADQSKAEEFAFKNKLSKESAIQLSSCIRKTLLAPSSTRVPSKNSSYETLTYSAKDSSDDVFTETNSGFRSSNQNSSLKSFQSVPDSNVNVFGGFGGSVVDNNELLSTGKNSHQTTSLNLEGSPINLHAYKGTVTSIINDDSRNINKKTLSKQPVSEHKEKQTSFLRRFRVPGFSRDKDKTKDCPSSNSNPFHLASSNVKTLDASLDQGEWVPRIHRLESQIGLISKKKSFVLATMDDMKFTVVDITNVQNATQLRKLIAKSMYLDISIDQFDLFLTEVGGAQYIEILDDRKLDIARLYSDEFGTIKFFVKPSQNEESGMDSDTYLSFGTKSSSTYKADDDSIYHRKEDFKKQPSYPVLTSDFEITDAGPNLSLSGHQPDNKYYKGFSSAPNLAVVPELPSRRFRGFEKIRGAKGEMATKILDATEAQSEKNKFTVCRPHKKVTLKMPLNSGSSAPQSPSSNTSASVLTRNFVAHRDPPPPPTETSSLRRKNTLTRRPSIRHARSSPYIDTGHNEASKFSHTSFDPKASSKSSNSLKESVEALSEIPFEDAPALDESDLSGDPFWAIQPKQSSSQVPKENHHNIQSKLSINTEAATDLKANELSSPKTPEYCRGDDRSISLSPLSYRLRKSKHIRESPPSSKVINSGNWEVRPSADDLYEDVDRFFPRYDLDKVLVVDQSRMVSSPSKVSIRPKMKSVRLLAREASEARKEIRHNARRNKSGNLLRRSSTKLWGSRIVELKPDTTITSGSVVSQNATFKWMKGELIGNGTYGKVFLAMNINTGELIAVKQVEIPQTINGRHDQLRKDIVDSINAEISMIADLDHLNIVQYLGFEKTETDISIFLEYVSGGSIGRCLRNYGPFEEQLVRFVSRQVLYGLSYLHSKGIIHRDLKADNLLIDFDGVCKISDFGISKHSDNVYDNDANLSMQGSIFWMAPEVIHNDHQGYSAKVDVWSLGCVVLEMLAGRRPWSTDEAIQAMFKLGTEKKAPPIPSELVSQVSPEAIQFLNACFTVNADVRPTAEELLNHPFMKCDEEFNFKDTNLYDMLCKRKS

SEQ ID NO: 2070 - protein, 1957 aa, Schizosaccharomyces pombe
MSNQSSSGSNTSDLDEESASSLVSSAASPFIDSDLETPRPNISRASTGQLAEDGDTSSQHEDSSEELKRQEVRGMRRHSDLSIDAKLGSSEGSTASSALPLTPRSPSNASWLLVRGGLLDSPILDINSVTQKSNLLNELKQVRSKLAALEHENGILSLQLSSSNKKDKNTSSVTTLTSEEDVSYFQKKLTNMESNFSAKQSEAYDLSRQLLTVTEKLDKKEKDYEKIKEDVSSIKASLAEEQASNKSLRGEQERLEKLLVSSNKTVSTLRQTENSLRAECKTLQEKLEKCAINEEDSKLLEELKHNVANYSDAIVHKDKLIEDLSTRISEFDNLKSERDTLSIKNEKLEKLLRNTIGSLKDSRTSNSQLEEEMVELKESNRTIHSQLTDAESKLSSFEQENKSLKGSIDEYQNNLSSKDKMVKQVSSQLEEARSSLAHATGKLAEINSERDFQNKKIKDFEKIEQDLRACLNSSSNELKEKSALIDKKDQELNNLREQIKEQKKVSESTQSSLQSLQRDILNEKKKHEVYESQLNELKGELQTEISNSEHLSSQLSTLAAEKEAAVATNNELSESKNSLQTLCNAFQEKLAKSVMQLKENEQNFSSLDTSFKKLNESHQELENNHQTITKQLKDTSSKLQQLQLERANFEQKESTLSDENNDLRTKLLKLEESNKSLIKKQEDVDSLEKNIQTLKEDLRKSEEALRFSKLEAKNLREVIDNLKGKHETLEAQRNDLHSSLSDAKNTNAILSSELTKSSEDVKRLTANVETLTQDSKAMKQSFTSLVNSYQSISNLYHELRDDHVNMQSQNNTLLESESKLKTDCENLTQQNMTLIDNVQKLMHKHVNQESKVSELKEVNGKLSLDLKNLRSSLNVAISDNDQILTQLAELSKNYDSLEQESAQLNSGLKSLEAEKQLLHTENEELHIRLDKLTGKLKIEESKSSDLGKKLTARQEEISNLKEENMSQSQAITSVKSKLDETLSKSSKLEADIEHLKNKVSEVEVERNALLASNERLMDDLKNNGENIASLQTEIEKKRAENDDLQSKLSVVSSEYENLLLISSQTNKSLEDKTNQLKYIEKNVQKLLDEKDQRNVELEELTSKYGKLGEENAQIKDELLALRKKSKKQHDLCANFVDDLKEKSDALEQLTNEKNELIVSLEQSNSNNEALVEERSDLANRLSDMKKSLSDSDNVISVIRSDLVRVNDELDTLKKDKDSLSTQYSEVCQDRDDLLDSLKGCEESFNKYAVSLRELCTKSEIDVPVSEILDDNFVFNAGNFSELSRLTVLSLENYLDAFNQVNFKKMELDNRLTTTDAEFTKVVADLEKLQHEHDDWLIQRGDLEKALKDSEKNFLRKEAEMTENIHSLEEGKEETKKEIAELSSRLEDNQLATNKLKNQLDHLNQEIRLKEDVLKEKESLIISLEESLSNQRQKESSLLDAKNELEHMLDDTSRKNSSLMEKIESINSSLDDKSFELASAVEKLGALQKLHSESLSLMENIKSQLQEAKEKIQVDESTIQELDHEITASKNNYEGKLNDKDSIIRDLSENIEQLNNLLAEEKSAVKRLSTEKESEILQFNSRLADLEYHKSQVESELGRSKLKLASTTEELQLAENERLSLTTRMLDLQNQVKDLSNIKDSLSEDLRTLRSLEDSVASLQKECKIKSNTVESLQDVLTSVQARNAELEDEVSRSVDKIRRRDDRCEHLSGKLKKLHSQLEEQHETFFRAEQQRMTQLGFLKETVKKQEKLLKKLNLRQEQLIPRSSILVYESYIRDIEKEIIVLQERLNGIELSQQLPKGYFGYFFKTNRVEMEVLDSFKQQVAKLQFLAGAEFIVKFKEDLEKCAAEEKEKQATFDNYSEKVENLGKSIEALYFALNREISFRKSLALSKSAYHNLLVRDSPKFNPDSQITYSIPVTNTKQSLLRSAILCVISLQRLRLLGQRHSFCEEVIENLSCV

SEQ ID NO: 2071 - protein, 762 aa, Schizosaccharomyces pombe
MQVRTLLTLGKKKVIGNRQCILSLYRKYSNVQSRKAEDQLLRQIFDDQNIAVNQITKRNGIQGVGLFRNHFLSDKDTGFLRLAETASEKCKAVIEDLLLEDTEDGSIVVSKFDRISNLLCSVIDLFEFVRCAHPDKMVVMKAEEAYSYLFELMNTLNTHQGLYEKLKCSLQQTPTLKDTDPEAYTVGRVFLQDFEKSGVNLESSKRNSFVKKSSESATLGRAFFNNSMNRPQRYLTISKQRLAGSDPYFVRSLSKNDKNFIMIPTVGYEGTQALISVANPDVRKEIYMEGHKGTVEEVELLNSYLRSKAEVAKLVGKSSFADLQLIDKMANAPKHVVEFLENLSLKNSSVLKKILNNLALMKKKELNLNFLPSFDVWDREYYTARYKQSLINQKPSLNPSITNYRRFFSVGTVIQGLSRLFSSLYGLRFVPADISPGEVWHPDVNKVNVYNENDHVMGVIYFDLFARTGKTDGAAHFTIRSSRELDLTSFDDSISLGFDDATNIRVKDNKRYQIPVISLLCNFVRSSGMDPTFLDLWDVKTLFHEMGHAMHSILGHTKYQNLAGTRCATDFVELPSIIMEFFMSNPAVLPLYARYEGTEIPLPVQVLNHHNMVENSSAPLDLQSQICMAMVDQLFHSKVVLDPSFNSIDEVTNVTRKFSGFESAPPAAWYLQFSHLYGYSATYYSYIFDTVLASLIFSKLFAGNPLSREAGEKFRKAILRWGGSRSPWECVAEALEQPILATGGEEAMRRIGSEGIKATSTF

SEQ ID NO: 2072 - protein, 542 aa, Schizosaccharomyces pombe
  unsure (1)..(542): unsure at all Xaa locations
SLNPHQIFNESGIQERGENARLSSFVGAIAVGDLVKSTLGPKGMVRSNLHRKNFXLTIYRDKILQSNSSGDIVVTNDGATILKSIALDNAAAKVLVNISKVQDDEVGDGTTSVCVFAAELLRQAEIMVNAKIHPQVIIDGYRIATKTAIDALRASSIDNSSDPAKFRSDLENIARTTLSSKILSQNKNHFAQLAVDAVLRLKGSTNLDNIQIIKILGGKLDDSFLDEGFILNKTIGVNCPKVMENANILIANTAMDTDKVKVFGARVRVDTTGKLAELERAEREKMKAKVEKIKSHNINCFINRQLIYNWPEQLFADAGIMSIEHADFDGIERLSLVTGGEIASTFDHPELVKLGHCKKIEEIIIGEDKMIKFSGVEAGEACTIVLRGATHQLLDESERAIHDALAVLSQTVAESRVTLGGGCAEMLMAKAVEEAATHEPGKKAVAVSAFAKALSQLPTILADNAGFDSSELVAQLKAAHYDGNDTMGLDMDEGEIADMRAKGILEALKLKQAVVSSGSEGAQLLLRVDTILKAAPRPRERM

SEQ ID NO: 2073 - protein, 363 aa, Schizosaccharomyces pombe
  unsure (1)..(363): unsure at all Xaa locations
MKSVGHFVPWLTDIRHLTDGTISEVFVGERKNSKKLYVIKVQGLVFKRPPHDAMRGKLILESIGHPHIERIVDSFIDNEAGSVYLITSFKSFVLSDVMDEISIDTKCKIVLQISSALEYLEKHGILHRDIHPNNILLDSMNGPAYLSDFSIAWSKQHPGEEVQELIPQVCXREFYILPNLQDFXRFFXIGTGHYRAIETLFGCHSYGHEVDRWTFGILIAELFSNQALFDDGSSEGWPSELRLTSSIIQTLGTPNPSMWPVSFKSLTLYLSLXTKTKHFRLFFXIIGFHADFANCFXELSTFPDWNKFIFHEYPPKPWSEILPSVDTSIQYIVSHLVTYSNRASPSFVIESFPKVSARLSQYA

SEQ ID NO: 2074 - protein, 224 aa, Schizosaccharomyces pombe
ILTLCLGFTRVFLVLISLYFMSWHPNYCTIVYLYSSLLDAFDGWAARKLHQATNFGAILDMVTDRCATSCLLCFLCAAYPKYAIIFQLLVSLDLASHYMHMYSTLHQGASSHKTVTKKHNWMLRLYYGNNKVLFIFCAANEMFFVALYLLSFTPRTPPKLGYLPVPSFIYSTGELPLSYPTLLAVLCGPICLAKQIINVVQLVNAANALVKMDVEQRRAAKKLQ

SEQ ID NO: 2075 - protein, 772 aa, Schizosaccharomyces pombe
MKFYIDDLPILFPYPRIYPEQYQYMCDLKHSLDAGGIALLEMPSGTGKTISLLSLIVSYQQHYPEHRKLIYCSRTMSEIDKALAELKRLMAYRTSQLGYEEPFLGLGLTSRKNLCLHPSVRREKNGNVVDARCRSLTAGFVREQRLAGMDVPTCEFHDNLEDLEPHSLISNGVWTLDDITEYGEKTTRCPYFTVRRMLPFCNVIIYSYHYLLDPKIAERVSRELSKDCIVVFDEAHNIDNVCIESLSIDLTESSLRKASKSILSLEQKVNEVKQSDSKKLQDEYQKLVRGLQDANAANDEDQFMANPVLPEDVLKEAVPGNIRRAEHFIAFLKRFVEYLKTRMKVLHVIAETPTSFLQHVKDITFIDKKPLRFCAERLTSLVRALQISLVEDFHSLQQVVAFATLVATYERGFILILEPFETENATVPNPILRFSCLDASIAIKPVFERFRSVIITSGTLSPLDMYPKMLQFNTVMQESYGMSLARNCFLPMVVTRGSDQVAISSKFEARNDPSVVRNYGNILVEFSKITPDGLVAFFPSYLYLESIVSSWQSMGILDEVWKYKLILVETPDPHETTLALETYRAACSNGRGAVLLSVARGKVSEGVDFDHHYGRAVIMFGIPYQYTESRVLKARLEFLRDTYQIREADFLTFDAMRHAAQCLGRVLRGKDDHGIMVLADKRYGRSDKRTKLPKWIQQYITEGATNLSTDMSLALAKKFLRTMAQPFTASDQEGISWWSLDDLLIHQKKALKSAAIEQSKHEDEMDIDVVET

SEQ ID NO: 2076 - protein, 340 aa, Schizosaccharomyces pombe
MFKRRRNPKGLVLNPNASVKSSDNDHKEELINNQKSFESNVEAFMEQCAHMNRRPAWISDLDNSSLEVVRHLGEGNGGAVSLVKHRNIFMARKTVYVGSDSKLQKQILRELGVLHHCRSPYIVGFYGAFQYKNNISLCMEYMDCGSLDAILREGGPIPLDILGKIINSMVKGLIYLYNVLHIIHRDLKPSNVVVNSRGEIKLCDFGVSGELVNSVAQTFVGTSTYMSPERIRGGKYTVKSDIWSLGISIIELATQELPWSFSNIDDSIGILDLLHCIVQEEPPRLPSSFPEDLRLFVDACLHKDPTLRASPQQLCAMPYFQQALMINVDLASWASNFRSS

SEQ ID NO: 2077 - protein, 1014 aa, Schizosaccharomyces pombe
  unsure (1)..(1014): unsure at all Xaa locations
MKRRATFQCPLIESTIKHQSTNYTKTETATTSHEVSENANEHKGKSNIDINKIAYYNVVWYGSTISFLTSXLNASGRKITMKKHKTWEGDGFLVREDSNLTLYNSDFTRYSYMSNLLKMKSQTIXHLLLRDIFYXYMLKTGSCHSRVPQIKEGELLRISGKEISVRYTCKRMFLIIFRLRRKSLQKVMKQAHIXMILSETFICLKXSVNSSHLXDLTQCTRQYSALPKPRHDPTVLGALVMSRPKTWDPRYGKSECLIXHYRTHVDVVIDPFLSKHLYSHQREGVSFLYDCLLGMEGKCGYSAILADEMGLGKTLQTITVVWTLLSMRLRVFFNFHSLILLFRAVLYANRSSTINNAMVVAPVTLLKVRSFKTSLLMARIGKMEFYNWLGHERIHVYIARCAEDFQEFTSNKTYSIIITGYETVIPLFILFSNCXRFVRTXRNYGCGIDIDLLICDEGIDLFINSLLILAHRLKSMSSQTWITLNKLKTRKRLLLTGTPLQNGMNQXMLFNFNRSDLSEYFSMVNFIIPGSLGTPNSFKAQYERPILRSRSMNASSRDISLGAARLQRVCLLKINFILIFSFLNLQANFTLRRKANILAKHLPPRSMQILKSVLTXXPTLFYSXNPTHQQENVYGHVLDGFKSSVDQKGYYLKILTRLSKICNSTILLRNEKENFLSTELQDKHVFEQENMLLSSSKLQILAALLKSFQRGCQKAVIVSQYKETLELIELFLSILHVRFCKLLGSTPFSERDLIVHNFNTSSFKEFSVLLLSSKAGGCGLNLTGSTRLIIYEPSWNPAQDLQALSRIYRSGQKRPVCIYTFLRYDRFYEXHIKLCSSGMLDERIFIRQNTKQGLSSSFIVCDLLXNFILTXLXDSDASQKKNFFTGEDIKTLFSYSKTETCLTYELAFDSDEIDSLTKKKDPLTKIDHTIDSPNTKEKDKEISSWKKASEYMDTNLVSCIFILIINGQGKKCPENAFQGWTWQFPNDLSIMNGVEDYIPLEPLPINCLMHKKFE

SEQ ID NO: 2078 - protein, 245 aa, Schizosaccharomyces pombe
  unsure (1)..(245): unsure at all Xaa locations
MGLLTILRQQKLKEREVRVLLLXDDSNIYRVKSNDFRGLDNAGKTTILKCLLNEDVSIFXGSIIYRLIGNEVSPTFGFQIRTLEVEGLRFTICTXLAIFEMNSLKLTNSRGIGGQKTLRNFWKNYFESTEAIIWVVDSLDDLRLEECRNTLQELLVEEVGXKCELSXHAYRNFLFTSILVLANKSDVSGALSSEEISKVSLQFMNPSXQQVKILNISKYKSSHWRIFSVSALTGLNIKDAISWLA

SEQ ID NO: 2079 - protein, 1067 aa, Schizosaccharomyces pombe
MITRLSGACLRRSGAKRNWPREHLVHRSLLASFSTTQRVLKCSVGPFRTSNVVFKSKEPKDNKPLDNKNDPKKTHNEDESHTNESLPSTDKKKKKDNDDFKQNLKSSSNKTEEKYSATQASKSKNDEFELGGEENEDEMPLNGEFNKNVPAKYSVPDVYPQLLALPIARRPLFPGFYKAIVTKNPSVSEAIKELIKKRQPYIGAFLLKDENTDTDVITNIDQVYPVGVFAQITSIFPAKSGSEPALTAVLYPHRRIRITELIPPKEDADSAASSDAAELETDKSSNLSSNGEVKSDLKQDNGKEEPEKEVESTPSILQNFKVSLVNVENVPNEPFKRQDPVIKAVTSEIMNVFKDIANVSPLFREQIANFSISQTSGNVFDEPAKLADFAAAVSAADHRELQEVLEATNIGDRLQKALYVLKKELLNAQLQHKINKEIEQKITQRHKEYLLTEQLKQIKRELGQELDSKEALVTEFKKRTESLSMPDHVKKVFNDELSKFQHLEPMAAEFNITRNYLDWITQLPWGKRSVENFDLDHAKEVLDRDHYGLKDVKDRVLELVAVGKLRGTMQGKIMCLVGPPGVGKTSVGKSIASALNREFFRFSVGGLTDVAEIKGHRRTYIGAMPGKIVQALKKVQTENPLILIDEIDKVGKSHQGDPASALLELLDSEQNSAFLDYYMDIPLDVSSVLFVCTANTIDTIPPPLLDRMEVIELSGYVSAEKVNIAKGYLIPQAKAACGLKDANVNISDDAIKGLISYYAHESGVRNLKKSIEKIFRKTSFSIVKEIDDELNSKEKSTGKSGKKTSPQSSEDAANKEASSVPLKVPDKVNIEIEEKDLTKYLGPPIYTSQRLYDTTPPGVVMGLGWTPMGGVSMYVETIVKNILSSNSTPSLERTGQLGDVMKESSEISYSFSKSFLSKHFPNNKFFEHARLHMHCPEGSISKDGPSAGITMATSLLSLALDTPVPATTAMTGELTLTGKILRIGGLREKTVAAKLSGMKEILFPKSNLADWEQLPDYVKEGLTGVPVAWYDDVFKRVFSNIDAEKCNNLWPNLIKSSSKQHQISPSH

SEQ ID NO: 2080 - protein, 481 aa, Schizosaccharomyces pombe
MDALKLLTTNVKFKNKVPQPSIKEKEAKKLQGITKGKAKVTGNNPVDPIEEFPEGILCENLKKQNITECTTIQRYAIPTIGSKRDLLACAPTGSGKTIAYLFPILQKLQLHVPGGYRAIIVAPTRELCEQIYRQAEKLSFGTSLKIIELSKSNEKIQEKAPKLREKYDMCIGTPMRLVQAIQTGLSFEKVEFFVMDEADRLFEPGFIEQTDHILSACTSSNICKSLFSATIPSRVEELAKVVTVDPIRIIVGLKDAATDSIDQRLLFVGSDTSKIVILRQMISNGELKPRVVIFVQDIERAKALYTELLFDEIHVGVIHGELPQAKREEALAKFRKGEIWVLIATDLLARGIDFHGVKMVINFDFPQSVHSYIHRIGRTGRAGNTGQAVTFFTKEDGEYIKLIAGVMRSSGCEVPNWVMALPKPSKEMKKKLKKSPPKRKRITTRASYDRQKEQRKKEYIKKVKKEASIKKHNEATGDSGQ

SEQ ID NO: 2081 - protein, 712 aa, Schizosaccharomyces pombe
  unsure (1)..(712): unsure at all Xaa locations
MAPRSSAVHVAVYSGVEVYECFIKGVSVMRRRRDSWLNATQILKVADFDKPQRTRVLERQVQIGAHEKVQGGYGKYQGXVVYCYALXHDLLSLNNANNXVFTKPNRGILIPFCIKYLYGRVLXMIDGINQTIGTWVPFQRGVDLATKYKVDGIMSPILSLDIDEGKAIAPKKKQTKQKKPSVRGRRGRKPSSLSSSTLHSVNEKQPNSSISPTIESSMNKVNLPGAEEQVSATPLPASPNALLSPNDNTIKPVEELGMLEAPLDKYEESLLDFFLHPEEGRIPSFLYSPPPDFQVNSVIDDDGHTSLHWACSMGHIEMIKLLLRANADIGVCNRLSQTPLMRSVIFTNNYDCQTFGQVLELLQSTIYAVDTNGQSIFHHIVQSTSTPSKVAAAKYYLDCILEKLISIQPFENVVRLVNLQDSNGDTSLLIAARNGAMDCVNSLLSYNANPSIPNRQRRTASEYLLEADKKPHSLLQSNSNASHSAFSFSGISPAIISPSCSSHAFVKAIPSISSKFSQLAEEYESQLREKEEDLIRANRLKQDTLNEISRTYQELTFLQKNNPTYSQSMENLIREAQETYQQLSKRLLIWLEARQIFDLERSLKPHTSLSISFPSDFLKKEDGLSLNNDFKKPACNNVTNSDEYEQLINKLTSLQASRKKDTLYIRKLYEELGIDDTVNSYRRLIAMSCGINPEDLSLEILDAVEEALTREK

SEQ ID NO: 2082 - protein, 643 aa, Schizosaccharomyces pombe
  unsure (1)..(643): unsure at all Xaa locations
LXQFLHMYDTYISKKQDVLLWGDEIECIVVSMDDKSKKARVSLRQEDILNALGKYEETFRHVDFGPVYAALRNETCPKKIDAILSEVAKNPADYVERIGGNSNKDTIEITSSTKPHAQNAVPTFHPEYGRYMLESTPGAPYGSTLKDFTFVEYNMRLRRKIIENHLLPNELPLTITNFFRLGTPGFTDPEVEANGAISRSFFLPDDVINTHVRFPTLTANIRQRRGRKVAMNVPIFFDKNTIKPFHDPTVPWDRNLFPEDANARDGAALDNHIYMDSMGFGMGCCCLQITFQAKSCDEARLLYDQLTPITPLMLALSAGTPAFRGYLADQDCRWNVIAGAVDDRTEEEMKTVPKSRYDSVDLYISNDKRNLPEYNDVPVVINQDCYDKLIKDCIDERLAKHMAHIFSRDPLVIFSDSILQDNSVSNAHFENLNSTNWQSMRFKPPPPGSDIGWRVEFRSMEIQITDFENAAYSIFVVMLSRAILSFNLNLYMPISLVDENMKAAHARDAIHRKKFWFRCNPFPDASTDDESGQFRQLTIDELFNGEHRENGFPGLITIVRSYLYSCNPDAKTICLIERYIRLISQRANGQCLTAASWIRNFITTHPSYKQDSVVNDEINYDLIRRIAKIVDGDYDDTLLGKCS

SEQ ID NO: 2083 - protein, 507 aa, Schizosaccharomyces pombe
MLSLFLKSLFAIIIIELTIIHALPTYTVHWKCSIQQANTSSASSNQTVQPRQHAAPSSDRIKSLPEFKGSLPELYSGYLEANSDKSLFYTYAPAVVDSETFIVWLQGGPGCAGTLGFFSENGPIEISQSSPSPSLNPESWTNFANMLWLDQPFGTGYSQGQAAYTTTIEEASSDFVNALKSFYQKFPHLMKKKLYLVGESYGSIWSANFAEALLSEPSLNINFMGVGIVSGLTADYETQEQITASIWVEHISKLGYYFNNTSSTISEEFKKRNKECQYDSVLNRLTFPTEQYPIWRPEYNFSTSTSLRKREALDGEDIGNVFNSISGCDLYSLSNFLLYLENSCVITYDVSLDCSFNEYNDPLITYLNREDVRSSLHATKASTALTSGEGVFADGCNFDLYKKIVSNNVESVLVEIIPRLTEKYKVSFLAGALDLQILWTGTLLALQNTTWNGWQGFTQSPGSLETTNGFTLDERNLAFTLSNSVGHMAPSKDPQMVREWLENTLLY

SEQ ID NO: 2084 - protein, 2244 aa, Schizosaccharomyces pombe
MSGLLPSLSSSFPLVQSEALGMPRTHGPKPSENDPKEPTCSPSPAFYSVNGEMKDYKLMALELEDKSVLQGYSFGADHSVSGELVFQTGMVGYPESLTDPSYRGQILVFTFPTVGNYGVPDRRILDEISGLPKYFESNQIHVAAIIISSYSQNYSHFLAHSSLGEWLKEQGIPGIFGIDTRALTKKIRDQGSMLGRLLIQKDESPINPSSITGLGKDWSTAFEDIPWKNPNTENLTSQVSIKEPKLYEPHPTTAIKKADGKIIRILVIDVGMKYNQIRCFLNRGVELLVVPWDYDFTKETYDGLFISNGPGDPSLMDLVVDRVKRVLESKTVPVFGICFGHQIMARAAGASTTKMKFGNRGHNIPCTCMISGRCYITSQNHGYAVDASSLSNGWKELFVNANDGSNEGIYNTEYPFFSVQFHPESTPGPRDTEFLFDVFIDVVKRSADAKSLQPFKLPGGTIEENRSRHPLVDAKRVLILGSGGLSIGQAGEFDYSGSQAIKALREEGIYTILINPNIATIQTSKGLADKVYFLPVNADFVRKVIKQERPDSIYVTFGGQTALNVGIELKDEFEQLGVKVLGTPIDTIITTEDRELFARAMDEINEKCAKSASASSIEEAIKVSKDISFPVIVRAAYALGGLGSGFADNEAELIDLCTLAFATSPQVLIERSMKGWKEIEYEVVRDAFDNCITVCNMENFDPLGIHTGDSIVVAPSQTLTDEDYNMLRTTAVNVIRHLGVVGECNIQYALNPFTKEYCIIEVNARLSRSSALASKATGYPLAFTAAKLGLNIPLNEVKNSVTKVTCACFEPSLDYVVVKIPRWDLKKFTRVSTQLSSAMKSVGEVMSIGRTFEEAIQKAIRAIDYSNTGFNVKDALMSIDTELQTPSDQRLFAIANAMASGYSVDRIWELTRIDKWFLEKLMGLIRTSQLISKHDISSLPISLLKTAKQLGFADVQIAAFMNSTELAVRRIRTEAGIRPFVKQIDTVAAEFPAFTNYLYTTYNAVEHDIHFNDKGVMVLGSGVYRIGSSVEFDWCAVRAVRTLRDRGVKTIMVNYNPETVSTDYDEADRLYFENIGLETVLDIYEQESSSGIIIAMGGQTANNIALPLHRENVKILGTSPEMIDGAENRFKFSRMLDDIGVDQPKWKELTSFDEADKFCDTVGYPVLVRPSYVLSGAAMNTVYSQSDLHSYLQQAVAINKDHPVVISKYIENAKEIELDAVAREGKMVMHVISEHVENAGVHSGDATLVLPPQDLAPTTIERIVDAAAKIGEALNITGPYNIQFIAKDNEIKVIECNVRASRSFPFVSKVIGVDMISMATDVIMGNPIQPYPDVDLPRDYVAVKVPQFSFSRLSGADPVLGVEMASTGEVACFGHNKFEAYLKAMISTGFRLPKKNILISIGSYKEKAELLPYVKKLYENNYNIFATAGTSDYFMESGVPCKYLADLPAEEANNEYSLSAHLANNMIDMYINLPSNNRYRRPANYISSGYKSRRLAIDYSVPLVTNVKCAKLMIEAICRNLDFSLSTVDFQSSFQTANLPGLINISAFLPEFTSEAVSDYTKECIASGFTMARFLPFSTSSTLADKDSLSAVKKLALDHAHCDYNFSVIASSTNEVTISELTSESGCLFFHFEKDDSGIDHVTAVASHFNVWPDTQTVMTDAKSTTLASLLLLASLHNRRIHITNVSSKDDLNLIVLAKQRSLPVTFDVSVYSLFLNQNDYPGATFLPTADDQVEIWNKLSYIDCFSIGSIPSRLAKFVGNTAFTGFGVREAIPLLLTAVNEGRLTLKDVVDRFYSNPKAIFRLHDQDDSGVQLEVDRSVSWSSKDWTPFNGKKLYGSIQSVQFDGHDVFFDGELNFEHTYGRDYSSASLADKSKATRKVSALMSPGLPHAAPSLAEAFGQAPENKAHPDISLNMTPNFKPSHELVQLINSSPFYRKHIISVHQVTRSDLHVLFAIAHQMRIIVERQGVIDLCYGKLLCTMFFEPSTRTSSSFDAAMQRLGGKVVAVTASASSVNKGESLADTIRTLGCYGDAIVLRHPSIESARIAANFSPVPIINGGNGSKEHPTQAFLDLYTIREELGSVNGLTITFIGDLKYGRTVHSLARLLAFWHVELHLVSPEQLALPDDVKDDIRANGLNFIEHRELTKEVVAQSDVLYCTRVQKERFASVDEYEKLKDSFIVDNSVLASAKSHCIVMHPLPRNREISEEVDFDQRRAAYFRQMRYGLYIRMALLACVMGATEVAN

SEQ ID NO: 2085 - protein, 566 aa, Schizosaccharomyces pombe
MNELHDGESSEEGRINVEDHLEEAKKDDTGHWKHSGTAKPSKFRAFIRLHFKDSRKFAFSRKKEKELTSEDSDAANQSPSGAPESQTEEESDRKIDGTGSSAEGGDGSGTDSISVIKKSFFKSGRKKKDVPKSRNVSRSNGADTSVQREKLKDIFSPHGKEKELAHIKKTVATRARTYSSNSIKICDVEVGPSSFEKVFLLGKGDVGRVYLVREKKSGKFYAMKVLSKQEMIKRNKSKRAFAEQHILATSNHPFIVTLYHSFQSDEYLYLCMEYCMGGEFFRALQRRPGRCLSENEAKFYIAEVTAALEYLHLMGFIYRDLKPENILLHESGHIMLSDFDLSKQSNSAGAPTVIQARNAPSAQNAYALDTKSCIADFRTNSFVGTEEYIAPEVIKGCGHTSAVDWWTLGILFYEMLYATTPFKGKNRNMTFSNILHKDVIFPEYADAPSISSLCKNLIRKLLVKDENDRLGSQAGAADVKLHPFFKNVQWALLRHTEPPIIPKLAPIDEKGNPNISHLKESKSLDITHSPQNTQTVEVPLSNLSGADHGDDPFESFNSVTVHHEWD

SEQ ID NO: 2086 - protein, 318 aa, Schizosaccharomyces pombe
  unsure (1)..(318): unsure at all Xaa locations
LIKSAGAVASRLLCHPIDTITVHKQTIGKFSFKTMPLKAYYRGLPISLTLITPATCLYLSTYVEAKRRFKPSVGEGAILYSICGMTAEVVSSFVWTPLEVIKARTQISQKGSVINTISTLARSEGLKGFYRGYWMVCESFLFIYXIFFKXESKQSKALRPLGEIKKQKXTXSNFXLIFCXFSFXLKLXGVAIYLPTTVSWWVCYEESKKYLQKQSNWDISVIAPICSALGTVVATTISTPLDIVKTRYQVATSSAMRKAEYGLQAEKELGILEIAKLLFSKHGVKGFTRGLFTRMCYIMPSGMISMSVFESFKSKDID

SEQ ID NO: 2087 - protein, 925 aa, Schizosaccharomyces pombe
MSLGLQPNNDISSLVSSKNMTSENGLEHQFEELLVEKQYSEEHCAYCHIKNPNSILKCLHCNKWFCNVRGKSGASHIISHLVRARHKQVALHSHSSLSDTVLECYNCGTRNVFLLGFIPAKAKTVVVLLCRQPCARASIAKDMNWDLTQWQPIISDRQFLPWLITPPSEEEQKLAIPITSQQMVRLEELWRKDPNANLEDLDKPIEDDSLPSVELRYKDAHAYQAVLSPLIQAEADYDKRLKESQTQKDVVVRWDQAINKRYTAWFLLPKLESGEIRLAIGDEMKLTYEGELRAPWSSTGYVIKIPNNVSDEVGLELKRSDKVPIECTHNFSVDYVWKSTSFDRMQTALRLFATDGSRLSSFLYHKLLGHDIPPSFLKPKLPSDLSVPNLPKLNASQSEAVRAVLSKPLSLIQGPPGTGKTVTSASVVYHLATMQSRKRKSHSPVLVCAPSNVAVDQLAEKIHRTGLRVVRVAAKSREDIESSVSFLSLHEQIKNYKFNPELQRLLKLRSENNELSIQDEKKLRILVAAAEKELLRAAHVICCTCVGAGDRRISKYKFRSVLIDEATQASEPECMIPLVLGAKQVVLVGDHQQLGPVVMNKKVALASLSQSLFERLIILGNSPFRLVVQYRMHPCLSEFPSNTFYEGTLQNGVTTSERIARHVDFPWIQPDSPLMFYANFGQEELSASGTSFLNRTEASTCEKIVTTFLRSNVLPEQIGIVTPYDGQRSYIVQYMQNNGSMQKDLYKAVEVASVDAFQGREKDFIILSCVRSSEHQGIGFVNDPRRLNVALTRAKYGVIVLGNPKVLAKHALWYHFVLHCKEKGYLVEGTLNSLQKFSLTLTPPQKPQKFKRDLNVQRSLSPIQNAGSAMLPSFSNLPNLYSSSYLEEWNVFAQYKRRESNATDFEDFRSQVGDDESKFDEPTRF

SEQ ID NO: 2088 - protein, 543 aa, Schizosaccharomyces pombe
DHQKDLNFSPYKSIPLNNRPYSPMSEIVGFSGSTTPLDTYGNRPSGKKFNKNSKFRPPGSTISSYSSASTLRRLPRAPGSKVHAERQNSTFNSGISLRALRKEMGNTAPVSSNQLLKDADLVMENLSTRNTEKVLREVNILKRLRESCVAITAKSYDTLDERKIRSLTTFEYLEIKNFQKIYFTGSENCQKLSKQIPLDECNEALFDDDNGDYKAIQGDHLLYRYEIIDTVGKGSFGQVLKCIDHKRGQVVAIKVIKNRQKFHGQTLVEVGILKRLCEADPADKNNVIRYLSHFDFRGHLCIVTELLGSNLFDVIRENNYKGLPLIVVKSFALQGLQALRLLQGQNIIHCDLKPENLLLSHPLKARIKLIDFGSSCFYNEKVYTYLQSRFYRAPEIILGLEYGKEIDIWSFGCILAELFTGVPLFPGGNETEQLGYIMEVLGPPPMALIRNSTRSKAYFDSEGKPHPITDSHNRLLVPSTRTFSQLLNTKQASFLDFLSKCLKWDPKDRITVDSALQHEFILGKTSQKPMVSKGSHPLPDLPV

SEQ ID NO: 2089 - protein, 483 aa, Schizosaccharomyces pombe
  unsure (1)..(483): unsure at all Xaa locations
LXKAISLVKTAIDNDNAEQYPDAYKYYQSALDYFMMALKMXVTQXFELGXGYIVAMIHKEIYIWIYIFKLLFANISDEKNEKSKEIIRSKVIEYLDRAEKLKVYLQEKNNQISSKSRVSNGNVEGSNSPTANEALDSDAKKLRSALTSAILVEKPNVRWDDIAGLENAKEALKETVLLPIKLPQLFSHGRKPWSGILLYGPPGTGKSYLAKAVATEAGSTFFSISSSDLVSKWMGESERFVILRXNYLLFNIYMTNIIGLVRQLFEMAREQKPSIIFIDEIDSLCGSRSEGESESSRRIKTEFLVQMNGVGKDESGVLVLGATNIPWTLDSAIRRRFEKRIYIPLPNAHARARMFELNVGKIPSELTSQDFKELAKMTDGYSGSDISIVVRDAIMEPVRRIHTATHFKEVYDNKSNRTLVTPCSPGDPDAFESSWLEVNPEDIMEPKLTVRDFYSAVRKVKPTLNAGDIEKHTQFTKDFGAEG

SEQ ID NO: 2090 - protein, 513 aa, Schizosaccharomyces pombe
  unsure (1)..(513): unsure at all Xaa locations
MGQTLSEPVTEKHSVNGSNEFVLYGLSSMQGWRISMEDAHSAILSMECSAVKDPVDFFAVYDGHGGDKVAKWCGSNLPQILEKNPDFQKGDFVNALKSSFLNADKAILDGKFVVNNDKVVFIDIITILKSPKNXXILCLKFLXIFCSFVXLMLRKIVTKIIEMFTSXCXKVVTFSLVSEKKFVISLHCILLTILTDDQFHTDPSGCTATVVLRVGNKLYCVSLGSCLVLLIVXANAGDSRTVLGSKGIAKPLSADHKPSNEAEKARICAAGGFVDFGRVNGNLALSRAIGDFEFKNSNLEPEKQIVTALPDVVVHEITDDDEFVVLACDGIWDCKTSQQVIEFVRRGIVAGTSLEKIAENLMDNCIASDTETTGLGCDNMTVCIVALLQENDKSAWYKKIADRVAANDGPCAPPEYAENHGPGWRSGDNNKKVIVPPNFHQVKLNGSDGYDKDANENSKEDDSTNGSLAAGFRWKEHFFPHKAEEENSSSETDIVNSNKDVADDHKEAVSAAD

SEQ ID NO: 2091 - protein, 789 aa, Schizosaccharomyces pombe
  unsure (1)..(789): unsure at all Xaa locations
MVKVSGKLRNGGSITKQNLTDGLVGGQRIKAPNKKKNRKASKNTTKKSTVSVVNFLEQDTDFGANEVVGSDNSSPEKRSENSPSKRKDILEQRKNLPIWEAHDTLCQQIQDNRVIVVVGETGSGKSTQIPQFLNECPYAQEGCVAITQPRRVAAVNLAKRVAAEQGCRLGEQVGYSIRFDDTTSKKTRIKYLTDGMLLRELINDPILSQYHTLILDEAHERTLMTDMLLGFVKKIIKKRPALRVIIMSATLNAERFSEFFDGAEICYISGRQYPVQIHYTYTPEPDYLDACLRTIFQLHTKLPPGDILVFLTGQDEIEALEALIKSYSKQLPSNLPQIQACPLFASLPQEQQLQVFLPALANHRKVVLSTNIAETSVTISGIRYVIDTGLAKIKQFNSKLGLESLTVQPISQSAAMQRSGRAGREAAGQCYRIYTEADFDKLPKETIPEIKRIDLSQAVLTLKARGQNDVINFHYMDPPSKEGLLRALEHLYSIGALDDNGHINDLGYQMSLIPLLPSLARAVLAAREHNCLSEVIDVVSCLSTDSMFLFPQEKRDEAIEARLKFLHSEGDLLTCLNALRQYLESSHDSRKQWCSQNFINRRALKTILDIRKQLREHCLKDGWELNSSPEVNSENLLLSFLSGYITNTALLHPDGSYRTIIGNQVSFLFNDIQIHVACICNXSCQTFLIQIRTISIHPSSSLFGKKVEAIMYHELVSVIVSNFFXSNHSGITTKSYVRGVSSIRSNWLNAVAPHYLARRSTXTFQLLKKIKKAHILSHYILVNLETTIF

SEQ ID NO: 2092 - protein, 1022 aa, Schizosaccharomyces pombe
  unsure (1)..(1022): unsure at all Xaa locations
MSFDGLIVENENTKSGYNDGNVGILKSIILNXRMXDLTDLFKQNGTDMSVINSLLGDTNNPGMNESPKILDSSFENSNPQDGPNYEDFDFMGSIHKEFGNNINEMDDMEDVSDDNLPEEEQAVNYTGDKDDEDFGKLLAKEMGEEAAGQVLSGVGFSIPSGLVPPSEPSKTVSSTTEELQNEAQIRESIVKTFFPTFERGVLLNFSELFKPKPVKLAPPKKKTPKGMNXLLLYFFTDLTCXVCVPGRLTLEVDTDYAIIFNSKKSLPLKRNVVSPISTHTKKRRRTANTSQVWFDLEXLSLTERRNDGLDLNTVFTTNDWEKNIIYDESDVNKTNQSSFFIDKSLVDIDFAFDENIFDGDTGTSKVVLNLNDPKLLLQPQLPKKEDSQRSFADTHQRNSLAWKFNISNDPAYEMLKQNHQSKVRNTLSQLAIEHAAFAEKLTFPYYKTRLSKRAVRSYHRPTMSFKPNAAIVFSPLIVRKRSKDKHKSERELIPTTKEITMGDTTHAILVEFSEEHPAVLSNAGMASRIVNYYRKKNEQDESRPKLEVGESHVLDVQDRSPFWNFGSVEPGEITPTLYNKMIRAPLFKHEVPPTDFILIRNSSSYGSKYYLKNINHMFVSGQTFPVTDVPGPHSRKVTTASKNRLKMLVFRLIRRSPNGGLFIRQLSKHFSDQNEMQIRQRLKEFMEYKKKGDGPGYWKLKSNEVVPDEAGTRSMVSPETVCLLESMQVGVRQLEDAGYGKTMDEINDDEDEEQPAEQLLAPWITTRNFINATQGKAMLTLFGEGDPTGIGEGYSFIRTSMKGGFKPAGETADDKPEPQTKNAHAYNVAKQQRAYEEEINRIWNAQKRGLSINNLEELAKKYGINSIHDDYVESNEETTREETPSSDKVLRIVRLYRDKNGNLERKQETIHDPIVIHAYLKKRREIDEQSTALDAVVPTGDEAIDRRNRRRLEQELAKSQKNWERRRARHAAKEGINLNGEGRKPTTRKCSNCGQVGHMKTNKICPLFGRPEGGLATMLDKN

SEQ ID NO: 2093 - protein, 267 aa, Schizosaccharomyces pombe
  unsure (1)..(267): unsure at all Xaa locations
NVLPGGEAAVLNDQSFPVREWSIKLVCLNPQGEETDASFVDRVTYKLHPTFQNPTRSMYYVMKGRLAEXRXLIFLAIRKPPFQIKEQGWGEFEMEIIIYYADKGGEHRFLHYLHFQQEHYHEDIELVCVLSILTFTRLXFYGANXVLNINATRPGLLKALTATGEVPGYSDEGEEARKDKRKNESEVGAGKKKAKAKPVDMDKLAEGLQKLQEDDLLQVVQMVNENKTPDMYVRNDIEGGEFHIDLYTLPDNLLLLLYSFCAKRVTM

SEQ ID NO: 2094 - protein, 408 aa, Schizosaccharomyces pombe
  unsure (1)..(408): unsure at all Xaa locations
MSNAVSSSVFGEKNNSVAYELPWVCIYYEQLKRPLXRFXCSAITIASWXLRHLFIIXRFNIIXYADLXTYRVEKYRPIVLDDIVGNEETIDRLKVIAKEGNMPHLVISVTYFFLIIIYTTCXLIFIGNPGIGKTTSILCLAHALLGPAYKEGVLELNASDERGIDVVRNRIKAFAQKKVILPPGRHKIIILDEADSMTAGAQQALRRTMEIYSNTTRFALACNQSNKIIEPIQSRCAILRYSRLTDQQVLQRLLNICKAEKVNYTDDGLAALIMTAEGDMRQAVNNLQSTVAGFGLVNGENVFRVADQPSPVAIHAMLTACQSGNIDVALEKLQGIWDLGFSAVDIVTNMFRVVKTMDSIPEFSRLEMLKEIGQTHMIILEGVQTLLQLSGLVCRLAKSQMKPESFII

SEQ ID NO: 2095 - protein, 356 aa, Schizosaccharomyces pombe
  unsure (1)..(356): unsure at all Xaa locations
MNNQLENVFRFDEEKERAKIRESPWKHEXVKISLVFSYIIPVSEFFSLRXFIKIINPVMLTITAPEFFRSVKISAVALLKMLRHVSQGMPLEVMGYVQGKVEGASLIILDSFALPVEGTETRVNAHEEAQEYSVQYHTLCKSVYRHENVIGWYHSHPNYGCWLSGVDVETQRQNQKYQDPFVAVVLDPKRSLESPYVNIGAFRTYPVGNDGSIRTKSRHHPSVLFKNLPSSKIEDAGAHAEAYYSLPITYFHSKAEKKVTEFLRNRNWSRSITECSILQVRFIFXXSFLTSLQVFLTSNIENEFLHDSEKLIDHLIHETGNNELPVASAYEQSKACCNELSTFLSQIDVQDKLFKE

SEQ ID NO: 2096 - protein, 300 aa, Schizosaccharomyces pombe
MDYLLNYADQYALDSIYNAVYPLARDNIVRQSISLFFLTWFGGMFLYLTFASLSYQFVFDKSLMDHPKFLKNQVFMEVLTALQNLPGMALLTVPWFLAELHGYSYLYDNISDYGLKYFLCSLPLFVMFSDFGIYWAHRFLHHRYVYPRLHKLHHKWIICTPYASHAFKSADGFLQSLPYHLFPFFFPLHKLTYLALFTFVNFWSIMIHDGKYISNNPIINGAAHHNGHHIYFNYNYGQFTTLFDRLGNSFRAPDEAWFDKDLRQNEDVLRVELMEYEAIRNEVEGDDDREYIANSAKKNH

SEQ ID NO: 2097 - protein, 525 aa, Schizosaccharomyces pombe
  unsure (1)..(525): unsure at all Xaa locations
MLKKQALSGIRRFSLATKQSFVKTSYKLPRKSWLNTAKFNTIRYASTEAAKHNKGSIKQVIGAVVDCQFEDADSLPSILNALEVKLPDNKRLVLEVAQHVGENTVRTIAMDGTEGLVRGTAVIDTGSPISIPVGPGTLGRIMNVIGEPVDERGPIKAVKYSPIHADAPSFEEQSTTPEILETGIKVVDLXAPYARGGKIGLFGGAGVGKTVFIQELINNIAKAHGGYSVFTGVGERTREGNDLYREMQETGVIKLEGESKAXLVFGQMNEPPXCSARVALTGLTVAEYFRDIEGQDVLLFIDNIFRFTQAGSEVSALLGRIPSAVGYXTHVATDMGAMQERITTTKXRFYTSVQAVYVPADDLTDPAPATTFAHLDATTVLSRSISELGIYPAVDPLDSKSRMMDXSYSWXEXLXPCRSVQQMLQEYKSLQDIIAILGXGXIVXSXXIDSXSVSXGTTFLSQPFAVAEVFTGIEGRLVSLKDTIRSFKEILEGKHDSLPESAFYMVGSIDDAVKXGXEDCTRIGA

SEQ ID NO: 2098 - protein, 312 aa, Schizosaccharomyces pombe
  unsure (1)..(312): unsure at all Xaa locations
MSDITVEPIGKQMEKLILDVQQEIVAGLEAVDGQKFFQDKWTKGEGGYGISCVIQDGNVFEKGGVNTSIVQGKLNQDAVQRMRANHEGIDRTAKELPFFAAGISMVIHPRNPMAPTTHLNYRYFELVNSDGKKIWWFGGGADLTPSILFEEDGKHFHKLHKEACDRHDPTFYPRFKKWADEYFLIKHRKETRGIGGIFFDDLSEKDPQELFAFVKDCXPTFLPAYVPIMEKRKNMEFTEDDKEFQLIRRGYYAEFNVMYDRGTWFGLQAPEXPVESILMTLPLHASWRXQVXPKQERHKALLKVTHTPIEWC

SEQ ID NO: 2099 - protein, 319 aa, Schizosaccharomyces pombe
  unsure (1)..(319): unsure at all Xaa locations
MQQDEVIWQVVGHEFCSYRIKXVDFALLVLHYNLTQFLEGEAQNFCRNEYNVTGLCNRQSCPLANSRYATVREDNGKLYLYMKTIERAHFPSKLWQRIKLSKNYAKALEQIDQQLLYWPGRQIHRCKQRLTRLTQYLLKARRLALKHQPALIPIKXXQAHREASRERKALIAAKLEKNIEKELVKXTXSGVYGDQPLNVNEEIWNXGTSAREGLXXXREEEEEREEAELEFVSDDEDEEDISDLEDWLGXRSVHGTSESEEEESSESESDEDEDEDNKGKIRKRKTDDAKKSRKKRAPHIHIXVXARTENEKIXCCSTF

SEQ ID NO: 2100 - protein, 424 aa, Schizosaccharomyces pombe
  unsure (1)..(424): unsure at all Xaa locations
MEVPSAVTLNNYVGMKTKECXXRVKTNVYRFDSITSQINRKLIRRGFQFNVMVVGTYYFYYRFSIIMMLTVSNRTSGSGKSTLINTLFSAHLMDSKGRLDYQAPYRQTTEIHVTSQGMLIFLXLGFHLXLNSLSWLQXVSNPYIYYGYIANHIVVRENRVQLQLNLIDTPGYGDQINNDKWXVXSVEMEISIPAQAISNYNSWEPIIKYIRDQHSSYLRRELNSHREKRLQDTRVHCCLFFIRPTGHSLRPIDIAVLKRLTEVVNVVPVIAKSDSLTLEERAAFKQQIREEFVKHDINLYPYDSDDADEEEINLNAAVRNLIPFAVVGSEKAIIVDGRPIRGRQNRWGVVNVDDENHCEFVFLRNFLMRTHLQDLIETTSYYHYEKFRFKQLSSLKEQSSLATRMGSPAPVYPSEPHLHTATAQ

SEQ ID NO: 2101 - protein, 488 aa, Schizosaccharomyces pombe
MEIAGNSSTISPTFSTPTKKRNLVFPNSPITPLHQQALLGRNGRSSKRCSPKSSFIRNSPKIDVVNTDWSIPLCGSPRNKSRPASRSDRFIPSRPNTANAFVNSISSDVPFDYSESVAEACGFDLNTRVLAFKLDAPEAKKPVDLRTQHNRPQRPVVTPAKRRFNTTPERVLDAPGIIDDYYLNLLDWSNLNVVAVALERNVYVWNADSGSVSALAETDESTYVASVKWSHDGSFLSVGLGNGLVDIYDVESQTKLRTMAGHQARVGCLSWNRHVLSSGSRSGAIHHHDVRIANHQIGTLQGHSSEVCGLAWRSDGLQLASGGNDNVVQIWDARSSIPKFTKTNHNAAVKAVAWCPWQSNLLATGGGTMDKQIHFWNAATGARVNTVDAGSQVTSLIWSPHSKEIMSTHGFPDNNLSIWSYSSSGLTKQVDIPAHDTRVLYSALSPDGRILSTAASDENLKFWRVYDGDHVKRPIPITKTPSSSITIR

SEQ ID NO: 2102 - protein, 451 aa, Schizosaccharomyces pombe
MSLEENVKEAKNAFNILQTLSVEDRDDALDKIVEELRIKKSEVLAANAEDMKAAKLLAESGKLSSSMVKRLDLSSSDKYDSMVQGVLDVKSLPDPLGRVTYARSLDDGLDLYKVSCPVGLLLVIFEARPEVIINITSLAIKSGNAVVLKGGTESAKSFAALSNVVRSALGKSKVPQAAVQLVQSREEVSQLLKLDEYIDLVIPRGSTNLVRHIKDNTKIPVLGHAAGLCSMYVHEDADMELASKLVLDGKTDYPAACNAIETLLINEAVLSSHLPKIAETLTEAKVTLKCDPASLKVLKDMPKVSALVEPSVDQDYNTEFSDLILAIKTVPSLQSAMQHINTHGSKHTDCIITSSEAAANRFMAGIDASGVYWNASTRFADGFRYGYGTEVGISTNKIHARGPMGLDGLTIYKYQLRGNGQVASSYGVGPGKRAFKHTPINIDNISQVSKK

SEQ ID NO: 2103 - protein, 573 aa, Schizosaccharomyces pombe
  unsure (1)..(573): unsure at all Xaa locations
MDKNDYLHFERNPSLFPKSTLDKVQKTKKYIEHYYKVAVDHAVERNQRYEXHYYSGFXHCFTFLNXYSHLIRXSDKYQRRCFYXFFLRSQLRVLQXMHNLECLXNLRQLTHLVSKMLINNASFRLIYFXVXILILFRRINLEQRLATERGSEERKNRQLRASGEKESQFLRFRRTRLSLEDFSTIKVIGKGAFGEVRLHNCLCFWYLIKXVRLVQKLDTGKIYAMKSLLKTEMFKRDQLAHVKAERDLLVESDSPWVVSLYYAFQDSLYLYLIMEFLPGGDLMTMLINYDTFSEDVTRFYMAECVLAIADVHRMGYIHRDIKPDNILIDRDGHIKLSDFGLSTGFYKQDQSASYMKPRTGNTVKRGQMVDAIWLTMSSKDKMATWKKNRRVMAYSTVGTPDYIAPEIFLQQGYGQDCDWWSLGAIMFECLIGWPPFCSENSHETYRKIINWRETLTFPNDIHLSIEARDLMDRLMTDSEHRLGRGGAIEIMQHPFFTGIDWDHIRETAAPFIPNLKSITDTHYFPVDELEQVPEQPVTQQPASVDPQTLEQTNLAFLGYTYKKFNYLTMKGAL

SEQ ID NO: 2104 - protein, 484 aa, Schizosaccharomyces pombe
  unsure (1)..(484): unsure at all Xaa locations
MAPQFKRPELFGFDKSHAQSFVQGKWIXSPNNKTFEVDNPATGEIIGKVADVSVEETKKAISAANEAFKTYKNFTHVQRSQLLERWAXXLIMENKDDLVKMLTXRNXQALSQAEMEXHHMXGYLKWYAAEAVRTXWRCSSSSLQSQNFXHLHXNSSWCQAXDYSLELPRAMIARKGXCRFGCXVVRYFXCLLPXLPTFAXFSXGWRKRPVSLTVSXMXITSSDASAHGKELXYQPYRSXGFLXTGSLMSVKFLWDKSASTIKNVSMELXRXCPFHCIPXLPHXSGVESFCTIKFNSCGQVCVCPNRVYVHKNVYDEFVSKLTEKVKTIRVGDGFDSSSAVGPLISQDGCRKVSKHIEDAVSKGXQNHCWWKGDFLKQRLFFEPTVLSGVTQDMLVASEETFGPLASVFKFDDTEEVIEWXXRQXCXXLAGYVFTNNLSXNDPRCQRTRGGSCXVPISNGXXNHLFPLAXIKQAVLXKEAGVWAX

SEQ ID NO: 2105 - protein, 173 aa, Schizosaccharomyces pombe
  unsure (1)..(173): unsure at all Xaa locations
FPXIXHXKNRFEXLHSXISXVDGXQYRXCLXWDTAGQEEYDQLRSLSYSDTHVIMICFAVDSRDXLENVITKWLPEXLSNXPWCXIGSXLXLKCDLRGADEEQVDHSKIIXLREGLAAAKKINAVRYLECSAKLNRGVNEAFTEAARXXPLAAQPRGTKDGADESHGXRMYHA

SEQ ID NO: 2106 - protein, 497 aa, Schizosaccharomyces pombe
  unsure (1)..(497): unsure at all Xaa locations
LLTLXIGNKYRIGRKIGSGXLGQIYLGLNTVNGXTSAVKLEXFKARHHQLEYEXVVLXYFFTXXISWIXFRXLQFLLYIYQPXLDVLQPKRKSKSYSXLVIFLFSFXHLGFVCINILKGNIGIPTIRWFXCXPIXYNXYGHGFXXXPSLXXXLFCXLWKKXLSXNGSFLADQLISRIEYVHSKXHSYIETLSPDNFLMKKHSNVVTXDXLRIGEKIRDFKTHXSYSISXXNKNLRERLDYASIXHPXLVLNNLAVMPRILGYXFTLFLSRQFAXGKATSXXQRSKSINGXVIPRXGLLWKSFAKXXPEEFITTCVTXRQLSFYRXSQTMLIXESCFVFTYSXRIPYDYVFDWMILKYVSFXKENDKXDTLVXPXQMIEXFDXLTIISKSELLLLPPLLLQHLHRLHXPMGVTNSTGXXPLXPNYSSIPLPLSGIQRLHNLSPTXYCSMCFSLTSSSXPFVLLFPTXXLEYIPXXRCNLNXSAQXRXCFRXRXPAPXF

SEQ ID NO: 2107 - protein, 171 aa, Schizosaccharomyces pombe
KNFFRYLTPKNRFENYIHDIFVDGNSIELSLWDTAGQEEYDQLRSLSYSDTHVIMICFAVDSRDSLENVITKWLPEVSSNCPGVKLVLVALKCDLRGADEEQVDHSKIIDYEEGLAAAKKINAVRYLECSAKLNRGVNEAFTEAARVALAAQPRGTKDGADESHGTGCIIA

SEQ ID NO: 2108 - protein, 484 aa, Schizosaccharomyces pombe
  unsure (1)..(484): unsure at all Xaa locations
MTVVDIKIGNKYRIGRKIGSGSFGQIYLGLNTVNGEQVAVKLEPLKARHHQLEYEXVVLXYFFTXVXVGFLSELQFLLYIYQPXLDVLQPKRKSKSYSIWLFFFFLSNIXFRVYNILKGNIGIPTIRWFGVTNSYNAMVMDLLGPSLEDLFCYCGRKFTLKTVLLLADQLISRIEYVHSKSFLHRDIKPDNFLMKKHSNVVTMIDFGLAKKYRDFKTHVHIPYRDNKNLTGTARYASINTHIGIEQSRRDDLESLGYVLLYFCRGSLPWQGLQADTKEQKYQRIRDTKIGTPLEVLCKGLPEEFITYMCYTRQLSFTEKPNYAYLRKLFRDLLIRKGYQYDYVFDWMILKYVSFEKKMIRXYVSLTLTNDXKFDXLTIISKKRAAAAAAASATAPPQVTSPMVSQTQPVNPITPNYSSIPLPAERNPKTPQSFSTNIVQCASPSPLPLSFRSPVPNKDYEYIPSSLQPQYSAQLRRVLDEEPAP

SEQ ID NO: 2109 - protein, 624 aa, Schizosaccharomyces pombe
MRPGMHDTPLSLMQKREALAISLSKRDSVGSYAPYNVTCPSDYMLRPASDGISSGEQSFIDKRIPKINTQMRSFISNTGLDVDVNSVINDSDGPRLGLAFSGGGLRAMVHGGGVLNAFDSRNGNGSSLAGILQSAMYIAGLSGGSWLVGSVAVNNFANITYLRDNVWNLEHSVFAPHGDNVVENLAYYDDLDDEIDQKKDAGFDTSLTDLWGRALSRKLVDATQGGPNITFSSIRNQTWFQNADYPYPIIISDSRLEEEKAIPANTSIFEFTPYEFGTWDNGIKAFLPMEYVGTHLKNGVPPDHKCIRNYDNAGFVMGTSATLFNTFLLEWSQEVTSNSTLYDIIHKVFEKLSEDQNDIAPYPNPYQNFTTTNTTVKNPFERFDTIDLVDGGEDDENIPIWPLLHPQRFVDVIFAVDATYDDSNGWPDGSSIVTTYERIITYNANKSVDVRGFPYIPDEDTIISLGLNTHPTFFGCDGRNTTAGNHTVDNNTPPLLVYFPNYPWVYYSNISTFTMSMNDTLSSGILENAALSATQNNSDSFAVCLACAMIQRSLERKNMSTPSQCSSCFEQYCWNGTTVNNPSAVSNYAPTVLSASTTSGTSSVRAKPIVFYLFASLLTVSLLL

SEQ ID NO: 2110 - protein, 613 aa, Schizosaccharomyces pombe
MLFRGLSLWMLFLASCLSALALPAAEDDGSVKVFKRAKKHSTKQEGPSYAPYYVDCPSDNIVESLSSNEIPSAESEYLSTRSTITNTAMKDFLRNANLPGLNADTLSGSEGPSIGIALSGGGLRAMILGSGALSAMDARHDNHTVLTGLLQASDYLVGTDGSAWTVGGIALNNFSTINDFSKLWAFNHPLMYPKSAIVFNAHFYSSIMNEVAEKANAGFNISLSDYWGRVISRTLGDTTYGFPNVSLSSITSQEWYRNANFPYPIITFATQNYGEDISNVNTTFFEASPNVFGTFDHGINSFIPTEYLGTTLNNGASSNGSCVINYDNFGFMMGASSTYFNKIMRNFNDSSTKNGRIIQQYLKGNFSENGQQIISIPNPFQGVESANSDAANNLGSSSSLNLVDTFLTGEKIPLWPLLQKGRDVDVIVAVDNGDDSEWLWPNGNSLVQTYERVVAAQAAGNTNVKGFPYVPSQQSFVSLHFNDRPVFFGCDGRNTTAGNHTVTRDTPPLVIYLPNVPYNYFTNISTDRTYYTEDMIQQLLTNGLISSTVDNDTYFGQCFACAVVKRTLERNNITASPECQQCYYNYCWSGLYDDSAANDDIVYNPTCRLGEGI

SEQ ID NO: 2111 - protein, 384 aa, Schizosaccharomyces pombe
MLLFKFNFTTAFLFTILAFAQARSHSSSSSSTSKSSASHHSSINSTSATSVYDFSSLTTPIVPTNGVAQEPTLYESSRGLSCPGYQARNISEYSYGVLAILELAGDACYAYGTDYPYLLLNVSYDTEERVHISISDLNQTQFQLSNRRDVWDAPLFYRSSNFSGNLQYNFSFNTDPFEFWITRIADDQVLFDTRGNPLIFEDQYIELTTNMVEDYNVYGLSGSQQSFRLGNNLTKTFWATGYSDSPEANMYGSHPFYMEQRYIPIGTTNTYTSASHGVLMLSSNGMEVLLRSTYIKYRMIGGIIDLFVYSGSTVSPKYTIQQYVQSIGTPTMQPYWSLGFQMSRWGYKTLSDLINMRSYLNASNIPTEGFWNDIDYMSEFRTFT

SEQ ID NO: 2112 - protein, 785 aa, Schizosaccharomyces pombe
  unsure (1)..(785): unsure at all Xaa locations
MLWNTQYFRIEGMISLGWPRLAKTSILKFVPIAQNHRIRKMKVQDDFILTIDDSEDDIHYDDYDADAVDEEMPSNVELKKKSKKATPAKDSDFNGEFLFEADVNKDLSSATDMNWDFDMGSKTESNRASNTVDLDAIISRNRKPDDDEFPSSFPSEEELQEPEQENIDSDDEDLAIDGFGAGAIAENEDESSQDESESEEEDDITEPVPSFANISTQDFNSDSAAGSSDSEEDEEEIAKKNAFFAEGDKEKSMMTTTHSSFQSMNLSRPILKGLSNLGFEVPTQIQDKTIPLALLGKDIVGAAVTGSGKTAAFIVPILERLLYRPKKVPTTRVLILCPTRELAMQCHSVATKIASFTDIMVCLCIGGLSLKLQEQELRKRPDIVIATPGRFIDHMRNSQGFTVENIEIMVMDEADRMLEDGFADELNEIIQACPKSRQTMLFSATMTDKVDDLIRLSLNRPVRVFVDNKKTTAKLLTQEFVRVRPQRELLRPAMLIYLCKELFHRRTIIFFRSKAFAHKMRVIFGLLSLNATEIHGSLSQEQRVRALEDFRDGKCNYLLATDVASRGIDIKGIEVVINYEAPATHEVYLHRVGRTARAGRSGRAITLAGEGDRKVLKGVFKNSSAQNTKLVNRNLDFNKVEKFGKEIEELEPVVQKVLDEEKQEREVCCFYKYINFFSNKCSLKIAERDLKKGENIMKYGDEIRSRPARTWFQSEKDKQASKGMXHXNKKICLLTLXPSEAKDKKSLAKRKKQMEKEEVPRAYKKTKNDRLSNKKSTKKSKSKRK

SEQ ID NO: 2113 - protein, 355 aa, Schizosaccharomyces pombe
MSKDYGTPPENWREVYDEICKMKAKVVAPVDVQGCHTLGERNDPKKFRFQTLVALMLSSQTKDIVLGPTMRNLKEKLAGGLCLEDIQNIDEVSLNKLIEKVGFHNRKTIYLKQMARILSEKFQGDIPDTVEDLMTLPGVGPKMGYLCMSIAWNKTVGIGVDVHVHRICNLLHWCNTKTEEQTRAALQSWLPKELWFELNHTLVGFGQTICLPRGRRCDMCTLSSKGLCPSAFKEKSGITITKRKVKTIKRVKKRPASESPPLSPLSLPTDDLYYQSIEDKSLIKLEDLDPVDSISHMNEPLKKEPAADIDVDQKPPVAFHSTTKETRSLRRSKRVAKKSSQYFSQQSLQDIEDLV

SEQ ID NO: 2114 - protein, 297 aa, Schizosaccharomyces pombe
  unsure (1)..(297): unsure at all Xaa locations
MSSLCKTRLQEERKQWRRDHPFVCKFXXTXRNHXQLLLLRGFYAKPCKSSDGGLDLMNWKVGIPGKPKTSWEGGLYKLTMAFPEGMYSKXISDIFLQSLXFALLSLEFCLDIHYFFVQTEFXLYPHDKTCRYAFPFSXSKVHGFSFYYLQNIYXLQSQNYPTRPPKCKHITTIFCXCFCTGRFTPPLFHPNVYPSGTVCLSILNEEEGWKPAITIKQVRIQINFLISRFXPFLDFLGIQDLLDDPNIASPAQTEAYTMFKXVSXLLFPQPSNIINLVXKGXSEYEKRVRAQARENAP

SEQ ID NO: 2115 - protein, 642 aa, Schizosaccharomyces pombe
DLINMRSYLNASNIPTEGFWNDIDYMSEFRTFTVNSTAFPPNQTLDFFRSLDESHQHYVPVLDPAIYAANPNKSADRTYYPYYSGFEDNIFIKNPNGSAYVGMAWPGFVVYPDFTNPAVLQYWKQGILNLSTAFGSNYSYDLPFSGLCLDMNEPTSFCIGSCGSDLLKLNPVHPPFSLPGDVDNKVYSYPEDFNATNTTEYKSVSRASQSQYKATATSEKSHETPSSESLINGKPEFSINYPPYALDTDTETHDLAQFGVSPNATMHGNTLRYNLFNTYGYSESKISFEALNSIQPNIRPFLLSRSTFVGSGRYAAHWLGDNKSQWSDMVSSISSILTFNLLGIPMVGADVCGYNGNTDEELCARWMALGAFLPFYRNHNSLGSIPQEPFRWASVAEASRSAIEIRYSLLPYWYTLMHTASVDGTPMVRPLFFEFPKQISLASVDKQFMIGTALLISPALEPNTTYIQGIIPGDNDTIWYDWYNHSVINHDYDENITMSAPLGYVNIAVRGGNIIPLQQPGYTTYESRNNPYSLLIAMDNNGFASGSLYIDDGISMQTNSSLSVKLNSNSNTITCVVSGTMVSSPSLANITILGLSNPPNTILFNGQQLSDYQYSDQTLSLTNLLDLTVDGAFSKNWTVTWS

SEQ ID NO: 2116 - protein, 1079 aa, Schizosaccharomyces pombe
MGKKGKKSGYADWEDDLGEDISGQNEYLDNTSQDSPQNDELAEKSENLAVSSEKTTSKKKKGKKNKGNKNQVSDDESQELESPQGPKELTAVTELDDDEFDYKPKKGKKGKKSKKVEEDDEPQEIESPQGPKELTAVTELDDDEFDYKPKKGKKGKKAQNNNESEAAAPPEIPEVRVKTKKEKEREKKEREKLRKKQQQAKKKGSTGEDTLASSEVSSEVDISTPAENDSSAKGKQAAGSKRKGPNVTALQKMLEEKRAREEEEQRIREEEARIAEEEKRLAEVEEARKEEARLKKKEKERKKKEEMKAQGKYLSKKQKEQQALAQRRLQQMLESGVRVAGLSNGEKKQKPVYTNKKKSNRSGTSSISSSGILESSPATSISVDEPQKDSKDDSEKVEKETEVERKEENEAEAEAVFDDWEAALEEPEVAENNEVVTEKKETDIKSDAVEHSIKDKEDSKTDKVDDIPQAAPAESNVSESDLRSPICCILGHVDTGKTKLLDNLRRSNVQEGEAGGITQQIGATYFPIESIKQKTKVVNKKGKLQYNIPGLLIIDTPGHESFTNLRSRGTSLCNIAILVIDIMHGLEPQTIESIRLLRDQKTPFVVALNKVDRLYGWHSIKDNAIQDSLSKQKKAIQREFRDRVESIILQLNEQGLNAALYFENKNLGRYVSLVPTSAQSGEGVPDLVALLISLTQTRMSDRIKYITTLECTVLEVKVIEGLGATIDVILSNGVLHEGDRIVLCGMGGPIITTVRALLTPQPLKEMRVKSAYVHHKEIKAAMGVKICANDLEKAVAGSRLLVVGPDDDEEDLAEEIMEDLENLLGRIDTSGIGVSVQASTLGSLEALLEFLKQMKIPVASVNIGPVYKKDVMRCATMLEKAKEYALMLCFDVKVDRDAEDLAEQLGVKIFSANVIYHLFDAFTAHQKKILEQKREESSDVAVFPCVLKTVAAFNKRDPIILGVDVVEGVLRINTPIVAVKQLPNGEPQIIELGRVASLEMNHKPVDKVKKGQAGAGVAMKLESSGSQILFGRQVTESDALYSHITRQSIDSLKDPAFRDEVSRDEWQLIIQLKKLFGII

SEQ ID NO: 2117 - protein, 603 aa, Schizosaccharomyces pombe
MKISDKLLHPDWKEKVTYSYEFFPPKTSTGVQNLYNRIDRMKTWGRPMFVDVTWGAGGTSSELTPGIVNVIQTDFEVDTCMHLTCTNMSTEMIDAALKRAHETGCRNILALRGDPVKDTDWTEGESGFRYASDLVRYIRTHYNDEFCIGVAGYPEGYSPDDDIDESIKHLKLKVDEGADFIVTQMFYDVDNFIAWVDKVRAAGINIPIFPGIMPIQAWDSFIRRAKWSGVKIPQHFMDTLVPVKDDDEGVRERGVELIVEMCRKLIASGITRLHFYTMNLEKAVKMIIERLGLLDENLAPIVDTNNVELTNASSQDRRINEGVRPIFWRTRNESYVSRTDQWDELPHGRWGDSRSPAFGEFDAIRYGLRMSPKEITTSWGSPKSYSEIGDLFARYCEKKISSLPWSDLPISDEADLIRDQLLSMNRNAFLTINSQPALNGEKSSHPVFGWGPPNGYVFQKPYVEFFVHPSLLNELKETVKKLNSVSYFVTNKNGDLDTNSQYEIPNAVTWGVFPNREIIQPTIVESTSFLAWKDEAYSLGMEWANAYSPDSISRKLLVSMMKEWFLCVIVDNDFQNGQSLFDVFNKMRSLKDIHPELYYANAS

SEQ ID NO: 2118 - protein, 109 aa, Schizosaccharomyces pombe
MQFCPTCGNHLIVAVDEEGRNAFDCRTCPYHFPISTFLYSRHEFAQKEVDDVLGGEEAFESNQQTEVTCENTKCDNNRAYFFQLQIRSADEPMSTFYRCTKCKFQWREN

SEQ ID NO: 2119 - protein, 403 aa, Schizosaccharomyces pombe
MQLNRKQLKNLHNYKYSAIDNSLLSKYILKPYWWNQLLKVIPMSMAYDLHPFACLFLLTLYLDPNLITLIGLGFVVINILTMLVYKYHYEMDAFPSWVYASWAIGLFLYQSFDAIDGSQARRTGTSSPLGQLFDHGVDAINTSFEVLLTIELLQLDMFSSILTQFASLLYFYISTWEEYHTGTLYLSYFSGPVEGIVMVIGLFALTAIKGDSFWLKLHPTPESWGFVRSFLPYYTYGSCLYNFMAFALLLNVLQSLRNALQAVQKNNGSVIKALSGILPYFLQWMAVFSLYAKYPAFFEHHFLTIFCLNAFIFAYSVGVVIVSHITESPFPYWNVLILPFLVDAVDAYTFGVLKNVQTEYFFCYVGICIGVYGNFVAHVIAMITEEYGIKCLTIPSKPESKKN

SEQ ID NO: 2120 - protein, 580 aa, Schizosaccharomyces pombe
MDKHFINDPEVLVLDGLKSLADMNKTLTVHEEGKFIYFHDYNKKNVSVISGGGAGHEPTHSSFVGKGMLTAAVSGSIFASPSSKQIYTGIKQVESEAGTLVICKNYTGDILHFGMALEKQRTAGKKAELIAVADDVSVGRKKSGKVGRRGLSGTVLVHKIAGAAAARGLPLEAVTTIAKAAIDNLVSIGASLAHVHVPGHEPIAKEDEMKHDEMELGMGIHNEPGCKRISPIPSIDDLIAQMLKQMLDQSDKDRAYVKIEGDDEVVLLMNNLGGLSMLEFSAISHKVKEALAKEYKINPVRIFAGPFTTSLNGLGFGITLLRTTDRVKVEGEEYSLVDLIDQPVEAIGWPLCQPSDLKSKNKIGNVSIEEGQKDVKSPVTVDKEKVRQAIVNSMENLIKAEPKITKFDTMAGDGDCGTTLKRGAEGVLKFVKSDKFSDDPIRIVRDIADVIEDNMDGTSGALYAIFFHGFAKGMKDTLEKSKDISSKTWAAGLKVALDTLFKYTPARPGDSTMCDALVPFVETFVKTNDLNAAVEEARKGADATADMQAKLGRAVYVGDDVKVPDAGALGVVAIVEGFTK

SEQ ID NO: 2121 - protein, 663 aa, Schizosaccharomyces pombe
MKKFQLFSILSYFVALFLLPMAFASGDDNSTESYGTVIGIDLGTTYSCVAVMKNGRVEIIANDQGNRITPSYVAFTEDERLVGEAAKNQAPSNPENTIFDIKRLIGRKFDEKTMAKDIKSFPFHIVNDKNRPLVEVNVGGKKKKFTPEEISAMILSKMKQTAEAYLGKPVTHAVVTVPAYFNDAQRQATKDAGTIAGLNVIRIVNEPTAAAIAYGLDKTDTEKHIVVYDLGGGTFDVSLLSIDNGVFEVLATSGDTHLGGEDFDNRVINYLARTYNRKNNVDVTKDLKAMGKLKREVEKAKRTLSSQKSVRIEIESFFNGQDFSETLSRAKFEEINMDLFKKTLKPVEQVLKDSNLKKSEIDDIVLVGGSTRIPKVQELLESFFGKKASKGINPDEAVAYGAAVQAGVLSGEEGSDNIVLLDVIPLTLGIETTGGVMTKLIGRNTPIPTRKSQIFSTAVDNQNTVLIQVYEGERTLTKDNNLLGKFDLRGIPPAPRGVPQIEVTFEVDANGVLTVSAVDKSGKGKPEKLVIKNDKGRLSEEDIERMVKEAEEFAEEDKILKERIEARNTLENYAYSLKGQFDDDEQLGGKVDPEDKQAVLDAVEDVAEWLEIHGEDASKEEFEDQRQKLDAVVHPITQKLYSEGAGDADEEDDDYFDDEADEL

SEQ ID NO: 2122 - protein, 484 aa, Schizosaccharomyces pombe
YDGKAVLAYWLNRSPSISKEEYKTVSATPAVQLAQIQFPLPTLVIPAESTTYREVVEDVFAKVEQEHPWVKETKLVAKPDQLIKRRGKSGLLKLNATWDEAKEWIRERAGKNQKVQHAVGYLTTFLVEPFVPHPPNTEYYININSVREGDWILFCNEGGVDVGDVDAKARKLLVPVRLSEFPSRATIASTLLSDIPVEQHESLVDFIIRLYSVYVDCQFTYLEINPLVVIPTAKGADVFYLDLAAKLDQTAEFECGAKWAVARAPESLGIKTSGEESGAINADHGPPMVFPAPFGRELSKEEAYVQGLDAKTGASLKLTILNAEGRVWNLVAGGGASVVYADAVAVNGAADELANYGEYSGAPTDGQTYEYAKTVLDLMTRGEPRADGKVLFIGGGIANFTSPAVTFRAIARALGDYKDKLHAHKVSIWVRRAGPNYQEGLRVIREAGKKFDLPLKVYGPECHISGIVPMGLGKAPVEAEWQMA

SEQ ID NO: 2123 - protein, 261 aa, Schizosaccharomyces pombe
MVAPAHNYESRNILDLLSLKGKNAVVFGGARGIGHAICSVFAEAGANAFIVYNTTPGEKAAKEIAQANGVKTYTCKCDVTIPKEVEHAFAEIQKVFDTIDIVVPNNGICTGKSAIDMTYEEFANEINVNLLGVFNVAHNAGPIFQKQGHGSLVATASMSGVVVNVPQQQCAYNTSKAGVIQLIKSLAVEWRKFARVNCVSPGYTTSDMTGGKFHKEWEPYTPFERNGLAKEIASAYLYLASDAASYASGTNLIVDGGYTSI

SEQ ID NO: 2124 - protein, 356 aa, Schizosaccharomyces pombe
  unsure (1)..(356): unsure at all Xaa locations
MAAKHVKYMACLFDMDVCLFFTPHYLLXKLLHXQSLFLQGLLVDSETIYTKTTSMXIIYLCLYLAQNYNVFXSLFFLXDLILDRYGKDPLPISVKAQMMGYVIXSXRRDILKCFQNCRSNLRYVGRPGSAAAKVVIDWSNIPMTPQQFVDEQQVIRVRTYTLHLFPFQLTFXKAKFWSSLKPMPGAESLINNLSNHGIDIGVCTHPYAIIKVCXQHHQLATSSNTANYNMKTAHLKHIFEKFGKNVITGDNPSIAPGRGKPFPDIWLKVLNLINESRKQRGLKALTPSQCIAFEDSIPGVKSAKAAGMHVIWVPDAAIKNLVGDQLNEIVDSQCETLPSLSEFDINKYLNINSKQA

SEQ ID NO: 2125 - protein, 278 aa, Schizosaccharomyces pombe
  unsure (1)..(278): unsure at all Xaa locations
MSENYSFSLRKFKLVFLGEQSVGKTSLITRFMYDQFDNTYQVSNYNXNFFTNRVQATIGIDFLSKTMYLEDRTVRLQLWDTAGQERFRSLIPSYIRDSSVAIIVYDITSKXXWHSNFAIYFYSDFIFEYLLTTYRHNSFVNTEKWIEDVRAERGDDVIIVLVGNKTDLADKRYDTPANRDSAFTMRHLFIHNSKAIFWFLMVLMLTVVXASTQEEGEKKAKELKIMHMETSAKAGHNVKLLFRKIAQMLPGMENVETQSTQMIDVSIQPNENESSCNC

SEQ ID NO: 2126 - protein, 718 aa, Schizosaccharomyces pombe
KCKIMAMDDFPIEELGNEKNVVVLVSTAGQGEFPQNGREFWEAIKGADLNLSELKYGVFGFGDYEYWPRKEDKIYYNRPGKQLDARFVELGAAPLVTLGLGNDQDPDGWETAYNLWEPELWKALGLDNVEIDIDEPKPITNEDIKQASNFLRGTIFEGLADESTGALAESDCQLTKFHGIYMQDDRDIRDERKKQGLEPAYGFMIRARMPAGVCTPEQWIAMDDISTKWGNHTLKITTRQTFQWHGVLKKNLRNTIRNIVKVFLTTLGACGDVARNVTCSSTPNNETIHDQLFAVSKQISNELLPTTSSYHEIWIEDPETVEKRKVAGEAVQDVEPLYGPTYLPRKFKVGVAAPPYNDVDVYTNDVALIAIIENDKVLGFNVGIGGGMGTTHNNKKTYPRLATVVGYVLTDKIMEVVKAILIVQRDNGDRENRKHARLKYTVDTLGVSTFVEKVEEVLGYKFEEARDHPQFIKNHDDFEGWHKTEKNKYWRSIFVENGRIENNGILQFKTGLRELAERLYTEKSEAEFRLTANQHVILFNVAENELGWINEHMAKYKLDNNAFSGLRLSSAACVALPTCGLAMAESERYLPKLITKVEEIVYEAGLQKDSIVMRMTGCPNGCSRPWVAEIACVGKAPNTYNLMLGGGFYGQRLNKLYRSSVQEKEILNLLRPLIKRYALEREDGEHFGDWVIRAGIITAVENGGANGAVHEGVSPEAF

SEQ ID NO: 2127 - protein, 1186 aa, Schizosaccharomyces pombe
  unsure (1)..(1186): unsure at all Xaa locations
MDDLKELEYLSLVSKVASEIRNHTGKXXALILIFLXIINQIXGIDDNTLAEFIINLHDQSKNYDEFKNNVLSCGGEFTDSFLQNISRLIKEIKPKDDIPTDNVNNGSNSVNGASHDLDSKDVDKQHQRKMFPGLSIPNSTNNLRDRPALMDNAMDELEELSTLAKTRRNDRDSRRDERHYLNGIRERRERSISPSFSHHSRTSISGQSHSSRSSRGPLLNAPTLYGIYSGVVSGIKDFGAFVTLDGFRKRTDGLVHISNIQLNGRLDHPSEAVSYGQPVFVKVIRIDESAKRISLSMKEVNQVTGEDLNPDQVSRSTKKGSGANAIPLSAQNSEIGHVNPLETFTSNGRKRLTSPEIWELQQLAASGAISATDIPELNDGFNTNNAAEINPEDDEDVEIELREEEPGFLAGQTKVSLKLSPIKVVKAPDGSLSRAAMQGQILANDRREIRQKEAKLKSEQEMEKQDLSLSWQDTMSNPQDRKFAQDVRDSAARQLTSETPSWRQATRNANISYGKRTTLSMKEQREGLPVFKLRKQFLEAVSKNQILVLLGETGSGKTTQITQYLAEEGYTSDSKMIGCTQPRRVAAMSVAKRVAEEVGCRVGEEVGYTIRFEDKTSRMTQIKYMTDGMLQRECLVDPLLSKYSVIILDEAHERTVATDVLFGLLKGTVLKRPDLKLIVTSATLDAERFSSYFYKCPIFTIPGRSYPVEIMYTKQPEADYLDAALMTVMQIHLSEGPGDILVFLTGQEEIDTSCEILYERSKMLGDSIPELVILPVYSALPSEIQSRIFEPAPPGGRKVVIATNIAETSLTIDGIYYVVDPGFVKQSCFDPKLGMDSLIVTPISQAQARQRSGRAGRTGPGKCYRLYTESAYRNEMLPSPIPEIQRQNLSHTILMLKAMGINDLLNFDFMDPPPAQTMIAALQNLYALSALDDEGLLTPLGRKMADFPMEPQLSKVLITSVELGCSEEMLSIIAMLSVPNIWSRPREKQQEADRQRAQFANPESDHLTLLNVYTTWKMNRCSDNWCYEHYIQARGMRRAEDVRKQLIRLMDRYRHPVVSCGRKRELILRALCSGYFTNVAKRDSHEGCYKTIVENAPVYMHPSGVLFGKAAEWVIYHELIQTSKEYMHTVSTVNPKWLVEVAPTFFKFANANQVSKTKKNLKVLPLYNRFEKPDEWRISKQRKGGR

SEQ ID NO: 2128 - protein, 1190 aa, Schizosaccharomyces pombe
KIVIQGFKSYKDYTVIEPLSPHHNVIVGRNGSGKSNFFAAIRFVLSDAYTHLSREERQALLHEGPGATVMSAYVEVTFANADNRFPTGKSEVVLRRTIGLKKDEYSLDKKTVSKTEVINLLESAGFSRSNPYYIVPQGRVTSLTNAKDSERLELLKEVAGTQIYENRRAESNKIMDETIQKSEKIDELLQYIEERLRELEEEKNDLAVYHKKDNERRCLEYAIYSREHDEINSVLDALEQDRIAALERNDDDSGAFIQREERIERIKAEITELNHSLELLRVEKQQNDEDYTNIMKSKVALELQSSQLSRQIEFSKKDESSKLNILSELESKISEKENELSEILPKYNAIVSEADDLNKRIMLLKNQKQSLLDKQSRTSQFTTKKERDEWIRNQLLQINRNINSTKENSDYLKTEYDEMENELKAKLSRKKEIEISLESQGDRMSQLLANITSINERKENLTDKRKSLWREEAKLKSSIENVKDDLSRSEKALGTTMDRNTSNGIRAVKDIAERLKLEGYYGPLCELFKVDNRFKVAVEATAGNSLFHIVVDNDETATQILDVIYKENAGRVTFMPLNKLRPKAVTYPDASDALPLIQYLEFDPKFDAAIKQVFSKTIVCPSIETASQYARSHQLNGITLSGDRSDKKGALTAGYRDYRNSRLDAIKNVKTYQIKFSDLQESLEKCRSEIESFDQKITACLDDLQKAQLSLKQFERDHIPLKDELVTITGETTDLQESMHHKSRMLELVVLELHTLEQQANDLKSELSSEMDELDPKDVEALKSLSGQIENLSHEFDAIIKERAHIEARKTALEYELNTNLYLRRNPLKAEIGSDNRIDESELNSVKRSLLKYENKLQIIKSSSSGLEEQMQRINSEISDKRNELESLEELQHEVATRIEQDAKINERNAAKRSLLLARKKECNEKIKSLGVLPEEAFIKYVSTSSNAIVKKLHKINEALKDYGSVNKKAYEQFNNFTKQRDSLLARREELRRSQESISELTTVLDQRKDEAIERTFKQVAKSFSEIFVKLVPAGRGELVMNRRSELSQSIEQDISMDIDTPSQKSSIDNYTGISIRVSFNSKDDEQLNINQLSGGQKSLCALTLIFAIQRCDPAPFNILDECDANLDAQYRSAIAAMVKEMSKTSQFICTTFRPEMVKVADNFYGVMFNHKVSTVESISKEEAMAFVEG

SEQ ID NO: 2129 - protein, 409 aa, Schizosaccharomyces pombe
MSDYGFANIEEAKADAIFKLNAQYHQDEDPKKVNMSVGAYRDDTGKPWILPAVKKASKIVEEQASFNHEYLPIAGLPRFTKAAAEVLFRPNPHLLSEDRVASMQSVSGTGANFLAASFIETFYVKHTGAHVYISNPTWPVHRTLWEKLGVTVDTYPYWDAKNRSFDYEGMLSTIKSAPEGSIFLLHACAHNPTGIDPTREQWLSIFESLLSRKHLVVFDIAYQGFASGDLNRDSWALNEFVKYNKDFFVCQSFAKNMGLYGERTGCMHYVAKDASTKNKVLSQLCIVQRNTISNPPAYGARIAAEILNSPQLFAEWEQDLKTMSSRIIEMRKRLRDSLVALKTPGSWDHITQQIGMFSFTGLTPAQVQFCQERYHLYFSANGRISMAGLNNSNVEHVAQAFNHAVRELP

SEQ ID NO: 2130 - protein, 2241 aa, Schizosaccharomyces pombe
NHILGGNSLDKAPAGKVKDYIASHGGHTVITSILIANNGIAAVKEIRSIRKWAYETFNNERAIKFTVMATPDDLKVNADYIRMADQYVEVPGGSNNNNYANVELIVDIAERMNVHAVWAGWGHASENPKLPEMLSASSKKIVFIGPPGSAMRSLGDKISSTIVAQSARVPCMSWSGNELDQVRIDEETNIVTVDDDVYQKACIRSAEEGIAVAEKIGYPVMIKASEGGGGKGIRQVTSTEKFAQAFQQVLDELPGSPVFVMKLAGQARHLEVQILADQYGNNISLFGRDCSVQRRHQKIIEEAPVTIAPAATFHEMERAAVRLGELVGYASAGTIEYLYEPENDRFYFLELNPRLQVEHPTTEMVSGVNLPAAQLQVAMGLPLSRIPHIRELYGLPRDGDSEIDFFFQNPESFKVQKVPTPKGHCVACRITSEDPGEGFKPSSGMIKDLNFRSSSNVWGYFSVGTAGGIHEFADSQFGHIFSFAESRESSRKSMVVALKELSIRGDFRTTVEYLVRLLETKEFSENEFTTGWLDRLIAQKVTSARPDKMLAVVCGALVRAHATADTQYRAFKSYLERGQVPSREFLKNVYDIEFIYDNTRYRFTASRSSPGSYHLFLNGSRCTAGVRSLTDGGLLVLLNGHSYTVYYRDEVTGTRISIDNLSCMLEQENDPTQLRTPSPGKLVRFLVETGEHIKAGEAYAEVEVMKMIMPLVATEDGVVQLIKQPGASLDAGDILGILTLDDPSRVTHALPFDGQLPNWGEPQIAGNKPCQRYHALLCILLDILKGYDNQIILNSTYNEFVEVLRNHELPYSEWSAHYSALVNRISPVLDKLFVSIIEKARSRKAEFPAKQLEVAIQTYCDGQNLATTQQLKVQIAPLLKIISDYKDGLKVHEYNVIKGLLEEYYNVEKLFSGINKREEDVILRLRDENKDDVDKVIALALSHSRIGSKNNLLITILDLMKSEPSTFVSLYFNDILRKLTDLDSRVTSKVSLKARELLITCAMPSLNERFSQMEHILKSSVVESHYGDAKFSHRTPSLDILKELIDSKYTVFDVLPAFFCHTDPWVSLAALEVYVRRAYRAYSVLEINYHTEAGTPYVLTWRFQLHSSGAPGLGANSTNGSNFPASTTPSYENSNRRLQSVSDLSWYVNKTDSEPFRFGTMIAAETFDELENNLALAIDRLPLSRNYFNAGLTLDGNSSSANDNTQELTNVVNVALTSTGDLDDSAIVSKLNQILSDFRDDLLEHNVRRVTIVGGRINKSAYPSYYTYRVSAEQKDGNLVHYNEDERIRHIEPALAFQLELGRLSNFNIEPVFTDNHNIHVYRATAKNMDTDKRFFTRALVRPGRLRDEIPTAEYLISETHRLINDILDALEVIGHEQTDLNHIFINFTPAFGLAPKQVEAALGGFLERFGRRLWRLRVTAAEIRIICTDPSTNTLFPLRVIISNVSGFVVNVEIYAEVKTENNSWIFKSIGQPGSMHLRPISTPYPTKEWLQPRRYKAQLMGTTFVYDFPELFRRAFTDSWKKVPNGRSKVTIPQNMFECKELVADEHGVLQEVNREPGTNSCGMVAWCITVKTPEYPNGRKIIVVANDITFQIGSFGPQEDEYFYKVTQLARQRGIPRIYLAANSGARIGVADEIVPLFNIAWVDPDSPEKGFDYIYLTPEAYERLQKENPNILTTEEVVTETGELRHKITTIIGSSEGLGVECLRGSGLIAGVTSRAYNDIFTCTLVTCRAVGIGAYLVRLGQRAVQIEGQPIILTGAPALNKVLGREVYTSNLQLGGTQVMHRNGISHLTSQDDFDGISKIVNWISYIPDKRNNPVPISPSSDTWDRDVEFYPSQNGYDPRWLIAGKEDEDSFLYGLFDKGSFQETLNGWAKTVVVGRARMGGIPTGVIAVETRTIENTVPADPANPDSTEQVLMEAGQVWYPNSAFKTAQAINDFNHGEQLPLFILANWRGFSGGQRDMFNEVLKYGSYIVDALASYKQPVFVYIPPFSELRGGSWVVVDPTINEDQMEMYADEESRAGVLEPEGMVSIKFRREKLLSLMRRCDHKYASLCNELKRDDLSADDLSTIKVKLMEREQKLMPIYQQISIHFADLHDRVGRMVAKKVVRKPLKWTEARRFFYWRLRRRLNEHYALQKITQLIPSLTIRESREYLQKWYEEWCGKQDWDESDKSVVCWIEEHNDDLSKRTQELKSTYYSERLSKLLRSDRKGMIDSLAQVLTELDENEKKELAGKLASVN

SEQ ID NO: 2131 - protein, 432 aa, Schizosaccharomyces pombe
DREVDVGIPDPTGRLEILRIHTKNMKLADDVDLEQIAAETHGYVGSDLASLCSEAAMQQIREKMDMIDLDEDEIDAEVLDSLGVTMDNFRFALGSSNPSALRETVVEVPNVRWEDIGGLEEVKRELRETVQMPVMYAEKFLRFGVTPSKGVLFFGPPGTGKTLLAKAIANECSANFISVKGPELLSMWFGESESNVRDIFDKARAAAPCVVFLDELDSIAKARGASAGDSGGGDRVVNQLLTEMDGVNSKKNVFVIGATNRPDQIDPALMRPGRLDQLIYVPLPDEEARFSILQTQLRHTPVAEDVDLRAVAKATHGFSGADLEFVVQRAVKLAIKDSIEEDIKRENETGEAPADDVVMDEDASVSQVQRHHVEEAMKMARRSVSDAEVRRYEAYAHQLLTSRGLTGFQFDSADSNTNGPSFGNDGADDLYA

SEQ ID NO: 2132 - protein, 205 aa, Schizosaccharomyces pombe
MSVNNEVSADQHNPELEDDTFEHGPPVSLGEKKSLNEYMKMDAEDESLQKWKASLGITGTGYSPSNDRRTVVILKLSLLVDGRDPVDVNMEDAASVEQIRKKGFTIKEGSEFKIGVKFRVQHEVISGLRYVQTVRRRGFVVDKTSTMIGSYGPSETPYDFTSEPDEAPTGMLARGHYEANGKFVDDDKVVHHEFVWAFDVAKSWK

SEQ ID NO: 2133 - protein, 709 aa, Schizosaccharomyces pombe
  unsure (1)..(709): unsure at all Xaa locations
MKGLRSKFVKALSLKDEQGSHKNGHSKSHYISKNGSYVETDDVKHTDTHHSSKHELKKLKSHFLKDTLKHKRNHHANSNNEKHENSDKKIHTTVLASGHEDSDYSTFLPVIETSKVKDANHFPPNYPEPKNVSIRRLVXYFLPKXLFSYXLTCRDSVSSNIDEFPNDSISSASFLSVPQSTPPYLVSQPTPLNKFLAGAENVDIPHSLRPVPRREHSSQFQVSEKRTLVRLPSFDGTFSKILISYFNNVLFFILVLIXLDVHTSEREELFIKKLEQCNIIFDFNDPSSDLASKEIKREALLQMIDYVSENRGISSASLFPYVVNTVCLLLCFLLLXKSNHYSFSLNVFRPISPALNDYSSDMFALDDEPFLEPAWPHLEEVYLLFIKFLESPDFRASKAKSLVDRRFFNRLLALFDTEDPRERELLKTTLHRIYGKFLNLRSYIRKSMNNVFLQFIYEREKFHGIAELLEILGRYVSLMVIVPKLIYKLTYXYINGFAVPLKEEHKIFLSKVLIPLHQTKSVFLYHPQLTYCIVQFIDKDPSLTKAVLTGILKYWPRINSFKELLFLNEIEDIFEVLEPSEFVNIMSPLFQQLARSISSMHFQVAERALCLWSNEYFTSLVSQNVVTLLPIIYPSLYKTANEHWNSTIQAIACNVLQIFVDMDADFFNGLVEDYKQAIIKQEEVMIIRKQQWCQIEALAAENKPTDYLR

SEQ ID NO: 2134 - protein, 415 aa, Schizosaccharomyces pombe
  unsure (1)..(415): unsure at all Xaa locations
MSAVDKRAKFESALPVFVDEIVNYLKTINIPDDVTEWYKNVCECRVTIFSNVNECFXNIDLLKKKCYTLRCFYCIGIVSYHLYFNXITSIFYFFLGTSNNTXLTAVFVSLFHNTLGGKYNRGLSVIDSYEILLGHPLDEAAYMKAAVLGWMVELLQSFFLIADDIMDASKTRRGQPCWYLMPGVGNIAINDAFMVESAIYFLLKKHFRQESCYVDLIELFHDVTFQTELGQQLDLLTAPEDSVDLSKFSLQKHSFIVIYKTAFYSFYLPVALAMHLAGVATPENLKCAQDILIILGKYFQVQDDYLDCYGDPTVTGKIGTDILDNKCSWIINLALAKCTPEQRVILDDNYGRKDSESEKRVKAVFEELNIRGEFENYEESEVSEIKKLIDGVDESTGLKKSIFTTFLGKIYKRNK

SEQ ID NO: 2135 - protein, 675 aa, Schizosaccharomyces pombe
  unsure (1)..(675): unsure at all Xaa locations
MTVSLNTMMGVDGLEDQEQLREIRNCLLKCISECSERGLVYAVRWYAECKRSFNXKIYNLSMKLLQKTVNFQFMITVILLVCYGXHYPHSKVQRFCCYXFRNLMXFKAILQEMFNXSFLYYLLLCEIILPLLVSFLYXRIFXAAEMLNGMNPIEMEHIPFSSTPTGEFDLDPDMANEKLLEVEEKNIYLLAKSYFDCKEFERAAYTLQNCKSSKSIFLRLYSKYLAGEKKSEEENETLLNTNLTLSSTNREFYYISEVLESLHYQGNKDPYLLYLSGVVYRKRKQDSKAIDFLKSCVLKAPFFWSAWLELSLSIDSLETLTTVVSQLPSTHIMTKIFYVYASHELHQVNSSAYEKLAEAEIIFPNSRYLKTQRALLTYDSRGILFXVFYLLTLQTFDEAESLFENILTNDPYRLDDMDTYSNVLFVLENKSKLGFLAQVASSIDKFRPETCSIIGNYYSLLSEHEKAVTYFKRALQLNRNYLSAWTLMGHEYVELKNTHAAIESYRLAVDVNRKDYRAWYGLGQTYEVLDMHFYALYYFQRATALRPYDQRMWQALGNCYEKIDRPQEAIKSYKRALLGSQTNSSILVRLGNLYEELQDLNSAASMYKQCIKTEETEISPETIKARIWLARWELGKKNYREAELYLSEVLNGDLELEEAKALLRELRSRMEHSYD

SEQ ID NO: 2136 - protein, 708 aa, Schizosaccharomyces pombe
  unsure (1)..(708): unsure at all Xaa locations
MVVKRTQTDSRMQSTPGNHNHPDAHANAAYMTPPSMGALNANNSNSQLSTLTISPMTYLANNTSTDGSFLKERNAQNTDSLSREDYLRLWRHDALMQQQYKCAAFVGEKVLDITGNPNDAFWLAQVYCCTGDYARAKCLLTKEDLYNRSSACRYLAAFCLVKLYDWQGALNLLGETNPFRKDEKNANKLLMQDGGIKLEASMCYLRGQVYTNLSNFDRAKECYKEALMVDAKCYEAFDQLVSNHLLTADEEWDLVLKLNYSTYSKEDAAFLRSLYMLKLNKTSHEDELRRAEDYLSSINGLEKSSDLLLCKADTLFVRSRFIDVLAITTKILEIDPYNLDVYPLHLASLHESGEKNKLYLISNDLVDRHPEKAVTWLAVGIYYLCVNKISEARRYFSKSSTMDPQFGPAWIGFAHSFAIEGEHDQAISAYTTAARLFQGTHLPYLFLGMQHMQLGNILLANEYLQSSYALFQYDPLLLNELGVVAFNKSDMQTAINHFQNALLLVKKTQSNEKPWAATWANLGHAYRKLKVRNIXFSTFFYFSLTSFRMYDAAIDALNQGLLLSTNDANVHTAIALVYLHKKIPGLAITHLHEVSLYIYXNICLMFYLTLIRVLAISPNEIMASDLLKRALEENSLTSGFLNSKYVFEDEVSEYMQQSNLNTSDKSMSMEDQSGKVTESVNDRTQVLYADSRSEMMMDDIEGNVSEQR

SEQ ID NO: 2137 - protein, 1117 aa, Schizosaccharomyces pombe
MFGGELDDAFGVFEGKVPKSLKEESKNSQNSQNSQKIKRTLTDKNASNQEQGTKKLESSVGEQESATKRAKIENLKDNQDLIPNNDVNGIHINNSAVADTKHKPKIGDIAADDISNEVSIKNEGDTIPEATVADSFEQEASLQVAGKVGMTEAKSSTEEVVELRHQVRHQVSIPPNYDYVPISKHKSPIPPARTYPFTLDPFQAVSIACIERQESVLVSAHTSAGKTVVAEYAVAQSLRDKQRVIYTSPIKALSNQKYRELLAEFGDVGLMTGDVTINPDATCLVMTTEILRSMLYRGSEVMREVAWVIFDEIHYMRDKERGVVWEETIILLPDKSHFVFLSATIPNAMQFAEWITKIHRQPCHVVYTDFRPTPLQHYLFPSGSDGIHLVVDEKSNFREENFQRAMSALMEKQGDDPAAMATKGNAKKGKTGKGGVKGPSDIYKIVKMIMVKNYNPVIVFSFSKRECEALALQMSKLDMNDQTERDLVTTIFNNAVNQLSEKDRELPQIEHILPLLRRGIGIHHSGLLPILKEVIEILFQEGLLKVLFATETFSIGLNMPAKTVVFTNVRKFDGKTFRWISGGEYIQMSGRAGRRGLDDRGIVILMIDEKMDPPVAKSMLKGEADRLDSAFHLSYNMILNLLRVEGISPEFMLERCFFQFQNSLEVPKLEAKLEESQQHYDSFTILDERPLEEYHTLKTQLERYRTDVRTVVNHPNFCLSFLQGGRLVRVKVGNEDFDWGVVVNVSKRPLPKGQSNEYLPQESYIVHTLVMVASDTGPLRIRSGHLPEVHPPAAEDKGKFEVVPFLLSSLDGIAHIRVFLPNDLKSQGQKLTVGKALSEVKRRFPEGITLLDPVENMNIKEPTFIKLMKKVNILESRLLSNPLHNFSELEEKYAEYLRKLALLEEVKDLKKKLSKARSIMQLDELNSRKRVLRRLGFTTSDDVIEVKGRVACEISSGDGLLLTELIFNGMFNDLTPEQCAALLSCLVFQEKSEVENQRMKEELAGPLKILQEMARRIAKVSKESKQELNEEEYVNSFKPSLMEVVYAWAHGASFAQICKMTDVYEGSLIRMFRRLEELIRQMVDAAKVIGNTSLQQKMEDTIACIHRDIVFSASLYL

SEQ ID NO: 2138 - protein, 605 aa, Schizosaccharomyces pombe
MTTGYESVPTSEPSDNLAPRAELWQRHLLEKKEGDQSISVSAFNISSMHNELSGLSEKSRQRVEAVWAAFSEASCSERKLALQGILNNCSSSLLSFASSTLDSLVRLDFLSLLPVEISFRILSFLDARSLCQAAQVSKHWKELADDDVIWHRMCEQHINRKCEKCGWGLPLLERNTLYAAKASIQKRYERLTKRGVDQAHESSPVKKAKLDDYPTSSNEETISSVKPPSPNSDSKFFLPFKTRPWKEVYAERCRVECNWRHGRCRQVVLSGHSDGVMCLQLVRNILASGSYDATIRLWNLATFQQVALLEGHSSGVTCLQFDQCKLISGSMDKTIRIWNYRTSECISILHGHTDSVLCLTFDSTLLVSGSADCTVKLWHFSGGKRITLRGHTGPVNSVRIIRDRGLVLSGSDDSTIKIWSLETNTCLHTFSAHIGPVQSLALADSRLFSCSLDGTIKQWDIEKKKCVHTLFGHIEGVWEIAADHLRLISGAHDGVVKVWEACECVHTLKNHSEPVTSVALGDCEVVSGSEDGKIYLWLFNNAPNESPVSTQSVPISSLNGQRSNSSVQRALSSVPNYSSSLSNISTRNLNIPPSNANNDDVSIQS

SEQ ID NO: 2139 - protein, 443 aa, Schizosaccharomyces pombe
MYQRSLFRGVAQGLKRSSVRFQSTSSGSSNGNFFLRHWKLLSVIGSFTAGVAIYDMSDVRSFIHGRIEMPLFHAFTTPEFSHRVAILAASWGITPKDRVADDPSLAVEVWGKKFCNPIGLAAGFDKQADAISGLLNFGFSYLEIGSVTPKPQPGNPKPRYFRLKPDLSVINRYGFNSIGHDAILAKIQKRVRKYIAKTSPQLLKQFDANPASCTDPAVLGVPRSLIPNKFLGINLGKNKNGNEIEDYVEGVRTFGNFADILVINVSSPNTPGLRNLQKKSALSTLLTAVVSERNKLNSPHPPVLVKIAPDLNEEELTDIADVLKKCKIDGVIVGNTTVQRPKTLKSTSHVEETGGLSGPPLKPIALNTLRTLRKHLSSDIPIIGCGGISSGKDAIEYARAGATMVQVYTALGYDGPVIAHKIKQEILAELKGKRWVDIIGKEE

SEQ ID NO: 2140 - protein, 557 aa, Schizosaccharomyces pombe
MDFNNIPLATIKSSDDKGKDFIVEMTTRPSETKKKVPFSEDMREIPSLPNEEEANATDPQANEVADENGEGFEAEKISSWIWVLSAVAGISGLLFGYDTGVISGALAVLGSDLGHVLSSGQKELITSATSFAALISATTSGWLADWVGRKRLLLCADAIFVIGSVIMAASRNVAMMVVGRFIVGYGIGLTSLIVPMYITELAPARLRGRLVIIYVVFITGGQLIAYSLNAAFEHVHQGWRIMFGIGAAPALGQLISLFWTPESPRYLLRHNHVEKVYKILSRIHPEAKPAEIAYKVSLIQEGVKVDFPEGNKFQHFFHSLKVLFTVPSNRRSLFIGCFLQWFQQFSGTNAIQYFSAIIFQSVGFKNSISVSIVVGATNFVFTIVAFMFIDRIGRRRILLCTSAVMIAGLALCAIAYHFLPADTTQNTNSGWQYVVLASIIIFLASYASGIGNIPWQQAELFPMEVRALGAGFSTAINWVGNLIISASFLTMMESITPTGTFALFAGFCFVGLVTSYFTYPELAGMSIENIHKLLEKGFWQAVKESTKRVRKGRIDEA

SEQ ID NO: 2141 - protein, 1029 aa, Schizosaccharomyces pombe
  unsure (1)..(1029): unsure at all Xaa locations
MEVNGVSQSEAAPYVTKSSVKFRDNFWVCVNLLYLVKQSYVNKIVAGSEDAGMDALMSRTKSSLSVLESIDEFYAKRXVWLPRLEVAALPXALRXFKKYVFGRFIVIXDVLQIIVDSXDSLCNEPKGSVXLLIKVXLTKLVLSIEREYASKLQELAASSADIPEVGSTLNNILSMRTETGSMAKAHEEVSQQINTELRNKIREYIDQTEQQKVVAANAIEELYQKKTALEIDLSEKKDAYEYSCNKLNSYMRQTKKMTGRELDKYNLKIRQAALAVKKMDAEYRETNELLLTVTREWIDRWTEVCDAFQHIEEYRLEFLKTNMWAYANIISTACVKDDESCEKIRLTLENTNIDEDITQMIQNEGTGTTIPPLPEFNDYFKENGLNYDIDQLISKAPSYPYSSSRPSASASLASSPTRSAFRPKTSETVSSEVVSSPPTSPLHSPVKPVSNEQVEQVTEVELSIPVPSIQEAESQKPVLTGSSMRRPSVTSPTFEVAARPLTSMDVRSSHNAETEVQAIPAATDISPEVKEGKNSENAITKDNDDIILSSQLQPTATGSRSSRLSFSRHGHGSQTSLGSIKRKSIMERMGRPTSPFMGSSFSNMGSRSTSPTKEGFASNQHATGASVQSDELEDIDPRANVVLNVGPNMLSVGEAPVESTSKEEDKDVPDPIANAMAELSSSMRRRQSTSVDDEAPVSLSKTSSSTRLNGLGYHSRNTSIASDIDGVPKKSTLGAPPAAHTSAQMQRMSNSFASQTKQVFGEQRTENSARESLRHSRSNMSRSPSPMLSRRSSTLRPSFERSASSLSVRQSDVVSPAPSTRARGQSVSGQQRPSSSMSLYGEYNKSQPQLSMQRSVSPNPLGPNRRSSSVLQSQKSTSSNTSNRNNGGYSGSRPSSEMGHRYGSMSGRSMRQVSQRSTSRARSPEPTNRNSVQSKNVDPRATFTAEGEPILGYGKFIKEKLXKFLILLIIIQLSALYDYQAQIPEEISFQKGDTLMVLRTQEDGWWDGEIINVPNSKRGLFPSNFVQTV

SEQ ID NO: 2142 - protein, 2100 aa, Schizosaccharomyces pombe
MKSQEQQTPETREKSSSTSESGHPISLDSKTPPPNDSKIESIVKAQILFLLSTLREDQYDTKLEQIRQLINKNAPRVYHHFLRRLIQGNSYRIFGTGKSSDGLATYKLLLDELKSLTKSWVMAKRFSDAISGSDSEVFEDFDIEAFLDHFQFSPLERTNLLIGLTTSVKPTLAKKASALLKNTFQSLLNQLSDPTQQQSIDKNDLDLLREGLFTTDYDRIPLIKVPKFDAIIEKKLANSRPLTALFGPMKASKATLKSMKEAILKKYPPGTATETDVAYLINSLVAIHDYGAWDTVLMGKAIVSSFENLNWEAMLSMFDNPKFMITGTPSLVLFFTIFTNAYKLRQTNFTLDFLWVLWRNPLPQLSIISHIILSPTSMFDIREFNVNPVVSVDSLKDYSEELVNYAKIYEKSNLNCIELVQILLRLLSEVVTYETSLFLNFLDEKVSAELLLLGTLQLPLAWNPVQESLAFQWCSDFFSNFKEHKFVFVRIERTNPQFLFAFLRSLWLKDSSSVNQVVEFIIENDFTSHIGNIQPNRFALEIAALAAARKALSFQDWLDKKMLEFEDADGLNVFLVEVLDFLMSRAALQKNESEQKEESVVLSIDTVNVLLTTLMDNVSISEEVSEHIKDVQILCLQVYPRLFSLGHDRDSIVIATNTTNSFSPDVESEVESYFQALYERRISIGKIVLTLQNFKKSENPRDLDLFACLQHSLFDEYRFFPDYPLEALALTAVLFGSLIQFELLSFVPLGVALRYVYQALLMPTDSKMFRFGMQALVQFQEKLPKYINYCNLILGIPSLQLVRPDIYDSIREMIASNENTEVEKDKLDSFSALANPASPKAPEYTFVSIHVPPLNVPNAEGEIEESVCDNILFAINNLSQLNFNEKLKDVKDNLTPAYLPWFSHYIVTQRVSREANFLSLYGKFLEELKSSDLYKIVFRDTLQAILDIMNNNAETLSPSEKTNLKNLGSWLGSITLLRNKPITTLQVSFKDLLLEGIDSGRIDRVLPFVCKVLEKASSSVIFKPPNPWLMGILKLLVELYQFADFRLNLKFEIELLLNNLNVKMDNIEPSEMYRNHLVQKADLEKELPEDVLNAEFPDGTDVITQYIVAASSQITVTDAVAQVFGKPKPAIKNITQLIIQQSVLEIISAVVRRSVGIAAITTKSLLQKDFAAESNPSRLLLAARQMAKTLAGNLAMVTCREPLQMLMINNFRTIALQDVENVHAAVAQAIDELVSQNLFVASSVIESVASETAIAEIDAEIEHMIVERVRHRKTTPNLPFVDPAGAANLHLNLPSVLKLSSELTPQQFQLYENFDRLSLSTIMSNNSFTSLNGLRTDSADSTDALNSNLNNTVENEANQTALNYARNLLIIIGQLFQLAAQMPYTSMQEVPADHELHELVNQFLTGVASINHPIADHVFLLCAQECCRILLTDSKSPFILEVFSAILEYICQASTKTAINVSLYWNFSNDLEKLNLPIILSLIRFGILTSGEVDYHVARGVRSEQGSGPVTDFAIELLRTAVGGENPMALPGNFVNSITSLYEISESFSGETKQAYEQLVETMNKSVSPASEILSDLDNKQQLNDQIIIVFVSWVHLLRNSATNDETKAAFVYQLHKQGILSEPELCIQFFRCNLEAVLVAFLEAASVNAPDYFNVDAYASLLVNVVKYTEGSTEGTVSSKSVLFRKIIALIIGVFAELHNSMAEFVHQKTFFRLFSSILSELDDAKDVLESCFVDIYSVILECFLAIQPRSFPAFTFAWLSLISHSYLLPKVLLVNNDKINDLFSEILMSFLKFLDLKDDIDKAQFKLLYNGFLRIILVLLHDFPGFLATHCYQLIPYIPLECVQLRNMVLSAFPSDLHLPDPFAQGLKVGRLPEVTRAPLISNSVSASLEKFASALDLEACFSSSKPAEVAKLLLEVYSSQDTPTKLNEWANYFMLCLIRHATRDSPAKQAPQFQSKSPECVIISTMNRSCDSKCRYFLLTAIANQLRYPSSHTYYASCCFLYLFKSSSNNPQELLIKEQMTTVLLERIICNRPHPWGLLITFTELLKNEDYNFWKHPYIKRNDEICRLFDSLHEHVMAPSSANNVSTEEATELMGQV

SEQ ID NO: 2143 - protein, 219 aa, Schizosaccharomyces pombe
MKLTKFLTVFIPFIAGLIYYIQKYHLRSFYQFDPAKLQELSKQSIALYANDTKALLYDLSDRLVAEYGDLITPVNQDEWVHNNAGGAMGTMFILHASFSEYLIFFGTPIGTEGHSGVHMADDYFTILRGRQLAASANDLEARVYLPGDQHVHPWGHTAQYSMPSGEPCFALELAQGWIVSMLPFGFMDGLFSTIDFGTLYKTVYFTAGRMLKSVLMGKF

SEQ ID NO: 2144 - protein, 1000 aa, Schizosaccharomyces pombe
  unsure (1)..(1000): unsure at all Xaa locations
MKRKDNKELICIPSSSPPSTPIREENYYLLTSSPIECSPIQQLDLSGSFKNYSTTSSRANGKKFGQLAMQSRIFFDTTDHKKYVESSYAAYDPHDQPPERDVSLKESSNKINPSNFFDSEQITKINAVKKRFPALDSEMIIATLEKFNWRENITIHKLTFQKLLGRGNSTINKSAQKLNNQPIEKSSVDKENAKRKRYVEEGTKQGQKKKPLRVIELSDEETNEDDLLGQSPTACTTDANIDNSIPENSDKIEEVSIESSGPSEVEDEMSEYDVRVLNFLNESTLQEIVEVSGCESKVVEYFISKRPFPSLEKAEALCQRNAHAATGKRKKSDGRNVGRKLVNSTYEVLQGFDAVDSLIAKCERYGAMISNTMRSWHNLFDDKKMEQFLNTSTGSISYEYNSQQPSSIASGITLKSYQIVGLNWLCLMYKAKLSGILADEMGLGKTCQVISFLASLKEKGIQNRHLVVVPSSTLGNWLREFEKFCPSLRVESYSGTQSERINKRYYLMDTDFDVLVTTYQLASGSRDDRSFLRKQRFDVSLCFLSVNXSFRISIFDEGHYLKNRMSERYKHLMNIPANFRLLITGTPLQNNLKELIVCLNNLFLLIFASPLLAFMLPKVFDNNMQGLDIIYKIKTTSDGDIERAYLSQERISRAKTIMNPFILRRRKENVLSDLPPKIQHVEYCHMEETQLSLYLSVLELKNLVNANRENILMQLRKAALHQLLFRSQYNLETLSLMSKRILRVRLVLFLCLALTITGGAYLDANPQYIFEDMEVMSDFELHKLADQYRHLHPFALKGKPWMDSAKVKKLCSLLKKSRPNERILIFSQFTQVLDILEYVLNTLDLEFLRLDGSTPVETRQQLIDDFHTNENYKVFLLSTKSGGFGINLTCANIVILFDCSFNPFDDMQAEDRAHRVGQTRPVHVYRLITKNTIEVXKQSFIXLFLLTWYRKIFRRLANTKLTLESSLTTDSEKIQKEISGELMKSLQMDGRVDTMDGSVV

SEQ ID NO: 2145 - protein, 1117 aa, Schizosaccharomyces pombe
  unsure (1)..(1117): unsure at all Xaa locations
DALKKLRIDEPNSTVNQHHQLNLQYEALMNDLGGINIFLSKPPGDELRPLIVSIDFSVHQPIFGITFVGIDPVDHRYPHVFTNNSIIPYSTCSWLPCVDGIWERSTWEFEITLPKTLSSLMHREKTQPSDLNNGANGVDGHDDNYENNRFDHQFNLSNEPDLLEDHDIEVICCGDLLDQVTHPKDMRKKTVYFSVTTPVAPNYIAFAAGPFKHINLTDFREPEDDDAMGSSAIDITGYYLPKYAEEVENTCVFLYKAMDFFVREYGSYPFNSFKLCFVDETNFPIISTPSLVISSNSILYPKDSLDQIYDSTKTLTWALASQWIGVYLIPKAWSDLWLIYGLSYYICGLFLKKLMGNNDYRFRLKKQVYRLLELDIGKPPISQRNINIPIDPNTLDFIALKSPLVIHILERRLTKTGGSLGMSRVIPKLLLQVMSGDMLNGCLSTSHFLKTCEKASHMRLDVFAQQWIYGYGYPIFRVVQRFNRKKMIIEMGIDQVQTKEAPRAPMSDKNFLSDAIRHLNNESIPTGLPVFSGPMTIRIHEADGTPYEHVVELKDSFTKLDIQYNTKYKRISRNRSTKNVKRDGDHNGDDSDYVIRSLGDVLQSDEDIERWHLYDYTKEEEDTMATEAFEWIRVDADFEWICDLRVRQPEHMYVSQLQQDRDVVAQLETIRHFTSESFTVSQQVSTVLLRTLLDNRYYYGIRQEAARALARCAIPELDWVGYYHLRMAYLEKFCFKDSTIPKSNDFSNITEYYVKCAMLESFPNIRDRKGVTPSSVKKLLLDLLCYNDNANNEVXFSFTNFDXLILFSDAYFICLLIDSLVEGLIPRGETVQYAFSDPEHMEFVNQVINEIDRYMRIDACMPSFKNIITCKSLKAKLRLAQTFHLEFGPKELLPYTQEGNYVLVRCIAFNLMLQAGALKYTPLIKYIFYILTNDLSPVVRRSLLYSVQDGLGALARGGTKSDVASEDLIVEEDITKAVEKRIDITSRASISGAIEALRNDLGQNHDFATEIWNAINNPKSDLLTKRNLLMICRVLYKAKSSLLVTLKIPSLIPRLRAIHLGKGKIVIKKAPLKQITSKTKEKSTSPTPPSITINPIKPKGPTLKIKLTNLRSTPPSH

SEQ ID NO: 2146 - protein, 149 aa, Schizosaccharomyces pombe
TTRNLTDEQIAEFREAFSLFDRDQDGNITSNELGVVMRSLGQSPTAAELQDMINEVDADGNGTIDFTEFLTMMARKMKDTDNEEEVREAFKVFDKDGNGYITVEELTHVLTSLGERLSQEEVADMIREADTDGDGVINYEEFSRVISSK

SEQ ID NO: 2147 - protein, 440 aa, Schizosaccharomyces pombe
SIKENGAMVVFGASGDLSKKKTFPALFSLFSEGRLPKDIRIVGYARSKIEHEDFLDRITQNIKIDEEDSQAKEKLEEFKKRCSYYRGSYDKPEDFEGLNSHLCEREGDRSTHNRIFYLALPPDVFVSVATNLKKKCVPEKGIARLVIEKPFGVDLKSAQELQSQLAPLFDEKEIYRIDHYLGKEMVQNLVHLRFCNPVISHLWDKNSISSVQITFKEPIGTEGRGGYFDSSTIVRDIVQNHLVQILTLLTMETPTTFSADDLRDEKVKVLRRTRLGDLKDIVLGQYVKSKDGKKPGYLDDETVPKGSRCPTYSAIPCFIDTERWRGVPFLLKAGKAMDIGKVEIRVQFKAAANGLFKDAYHNELVIRVQPDEAIYFKMNIKQPGLSEAPLLTDLDLTYSRRFKNMKLHEAYEALFLDAFAGDQSRFARIDELECAWSLVD

SEQ ID NO: 2148 - protein, 494 aa, Schizosaccharomyces pombe
SIKENGAMVVFGASGDLSKKKTFPALFSLFSEGRLPKDIRIVGYARSKIEHEDFLDRITQNIKIDEEDSQAKEKLEEFKKRCSYYRGSYDKPEDFEGLNSHLCEREGDRSTHNRIFYLALPPDVFVSVATNLKKKCVPEKGIARLVIEKPFGVDLKSAQELQSQLAPLFDEKEIYRIDHYLGKEMVQNLVHLRFCNPVISHLWDKNSISSVQITFKEPIGTEGRGGYFDSSTIVRDIVQNHLVQILTLLTMETPTTFSADDLRDEKVKVLRRTRLGDLKDIVLGQYVKSKDGKKPGYLDDETVPKGSRCPTYSAIPCFIDTERWRGVPFLLKAGKAMDIGKVEIRVQFKAAANGLFKDAYHNELVIRVQPDEAIYFKMNIKQPGLSEAPLLTDLDLTYSRRFKNMKLHEAYEALFLDAFAGDQSRFARIDELECAWSLVDPLLKYMEEEKPVPEPYEYGSDGPECLYSFLKKFGYIYDSPDYYDYPVMSVPSDH

SEQ ID NO: 2149 - protein, 1333 aa, Schizosaccharomyces pombe
MSYANYRYMKARAKRWRPENLDGIQTSDEHLINLFAKILSKHVPEIGKFDPNKDVESYISKLDQHFTEYPSLFPNEHTKRQYTLNHLEELEQQFAERMFSENGSLTWQELLRQTGKVQGSNKGDRLTKTFEGFRNQLDKVQFIRKLMSKANVDDFHTRLFILWMLPYSLRKLKERNYWKSEISEIYDFLEDKRTASYGKTHKRFQLQNKNLGKESLSKKNNTTNSRNLRKTNVSRIEYSSNKFLNHTRKRYEMVLQAELPDFKCSIPCLIDTGAQANIITEETVRAHKLPTRPWSKSVIYGGVYPNKINRKTIKLNISLNGISIKTEFLVVKKFSHPAAISFTTLYDNNIEISSSKHTLSQMNKVSNIVKEPELPDIYKEFKDITAETNTEKLPKPIKGLEFEVELTQENYRLPIRNYPLPPGKMQAMNDEINQGLKSGIIRESKAINACPVMFVPKKEGTLRMVVDYKPLNKYVKPNIYPLPLIEQLLAKIQGSTIFTKLDLKSAYHLIRVRKGDEHKLAFRCPRGVFEYLVMPYGISTAPAHFQYFINTILGEAKESHVVCYMDDILIHSKSESEHVKHVKDVLQKLKNANLIINQAKCEFHQSQVKFIGYHISEKGFTPCQENIDKVLQWKQPKNRKELRQFLGSVNYLRKFIPKTSQLTHPLNNLLKKDVRWKWTPTQTQAIENIKQCLVSPPVLRHFDFSKKILLETDASDVAVGAVLSQKHDDDKYYPVGYYSAKMSKAQLNYSVSDKEMLAIIKSLKHWRHYLESTIEPFKILTDHRNLIGRITNESEPENKRLARWQLFLQDFNFEINYRPGSANHIADALSRIVDETEPIPKDSEDNSINFVNQISITDDFKNQVVTEYTNDTKLLNLLNNEDKRVEENIQLKDGLLINSKDQILLPNDTQLTRTIIKKYHEEGKLIHPGIELLTNIILRRFTWKGIRKQIQEYVQNCHTCQINKSRNHKPYGPLQPIPPSERPWESLSMDFITALPESSGYNALFVVVDRFSKMAILVPCTKSITAEQTARMFDQRVIAYFGNPKEIIADNDHIFTSQTWKDFAHKYNFVMKFSLPYRPQTDGQTERTNQTVEKLLRCVCSTHPNTWVDHISLVQQSYNNAIHSATQMTPFEIVHRYSPALSPLELPSFSDKTDENSQETIQVFQTVKEHLNTNNIKMKKYFDMKIQEIEEFQPGDLVMVKRTKTGFLHKSNKLAPSFAGPFYVLQKSGPNNYELDLPDSIKHMFSSTFHVSHLEKYRHNSELNYATIDESDIGTILHILEHKNREQVLYLNVKYISNLNPSTIMSGWTTLATALQADKAIVNDYIKNNNLNI

SEQ ID NO: 2150 - protein, 399 aa, Schizosaccharomyces pombe
  unsure (1)..(399): unsure at all Xaa locations
MATTAQKIKEVEDEMAKTQKNKATAKHLGMLKAKLAKLKRELITPTGGGGGGGRMYXTSNFCLEYXSFLVGFDVARTGIGTVGFIGFPSVGKSTLMTQLTGTRSEAAAYEFTTLTTVPGVLQYNGAKIQILDLPGIIEGAKDGRGRGKQVITVARTCNLIFIVLDVLKPMSHKRIIEEELEGFGIRLNKEPPNIVFKKKERGGINITNTVPLTHIDLDEIRAVCSEYRVNSADIAFRCDATIDDLIDVLEGNRVYIPALYVLNKIDSISIEELDLIDRIPNAVPICGNRGWNIDELKETMWDYLNLVRVYTRPRGLEPDYSEPVILRTGHSTVEDFCKFSNCFCRSSCCXLLXCNNIHSSIKSQFKHAYVWGKSVPYPGMRVGLSHVLLDEDVVTIVKK

SEQ ID NO: 2151 - protein, 282 aa, Schizosaccharomyces pombe
MFYSDYLKLLKIFVVGVFPCTLFVNAPHGKLAKQSKLFSKGYISGRVGWVLMELVAPLTFLYAIRNNRHFESTLPSLGDGSNRDYLDSCRKVLAGMFLVHYANRALVSPLLMAPQVSPMHWTVFVSAVLFNFLNGMSIGLYLVQASVQHHPVSIIRRYIGMFLWLMGWLGNMYHDNILYDLRRSSNKKKDPDNLDTVQSENSYYRIPYGGLFQYVSCPNYFCEWIEWFGCYLAAGPSAEPFWWFFLSEILLMLPRALKAHQWYCKKFPKYPANRRAIIPFLM

SEQ ID NO: 2152 - protein, 764 aa, Schizosaccharomyces pombe
MVKSAVLGFPRIGKNRELKKATEAYWSGKTSAEELLATAKQLRLEHWKLQKAQGVDIIPSNDFSLYDQIMDHSFSFNVIPPRYRLSGLSSLDTYFAMGRGMQRAATADKAAVDVPAGEMVKWFDSNYHFLRPEVSEETDFKLSSTKALDEFLEAKEAGIITRPVLVGPVTYLFIAKAAKGSSIKPIELLPKLLPVYVELIKKLTEAGAEYIQIDEPILTLDLPQEILASYKEAYETLGKIGKLILTTYFGSLQSNADVLKGLPIAGVHVDVVRAPENLDRALAVLGENQIISVGVVSGRNIWKTDFQKATAIIEKAISAVGSERVQVASSSSILHIPHSLSGEDQINPEIKRWFAFAVEKCAELAILTKAANDGPASVRAELEANAADCKARAESPITNVEAVRERQSKVTPQMHERKSPFETRYAKQQASLKLPLFPTTTIGSFPQTKEIRVTRNRFAKGLISQEEYDAFIRKEISDVVKFQEEVGLDVLVHGEPERNDMVQYFGERMEGFVFTVNGWVQSYGSRCVRPPIIVGDVYRPAPMTVKESQYAQSITSKPMKGMLTAPITILRWSFPRDDVHDSVQAQQIALGLRDEVLDLEKAGIKVIQCDEPALREGLPLRRAEWDEYLKWAIDAFRLATAAVQDDTQIHSHFCYSDFNDIFDAIQRLDADVVSIENSKSDMKLLNVLSRYTSCIGPGLFDIHSPRVPPVSEFKERIDAIVKHVPKDHLWLNPDCGLKTRGWPETTADLKNMIAAAREAREQYA

SEQ ID NO: 2153 - protein, 1214 aa, Schizosaccharomyces pombe
SNKGDRLTKTFEGFRNQLDKVQFIRKLMSKANVDDFHTRLFILWMLPYSLRKLKERNYWKSEISEIYDFLEDKRTASYGKTHKRFQLQNKNLGKESLSKKNNTTNSRNLRKTNVSRIEYSSNKFLNHTRKRYEMVLQAELPDFKCSIPCLIDTGAQANIITEETVRAHKLPTRPWSKSVIYGGVYPNKINRKTIKLNISLNGISIKTEFLVVKKFSHPAAISFTTLYDNNIEISSSKHTLSQMNKVSNIVKEPELPDIYKEFKDITAETNTEKLPKPIKGLEFEVELTQENYRLPIRNYPLPPGKMQAMNDEINQGLKSGIIRESKAINACPVMFVPKKEGTLRMVVDYKPLNKYVKPNIYPLPLIEQLLAKIQGSTIFTKLDLKSAYHLIRVRKGDEHKLAFRCPRGVFEYLVMPYGISTAPAHFQYFINTILGEAKESHVVCYMDDILIHSKSESEHVKHVKDVLQKLKNANLIINQAKCEFHQSQVKFIGYHISEKGFTPCQENIDKVLQWKQPKNRKELRQFLGSVNYLRKFIPKTSQLTHPLNNLLKKDVRWKWTPTQTQAIENIKQCLVSPPVLRHFDFSKKILLETDASDVAVGAVLSQKHDDDKYYPVGYYSAKMSKAQLNYSVSDKEMLAIIKSLKHWRHYLESTIEPFKILTDHRNLIGRITNESEPENKRLARWQLFLQDFNFEINYRPGSANHIADALSRIVDETEPIPKDSEDNSINFVNQISITDDFKNQVVTEYTNDTKLLNLLNNEDKRVEENIQLKDGLLINSKDQILLPNDTQLTRTIIKKYHEEGKLIHPGIELLTNIILRRFTWKGIRKQIQEYVQNCHTCQINKSRNHKPYGPLQPIPPSERPWESLSMDFITALPESSGYNALFVVVDRFSKMAILVPCTKSITAEQTARMFDQRVIAYFGNPKEIIADNDHIFTSQTWKDFAHKYNFVMKFSLPYRPQTDGQTERTNQTVEKLLRCVCSTHPNTWVDHISLVQQSYNNAIHSATQMTPFEIVHRYSPALSPLELPSFSDKTDENSQETIQVFQTVKEHLNTNNIKMKKYFDMKIQEIEEFQPGDLVMVKRTKTGFLHKSNKLAPSFAGPFYVLQKSGPNNYELDLPDSIKHMFSSTFHVSHLEKYRHNSELNYATIDESDIGTILHILEHKNREQVLYLNVKYISNLNPSTIMSGWTTLATALQADKAIVNDYIKNNNLNI

SEQ ID NO: 2154 - protein, 1089 aa, Schizosaccharomyces pombe
  unsure (1)..(1089): unsure at all Xaa locations
MKSLKGRLLFLRKFVFFSLLILLFAHGASSSSSSFNYFDKRTNGKANNELALFSPTADSPSSVDGVLELPSAENVFAESSLYNAFIVATVDGSLHSYDRITGQELWSLFTNANPGLSYTKDENSLLSSKFLSQSNFKSYNSTHGEFYSDSTLNISYLSDDDTVWFVEPIDGGILYAFNLQTGLVRLPHSIKDLVHASPIRLLNNNVFVGSKNTTLFTIDVSNGDIVSQYPSGHRYETHHSVHNLGTKRDSVPSGADSDLSFKDPSGKKLSESLDLLDDFNYQVTVSNKSFVDIARTEYFITIYSDSNVILDLVYIDWTPTKNEIMYESFHSSSFDSKLALSSYDSSLHIVDTHSKFIKQNIPLMSPAATVFDIVTLPHNKKIDKSQTPAKFPTSVLLRQPIDTYLETMFPQIARNKTEHVYINHIGNAWFAMSERHYPLVSLAPEASFLYYNGFYIPLNSIFGLHSLMATPKPFFALPGLPGYDIPSYVESEGSTKTLPSIGKKPIPLLDPNPISSTPISITFWVIMFLSVSFTIVTFFSILRIRSSEVRPLKSQKNTVSINNKIDTSKRRRKGKRRKRVSDEHSASSNFNEIESQASFEQNQTLDILSENIVEIQDKSTDPLQKSLDSSLKSHLPEATVIQNTDGSVTVNSLTVYPEVIGYGSHGTIVYRGVYEDREVAVKRVLMEFYDLASREITLLQQSDNHPNIVRYYCKQKSDQFLYIVIELCKCNLSDLIEKPIAYDDLFKSIDLVSLLYQIAFGVSHLHSLDLVHRDLKPQNILLVVNNSPNLSKTRVRALISDFGLSKKLDFNQSSLRNTTFEAAGSYGWRSPEILSGSLSQQSKEIQVKTREGRIRQASHATDIFALGCIFYYTLTGGMHPFGSHYDCEGNILKGNYCLVHLQSLGECGVLAADLIEDMIAFEPSKRPTIEVVLNHPLFWDYAKKLDFLIDVSDRFEVEERDPPSPLLQMLENNSKSVIGENWTTCLHSSLVDNLGKYRKYDGSKILDILRVLRNKVLIXWMIILLLLTSFFRRHHYQDLPESVRRVLGDLPDGFTSYFVEKFPMLLLHCYHLVKDVLYEESQFKRYLEY

SEQ ID NO: 2155 - protein, 391 aa, Schizosaccharomyces pombe
  unsure (1)..(391): unsure at all Xaa locations
MAVLLRDKHISYLHDIGNVSEKKIVXXFNFLTNSRTDELDFWLKEHLHVSAIYWSCMSFWLLKKKDQIDKERIVSFLLSCLTESGXLYYXYXNIDTGCXQXVRRFACYPGHDDHITNTVYAVQVLAMLDSLHVVDKDKVASCKFLCICTCDPXLIYKXLDIIGLQNEDGSMKGDRWGEIDARFLYSGINCLAILGKLDYLNKNTAVDWLMKCYNFDGGFGLCPGAESHGAMGMFNFKTQLLTXXFLTCVAALKILNKLDLIDEELLGWWISERQVKGGGLNGRPEKLPDVRRLLFVXHVYXXFXSCYGWWDLSPLAIIGKLDWIDRNQLIDFLLGTQDADSGGFADRKEDATDVYHTCFSLAGLSLLQFPNIEPVDPRFCLPLEVTQKMKL

SEQ ID NO: 2156 - protein, 308 aa, Schizosaccharomyces pombe
MLMLDGGSTAILPKLPESISESRLWTSEALVRYPEIVVKHHEEFLKVCDIISTFTYQLDASIYDEKVEGVPLKQVYANSIGLPVYAREHLGLPNKYIALCLGSHAATIPGCMEYKMIYDKPTDFEMLYNFHKNRIEAIQASNPKAFEKIDFIAFESLPHVTEAEVVCQLIQDMKGWSKRCWITCTCPERSTIERVSSIISKILSINHDSIWGIGVNCFHLSLLEPIAKMLSSLLPSNITAILYPDGRGLYQNPDGTFSPGSTDHPAPSPEEWSTITAKYSNLHNGNLILGGCCETNYNHLSLLREKTK

SEQ ID NO: 2157 - protein, 515 aa, Schizosaccharomyces pombe
MGQGSSKHADSKLDSYPSFSRSDTQGSIKSLKSLKTVLGKGKDSNHDRRTSTDTTHSRHRYPETPPSLPPPPSPGILATSPAVLQKHQQEDSGNSSQSPTSPHPSNQPAMLSPSTAASQHHHHHSSSSSYAVSPTSPTSPTSSGPIGSNFDSASEHNGPVYPQDQQGPVIIPNSAISSTDPDDPETVVSLNVDEMIQRLIHVGYSRKSSKSVCLKNAEITSICMAVREIFLSQPTLLELTPPVKIVGDVHGQYSDLIRLFEMCGFPPSSNYLFLGDYVDRGKQSLETILLLFLYKIRYPENFFLLRGNHECANITRVYGFYDECKRRCNIKIWKTFINTFNCLPIASVVAGKIFCVHGGLSPSLSHMDDIREIPRPTDVPDYGLLNDLLWSDPADTENDWEDNERGVSFVFNKNVIRQFLAKHDFDLICRAHMVVEDGYEFFNDRTLCTVFSAPNYCGEFDNWGAVMSVNSELLCSFELIKPLDQAAIRRELKKSKRSGMAIYQSPPAEQVTQSV

SEQ ID NO: 2158 - protein, 602 aa, Schizosaccharomyces pombe
  unsure (1)..(602): unsure at all Xaa locations
KTLPFSENFIMADSEEYKTVIGISFGNQNSSIAFNRVRKFFYLEKXVISXFIRIDLLYAGRRESLVNFQIKEANKSNRDGKTDVLANEEGNRQIPSILSYHGDQEYHGVQARGQLVRNADNSVTNFRDLLGKSHDELTLHHCHYSANPVNVEGQIGFKITVQEDEESDPKEKILTAHEASVRHLRRLTESAEDFLGTKVNGCVMSVPVYFTDAQRKALESAANEAGLPVLQLIHDPAAVILALMYSEEVLIDKTVVVANFGATRSEVSVVSVKGGLMTILASVHDENLGGEQLTDVLVNFFAKEFEKKNGIDPRKNARSLAKLRAQCEITKRVLSNGTTASAAVDSLADGIDFHSSINRLRYDLAASATLNRMADLVTEAVEKANMEPFDISEVILAGGASNTPKLTSLMESIFPEQTIIRSSSSVTPLQLDPSELTAIGSGVQASLIGHFDAADIAASTDAQVVDVPHLTAPIGINEGENFVTIFDIETALPARKTVEVIAPKEGAAFIPIYEAERSVKVTKVEPEPIDEEEAFSDDEEEEPEEIKERIAIPKTLIATITLPDVSPNAKIELVLQIDAEGKLTASARPKDGKGTNVRGSTA

SEQ ID NO: 2159 - protein, 589 aa, Schizosaccharomyces pombe
  unsure (1)..(589): unsure at all Xaa locations
MQTPSSASAESEKDSGNTYVGPWLLGRTLGQGNLAKVKCKYMRXNLVDFVLXGLVNKIEXTTYRQXRXTTXVSWLSCASIVFDFVFGNCTMANSVVGKHFQTNEKVALKMVYNDELEDKDTWKRLQREVTILRQLHHPNIITLYQVFRVPKYTVLALEYMDTDLHSMVVKHNRLDECTTRKIFRQIVHAIDYCHLHRVAHRDLKLENILLNKDLVVKLTDFGLSNFMLDGSFLSTSCGTPHYAAPEVIQGRYYDGCDVDVWGCGILLYLMLVGEFPFEDVTISNVLSRVCKGIYTIPSFVSSSASDLIRQMLMVLPTSRIKVAEIMQHPWFIADLPTHSRLPSRTSSFSSKHRSVTFSPPDLAILFDPSITSPSSSVGQIPQPTDHSALSPSKPMSISGTESPNPDPASLCYSSYEDLYSATSWHSDMAESSGFLDPTDIPPIPSNVETLRSSLPQRHASFMNKVYNHPLSRPPAPNRLRSLRWHYGIQTAKNPIEVLRKLCEALLELGARFRPCDEESFLKENKYKVFSCITCHNSPVYLVIELFSIGPSASVIDIRFSSSDDSIKYTSSYSPMPFLEVVKQLILKIA

SEQ ID NO: 2160 - protein, 359 aa, Schizosaccharomyces pombe
MSQYDVEPLLSKAAILNKYADLPQNGKVMAEYIWIDGFNHLRSKTMTLDAKPSSIDQLRVWNFDGSSTGQAPGNNSDTLLKPVAMYNDPFRRGDNILVLAACYTADGSPNGFNHRDACAKLLEKHADKETWFGIEQEYTMLDYYDRPFGWPKGGFPGPQGPFYCGVGTGRVFARDIVEAHYKACLYAGINISGINAEVMPSQWEYQVGPCAGIEMGDQLWMSRFLLHRIAEDFGVKISFHPKPILGDWNGAGCHTNVSTKDTRAEGGIKAIESYLEKFAKRHKEHIAVYGDDNDLRLTGRHETGSIDKFTYGVADRGASVRIPRSVAMNGCGYFEDRRPASSIDPYLVTGIITETMFEH

SEQ ID NO: 2161 - protein, 352 aa, Schizosaccharomyces pombe
MKDGYKIIGFISSGTYGKVYKAVSSNSNDKRLFAIKKFKAESKQVSSNAQQTGVSQSAIREMMLCREIQHENIVSLVQVLLKDGTISMVFEYAEHDLLQIIHFHSRSRTRQIPPSILKSILWQIINGVAYLHENWIMHRDLKPANIMITATGKVKIGDLGLGRLIRDPILPFYSSDRVVVTIWYRAPELLLGAHDYTPAIDVWAIGCIYGEMLALSPLFKGDEIKMEDKKVVPFQSTQMLRIMELLGTPTEERWPGLKNYPEYYQLSSFEVRYWNNLLPQWYQTVKNRDPQGLDLLMKMLQYDPKSRITAKQALEHVFFTSDKLWTTRYVFFLFLFIIERNKLLLTHFLAHF

SEQ ID NO: 2162 - protein, 423 aa, Schizosaccharomyces pombe
TCSAPGKVLIAGGYIVLDPQYSGLVIGLTAKGYASTTTLDDKCGTVRVKSPQFINAEWLYNIDWTVSPIRVHQIYENCELEKNPNPFVQLALFYVINYFFSTGRQPLCWQDLQVTLQVDNAYYHQPQLKPDQTSYPKFNFLNCTLGQVHKTGLGSSAAMITSLIGSLFLSLRRLTDDTGDKSLKIDDSTKVIVHNLAQIAHCSAQGKVGSGFDVGAATWGSCIYRRFDPKLIEQLLVPYDEQIKNINFSTELRKIVSKKWSDVVPFQLPATYCLLMGDVAGGSSTPGMVKKVQQWQKENPEESKNCFDDLYSRVLSIKNCFLSSESLDSELQSQFRSIRRILQRITVEAKVDIEPLKQTNILDNIEQLPGVIGVGVPGAGGFDAQFCLAINHTEIIENVIKTWKDDGVVPMDVSPAFDGLAVE

SEQ ID NO: 2163 - protein, 632 aa, Schizosaccharomyces pombe
  unsure (1)..(632): unsure at all Xaa locations
AGGIELAKKAIRSLKNYDEHENRYGSIFSVSGPGKKSLVGAFYXTFTVVVAANMLGCSMYELVRVGHEELVGEVIRIHQDKCTIQVYEETSGLTVGDPVQRTGKPLSVELGPGLAETIYDGIQRPLKQIFDKSQSIYIPRGINTESLNREHKWDFTPNKDLRIGDHVSGGDVFGSVFENSLFNDHKIMLPPRARGTVTYIAEAGSYHVDEKLLEVEFNGKKHSFSMLHTWPVRAARPVADNLTANQPLLTGQRVLDALYPCVQGGTTAIPGAFGCGKTVISQSLSKYSNSDLIVYVGCGERGNEMAEVLMDFPELTIDINGKPEPIMKRTTLVANTSNMPVAAREASIYTGITLAEYYRDQGKNVSMMADSTSRWAEALREISGRLAEMPADSGYPAYLGAKLASFYERAGRARCLGSPDREGTVSIVGAVSPPGGDFSDPVTSATLGIVQVFWGLDKKLAQRKHFPSINTSLSYSKYINALQPWYEERVPGFNTLRDQIKQIIQQEDSMLEIIQLVGKSALSETDKVTLDIAGIIKNDFLQQNGYSDYDRCCPLYKTYHMMRNMIAYYTKAKSAVETGSVPWSKIKESTSDIFYELTSMKFENPNEGEKEIVEHYETLHKKIEDKFHTLTE

SEQ ID NO: 2164 - protein, 410 aa, Schizosaccharomyces pombe
MDREDILKEFCNRNNIDVSQGRFFLESTNWNYELATALLHEVIPPEEDHGLQPSSDVSKVPEVTGSSSGISGGDQQPPRPLQRQQNTQGQGMKSGTASKKFATLRDLEGNDESAEEKSHLFTGGEKSGLSVEDGDPDPKKQLVRDILEKARQHTISPLDEQDSGPSSLASSWASVGQRLGTENEASGSTTPVTQSGPPRENPPTESQPEKPLRRTLYFWRNGFSVDDGPIYTYDDPANQEMLRYINSGRAPLHLLGVSMNQPIDVVVQHRMDEDYVAPFKPFSGKGQRLGSTYMQPRMSQMPGGLYTDTSTSSSVPINVKPNSTTPHASLQIDENKPTTRIQVRLSNGGRTVLTVNLSHTLHDIYEAVRAVSPGNFILSVPFPAKTLEDDPSVTVEAASLKNASLVQKSL

SEQ ID NO: 2165 - protein, 641 aa, Schizosaccharomyces pombe
MKIVDLIDKIPNGNAFYSFEYFPPKTTVGLENLSSRITRMSRNMMPLFSSVTWGTAGSTAEVSIYLAKMLEQHHKIPACLHLTCTNVDKAIIDKALETAKEYGIRNILALRGDPPLNSDHWEGKVSEFEHAVDLVRYIREKYGDYFCIGVAAYPEGHVDSNVPELSKDPLRDIPFLIEKVEAGADFIITQIFYEPEAFIKFENFVRNHSSNALRNIPIIPAIMPIQSYGSLKRMTRLCGCSVPSSLMQRLNAAKPDDEAIKNIGVEHIVDMIKKIMDNVQGRVHGFHFCTLNLERSVALILKNSGLLTKRWKQVESEMEDEKLLRTTRKRLSLDEPAELHNQVVVPSQQPVADKSSNLFVTSKQSSVSGHKDNLTEEAPFSVSEGSGVLGRQANWDDFTNGRFGDPRSPAYGEIDGYGPTLHFPPSEALKLWGYPVDESDITSLFQKHIMSDISAIPWIDEPVEVETKTIAKYLLKLNGNSWWTVGSQPAVNGAPSADPVFGWGPKGGRVFQKAFVECFVNGKDLKDFITKWHDNPQVTYYAGNNKSEFLTNAPKDGASAVTWGVYPGREIIQSTIIAEVSFKAWLSESFQVWGEWANLYSKNTPSRKLLENCINDRWLVTVIHHDFMDKNGLWKVLEIDF

SEQ ID NO: 2166 - protein, 721 aa, Schizosaccharomyces pombe
MDSGEMHHPYQAFSKVGKCEISQTNPSFSSGMRCLVRSADIQFKGICGLTRGFASFNKPPQTITEKIVQKFAQNIPENKYVRSGDYVTIKPKHCMSHDNSWPVALKFMGIGAKKVFDNRQIVCTLDHDVQNKSEANLRKYKNIESFAKGQGIDFYPAGRGIGHQIMVEQGYAMPGSMAVASDSHSNTYGGVGCLGTPIVRTDAAAIWATGQTWWQIPPIARVNLVGQLPKGLSGKDIIVSLCGAFNHDEVLNHAIEFYGEGLNSLSIESRLTIANMTTEWGALSGLFPTDEKLLAWYEDRLKFLGPNHPRVNRETLDAIKASPILADEGAFYAKHLILDLSTLSPAVSGPNSVKVYNSAATLEKKDILIKKAYLVSCTNGRLSDIHDAAETVKGKKVADGVEFYVGAASSEVEAAAQKNGDWQTLIDSGARTLPAGCGPCIGLGTGLLKDGEVGISATNRNFKGRMGSREALAYLASPAVVAASAIAGKIVAPEGFKNAVSLVSAVDITDKVNKQTASKSSTEAVDSETAIIDGFPSIVAGEIVFCDADNLNTDGIYPGRYTYRDDITKEEMAKVCMENYDSEFGKKTKKDDILVSGFNFGTGSSREQAATAILSRGIPLVVGGSFSDIFKRNSINNALLAIQLPDLVQKLRTAFANESKELTRRTGWHLKWDVRKSTVTVTTSDNKEMSWKIGELGNSVQSLFVRGGLEGWVKHEISKSN

SEQ ID NO: 2167 - protein, 305 aa, Schizosaccharomyces pombe
  unsure (1)..(305): unsure at all Xaa locations
MSFHITPIWMWKGTGNNYAYLLTCDKTKITAIVDPAEPEXVSEENEITTXILLSVISETXFSPPVFRIVLFVRSVTFNXPNXHXQTLSVIPVIKEKTAKKEIDLQYIXDTHHXLDHAGGNEDILSYFPSLKVYGXXKKCIGVTYTPKDKEIFKVGEVQVEALXYAMPTQXQYLLLVSSPXKXEPCXTGDTLFTSGCGRFFEGDAKQMDYALNHVLAALPDDTXNXTXGHEYTKXKCQVXFTIFSTPELXKIXWIFAXNHESXYWXTXTIGDEKKFNPFMCLGLESVQKAVGSSXSNHCYEELRDM

SEQ ID NO: 2168 - protein, 303 aa, Schizosaccharomyces pombe
  unsure (1)..(303): unsure at all Xaa locations
MSFHITPIWMWKGTGNNYAYLLTCDKTKITAIVDPAEPERXVKRMKXRLKYCYLXFRKHDFLLLFSELFCLCAPXHLINQTNIDKLSVIPVIKEKTAKKEIDLQYILTTHHHYDHAGGNEDILSYFPSLKVYGGKNASGVTYTPKDKEIFKVGEVQVEALHTPCHTQDSICYYVSSPSKRAVFTGDTLFTSGCGRFFEGDAKQMDYALNHVLAALPDDTVTYPGHEYTKSNAKFSSTIFSTPELTKLVDFCKNHESTTGHFTIGDEKKFNPFMCLGLESVQKAVGSSDPITVMKKLRDMKNAA

SEQ ID NO: 2169 - protein, 556 aa, Schizosaccharomyces pombe
MTPTMKSIARRKALLIALSIFAVTFILWNGFPGSSNRPLPSSNDEFHYEDIELPSGYRSEGEVVDLLNPKDELEEPLFSEEPLFPVTTSIPTKTAVSKPKIAPTSAAKDVTFSSSIDSDDCSVAYDNSKPVRQYVLMIDAGSTGSRVHVYQFNNCNPSPKLEEEFFKMIEPGLSSFAGDPEGAAASLDPLLDYAMENVPEEYRRCSPIAVKATAGLRLTGESEAKAILKSVRQHLENDYPFPIVKDGVSILEGSMEGIYAWITINYLLGTLGGKATHSTVAVMDLGGASTQLVFEPRFASDGESLVDGDHKYVLDYNGEQYELYQHSHLGYGLKEARKLIHKFVLNNAEALKESLELLGDSTSIIHPCLHLNASLTHPDSKSEASEVVFVGPSLAHLSLQCRGIAEKALYKDKNCPVRPCSFNGVHQPKFTETFTDSPIYLISYFYDRMISLGMPSTFTIEDMKYLANSVCSGPTYWQDAFSLTDALKELKEEPEWCLDLNYMISLLSVGYEIPNNRQLHTAKKIDNKELGWCLGASLSMLSEQNNGWNCNVKEEI

SEQ ID NO: 2170 - protein, 832 aa, Schizosaccharomyces pombe
  unsure (1)..(832): unsure at all Xaa locations
MEEEGHKSLTVRTNLSVIYXFFSLXSHLPQSSSSLSQSREIAKEFTSNIPPPTIKTNSSSSNILKPRLSLQNEVNQLKPAKFPSKMLPPGSLASVKSSSLAKKARPFTASSNPRMPKSAHPISSRSVSASSHFGRPASAVSSSLNSSDDVRSMSDESMESYNDEKSVNASALRTTEDRLRSMEMAYAQLSAKVIPSPSKRPANYKFYEQRIAMLEESLEVERSRTSELQEQFSVALREKAEAEANKIVSQKGMESLEIMLNSMKSENHQRMAMLEENHARVMETAELQHQAELQDFASNIEQKANSLIMEYKNELQSAEEHFSHKIKELTSENELKISRLQEEKDSLLKKVQEGASLAMQRVQNKHDLEKKRLQSAIQPLQEENNSLKQQIEQLQRELASETVVKENLKSSLDQQSANVQKLESTNRALESTIKTLEEDVYTMKNKIIELEGILKSANVERDGLVEKLIAEETLRRKLHNTIQELKGNIRVFCRVRPPLGDGESAQIAFPDQNSEASTIEIVAQAPGSSLTGNGIKQYAFNFDRVFSPETTNEDVFNELSQLIQSAMDGYNVCIFAYGQTGSGKTHTMSSNTGMIPSSVRMIYNRSTSLKERGWEYRMEGQFLEIYNETIIDLLASGNEEEKGKKKLEIYHDTKAGRTTITNITSEPLDTPEQVTWLLDQASKNRSVAATNANEHSSRSHSVFMLHLNGSNSTTGETCRSTLNLIDLAGSERLSSSQSVGERLKETQAINKSLSCLGDVIHALGSGKEGTYIPYRNSKLTNLLQYSLGGNSKTLMFVNISPLKQHVPETLCSLRFATKVNNTQIGTARKVTK

SEQ ID NO: 2171 - protein, 674 aa, Schizosaccharomyces pombe
MISSRFTNVVRSGLRFQSKGASFKIGASLHGSRMTARWNSNASGNEKVKGPVIGIDLGTTTSCLAIMEGQTPKVIANAEGTRTTPSVVAFTKDGERLVGVSAKRQAVINPENTFFATKRLIGRRFKEPEVQRDIKEVPYKIVEHSNGDAWLEARGKTYSPSQIGGFILSKMRETASTYLGKDVKNAVVTVPAYFNDSQRQATKAAGAIAGLNVLRVVNEPTAAALAYGLDKKNDAIVAVFDLGGGTFDISILELNNGVFEVRSTNGDTHLGGEDFDVALVRHIVETFKKNEGLDLSKDRLAVQRIREAAEKAKCELSSLSKTDISLPFITADATGPKHINMEISRAQFEKLVDPLVRRTIDPCKRALKDANLQTSEINEVILVGGMTRMPRVVETVKSIFKREPAKSVNPDEAVAIGAAIQGGVLSGHVKDLVLLDVTPLSLGIETLGGVFTRLINRNTTIPTRKSQVFSTAADGQTAVEIRVFQGERELVRDNKLIGNFQLTGIAPAPKGQPQIEVSFDVDADGIINVSARDKATNKDSSITVAGSSGLTDSEIEAMVADAEKYRASDMARKEAIENGNRAESVCTDIESNLDIHKDKLDQQAVEDLRSKITDLRETVAKVNAGDEGITSEDMKKKIDEIQQLSLKVFESVYKNQNQGNESSGDNSAPEGDKK

SEQ ID NO: 2172 - protein, 966 aa, Schizosaccharomyces pombe
  unsure (1)..(966): unsure at all Xaa locations
MENRICTLAKPLPKLDESKQAWVSYLWLKKALPGFEEHSAYVYMTTNPTIAGRIFLPINNEDLEDGTVEISGYDNLLADALYISTIAPVKLDFVQLIVIDDNSQDQDAIIERIKGRNAILMESDFINQNILVQVCQPVRHGVVDSETKFVIERKDSFTFLASNEKNISSFKRGKTETDAELVIRPSKVHTEIQWCLQNCSLIHVPFELLFNVGKKNGCPISLRLSDGKNVYGIASIKSDTEHDSVQLSPSLHYFDEFNESVISEEGTEAFLVARGPSVGIASRISLRTIPTQSCFSEKLLKAANLCVVQQVKQKVFLQSKQIFCVPINSLMANSDSVDILELTRNTDAYIWYSVEEIDPLNTYNIYYTNEDTSIVLDTQLSHRLLPSLRKPLLNFVKVHPPSQKLLRFCRAFFDPQQVPGFNPFFLLHGNPFTGKTKAVEEVASLFSAPVFTVSFNXSQLFFDSILTVFXISSYEFADATADHLEAKLDMFVQNVVKSPCAIIFVKDLDVLSISSDEGNIVPGSKSIQILLSKIDLVKSPQGRYIVIGTCHSIEKIPYEILSESFFELKFSELEMDERLELLKIYANNVIIDKRISLKDVALKTNSMSFGELECLPDHMTKAAVDRIKRTGYDNDSIILSGPIITEQDVDVSINRIRKEKSNTIFTVPKVNWDDIGGLEEAKTVLRDTLQLPLQFPELFSQGLKPRSGVLLYGPPGTGKTLLAKAVATELSLEFVSIKGPELLNMYVGESEANVRNVFEKARNSSPCVIFFDELDSIAPHRGNSSDSGNVMDRVVSQLLAELDSISKDNNKYVFVIGATNRPDLLDPSLLRPGRFDKLVYLGINKSEESKASMLRALTKTFKLDETIDLNEIAKNCHPNFTGADMYALCSDAVLSAIKRKTNEIDLLIQASGTDLSTEEFFKRNENQDSLELRITKEDFLTSLKKLRPSISEQELHRYEMVRHQFS

SEQ ID NO: 2173 - protein, 790 aa, Schizosaccharomyces pombe
EGTPDEDLEEYSDYSDVDNYGEEDDDSYKPAPRIRINNNKTKAQTTTNSNEARQSGISAMFGQNDFSNLLGLKLDHTARPLWINPIDGRIILEAFSPLAEQAIDFLVTISEPVSRPAFIHEYRITAYSLYAAVSVGLKTEDIIAVLDRLSKTPIPPSIVDFIRACTVSYGKVKLVLKKNRYFIESGDASVLRLLLRDPVIGPLRIDYSTQSSKQKSSKPSNEDNVEDKKDITNDSSKETAEKSSSDELFSAVVGLQEEEDDEDAVHLFEIKHSSVETIKKRCAEIDYPLLEEYDFRNDNINPDLPIDLKPSTQIRPYQEKSLSKMFGNGRARSGIIVLPCGAGKTLVGITAACTIKKSVIVLCTSSVSVMQWRQQFLQWSNIKPDHIAVFTADHKERFHSEAGVVVSTYSMVANTRNRSYDSQKMMDFLTGREWGFILLDEVHVVPAAMFRRVVTTIAAHTKLGLTATLVREDDKIDDLNFLIGPKMYEANWMDLAQKGHIAKVQCAEVWCAMTTEFYNEYLRENSRKRMLLYIMNPKKFQACQFLIDYHEKRGDKIIVFSDNVYALRAYAIKLGKYFIYGGTPQQERMRILENFQYNELVNTIFLSKVGDTSIDLPEATCLIQISSHYGSRRQEAQRLGRILRAKRRNDEGFNAFFYSLVSKDTQEMYYSSKRQAFLIDQGYAFKVITNLKGMENLPNLAYASKAERLELLQEVLLQNEEAADLDDGEDTSFGSRSLSRAPAKAKRSSGSLSTLAGADNMAYVEYNKSANKQLKKDSKEHHALFRKHLY

SEQ ID NO: 2174 - protein, 290 aa, Schizosaccharomyces pombe
  unsure (1)..(290): unsure at all Xaa locations
MEPGKKDYIDSPLRMQPASLSGASTPTIDLDGLSWPCKXXKHILYSFKYSNTNXVQGTQRRIDTAEEEKVKKISNAISTILECLGEDPERQGLLGTPERYAKAMLYFTKGYEQNLTEVINEAVFQEDHEEMVIVRDIDVFSLCEHHLVPFIGKVGFIXKWILSIAFTXLGYAIMFNPLSQTQRIKLTLLXIHIGYIPRKRVLGLSKLARIANMFSRRLQVQERLTKQVAQAIQAVLKPQGVAVVMEATHMCMVMRGVEKPGSSTVTSSLTGIFQRSHKTREEFFRLIGKF

SEQ ID NO: 2175 - protein, 716 aa, Schizosaccharomyces pombe
MSVSVALKAKPIAYGAVACANYVNLSGAGSISVKYEDVALLDKQNKESNVSIQLNGSDSPVFGSKLALQTFSQVYPKLFIGENDRSLVESWVETASALAGNHNFLELSSLLAQLDDHLIMRSLFVGYSLTSADFSIWGALKSNNMAAGAVRTGQYFNLARWYKFMDSQNAVSVTMEEFTKAVNISKKQKSSGPNYEIGLPDAIDGKVVTRFPPEPSGYLHIGHAKAALLNQYFANKYHGKLIVRFDDTNPSKENSEFQDAILEDVALLGIKPDVVTYTSDYLDTIHQYCVDMIKSGQAYADDTDVETMRHERTEGIPSKHRDRPIEESLEILSEMDKGSDVGLKNCIRAKISYENPNKAMRDPVIYRCNLLPHHRTGTKYRAYPTYDFACPIVDSLEGVTHALRTTEYRDRNPLYQWMIKAMNLRKIHVWEFSRMNFVRTLLSKRKLTEIVDHGLVWGWDDPRFPTVRGVRRRGMTIEALQQYIVSQGPSKNILTLDWTSFWATNKKIIDPVAPRHTAVESGDVVKATIVNGPAAPYAEDRPRHKKNPELGNKKSIFANEILIEQADAQSFKQDEEVTLMDWGNAYVREINRDASGKVTSLKLELHLDGDFKKTEKKVTWLADTEDKTPVDLVDFDYLITKDKLEEGENYKDFLTPQTEFHSPVFADVGIKNLKKGDIIQVERKGYYIVDVPFDGTQAVLFNIPDGKTVNRYGVKN

SEQ ID NO: 2176 - protein, 323 aa, Schizosaccharomyces pombe
MSPHKISDNHRHLMLSRFMMGNGVSIINMPFSGGQPKDGAELAPEMVEKAGLVDDLEHLGYDVKLIQNPEFKSRPSKEGPNQALMKNPLYVSNVTRQVRDAVQRELEQQRVVVNIGGDHSLAIGTVEGVQAVYDDACVLWIDAHADINTPESSPSKNLHGCPLSFSLGYAEPLPEEFAWTKRVIEERRLAFIGLRDLDPMERAFLRERNIAAYTMHHVDKYGIGRVVEMAMEHINPGKRRPVHLSFDVDACDPIVAPATGTRVPGGLTFREAMYICEAVAESGTLVAVDVMEVNPLLGNEEEAKTTVDLARSIVRTSLGQTLL

SEQ ID NO: 2177 - protein, 1401 aa, Schizosaccharomyces pombe
MGLEHTFYPAEDRFEPLLEHSEPVNFVPKENAKSYVRQGFASPHQSLMDNLVDSTESTKRSENFVSHIPLTPSHSGQSEKLMSTRTSHSPYISPTMSYTNHSPANLTRNSSFNHQHYSTTLRSPPSMRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHDDSKAETDSLAASYKEESALPVASNVGLRQPNELRIDSINLPPAIVTPDTINYSVD

SEQ ID NO: 2178 - protein, 717 aa, Schizosaccharomyces pombe
  unsure (1)..(717): unsure at all Xaa locations
MSSQLKSTWAPVPSTKPSQPCKIGTDFKGERIVYPVSLSNPYELVDXRTFTKXFLANKAIIIREIEKQENCFQYNEHTAPTTVARFSPSGYYVASGGTNANYCYYFLSFYFXTLLMINYRNQGNVRIWDCAGEDKILKNQVTAISGRITDLDWGKPVQVSICXLMKRRDSQRIIAVGEGKERXVISIVFEGCVKLLDLLIISKIPIFVDSCXSYFXQIWTAFTADSGNSVGEVRVLLVSNFLKMLTVTDFWTSSVVNAVSLRKSRPFRAATASDDNSINFFHGTPYRFNRSLRVHSKFVYDVRYSPNDERFASAGADGKVYVFDGKTGDQVYEIDAHKGSIFSISWSPDSSQFVTSSAGYSCKIWDANTGSLIREWLSSDKKQLVGTVWPTKDLIIVVNSKGNLTYLNPSDCKVIDTIYGHQRSITAATLSPDATHFYTASYDGTVLSWDIGKQKAFPLVGESHTNQVMQMIMADDHVITIGMDDTLRVIDIKQGCFAKDNVFPTGYQPIGVCSVEDCLILVTVSDIQVLRSLTGVSTAKTIYQPSAVASHPLKSEFCVGGEVXYHILISIXLLTFLGLLCIIHTLEKGELCEVAQCKDSTAPITCLAYSPDGKYLACGDASGKVVLYDANSREVITSRWAFHTGRILGMSWNAKSTHLATASLDTNIHIYSVERPMKYIAMKNAHSLGATQVEWVSENELLSTGSDAAIKVWSVTF

SEQ ID NO: 2179 - protein, 490 aa, Schizosaccharomyces pombe
MYPLNANSYTLLRKLGSGSFGVVWKARENVSGDIIAIKQVRLINFYSSLVSQKTYSCQIDLETGIDDITDIEQEVFMLSNCNSSNVIQYYGCFVDGYTLWILMEHMDGGSVSGLLKMGRLNEQVISIILREVLYGLNYLHGQNKIHRDIKAANILLSSSTGNVKLADFGVAAQLSNAASRRHTFVGTPFWMAPEVIQQTSYGLAADIWSLGITAIEMANGIPPRATMHPMRVIFEIPQSEPPKLDDHFSPTFRDFVSCCLDLNPNMRWSAKELLQHPFIKSAGTVKDIIPLLVQKENKLFDDSDQSVLEETINNTLKPFEEPIAEGNADIEDWTFETVKKSDSTVLGNTSIPKNSIISSQNKEELPSSIKYLEKTIMSDQATPHPFSKSLSEKGSSYHKSLTSDFAMKHYIKSTIRSMLLNDKLSATQRSSLESFYTSFISLDKNLSSKFVNQITPDNRLHHKKQKRSPISQLLFSRWLEETEKRRSLNG

SEQ ID NO: 2180 - protein, 380 aa, Schizosaccharomyces pombe
MNEEETNFVGIADLPNQRHKIVSRNGVAFTLMLCGESGLGKTTFCNTLFSTTIKSHMGPEKVRAKHAEKTVEIEITKAELEEKNFHLRLTVIDTPGFGDFINNSGCWESVVEFIEDQHESYMRQDQQPDRRKIIDMRIHACLYFLRPVRNGVRPMDLEAMKHISKRVNLIPVIAKADMYTRRDLALYKTRISQVLEYHQVNVYKPNMDEGDPVFHRQIQGIINCMPFAIVGSEDDIRTPDGRVVKGREYPWGIVEIENEEHCDFKQLRNILIRSCMLDLIQTTEEKLYEQYRQEQMKVRQYGEPKLRTIDNAKFKEEEENLRKRFTEQVRVEETRFRQWEQRLIAERDSLNKDLEAQHVQIKQIELEIERLKAATSSRKR

SEQ ID NO: 2181 - protein, 1030 aa, Schizosaccharomyces pombe
MSENSTDSKNFQFSEGSRESSNDELKVLLRDTETKEDEKSSFSNSEEESIIENLSDSSVNKEYAKNSLKLSDAVSESKYLNPLLKDKRHDRSFALHKVVVPDDYDYIPLNKHIPSDPPAKTYPFELDPFQSTAIKCVERMESVLVSAHTSAGKTVIAEYAIAQALKNRQRVIYTSPIKSLSNQKYRELLSEFGDVGLMTGDVSINPSASCLIMTTEILRAMLYKNSEIMHEIAWVIFDEVHYMRDKDRGVVWEETLILLPDAIRFIFLSATLPNALQFARWISEIHKQPCHVVYTDYRPTPLQHFIYPQGADGIYMLVDEKNKFKTENFKKVLEVLDHSTRQENYSKSSKKVKKSSSLERIINMVLSNRYDPIIVFCFSKKECEINAHQFGKLDLNDTENKELVTEIFDSAINQLSEEDRGLRQFEEMRSLLLRGIGIHHSGLLPILKELVEILFQEGLVRILFATETFSIGLNMPARTVLFTKAQKFSGNNFRWLTSGEYMQMSGRAGRRGIDTKGLSIVILDQSIDEQAARCLMNGQADVLNSAFHLSYGMILNLMRIEEISPEDILKKSFYQFQNMESLPLIKEELMQLKNEETSINIPNETAVKEFHDLKLQLEKYGEEIQKVMTHPDNCLPYLQSGRLIQIKLGGIIFPWGVLVNVIKREFDPNTREQVAPHETYVLDVLLPISSNSMSNHKVNPSILVPPRPNETPLYEIVSVLLTAVCNISSIRIYMPRELNSNESKLRAYRRVNEVIEEFKEIPYLDPLEHMHIESSTLSLSLRKLEILEPKLFDSPYYKDSKHRAEYHEFRKKLNLRAQIKDISTKITNTEAIIQLRELKIRQRVLRRLGFCTLENVIDIKGRVACEITSGDELLLVELIFQGFFNQMPPEEIAAALSCFVYEDKSEVSTLNLKEPFKKMYLTIIEAAKRIATVSLESKLQFNESDYLHQFKPDIMEPVSLWINGASFQEICIVSKLYEGSIVRTFRRLDELLKQLEHAAIVLGNNELKEKSVLTEQKLHRDIIFSASLYL

SEQ ID NO: 2182 - protein, 326 aa, Schizosaccharomyces pombe
MPNSTAQYPEKDSWEFLVKSGIAGGTAGCVAKSVVAPLDRVKILYQTNHASYRGYAYSRHGLYKAIKHIYHVYGLHGLYQGHTATLYRVFPYAGIKFVAYEQVRRVLIRDPEHETHARRFLSGSLAGTCSVFFTYPLELIRVRLAYITNTGKNPTLTQVTKDIFHERDFLCNKKYPGLSRLSKICNFYRGFSVTLTGIFPYAGMSFLAYDLATDFFHKQKIDEWVSTKKSDKKLKTWPELLCGAFAGVCGQTVSYPFEVCRRKMQIGGIRKNKSFLRLKQVVQTTYKEAGMRGFFVGLTIGYIKVIPMVSTSFFVYNHSKALLGID

SEQ ID NO: 2183 - protein, 219 aa, Schizosaccharomyces pombe
  unsure (1)..(219): unsure at all Xaa locations
LXSTYLREYKLVVVGDGGVGKSALTIQLIQSHFVDEYDPTIEDSYRKKCEIDGEGALLDVLDTAGQEEYSAMREQYMRTGEGFLLVYNITSRSSFDEISTFYQQILRVKDKDTFPVVLVANKCDLEAERVVSRAEGEQLAKSMHCLYVETSAKLRLNVEEAFYSLVRTIRRYNKSEEKGFQNKQAVQTAQVPASTAKRASAVNNSKTEDEVSTKCCVIC

SEQ ID NO: 2184 - protein, 560 aa, Schizosaccharomyces pombe
MKYGKVSFLALLCSLYVRGSLADPESEQEPLVFNPTEVKAPLVEQFQGAWSERWIPSHAKRFVNGIEEMSYVGEWTVEESSGPGALKGEAGLVMKDEAAHHAISYEFDEPINEPEKDLVVQYEVNPEEGLNCGGAYLKLLAEPTHGEMSNSIDYRIMFGPDKCGVNDRVHFIFKHKNPLTGEYSEKHLDSRPASLLKPGITNLYTLIVKPDQTFEVRINGDVVRQGSLFYDFIPPVLPPVEIYDPEDIKPADWVDEPEIPDPNAVKPDDWDEDAPRMIPDPDAVKPEDWLEDEPLYIPDPEAQKPEDWDDEEDGDWIPSEIINPKCIEGAGCGEWKPPMIRNPNYRGPWSPPMIPNPEFIGEWYPRKIPNPDYFDDDHPSHFGPLYGVGFELWTMQPNIRFSNIYVGHSIEDAERLGNETFLPKLKAERELLSKQESMEKQSMHVDEESNQILEKFLDVYDIIKAKLPPNVAEKVDYYVETIIETPEIGIAIVAVLGSLTAVILTCYFYFFASSSPASLSTGTTEAEKEQQEKFKQETETEKIDVSYAPETESPTAKNED

SEQ ID NO: 2185 - protein, 461 aa, Schizosaccharomyces pombe
MFPLGSVVEVITGERGFVRYAGEVENRKGVYVGLELLPEFAEFGKNRGVVDGREYFKTKNNEKTGIFVPFDKCKLASSISSSPSPKIDGTAASIGMGFPPMSPNLQSSIPRLTNVSSSSNLSMNTISSTALTPTEKILQKRIEDLLYERQNHQQQLEEVLATVDQLQSLVTNFNDQQDEVDELRERITLKEERIQQMRNEASQRRFEFKTTIECLEESSNRAIETYENRIAELEAQLEMYMSGKSEDDLLFSLQQERDYALNQVEILQERVDTLMKQKANSSTANEKLSHMESSSPTLTNASFESPKRGKGSNDLPENHPQRRQTLEFYEIEIEVLREKVEKLQALSDEKDFYISKLEKSLDRNDTTPVPSDEKLSNYAAEKENLVSRISELEHTIEQLTINNERDNERMSPAEFELETTQEVEENDSDSHDDEETWCEVCETNNHSLQECPTVFGSTDEA

SEQ ID NO: 2186 - protein, 473 aa, Schizosaccharomyces pombe
MVTFMVFGASGNLANKKTFPALFHLFKRNLVDRSSFYVLGYARSKIPIGEFRESIRESVKPDTESKQVFQDFIDRVSYFSGQYDQSSSYVEFRKHLESVEKKADSSKALRIFYIALPPSVYVTVSSHIYENLYLPGKSRLVIEKPFGKNYQSAVKLKEEVHKHWKEEEIYRIDHYTAKDMVNNFFTLRFANSSSIDAVLNRHSIQSVEIHMYETGGCEGRIGYYDANGVVRDVVQNHLTQIFCIAAMNEPKSASASDVRAEKVNLLKATRPASLKESMLGQYTTSEDGKIPGYLDLEGVPKDSKATTFAASTLHVDNDRWKGVPFVFVSGKRMKKGEVYIKYYFRLKDSGIFSDVKRRRYLILHVQPEEFVNLTCTINKPMTTDLQPIDAYASLNYNEQFKDLMKEKRDGYEILFEDAIRGDPTKFIRYDEVEYAWKIWDEILDSPKKPIPYPAGSDGPEGLEAYMKRHLGHE

SEQ ID NO: 2187 - protein, 456 aa, Schizosaccharomyces pombe
  unsure (1)..(456): unsure at all Xaa locations
MNQTEAAPVVSVSRVCTYCEVQIYKKRITNDXLDLDAHVNEEMPREYWDYENMQEVFGYQDNYEIIRKVGRGKYSEVFEGLNVLNNSKCIIKVLKPVKYKKIKREIKILQNLAGGPNIISLLDIVRDPEVRIKKKSFLYXIVLKLEGEEILCFSVYXVYTTLAFERLISIKLLYLSILIFYRSKTPSLIFEFVDNIDFRTLYPTLSDYDIRYYSYELLKALDFCHSRGIMHRDVKPHNVMIDHKKRKLRLIDWGLAEFYHAGMEYNVRVASRYFKGPELLVDFREYGKLHPLLLNIFTFLFSXPNFRYSLDIWSFGVMFAALIFKKDTFFRGRDNYDQLVKIAKVLGTDELFAYVQKYQIVLDRQYDNILGQYPKRDWYSFVNRDNRSLANDEAIDLLNRLLRYDHQVSYRTXRFLQDLIQSLIFLSGIYCIVTNLAXERLTCQEAMAHPYFQVLK

SEQ ID NO: 2188 - protein, 683 aa, Schizosaccharomyces pombe
MASVAIKEPKTAITPKKKSKASRLCFTPPTNLHNNKKNIFYTRYDCIGEGGFARCFRVKDNYGNIYAAKVIAKRSLQNDKTKLKLFGEIKVHQSMSHPNIVGFIDCFEDSTNIYLILELCEHKSLMELLRKRKQLTEPEVRYLMMQILGALKYMHKKRVIHRDLKLGNIMLDESNNVKIGDFGLAALLMDDEERKMTICGTPNYIAPEILFNSKEGHSFEVDLWSAGVVMYALLIGKPPFQDKEVKTIYRKIKANSYSFPSNVDISAEAKDLISSLLTHDPSIRPSIDDIVDHEFFHTGYMASTLPDEILHSMPIWPSSQSKSSFQRNLDFVASASGVGFGNSAGVEKNKPYALRTDEVDNDRILPSVLSPRDRVNPVMKIGPETKPVPSKLSTALHAARKSTDGSLGSRVKVLREESQSFVPTKSAVTEQVEPIQLIRSLSANTVSRLSKVGNMKSDIWISVKKTALKIGMALEAHTHALTSEDADSEPVLFITKWVDYSNKYGLGYQLSDESVGVHFNDDTSLLFSADEEVVEYALHPKDTEIKPYIYPASKVPESIRSKLQLLKHFKSYMGQNLSKAVQDESFEKPKNSTSNTMLFMQHYLRTRQAIMFRLSNGIFQFNFLDHRKVVISSTARKIIVLDKERERVELPLQEASAFSEDLRSRLKYIRETLESWASKMEVS

SEQ ID NO: 2189 - protein, 808 aa, Schizosaccharomyces pombe
  unsure (1)..(808): unsure at all Xaa locations
SVTRVITPGTLIDENFMNPYESNYILTVVFDPNFFSSDISNQGTAEDKDCFADCKIGLSWLDLSTGEFFTQDSNLQRLAGDLTRISPREIVLDESLKSFTTHPIYSFIQERKYFLSYVENRYQSLDCWNKFLEKEIDPSFIKYCTKLEVTAGCTLISYIADRLQNSHPNIQPPIRVSLNEYMIIGESAMKGLEIRSSLYQNRYTGSLLHAINKTVTKSGSRLLTRRLCAPSTNIVEINNRLDLVEKFKLLPELCSKVINLLKKSNDTHRILQHLLMGRGNSYDLLKMADNFSITKEIHSLLSPLESSSAFRLLLLNMHPHDELKQLINNAVDENALMKQKINEEEETEVIAQEAEEILQDENAQVEIVKKSLSSEFDIRQSFKENWVVKSNFNNNLRKLHEKLQSLFASYDKLQEDLSKRLGKKATLRKSPAKLYYVHLKLSGNETIERFIKKFTQAVLFQSTKSTASFQLPGWTSLGMDLENTKLHIHQEEQRVLKSITDEIVSHHKTLRSLANALDELDISTSLATLAQEQDFVRPVVDDSHAHTVIQGRHPIVEKGLSHKLIPFTPNDCFVGNGNVNIWLITGPNMAGKSTFLRQNAIISILAQIGSFVPASNARIGIVDQIFSRIGSADNLYQQKSTFMVEMMETSFILKNATRRSFVIMDEIGRGTTASDGIAIAYGCLKYLSTINHSRTLFATHAHQLTNLTKSFKNVECYCTNLSIDRVRLSFRXNFFXLDTQDDHTFSFDYKLKKGVNYQSHGLKVAEMAGKFLFAIQLNXRYRIPKNVLLAAEEVLTLLPNTSKPTSMK

SEQ ID NO: 2190 - protein, 407 aa, Schizosaccharomyces pombe
  unsure (1)..(407): unsure at all Xaa locations
MVKLKIRAVQPPPNDSRSSTPATGPPPPIPKIKIKTREPKGPRLTKIRLKRVREPGLGYDSEASDREEDTYIEEQIILRLPPGEDCEYVRKAIENREVGRGADIWVKFKGNDLVTLYYYXQSXDQRRAVVHVNGHLYAAKLVDLPCIIESNKSFDKKVIFKAADICQMLIATERIEHENSVLNTQLKQADYIYPHGLTTPMHWVRQKRFRKRVSNRTIEAVENEVDRLLAMDERAESTSNELIDQAQLARDSSIALSEDTSFDGMAGLRGTSIDRDDQSVQTDMFDGMDEDDLAGQIEQGMLELSQDTRESTAEPRAAGEESASEEEEEEEEEEEEENEADDETRENKRQNRLVREFISELESSIQKRRKDADEATNPILRNRFLADVNRMVTELELKRTQLVDNPE

SEQ ID NO: 2191 - protein, 450 aa, Schizosaccharomyces pombe
MIGPRLCAATPRFPLVSLAHRNSKVFALASSNAVAQRWGKRFYAPIETETPHKVGVEFEESKDRIFTSPQKYVQGRHAFTRSYMYVKKWATKSAVVLADQNVWNICANKIVDSLSQNGMTVTKLVFGGEASLVELDKLRKQCPDDTQVIIGVGGGKTMDSAKYIAHSMNLPSIICPTTASSDAATSSLSVIYTPDGQFQKYSFYPLNPNLIFIDTDVIVRAPVRFLISGIGDALSTWVETESVIRSNSTSFAGGVASIAGRYIARACKDTLEKYALSAILSNTRGVCTEAFENVVEANTLMSGLGFENGGLAAAHAIHNGMTAIHGPVHRLMHGEKVAYGTLVQVVLEDWPLEDFNNLASFMAKCHLPITLEELGIPNVTDEELLMVGRATLRPDESIHNMSKKFNPSQIADAIKAVDSYSQKWQEQTGWTERFRLPPSRHSPHLTDIHP

SEQ ID NO: 2192 - protein, 307 aa, Schizosaccharomyces pombe
  unsure (1)..(307): unsure at all Xaa locations
MCFFFRLVSSFAILRISFLSVFFSLVCIIQRCFMMLITIFCSLLTPIATXITKSIKFCKLRALQVANPQRKAKTPSNHATEELQQSSTNSTTLPTQEAAVETNASASHETSFALPTTSPAASLSISPTKSAAVSSEPNVEADVKSLSSTPAAPQLNSPSHSYEPTTFPSTTSITENLPTIDPTRSTRSSSHIQSLSPESKQTSDGHRPPSPTSITTTSTSIDPSVAFSSKSTLATTRTNAPLSRPSQPTKASPLNKFSALEAIQSARSHARYAYSALDYEDTTTAIHHLKSALKLLEEEEQGNHTAD

SEQ ID NO: 2193 - protein, 935 aa, Schizosaccharomyces pombe
  unsure (1)..(935): unsure at all Xaa locations
MSTKNALNDSQIKLLNSLNDNVTESRFCPFLNXQIIKGIPSTEFVEKFAESLYETQNDGSKKCSXYFVLYRNHFLFIRVLSISKAFFXSLELIVILGLLSIYGFPTSVTVIIAQKNNTSNTIRYIFYYIGMIYXQNVSVSSIDGSIKSFAACLHELNRLKSRVGDRIRDYASASKQVQNEYHQKSNHLREKFAQVLELSRHLEDNVNDMRSGLVDAGQELERAENNRKRILSSAELLRYYLEFRSGKPQTLMDFFRTNNHDKMLLCAQRTRQLLALANEVDLPDSSETLARIEKFSEFLETNFLKFFNNEYRKPNWKGMASFGTILQEFNGGASVVREFVNQHEFFIAADKVQSRQGLEQDPIWLILPDPTQKIPPLIQTLSSLFSELCSVIEGDCAVIKRVFPNPELVLQTFFQRIFGQSIQNRLEEVMEIAKGKSNLAYLRTLQTVVSSLRKLVADLKTILENRGFSVSDNSPLSLALNQYMEDLLVPFIEVDDYLKREEHSLRSLFRLSLYKYTSYKIRLETPEPGLLRSLMTPLQGNMVAPTGVHSQFNTKTEGFLLRIADIQENLIQSGSFITEDYITIEKNHSHLNSEKVYSFIGWHAEALNRASILISSQDLSVVISSLVNLLDKLIREDYVFKELSSIQSYISSHDKSKNLDLHYLVDIRECKKIMGYFSAYLMSIVIPFTGVTASSRRETVNILSSSISVIECAVNDVFYATVHALGDHLEIILSPYRQISYAMTEEQIDSSTELRQSMTRNVQNYLDYIKNLYHRLGPYDPSLLALKQKTATMLAAMLISFAFRSKVTAAGALLLQKYAQFFVFYRKXLIYXLYLVIINFFHSTLTSWGIDTVDAKFKLILQLLSLLMVKXVNIFXERKFVNIXNXRLPAVMQDKRKAGFSEMNIHEVLRLRFDLPENLKLQLNKEEALLPPKSS

SEQ ID NO: 2194 - protein, 252 aa, Schizosaccharomyces pombe
MATEANISATSANPQSQGENLKTFEIYRWNPEKPEVKPKLQKYTVDLTKCGPMVLDALIKIKNEQDPTLTFRRSCREGICGSCAMNINGSNTLACICNIKKDNKPTKIYPLPHCFIVKDLVPDLTYFYKQYKSIEPWLQNDNIPKDKEFYQSRADRAKLDGLYECILCACCSTSCPSYWWNSEEYLGPAVLMQAYRWIIDSRDQATAKRLDVMQNSMSVYRCHTIMNCARTCPKGLNPGLAIAKVKALMATA

SEQ ID NO: 2195 - protein, 313 aa, Schizosaccharomyces pombe
  unsure (1)..(313): unsure at all Xaa locations
MCQEDEYDYLFKTVLIGDSGVGKSNLLMRFTRNEFNIESKSTIGVEFATRNIVLDNKKIKAQIWDTAGQERYRAITSAYYRGAVGALIVYDITKQSSFDNVGRWLKELREHADSNIVIMLVGNKTDLLHLRAVSTEEAQAFAGKXFCWXDMELFGREVVKPALAALTLFRSSFLAILNCLKRRRSLFVLKYYSPCRFHSLFIKHICLPLIRHNFLNIINXCFYAENNLSFIETSAMDASNVEEAFQTVLTGMFIRTCFDFFKFYXSSVEIFRIVSNRSLEAGDDGVHPTAGQTLNIAPTMNDLNKKKSSSQCC

SEQ ID NO: 2196 - protein, 328 aa, Schizosaccharomyces pombe
  unsure (1)..(328): unsure at all Xaa locations
MSESRQELLAWINQVRFNILVRLKKLSAYXLILKVTSLGLTRIEDCGKGYAMIQIFDSIYQDIPLKKVNFECNNEYQYINNWKVLQQVFLKKGIDKVVDPERLSRCKMQDNLEFVQWAKRFWDQYYPGGDYDALARRGNRGPANTRVMNSSAGATGPSRRRQVSSGSSTPSMTKSSANNNNVSSTANTAAVLRAKQAQQQITSLETQLYEVNETMFGLERERDFYFNKLREIEILVQTHLTTSPMSMENMLERIQAILYSTEDGFELPPDQPADLTTALTDHDTNNVAEEAQMTDLKDSETQRVPSAPDFVHARLQSLEVDDDENITF

SEQ ID NO: 2197 - protein, 326 aa, Schizosaccharomyces pombe
MKDDHDAWEPEELVSDNNSSENELQEDQNSSITFLPPSVNKSNPAKSNYYHSTVTDDISKSQPYRLGVDEAGRGPVLGPMVYAVAYCPVDFDLTNYGFADSKTLASLKREELLKLICNKSNELGKNVGWSTMSISARELAAGMLRYRNKYNLNLQAHDTTIDLIKKVYESGINVTEIYVDTVGPPISYQEKLQAHFPQAKVTVTKKADSLFPIVSLASICAKVTRDIQLECARESIRTENWGSGYSSDARTTEWLKVNVDKIFGWKGDIVRYSWKTAKDLLELPSKSQSSIEIDWHEDDDTPTLNFTQKKKPNPASRSWFGSEFYF

SEQ ID NO: 2198 - protein, 1113 aa, Schizosaccharomyces pombe
IEDKWQLLPAFLKVKGLVKQHLDSYNYFVDVDLKKIVQANEKVTSDVEPWFYLKYLDIRVGAPVRTDADAIQASISPHECRLRDLTYGANIYVDIEYTRGKQVVRRRNVPIGRMPVMLRSNKCVLSGKNEMEMAALNECPLDPGGYFIVKGTEKVILVQEQLSKNRIIVEAEPKKGLWQASVTSSTHERKSKTYVITKNGKLYLKHNSVADDIPIVVVLKAMGLQSDQEIFELVAGAEASYQDLFAPSIEECAKLNIYTAQQALEYIGARVKVNRRAGANRLPPHEEALEVLAAVVLAHINVFNLEFRPKAVYIGIMARRVLMAMVDPLQVDDRDYVGNKRLELAGQLLALLFEDLFKKFNSDLKLNIDKVLKKPHRTQEFDAYNQLTVHSDHITQGMVRALSTGNWSLKRFKMERAGVTHVLSRLSYISALGMMTRITSQFEKTRKVSGPRSLQASQFGMLCTSDTPEGEACGLVKNLALMTHITTDEEEEPIIKLAYAFGIEDIHVISGRELHSHGTYLVYLNGAILGISRYPSLFVASFRKLRRSGKISPFIGIFINTHQRAVFISTDGGRICRPLIIVQNGLPKVESKHIRLLKEGKWGFEDFLKQGLVEYVDVNEENDSLISVYERDITPDTTHLEIEPFTILGAVAGLIPYPHHNQSPRNTYQCAMGKQAIGAIAYNQLQRIDTLLYLMVYPQQPMVKTKTIELIGYDKLPAGQNATVAIMSYSGYDIEDALVLNKSSIDRGFGRCQVFHKHSVIVRKYPNGTHDRIGDPQRDPETGEVVWKHGVVEDDGLAGVGCRVQPGQIYVNKQTPTNALDNSITLGHTQTVESGYKATPMTYKAPEPGYIDKVMLTTTDSDQTLIKVLMRQTRRPELGDKFSSRHGQKGVCGVIVQQEDMPFNDQGICPDIIMNPHGFPSRMTVGKMIELLSGKVGVLRGTLEYGTCFGGTKVEDASRILVEHGYNYSGKDMLTSGITGETLEAYIFMGPIYYQKLKHMVMDKMHARARGPRAVLTRQPTEGRSRDGGLRLGEMERDCLIAYGASQLLLERLMISSDACDVDVCGQCGLLGYKGWCNSCQSTREVVKMTIPYAAKLLFQELLSMNIVPRLAL

SEQ ID NO: 2199 - protein, 885 aa, Schizosaccharomyces pombe
MLIELQQIVKSGLVRNGAKHCTKRSLLCSNASVIASKRFQGSFAPGQQQPLNPLAKPIEQDRDAIIRILSSIGSRREVEQYLRYFTSFEAQRFAIIKVGGAIITDELDTLAQSLAFLNHVGLYPIVVHGAGPQLNKILASRNVEPEYSDGIRITDAETLSVARKVFLEENAKLVDALEKLGTRARPITGGVFQAEYLDKEKYKYVGKIVKVNKAPIEHSIRAGTLPILTSMAETASGQLLNVNADITAGELARVLKPLKVVYLNEKGGLINGETKKKISSIYLDREYDGLMKQPWVKYGTKLKIKEIKELLDTLPRTSSVAIISTKDLQKELFTESGAGTLISRGFVINKHDSLDSIPDAALENLIIQKNSLAAPSESLKQFKDTLKDRKLRIYSDSFNESVAIVDTTDSSLPVLLAFGAADNNWLNNVVDSILTTLKADFPSLLWRLQPSAKNLEWFFSKSEGTLFANNFYYFWYGVKDLNKISKFIQSDKPFADAIIQTQSTKPPTASSTTNNPSSSQINQKRSYSTSSLFSKNKKMNRSLFLKGGKRFFSAEAQKTQKPLKAVSSKPAKVVLLGARGYTGKNLIGLINTHPYLELSHVSSRELEGTKLPGYTKKEIQYVNLSTDDVKKLEEEGAVDAWVMALPNGVCKPYVDALTSANGKSVIVDLSADYRFEPSWQYGLPELNDREALRNSKRISNPGCYATGSQVGLTPILSLIDGQPSIFGVSGYSGAGTKPSPKNDLNVLTNNLIPYSLTDHIHEREISYRLKQPVAFIPHVAQWFQGITLTINVPLKKSITSRELRNLYQDRYNGEPLIHVQGDVPLVKDNAHKHHVSVGGFGVHSSGKRAVIVVTIDNLLKGAATQALQNLNLSCGYDEYAGIHLD

SEQ ID NO: 2200 - protein, 327 aa, Schizosaccharomyces pombe
MSFKKFPRHLLSIRDLSRGEIVKLIDRSSEIKQAYKQNFQNRRSVQMSGLSSQNVAMIFSKRSTRTRVSVESAVSCLGGNAMFLGKDDIQLGVNESLYDTSKVISSMVSGIVARVNKYSDVATLAKHASCPVINGLCDTFHPLQALADLLTIKETFKSFDGLKVAWVGDANNVLHDLMIANAKVGIHTSVAKPKDVNVRDDILSIVNEAANENGSTFEIVNDPKVAVKNADIVVTDTWISMGQEAEKEQRLKQFTGFQVTGEIMKLAKPSCKFMHCLPRHPEEVSDEVFYGENSLVFQEAENRKWTTVAVLEALLVNRGEILPPASA

SEQ ID NO: 2201 - protein, 193 aa, Schizosaccharomyces pombe
MTVTPINPTNQPYKYVFVVIGPAGSGKTTMAKAVSEKLGFEYIEGDDLHPKANIEKMSQGHPLNDNDRWGWLHNCGGACAMELDKESIKGVVLTCSALKRSYRDILRSSLEHRPAILRFIYLAASRETLIKRTTSRKNHYMKADMVESQLAILEAPTADEKDVITISVENGKEQSEEECLDIVHKMVNENKQP

SEQ ID NO: 2202 - protein, 353 aa, Schizosaccharomyces pombe
VLANKSCCGAVVTAFSVIGIVFTILKFTSFASFVYKTFFAKGVKVRKLLYQSLDSALTSLLSVYGAKKGYWAVVTGATDGIGKEYATQLAMSGFNVVLISRTQEKLDALAKELETVAKVKTRTIAIDYTKTTAETFEKLHQDLVGTPITVLINNVGQSHYMPTSFAETTVKEMDDIMHINCFGTLHTTKAVLSIMLRERQKNEKGPRCLILTMGSFAGLLPSPYLSTYAGSKAFLSNWSASLGEEVKKQGIDVWCFNSYLVVSAMSKVRRPTLTIPTPKKFVRAALSSIGLQRGGTNPYISQPYPSHAVMSWSLEQLLGSAKGFVVSQVAAMHLSIRKRALRKEARLQAQNQA

SEQ ID NO: 2203 - protein, 335 aa, Schizosaccharomyces pombe
MHEKGDKNLLAILVFSFVSFYFFLFCSLQNDENTAFMNLLHLPLPLLTCLTKDFLAGVSGGVAQVLVGQPFDCVKVRLQSQSNVSPIYNNALDCVKKISKNEGLAAFYKGTVLPLLGIGFCVSIQFTTFEYCKRFFSRDGTPVTMPQYYVSGAISGLANSFLVGPVEHVRIRLQIQTGKNVLYHGPWDCIKKISSQYGLSGIMKGYNPTAAREAHGLGMYFLAYEALVKNTMAKHHLTDRSQTPGWKLCVFGAGAGYAMWLAAYPFDIVKSKIQTDGFLSKATYKNSWQCAKGIYTKAGLRGFYRGFVPVLVRAAPANAVTFYVYETVSQHIRHL

SEQ ID NO: 2204 - protein, 466 aa, Schizosaccharomyces pombe
  unsure (1)..(466): unsure at all Xaa locations
DRLNWILEKYFTYLRPSWLKKLGTRRAYELIKIEDQNTDYSCIGPVNAAMNTVCVYFHEGPSSKAFQKHIQRLHDFMWVQPEGMLMRGTNGLQVWETSFTLQALVESGLYEKEAFKPDIAKALEFLDRQQVRFFFSKYVELDDDXLXFRIRTQYEGSGYRYNSLGAWPFSNITQGYTVSDTTSEALRAVLLVQSLPDFEKLVDIPRLRLSVDVILGMQNENLGFASYEPARTGEWMELLNPAEVFGNIMVEYSYPECTTSVILALRAFTKYDPGYRRDEIENTIENALEYVVKMQRPDGSWYGSWAICFTYAAMFATGSLASAGRYYENCPVQKKACEFLLSKQRPDGGWSESYMVWIQNRXWEIDXRMIXACVTGVYTETESSLVTQTGWALDALINAKYPDRKPIEKGIKFLMASQKSDGSWQQKSMEGIFNKNVAIAYPNYKLYFSIYTLGKFAKQYGNYLTI

SEQ ID NO: 2205 - protein, 644 aa, Schizosaccharomyces pombe
MSKSIGIDLGTTYSCVGHFSNNRVEIIANDQGNRTTPSYVAFTDTERLIGDAAKNQVAMNPHNTIFDAKRLIGRRFNDPEVQSDMKHWPFKVIEKDGKPLIQVEFKGETKTFTPEEISSMVLLKMRESAEAFLGGKVTDAVVTVPAYFNDSQRQATKDAGLIAGLNVLRIINEPTAAAIAYGLDRSNQHETNVLIFDLGGGTFDVSLLTIEEGIFEVKATAGDTHLGGEDFDSRLVNHFAQEFKRKNKKDITGNARAVRRLRTACERAKRTLSSSAQASIEIDSLYEGIDFYTSITRARFEELCADLFRNTMEPVEKVLRDSKIDKSSVNEIVLVGGSTRIPRIQKLVSDFFNGKEPCKSINPDEAVAYGAAVQAAILVGDTSEKTQDLLLLDVAPLSLGIETAGGVMTPLIKRNTTIPTKKSEVFSTYADNQPGVLIQVFEGERARTKDCNLLGKFELSGIPPAPRGVPQIEVTFDVDANGILNVSALEKGTGKTQKITITNDKGRLSKEEIDRMVSEAEKYKAEDEAETSRIQAKNHLESYAYSLRNSLDDPNLKDKVDASDKEAIDKAVKETIEWLDHNTTAAKDEYEDKQKELEGVANPIMAKIYQAGGAPGGAPGGMPGGAPGGAPGGADNGPEVEEVD

SEQ ID NO: 2206 - protein, 537 aa, Schizosaccharomyces pombe
MTDTPRILITPSPLSDISTTINKPNVHPSMSLLKALPECRLVVKSKGDKNNANVVEFPLDRHKQLLIAGKVYHDYKFKPRKSIFDRVTDPNYFAKSEFRGFYVLFWLSMAAWVLQLYARSYWQRDTLLGLPLARQVFRQFFVLFSSDFLMICLSFFSYGLQVCIEKNMIRWANLGYTIQTLWQGFYMVLAVYWVKHRDFPIVQCVFFTLHCAVLIMKQFSYSHHMGYISEIRILHNEYEKLLKFVRECLNSTEKDEKYTFELTFPNKPAETISTLQAEEIVALTAKYLSRQMRSEVGNVVYPDNINFFNYVDYLLVPSLVYSMEFPRVAHFRWHYMAFKAGSTFGLLALTLALVDWYFVPSAVAVKDLDFIGKLRIAPLLMNKIMFPAIILYLIMFYLIFDCILNAFAEITKFADRGFYGAWWNTVTWDEFSREWNKPVHVFLMRHVYHSSISGFKLKKSHAVLLTFLISALVHEFVMLLATGKFRCYILTFQLLQIPLYDLQQMFAFKKRDILGNVFFWIGMFTGPSFLCILYIVF

SEQ ID NO: 2207 - protein, 266 aa, Schizosaccharomyces pombe
MSSIDTPANKLQAKTLFHPEHLEYINKQLSELSPQDILKWCRWTLPSLFQTSALGLSGLVIMDMLSKMDMNVPLIFINTLHHFPETLDLLEKVKTKYPNVPVHVYRCAEAANEKEFAQKFGEKLWETDESRYDFLVKVEPASRAYSDLNVLAVFTGRRRSQGGERGSLPIVQLDGPVLKINPLANWSFTEVHNYIITNNVPYNELLNKGYRSVGDWHSTQPVREGEDERAGRWRGREKTECGLHSHPQSKFAQYMAELKKKETADQ

SEQ ID NO: 2208 - protein, 456 aa, Schizosaccharomyces pombe
MVNFASEVDKNNAFDSAHPSRKCKGSLDCNDPDPIFRHKVLVIIHKLAISSWNRIPLTLCNKLHIKRISGALTNAVYYVAPPEGYHAPKLLLRIYGPHVELFINRQVELENLKRLARHNIGPYLIGEFSNGRFEQYMESTTLTCKTIRDPKLSIYVGRRLCELHNFILLHPHEVLEMPAAWKNCLVWLPKAKAKILGRKHSLAITSEFMKTLEEDFNAYYNWFVEWSRDKKDWFGLKMVFSHNDTQYGNLLKIKAKKRSIPLSQKHRTLVPVDFEYAGPNLCAFDLANYFAEWMADYHHPTHNYLMDRSRYPDFNARKLVYHAYVEQSAVINDLLEIEDASLLKTDISDELKNTFEKQIMNLEESVRAISPAANIGWALWGILQCLEEDDEWEDLSVSSQVADRPEKQLVEGSTVPPIGTSSFDYIGYSSEKFDLFYEGCAALGLNGRNRSTFSYA

SEQ ID NO: 2209 - protein, 473 aa, Schizosaccharomyces pombe
MTNTRLASTRRLASSLLSQASLRSRQLNPLFTSSYSTRSSSLKDRLAELIPEKQAEIKKFRAEHGQDVIGEVTINQMYGGARGVRSLIWEGSVLDPNEGIRFRGYTIPECQKLLPSSPNGKQPLPESLFWLLVTGEIPTLSQVQALSADWAARSQLPKFVEELIDRCPPTLHPMAQFSLAVTALEHDSAFAKAYERGMNKHDYWKYEYEDCMDLIAKTVPIAGRIYRNLYRDGVVAPIQMDKDHSYNFANVLGFANNEEFVELMRLYLTIHADHEGGNVSAHTGHLVGSALSSPFLSMAASLNGLAGPLHGLANQEVLNFLITMKKEIGDDLSEETIKSYLWKLLNSGRVVPGYGHAVLRKTDPRYTAQREFALEHLPKDPMFQLVSRLYEIVPGVLTEHGKTKNPYPNVDSHSGVLLQYYGLKEQSFYTVLFGVSRTLGVASQLIWDRALGLPIERPKSFSTEALKKMVETK

SEQ ID NO: 2210 - protein, 1080 aa, Schizosaccharomyces pombe
  unsure (1)..(1080): unsure at all Xaa locations
MDSRLNRIQSKMKLWIKDKNLSNPSIPLKVLNKSFRSSRQSSVSNGHGLYSLDRDETESLMSSHEASNAGISLDSSFRVIQVGQPEPQYGNNAVTNTKYDLFTFLPKCLYEQFRYFYNMYFLLVSLSQLIPPLKIGYLSTYIAPLIFVLLITLTKEAVDDLKRRRRDSYANNEIYTVNDSPCAAQNIQAGDVVYIAKDQRIPADMILLETTVGNEAFIRTDQLDGETDWKLRIPCSNQHTEGIVHADAPIKSVHHFYGTFTLNNQKRPISVDHTLWANTVLASDGVYGVVVYTGKDTRQSMNSSKAKTKVGLLEKEINFYSKILCTFVLVLSIGLTFSHGIKTDWYISVFRYLILFSSIIPINLRVNLDLAKIVHSKNTESDPNLPGVVVRSSNIPEELGRIEYVLTDKTGTLTQNEMEMKKLHVGTMGFSAESMDVVQACIQNYSTPIPLSEDSKTLVRNLVLALSLCHNVTPSKGHDGVVSYQAASPDEVAIVKWTSTLGLVLTNRTRDAITLNNNVYKILNIFPFKSETKRMGIIVQSPDEKITFYLKGADSIMQNFVKPSFWLEEECGNLAREGLRTLVVAKKDLSAEEYSAFSLAHSDASLSFSNSRDKKMEEIVSRYLENDMDLLGLTGVEDKLQKDVKITLELLRNAGIHVWMLTGDKVETARCIAISSRLVSRGQYIHTINQLSSREEAHNHLLTLRNKPDSCLIIDGESMEFCIGYLQNEFIDIVSDLSSVVICRCTPTQKANMTRLIQEKKQASVCCIGDGGNDVGMIQVANVGIGIVGKEGQQASLAADYSVKEFSHVSRLLLWHGRISYKQTSKLAMFVIHRGLLISVCQVVYSVISAFEPIALFQGLLLVGYSTMYTMLPVFSIVYDRDVSEKLVFLFPELYKEMREQKCFSYKNFISCVLISVYQGMLNFISLPYLQTXGLIIQLFTFYLIGFEEEGKMLAVCFSCLIFNELIMVALQINTWXVYLSHLCVGIYTNDVREQTIVMSELLTLMMYILSVPFLTNYFGMFNIFTKNFREANTYRLKFLLGLKFYWVSALILFISLLPVWCGKALKRKLKPSSYAKLQR

SEQ ID NO: 2211 - protein, 356 aa, Schizosaccharomyces pombe
MNKILFYFFFFLTLILSATVYLFGGPMMLFFINYKTDLLKVDDVYNHEIYSNQSAAIPKIIHQTWKTNEIPEKWVGAQKSCIDLHPDYEYVLWTDESMREFIATDYPWFLTQYDSYPYNIERADVVRYFILYKYGGIYLDLDVGCNRTLDPLLHYPAWVRRTSPSGISNNVMGFAKGHPFLLQVVRNLPRFAFNYHFPYLTVMYSTGPLFLSIIWSAWRKLPDAEAWHHIWVMVPELYEKSHHAFFEIYEGSSWHDSDAGFVFYMLHHWAIFTFLGFLTFFIVVYFIFGYALKPAARVSRTGRRVFSSPFSKTSPSRWKIFHRFTSSNEKYDQTRSDSLPFMSDYDLESQTQSHSP

SEQ ID NO: 2212 - protein, 958 aa, Schizosaccharomyces pombe
  unsure (1)..(958): unsure at all Xaa locations
DHLLSYNRSAFDLFNSEKPLSPEKISTMLQHLQMRLSIEQQCVSGIEKIMSLYSKEQKDKTDVIIKLKEGKQKVNLLKRSLKRYNELHIPFDISTPSSEEKQQASGLNFRGLAKPISGTLKVTIHSLRNIEHTSFLQTHSFTMPSYAVLYVDDAQVAKSRISQTDTWDETFIFDVHRAKEFQIIIYEKKKDFDIPIALILIPTTIIAEELRRKRNIQEMSETSWKPSIAESASRSDEKGSKSDPINAPNSSSSISTNSPLAPTAYYKLLSKSWLSLEPVGQICISLSFSKRTTKRQFPETGLGRQGAIRQKKEDVVASQVGHQFVQRQFYQIMRCAVCAELFSYSPGLQCENCSFVCHKKCVTKVLASCIAQSNSEKSDFGGLRYRIPHRFEPFNSLGAQWCAHCGFFLPLRRKDCFKCVECGITCHGQCAHLIPDYCGMSNDLKHQLLTELEVSKRPKKPELPNQENKTTNEKVYRKPLSSQNTFDTLPTISQGLLAATQPVTSVLNTSPLPKTPEKDRSLNVTPSSSTPTPASVLAPPSSASLSSSKDANRSVPESPRREKKNRVTLDDFTFLAVLGKGNFGKVMLAEYKVNKKFYAIKVLKKEAILKNEELESLKTEKHVFEVANKEKHPFLLNLFASFQTSTRVYFVMEYILGGDLMVHIQRQQFSVKRARXYFNLYFYFYFYFLLTPXFYGAEVCLALKYFHENGIAYRDLKLDNILLCPDGHIRIADYGLCKENMLLGNTTSTFCGTPEFMAPEVRRNLFWFILSNENRFLLEQQYSKDVDWWAFGVLMYQMLLGQSPFKGEDEEEIFDAILSDEPLFPINMPADAVSLLRGVCKFLNMLTNSKNSFXTRDPNQRLGSGPKDANEVMAHPFFASIVWDDLYNKLYEPSYKPLINDPRDLNNFDEEFTSMTIVKIWLITNDRLGACPTLTPVNTVLTRQQQECFRGFSSFATE

SEQ ID NO: 2213 - protein, 366 aa, Schizosaccharomyces pombe
  unsure (1)..(366): unsure at all Xaa locations
MIDLDNIIERLYEKQLIAESVIAYLCSLAKEVLMQESNVVRLSTPITVVGDIHGYAXIQYCKKFILCGHSAYKVYSQFDDLLEIFRIGGPCPYTNYLFLGKLKXCSLESHXLITTNHXNXTLRTQHMLYYSLLTIXRDYVDRGYYSIETITLLICLKLRYPKRITLLRGNHESRGITQTYGFYSECLRKYGNANVWKYFTDIFDFLTLSATIDDTIFCVHGGLSPSIQHIDQILVLDRFREFPHEGPMADLVWSDPDPSVQEFSLSPRGAGFSFGEVIVTKFLEYNNMKHILRAHQLCSEGYQILFEKKLSTVWSAPNYCYRCANLASILQIDTDQSRFFNVFDAAPNQETPFVEPAAKVTAEYFL

SEQ ID NO: 2214 - protein, 768 aa, Schizosaccharomyces pombe
  unsure (1)..(768): unsure at all Xaa locations
MTEIFGKLHRSSNSENTNQASPSTIQSHSTQPVLSNDHSTKVNDYEGKEGASSNGYDPVFMSDRMKMRYNEITAQLHKEQVCYNXFFAXKTIFPIAFFIVFFKNHCLHKLLFTWLTYHSSLKEDKESGSNSSESNGITPMGTYSEKPKLLQSRTPPSSCYIRHDTVVPKDKNGQHAFGRLYVRLHQGRDLNVKSVNAQPYAVITFEKTQVMVPPPFKDIDGGIPISIPSKNRPLAGSASGSSSGLHSELMLADVRCPHWDFETVFDVTKMKSQMVVSVYDKYEDDKFLGSVKITPIFLHEYVQEAWYKLEPLDLTKSLEGEIKVETIYEHIEHVRYGPEDFTALRLIGKGKAALSXKIYGILTLFRHFGQVYLVRKNDTNRIYAMKKISKKLIVRKKEVTHTLGERNILVRTSLDESPFIVGLKFSFQTASDLYLITDYMSGGELFWHLQHEGRFPEQRAKFYIAELVLALEHLHKHDIIYRDLKPENILLDADGHIALCDFGLSKANLSANATTNTFCGTTEYLAPEVLLEDKGYTKQVDFWSLGVLVFEMCCGWSPFYAPDVQQMYRNIAFGKVRFPKGVLSSEGRSFVRGLLNRNPNHRLGAVADTTELKEHPFFADINWDLLSKKKVQPPFKPNVQNDLDVSNFDKEFTNTNVKNINIVSNVDPANASTPLSNTIQDRFRGFTLXSLFLNIXPSTNLKLYSVNKSIDEQFQNLGLQENEETDNLHACRTTTHSSVNSINSHGNPRTVDANDPVADTVFGETFEA

SEQ ID NO: 2215 - protein, 482 aa, Schizosaccharomyces pombe
  unsure (1)..(482): unsure at all Xaa locations
MTVQIDELDDKDLDEIIANGTLDGAXVXILNNLNYGLDXASKIMKILXQFSYSKQGAVDSETMIQYYRHLFPWKYLFQWLNHGPVVTNDFAHREFAFTLPNDAYIRYLSFSNWEELKKEALNLCPSRFEVGPVYSANPRDRKTIRKSTFHPLKKELVFDIDMTDYDDVRTCCSKTNICEKCWPFITIAVQVLDICFHEDFGFKHILWVYSGRRGIHAWICDEIACSLDDRSRRMIASYLQVVVGNPQGGVRLINNLKRPLHPHLTRSLNILKSAFVKIVLEDQDPWASKEGAENLLKLLPDKDLASALRKKWEVDPERSSKNKWSDIDTVLASGSIASISPSVIAIAKQDIVLTYLYPRLDVEVSRHLNHLLKSPFCVHPGTSRVCVPIDIERMDSFNPLKVPTVNDLLQELDKNSQNDNGHGPTMETNTTENQKDNARGQSNKGHGFSTSLNPYTLYFKSFSSQLFKETVGNKRKHENLEF

SEQ ID NO: 2216 - protein, 464 aa, Schizosaccharomyces pombe
  unsure (1)..(464): unsure at all Xaa locations
MPEQLVLRATLEGHSGWVTSLSTAPENPDILLSGSRDKSIILVCKSKKFQCGNCXQSNNEVVQYVNYTVIAVEKPDLKILPNXHIRXKYXALSIAFLLXYXFSNIYFSWNLVRDDVNYGVAQRRLTGHSHFVSDCALSFDSHYALSASWDKTIRLWDLEKGECTHQFVGHTSDVLSVSISPDNRQVVSGSRDKTIKIWNIIGNCKYTITDGGHSDWVSCVRFSPNPDNLTFVSAGWDKAVKVSIILVYYCNTXSLDVYGYWLCSFXSSKEXCLDXYLLLRRPYGSMRQNKSPYVLTFPIVILILALAITIYKFIHSNXLMLTLFKGLDLETFSLRTSHYGHTGYVSAVTISPDGSLCASGGRDGTLMLWDLNESTHLYSLEAKANINALVFSPNRYWLCAATGSSIRIFDLETQEKVDELTVDFVGVGKKSSEPECISLTWSPDGQTLFSGWTDNLIRVWQVTK

SEQ ID NO: 2217 - protein, 310 aa, Schizosaccharomyces pombe
DLNGALPEKKKKPKKSVAFDDEVDAVSKDGPEASSAGATDEDDSERKSSAKDLTTPVTEGEVDELKDMFSSMKKKKKSKKSSASAEEQTEDITTESGELDFSSMKKKKKKKKSADLSAFEKELEASSTGDATSDLSKQTFDSENMGEHAWLKSDRDYYYPELLNRFFTLLRTNNPELAGEKRKYTIVPPSVHREGKKTIFANISDISKRMHRSLDHVIQFLFAELGTSGSVDGSSRLIIKGRFQQKQIENVLRRYIVEYVTCKTCKSPDTILTKENRIFFMTCEACGSVRSVQAIKTGYQAQIGKRKHVS

SEQ ID NO: 2218 - protein, 652 aa, Schizosaccharomyces pombe
  unsure (1)..(652): unsure at all Xaa locations
MNQTETLIPAARNVIRVLGYEIEYSKWTICFALLAVCIAYDQSMLKIENYFFVSTAAXIPRXKASFSLDLSNXFIYFRFADANESAIRELVTMSLCANFINGAXXSNHSFXXXIYYDLIFTMDFNCDLXVANSLFSMFIXSIDMYRVILTFFXVSYQMQKGHIPGPRFKIPFMGSFLDSMKPTFEKYNAKWQTGPLSCVSVFHKFVVIASERDLARKILNSPSYVQPCVVDAGKKILKHTNWVFLDGRDHIEYRKGLNGLFTTRALASYLPAQEAVYNKYFKEFLAHSKDDYAQYMIPFRDINVATSCRTFCGYYISDDAIKHIADEYWKITAAMELVNFPIVLPFTKVWYGIQSRKVVMRYFMKAAAESRKNMEAGNAPACMMEEWIHEMIETRKYKSENKEGAEKPSVLIREFSDEEISLTFLSFLFASQDATSSAMTWLFQLLADHPDVLQKVREEQLRIRKGDIDVPLSLDLMEKMTYTRAVVKECLRLRPPVLMVPYRVKKAFPITPDYTVPKDAMVIPTLYGALHDSKVYPEPETFNPDRWAPNGLAEQSPKNWMVFGNGPHVCLGQRYAVNHLIACIGKASIMLDWKHKRTPDSDTQMIFATTFPQDMCYLKFSPFDASTVDWKNSKEAFSNEAVSAATVETESA

SEQ ID NO: 2219 - protein, 335 aa, Schizosaccharomyces pombe
MNFSKTLLKNSKDGISSVIFSPSVKNELIAGCWDGSLLHYQISENPELLGKYDLSSPILSLEYTDEKTALVGNLDGTVTTLDLNTRNHEFLGNHGKGVSCISKLRLESKIYILLASYSINILDCFISGSWDKSFRVWDVRVKQPVEGQDIGKKIFASSSRDNILVLGCSERENLVYDIRNLKLPFQRRPSSFKYMTRSVCCNQNFEGFVSSSIEGRTSVEYINPSQEAQSKNFTFKCHRQIQKDYDIVYPVNDLKFHPIHQTLATAGGDGVVAFWDIQVRKRLRVLNPSKINISSISFNVDGSMLAIATCAQEEAAGNIYVHALESNFAAPKLKS

SEQ ID NO: 2220 - protein, 316 aa, Schizosaccharomyces pombe
FLGASDSGKSTISKQIKILNKNGFSQEEIMTFIPVIRRNLLESAKTLVKIIVQKGINLDPLGTHNCEIIEKFNPTPGELINANIGQAITSLWSANSVRSCTYGNDSVLIDSAPYFFSRADEICSRHYVPTIDDILRSRNSTLGISEISFTLDHLQIRMFDVGGQRTERRKWIYCFENVNSIIFCVSLNDYDKKLYERAAPERNRLVESISLFDSIINSQWFMHSSIILFLNKFDLFRKKLEHVPFQDYFPQYEGKNSVKSITRYILWLFVNPSINRAKHNIYPHITTAVDTSNIKVVFSAVKETILQHSLKEAGMF

SEQ ID NO: 2221 - protein, 325 aa, Schizosaccharomyces pombe
MSYQQRANDSMNSAKQYSSSAGAVHNSDEPFSSSGAPQNRNFDTSYTSEIPSNSSRAANDMGTDIGSGDPYAGMTSDTKKGFNSVESRKKEQSDVRGGDTSYSRRHDDSSYSSNKYSTGGNDSYSSGGRNEDYSTSGGSYTTDPSRTDDTASYGQSQYNQSRKTTQGGDYGEDYSQSYPTDTYGSRQKATPSDTVGGGAYDYSSSGSHTHGGSHGTEHRGGSYGNDNTANKTRGAVSSAGYSGEGYGKGTYATDTTAEANRRAATGTRNARTTAQRNAQLAEDEHVSMGDKMKGNMEKMAGKLTRDPELVQKGEDLKTGHHSERY

SEQ ID NO: 2222 - protein, 408 aa, Schizosaccharomyces pombe
MNTELDMQNFEHIKFLENQISEDHFRWKKNSKHLYNLLITRTLTWPSLSIQWLSAMESITEKAVLKNRLLLGTHAAEGMPNFLQLADLDLPDFNQTILDPVKHYNEDTGELGGYSMQHSCKFQISQRILHNGDVNRVRHMPQNPNIIATMSSCGNAYIFDRTKYTSMPAEEFLPNISLIGHKKEGFGLSWNRQQNCRLVTAANDSKILEWDLNNFSRDTRCLTPVKDFHYDDSPVNDVEYHPHHTNLYIAVNDNGIAFICDNRLQQTCSKTVKASNPLFSVRHNPSIATLFALGSEQDLQLWDLRNLNKSVFNTSEDLSDNRLKVPSRLTLGGTSLSWSWRHSGRIVSACQEYCYVWNFNKANPLEFVHAGHKGTVNEVDFDPFEAQCIASVADDNELHIWKPNVIVN

SEQ ID NO: 2223 - protein, 513 aa, Schizosaccharomyces pombe
MKHNEVFGWTLKVLSFLLVVIPANALDKHGWRKQSIYSLLTDRFASTNPKPCNPEDREYCGGNWRGIIDKLDYIQGMGFTAIWISPIIKNIEGRTKYGEAYHGYWPQDLYTLNPHFGTEQDLIDLADALHDRGMYLMVDTVVNHMGSSDPRNIDYGIYRPFNQSSHYHPMCPIEQDKPLSLEQCWIGTEDMTLPDIDTENPQIIETLYNFIHDQVKQFKIDGLRVDATKHVRRTFWPGFCESAGVYCQGEEWTGQADLFCEWQEYMDGLHNFPVQGVAAESVIPLNDRALRKTAIAMNLVAHHCKDSTLLGLFLESQDAPRLAALNNDYTVLKNAMTLNLMSDGIPIVFYGQEQMFNGSHDPVNRPALWDQGYNTDGPLYQYTSKVNKIRRDLINSEDGEIYIRSITHAIMIGDHVMVMYKGPVITFITNYGAVDKEYLIKMPGSETMIDLLTCTLIEVEGEVMRTSIKKGEPKILYPYQLAFRDGFCQEQITLQEIDDVFMGRNEINGPDRK

SEQ ID NO: 2224 - protein, 1557 aa, Schizosaccharomyces pombe
IIKKLVDAEKHCNAVKDASFDERTWIWIPDSKESFVKAWIVEDLGEKYRVKLERDGSERIVDGFDAEKVNPPKFDMVDDMAALTCLNEPSVVNNLTQRYEKDLIYTYSGLFLVAVNPYCHLPIYGDDVVRKYQSKQFKETKPHIFGTADAAYRSLLERRINQSILVTGESGAGKTETTKKVIQYLTSVTDASTSDSQQLEKKILETNPVLEAFGNAQTVRNNNSSRFGKFIRIEFSNNGSIVGANLDWYLLEKSRVIHPSSNERNYHVFYQLLRGADGSLLESLFLDRYVDHYSYLKNGLKHINGVDDGKEFQKLCFGLRTLGFDNNEIHSLFLIIASILHIGNIEVASDRSGQARFPSLTQIDQLCHLLEIPVDGFVNAALHPKSKAGREWIVTARTREQVVHTLQSLAKGLYERNFAHLVKRLNQTMYYSQSEHDGFIGVLDIAGFEIFTFNSFEQLCINFTNEKLQQFFNHYMFVLEQEEYTQERIEWDFIDYGNDLQPTIDAIEKSEPIGIFSCLDEDCVMPMATDATFTEKLHLLFKGKSDIYRPKKFSSEGFVLKHYAGDVEYDTKDWLEKNKDPLNACLAALMFKSTNSHVSSLFDDYSSNASGRDNIEKKGIFRTVSQRHRRQLSSLMHQLEATQPHFVRCIIPNNLKQPHNLDKSLVLHQLRCNGVLEGIRIAQTGFPNKLFYTEFRARYGILSQSLKRGYVEAKKATITIINELKLPSTVYRLGETKVFFKASVLGSLEDRRNALLRVIFNSFSARIRGFLTRRRLYRFNHRQDAAILLQHNLRQLKLLKPHPWWNLFLHLKPLLGTTQTDEYLRRKDALINNLQNQLESTKEVANELTITKERVLQLTNDLQEEQALAHEKDILVERANSRVEVVHERLSSLENQVTIADEKYEFLYAEKQSIEEDLANKQTEISYLSDLSSTLEKKLSSIKKDEQTISSKYKELEKDYLNIMADYQHSSQHLSNLEKAINEKNLNIRELNEKLMRLDDELLLKQRSYDTKVQELREENASLKDQCRTYESQLASLVSKYSETESELNKKEAELVIFQKEITEYRDQLHKAFQNPEKTHNINDVKSGPLNSDENIYSTSSTTLSILKDVQELKSLHTKEANQLSERIKEISEMLEQSIATEEKLRRKNSELCDIIEALKYQIQDQETEIISLNADNLDLKDTNGVLEKNASDFIDFQGIKSRYEHKISDLLNQLQKERCKVGLLKQKTENRSVTQHTLDGNSPHPSFEEKHSGDPLKRIDGNNDDRKIDNKLLKTISKSLDALQLTVEEELSNLYSLSKDLSFTDISGHIPNSIRKLEKGLSTLSELKERLNASNSDRPSPDIFKDTQAIMNSRKLLSNPNSDAQSGLISSLQKKLYNPESNMEFTGLKPLSPSKISNLPSSQPGSPSKRSGKMEALIRNFDQNSSIPDPFIVNQRNSVLQTEFEKINLKLKEATKSGILDNKDLSKFSELIQSLLKENEELKNLTTSNLGSDDKMLDFAPLLEDVPNNTRNQIKGFVEKAISSKRAIAKLYSASEEKLFSTEKALREITKERDRL

SEQ ID NO: 2225 - protein, 1842 aa, Schizosaccharomyces pombe
MRPEVEQELAHTLLLELLAYQFASPVRWIETQDVILSPPVSAERIVEIGPSPTLAGMAKRTLKLKYENMDAALSINREVLCYSKDAREIYYNFEDEVADEPAEAPASTSSTPKVETAAAAAPAATPAPAPAQTSAPAAALPDEPPKALEVLHTLVAQKLKKSIEEVSPQKSIKDLVGGKSTLQNEILGDLQKEFGATPEKPEEVPLDELGAIMQSSFNGSLGKQSSSLISRMISSKMPGGFNNSAVRGYLGNRYGLGPGRLESVLLLALTMEPASRLGSEADAKAWLDSVAQKYAARNGVTLSSPTAEGGSSSGSAAVIDEETFKKLTKNNTMLVTQQLELFARYLNKDLRAGQKAQVAEKVISDTLRAQLDLWNEEHGEFYASGIAPIFSPLKARVYDSDWNWARQDALKMFFDIIFGRLKHVDTEIVARCISVMNRSNPTLLEFMQYHIDHCPAEKGETYQLAKTLGQQLIDNCKSVIDAPPVFKNVNHPTAPSTTIDERGNLNYEEIPRPGVRKLTHYVTEMAKGGKLPTESKNKAKVQNDLARIYRIIKSQNKMSRSSKLQIKQLYGQVLHALSLPLPSSNDEQTPVKETIPFLHIRKKSVDGNWEFNKSLTGTYLDVLESGAKNGITYQDKYALVTGAGAGSIGAQIVEGLLAGGAKVVVTTSRFSRKVTEFYQSLYTRHGSRGSCLIVVPFNQGSKTDVEALIDYIYDEKKGLGWNLDYIVPFAAIPENGREIDGIDSRSEFAHRIMLTNILRLLGAVKSQKASRGMDTRPAQVILPLSPNHGTFGNDGLYSESKLGLETLFNRWYSESWANYLTICGAVIGWTRGTGLMAPNNIVSQGIEKYGVRTFSQSEMAFNILGLMSQKVVDLCQSEPIYANLNGGLELLPDLKDLSTRLRTELLETAEIRRAVAAETAFDHSITNGPDSEAVFQKTAIQPRANLKFNFPKLKPYEALSHLSDLRGMVDLEKVPVVTGFSEVGPWGNSRTRWDMECYGEFSLEGCVEIAWIMGLIKNFNGKGKDGKPYSGWVDTKTGEPVDDKDVKAKYEKYILEHCGIRIIEAELFHGYNPEKKELLQEVVIDHDLEPFEASKEAAHEFKLRHGDQVEIFEIPDSTEWSVRFKRGTSMLIPKALRFDRFVAGQIPLGWDPKRYGIPDDIISQVDPTTLYVLVSTVEALVASGITDPYECYKYIHVSELGNTVGSGIGGMSALRGMYKDRWTDKPVQKDILQESFINTANAWINMLLLSASGPIKTPVGACATAVESVDAAVDLITSGKARICISGGYDDFSEEGSYEFANMGATSNAAKETERGRTPQEMSRPATSTRDGFMESQGAGVQIIMQAKLAIEMGVPIHGIVGYVSTAMDKQGRSVPAPGQGILTGAREIATKTPLPIVDLKFRSRQLQRRRSQIGEWAEREYLYLEEELDAMKVQNPDLDLEAYRIERINVIKEEVVRQEKEALNTFGNEFWKRDPTIAPIRGALAVWGLTIDDLGVASFHGTSTKANEKNECDVIDSQLTHLGRSKGNAVYGVFQKYLTGHSKGGAGAWMLNGALQILRSGFVPGNRNADNIDEYLARFDRVMFPSEGIQTDGIKAASVTAFGFGQVGGQVIVIHPDYIYGVIDEATYNAYKAKTAARYKASYRYTHDALVYNNLVRAKDSPPYTKEQEKAVYLNPLARASKSKAGTWTFPATLPAESDISKTNETTRTLQSLTTSLTNSNENVGVDVELVSAISIDNETFIERNFTDTERKYCFAAPNPQASFAGRWSAKEAVFKSLGISGKGAAAPLKDIEIISSESGAPEVVLHGEAAKAATTAGVKSVSVSISHDDNQSVSVALAHK

SEQ ID NO: 2226 - protein, 272 aa, Schizosaccharomyces pombe
MNSIVSKYTQSTNNDDPKKIIEEEGFTNRFDVVPVPQSSLYLRNLTDETKNKHCLIKMNHGTTTLAFRYQHGIVVCVDSRASAGPLIASQTVKKVIEINPYLLGTLAGGAADCQFWETVLGMECRLHQLRNKELISVSAASKILSNITYSYKGYGLSMGTMLAGTGKGGTALYYIDSDGTRLKGDLFSVGSGSTFAYGVLDSGYRWDLSKQEALYLAQRSIVAATHRDAYSGGSVNLYHIDENGWVFHGNFDVDSLIWEAKDNENSFAHIPR

SEQ ID NO: 2227 - protein, 423 aa, Schizosaccharomyces pombe
  unsure (1)..(423): unsure at all Xaa locations
MKSATIIGGGSHPELLHLISNRLGITPCDVSLKRFANGETSVEIRESVRDKDVFILQSGSSTVNDSLMELLIIISACKGGSAKRITAVMPYFPYSKQSKMRKYRDAITARMVANLLTVAGVDHIITLDLHASQMQGFFTRPVDNLYAEPNIAEWIRRNVDDWEEAVVVSKNPGGAKRVTSLADTLNLDFALINTDRQRSSHFSQNFEDSIMDETEATETHVTNCSVYLDRPRIHTAKYLLGHIIDDEEIITTPASVCSEDYAQEVNLYSQGGCPSDDDEEENIMSASIYAERMITLVGDVNGKTALLIDDTIENPTAFIVASEHLVKRCGAKRVIVIGTHGIFQNKCLKDLQSCEYIEQVMSNITESXLTXQXIVVTNTYPIKPQAVLECDKLTVIDISGVLAEAIRRTHNGESISFLFKKAF

SEQ ID NO: 2228 - protein, 146 aa, Schizosaccharomyces pombe
  unsure (1)..(146): unsure at all Xaa locations
LTYLAYVDTSLLGTGKIDRAAIVSRAGDSVWAASAGFNLSPQEIQGLAAGFQDPPSMFGTGIILAGQKYITIRAEGRSIYGKLQKEGIICVATKLCILVSHYPETTLPGEAAKITGKFFSVYYSXLAQLLTTQXEALADYLVGVGY

SEQ ID NO: 2229 - protein, 455 aa, Schizosaccharomyces pombe
MEANFQQAVKKLVNDFEYPTESLREAVKEFDELRQKGLQKNGEVLAMAPAFISTLPTGAETGDFLALDFGGTNLRVCWIQLLGDGKYEMKHSKSVLPRECVRNESVKPIIDFMSDHVELFIKEHFPSKFGCPEEEYLPMGFTFSYPANQVSITESYLLRWTKGLNIPEAINKDFAQFLTEGFKARNLPIRIEAVINDTVGTLVTRAYTSKESDTFMGIIFGTGTNGAYVEQMNQIPKLAGKCTGDHMLINMEWGATDFSCLHSTRYDLLLDHDTPNAGRQIFEKRVGGMYLGELFRRALFHLIKVYNFNEGIFPPSITDAWSLETSVLSRMMVERSAENVRNVLSTFKFRFRSDEEALYLWDAAHAIGRRAARMSAVPIASLYLSTGRAGKKSDVGVDGSLVEHYPHFVDMLREALRELIGDNEKLISIGIAKDGSGIGAALCALQAVKEKKGLA

SEQ ID NO: 2230 - protein, 174 aa, Schizosaccharomyces pombe
MTSQLEKEAREWIEETLHTKLNAQLDLLDQLQSGVILCRICKEALGANIRYKESNMPFVQMENISAFINYAQQVVHVPSQDMFQTSDLFERRNDEQVLRSIHSFSRYAAKMFPGKVRGLGPKLAEKKPRVFSAQQQREFREGVNSLQYGSFDMPTQGTEKIAFSRRRDPTGNMY

SEQ ID NO: 2231 - protein, 427 aa, Schizosaccharomyces pombe
YVEQAALEAHDGVSTGKYTIGLGLTKMAFVDDREDIYSFGLTALSQLIKRYQIDISKIGRLEVGTETIIDKSKSVKSVLMQLFGDNHNVEGIDCVNACYGGVNALFNTIDWIESSAWDGRDGIVVAGDIALYAKGNARPTGGAGCVALLVGPNAPIVFEPGLRGTYMQHAYDFYKPDLTSEYPYVDGHFSLECYVKALDGAYANYNVRDVAKNGKSQGLGLDRFDYCIFHAPTCKQVQKAYARLLYTDSAAEPSNPELEGVRELLSTLDAKKSLTDKALEKGLMAITKERFNKRVSPSVYAPTNCGNMYTASIFSCLTALLSRVPADELKGKRVGAYSYGSGLAASFFSFVVKGDVSEIAKKTNLVNDLDNRHCLTPTQYEEAIELRHQAHLKKNFTPKGSIERLRSGTYYLTGIDDMFRRSYSVKP

SEQ ID NO: 2232 - protein, 406 aa, Schizosaccharomyces pombe
MSSVETRNSFNPFRVLFDLGSYGWLHPSRLLLLEIPFVFAIISKVPYTEIDWIAYMEQVNSFLLGERDYKSLVGCTGPLVYPGGHVFLYTLLYYLTDGGTNIVRAQYIFAFVYWITTAIVGYLFKIVRAPFYIYVLLILSKRLHSIFILRLFNDGFNSLFSSLFILSSCKKKWVRASILLSVACSVKMSSLLYVPAYLVLLLQILGPKKTWMHIFVIIIVQILFSIPFLAYFWSYWTQAFDFGRAFDYKWTVNWRFIPRSIFESTSFSTSILFLHVALLVAFTCKHWNKLSRATPFAMVNSMLTLKPLPKLQLATPNFIFTALATSNLIGILCARSLHYQFYAWFAWYSPYLCYQASFPAPIVIGLWMLQEYAWNVFPSTKLSSLIAVCVPLITILKLYTSDYRKP

SEQ ID NO: 2233 - protein, 1854 aa, Schizosaccharomyces pombe
MSSSSNSDPSSSPDNTDFIPLKDNPKDTSSYINKKNPFVNDSFDSHDDSYLDNVNPFEYNVADDEDTISMTSDGVEFHNLGITETVDEQDKILSELQLAYPTVSRYSETLDKGLLNGDKTTKGDYTSLRRFRKPFLFDKLSPYFTHFFSEIYAAVLRVVGPPRANETPGRNLPFSPILRQIYNHPLYNIFIFVVIVLHAVLLMIRSDDPHDKSQTIDYLIIVIGILYTLEMLLKIYLFGFLYDGSSSFYDFINSYTKKTPRTMSYLRHSWNRVDFVAIVALWISVIGKKQQGIFRLFSMIACLRLTRLLNITRKTETILKSLKESSTPLVQVVSFNAFFGVMIAILGVQFFKASLNRQCVWLGDYGDQYLPTGQFCGGHWENGIKRAYLDKNGFPSNVNPRGFICAEKSVCRVVENPYSNTVSFDNFFNSLELIFVIMSSNGFTDIMYDIMDAEYFVSCLLFIISAYFLTLWLMSLVIAVVTSSFIDLQHSGKNQKEQKSVDKHLIRNKLCEKYLFYSNFIWISFIVAQFVTLCTQTYDQTSSTANRYLIFYACVDFLLAAEVILRFFAYLPDYRLFFRRYTNLVDIVLAVLNLVTLLPSIRKNPVAFGWLSIFAIARIYRCILLIPYTRKIAKLLFSNFKQLLNLMLFLVIVLFIASLCAVRLFQDLPNDGDSDDDAISFATTYESFLYMYQILTSENWTDVMFAIQARLAHLHLSWIPGAFFTLWFLFSNNVVLSMFIAVIQVNFAPSESDLKMEQLKMYLARLLRNYNPFQASLTLNALIKRNGSRKGKTVDESHYEWLYEDNIIKGFLRVTNIPPKEPLKPSLDTSPELSKYSLAKLSNNFKRFVMRDDPFSQAYFKRVIGIRWEKDMNLKTAAKDMQAAKAFVRIKQTEFLKNHPKYNDVFWVIKPSNRIRRFCQRLVMPGVNERYGGVEPYQWVYRVIQVFIYACILTAVIIECIATPIYERDHLLNDKQHAWFVWTEVAFATIFTIEAAIKIIADGFCITPNAYLRSTWNCIDFFVLVTLWINLYAVLTSHALLSRAFRAFKALRVLRLINLTQTSQRMFHDALISGFFKIFSAAVVSATLLIPFALWAKNVFGGLLYSCNDDNVLSASQCVLEYASTPNNWEVWAPRVWSNPPDYDFDRFPHALLALFEIASIEGWVDIMRSVMDITGFNNQPQTNASSGNAMFFVLFNLVSMIYILTLFIAIIISNYAERTGSAFFTAEQRAWLELRRKIKSMRPSKRPAIRPLGLRGLCYDFAVQKHGIWRRTFTGLYIVHLLFLLTIFYPCPIAYTYVRNSIFLILSICYTINICVKVYGLSFYYFFHSFWNMFDVVVTLGSLTCNIAILAKFENRSLTLLQTTLLVLVTVHLIPKFDNFDQLSKTVVASLPSIFSLIATWIVLYITFAIAFNQIFGLTKLGLNGGPNKNFRSIRNALVLLFTMTFGEGWNDVMHDYTISYPNCVNGDDFYNSDCGNKPWAYGLFIAWNIISMYIFVNMFITVVFDNFSYIHTKSSSFTNLQRNDFRQFKDSWAPFDPMVTGYIPKRNAVKFVLSLRGVYDFRIYRDEHTLRSIISKVQSKTGQQSVPMLENPLMGSEINLEALDQIIDTIDVNVVKERRNVLNSLCTEIMTLPGNVISFSNILMLVVLHKIVDHREAFPISDYIRRAYVLSELEKSIRMEKLLGLVETSIIRKTFLQHMEEKKKALENPFILLSEVSEILPETPIQEVLRQHNADPEQLLMSTRTPSVSDRSFSIVESTVPTIASGEGDDNHSVEDHLKVPTDNEPRRSPSLKEVLLRGSHSLHSNNDRTSFDIEAGFGTAESDFQFGGATEDINRIADRIDDYLDRDSFKG

SEQ ID NO: 2234 - protein, 412 aa, Schizosaccharomyces pombe
  unsure (1)..(412): unsure at all Xaa locations
MPSIDCKRLQKLAPKSPENQSKCISRLRYMVMLDQVESDEGGNSSTRPYVWAVLLNAPPRNADEYIRYVRQGPSPMAQKIQNDVSRTLVVESQFHSRVSQSSLSRLLNAYVWKRGALYVQGMNVLASPFLYACKSENQAFQFFDRLLQNECPLYVLPNIDGVHRGAKGKXLFIYCFNAPIYXSIIVNLLTQLQLLDKCLEVLDHRLYTYLLSKGLTAKIYALPCKXIANLFVVLXKELIGINFTFHIXLILTLSACTAPLSEALTIWDFLFAYGIHLNILCVIAQMFIFREQLIDHPRXVFSHHPFIIMKDLQKRRKLWNNFFFFFFFKLYFHLGSSYVSSFSSFLKLKKINKXRMLTIKPMTLLRTFPPLNAKNIMKITILLISKLPPELYNLLARHAWDSEAGVLIDRLT

SEQ ID NO: 2235 - protein, 362 aa, Schizosaccharomyces pombe
  unsure (1)..(362): unsure at all Xaa locations
MASNTAPKNVVTINQKLVLLGDSAVGKSRSFIQELILYILSFXSXLFIIIXSSLVLRFVKDQFDGKNLLMRLLIFHAIENXHFSSKQIYRESTIGGMQAQXWERFLSFXSYHFFXLSNLFSCFLTQTLPIDENTSVKLEIWYASLMQQNLLICFIFQLTKFXGYGGQERYKSLAPMYCMLXDVPLYLLTWLDRNANCAIVVYDITQAVSKTSIIRYGNKIMFDVFLFGFXQYLGISRKAKSWIKELQRQAPEGIVIALAGNKLDLAQERRAVEKAVSFFLSYIRLVGVLTFLXDAEAYAAEANLLFFETSAKTAENVNELFTAIAKKLPLEDKLNQARGAVNRGVNLSEARPAAQPSGSCSC

SEQ ID NO: 2236 - protein, 505 aa, Schizosaccharomyces pombe
  unsure (1)..(505): unsure at all Xaa locations
MSTTSSHSNVVGVHYRVGKKIGEGSFGMLFQGVNLINNQPIALKFVCNYFXRAIQILNFSTNVAFSQESRKSEVPQLRDEYLTYKLLMGLRKYSLWLLYXFSSISXHLSLAGIPSVYYYGQEGMYNLLVMDLLGPSLEDLFDYCGRRFSPKTVAMIAKQMVSLXTSIRLLSDWLYVITFXQGXSITRIQSVHERHFIYRDIKPDNFLIGFPGSKTENVIYAVDFGMAKQYRDPKTHVHRPYNEHKSLSGTARYMSINTHLGREQSRRDDLESMGHVFMYFLRGSLPWQGLKAATNKQKYEKIGEKKQVTPLKELCEGYPKEFLQYMIYARNLGYEEAPDYDYLRSLFDSLLLRINETDDGKYDWTLLNNGKGWQYSAAKQHVVQRRHTQGTNNRRQSTIPPYARTRQNLLSSPSKQTPVNNVVDASVATQKDGIPGKAASPQVQQQQQTSSAQQQQPQRVEQPAPQTTQPTQVDTQQAAKPAPSKEKSRKKFHLRLLSCCISKQE

SEQ ID NO: 2237 - protein, 329 aa, Schizosaccharomyces pombe
MPVDISSLLHAGYSNPLLREWQGVRPITKSSLMYPIFISEIDDAKEAIDSMPNQFRWGVNRLEEFLGPLVKKGLRSVILFGVIESKKDYCGSMADSENGPVIKAVKEIRHLFPELVVACDVCLCEYTDHGHCGLLYEDGTINNAKSVERIAEVSGNYALAGAQIISPSDCMDGRVKAIKQKLVELELSHKVCVISYSAKFASGFFGPFRAAANGAPKFGDRSCYQLPCNARGLAKRAILRDVREGADGIMVKPGTPYLDILAMASKLADDLPIATYQVSGEFAIIHAAAAAGVFELKRHVMETMDGFMRAGANIVLTYFTPELLEWLEY

SEQ ID NO: 2238 - protein, 128 aa, Schizosaccharomyces pombe
MQIFVKTLTGKTITLEVESSDTIDNVKSKIQDKEGIPPDQQRLIFAGKQLEDGRTLSDYNIQKESTLHLVLRLRGGIIEPSLKALASKYNCEKQICRKCYARLPPRATNCRKKKCGHTNQLRPKKKLK

SEQ ID NO: 2239 - protein, 966 aa, Schizosaccharomyces pombe
MEGILAFDRELDVALLDRVVQTFYQGVGAEQQQAQQVLTQFQAHPDAWSQAYSILEKSEYPQTKYIALSVLDKLITTRWKMLPKEQRLGIRNYIVAVMIKNSSDETVLQQQKTFLNKLDLTLVQILKQEWPHNWPNFIPEIVQASKTNLSLCENNMIVLRLLSEEIFDYSAEQMTQLKTKNLKNQMCGEFAEIFQLCSQILERAQKPSLIKATLGTLLRFLNWIPLGYIFETNIVELITNRFLNVPDFRNVTIECLTEIASLTSQPQYNDKFVTMFNLVMTSVNSMLPLQTDFREAYEESSTNEQDFIQNLALFLCAFFSSHLRPLENPENQEVLLNAHSYLLNISRINEREIFKICLEYWSKLVAQLYEEMQQIPMSEMNPLLNLSSPTSLISSNPNMLANLPLRKHIYKDILSTLRLVMIENMVKPEEVLIVENDEGEIVREFVKETDTITLYKSMREVLVYLTHLDVVDTEIVMTEKLARIVVGTEWSWQNLNTLCWAIGSISGAMNEEMEKRFLVNVIKDLLGLCEMKRGKDNKAVVASNIMYVVGQYPRFLKAHWKFLKTVVNKLFEFMHEYHEGVQDMACDTFIKIAQKCRRHFVAQQLGETEPFINEIIRNLAKTTEDLTPQQTHTFYEACGYMISAQPQKHLQERLIFDLMALPNQAWENIVAQAAQNAQVLGDPQTVKILANVLKTNVAACTSIGSGFYPQIAKNYVDMLGLYKAVSGLISEVVAAQGNIATKTPHVRGLRTIKKEILKLVDAYISRAEDLELVGNTLIPALFEAVLLDYLQNVPDARDAEVLNLITTIVNQLSELLTDKIPLVLDAVFGCTLEMISKDFSEYPEHRAAFFQLLRAINLNCFPALLNIPAPQFKLVINSIVWSFKHVSRDIQETGLNILLELINNMASMGPDVSNAFFQTYYISLLQDILYVLTDSDHKSGFKLQSLILARLFYLVESNQITVPLYD

SEQ ID NO: 2240 - protein, 676 aa, Schizosaccharomyces pombe
  unsure (1)..(676): unsure at all Xaa locations
ISYNEDLAHLLLSQPTDILPLFESAVTTVAKRLLYRSQENASTNIPTCQVTLRYDANILPIRNLTASHISKLVRVPGIIIGASTLSCRATALHLVCRNCRATRILQISGGFSGVQLPRVCEAPVLDGEKKDCPMDPFIIDHSKSTFIDQQVLKLQEAPDMVPVGELPRHILLNADRYLTNQITPGTRCVITGIFSIFQNKSVKASGAVAIRNPYIRVVGIQMDSNDGSKSTPLFSEEEEEEFLEISRTPNLYDIISNSISPAIYGNVDIKKAIACLLFSGSKKILPDGMRLRGDINVLLLGDPGTAKSQFLKFVERLAPIAVYTSGKGSSAAGLTASIQRDSVTREFYLEGGAMVLADGGIVCIDEFDKMRDEDRVAIHEAMEQQTISIAKAGITTILNSRTSVLAAANPIFGRYDDMKTPGENIDFQSTILSRFDMIFIVKDEHDETKDRNIARHVINLHTNLQESSETLAIGEIPFDKFRRYINYCRQXVYQIXYXLLMDLAKCAPNLDAEAAEKLSSQFVAIRKRVHQSEQDSNSRSTIPITVRQLEAIIRITESLAKMSLSPIASEAHATEAIRLFLTSTLAAATQSSPEVTEEVKKIEASLRKRLPIGFQASYRMLIREYVNGVCLLIKSKSNIILAGYSQHALEMALQILSSKETIQLRNGGQTVYRSGV

SEQ ID NO: 2241 - protein, 1444 aa, Schizosaccharomyces pombe
  unsure (1)..(1444): unsure at all Xaa locations
IYLLISGCLQYFYEVRKRSHYFHFRRFWTIWLKSLVIMVLLFTHIYDCYKTNESVWNVLSIITYFLALFLHVVEQPTLRIPMASLLMFWLFKFLASALVLLLRPNYTMFPMLNVVPSITFFCSLVCLLAEIYVPPANRVWYPDDAAELEETGLRPSRFTYANIFSRISFGWLSPLMKFGYRNYLTESDAWSLPPAERSSNLTIVFEKNWISHAKKKKSSLYMWGVCFXTIGSLPLLLSFXKLVQDVVAFIQPNLIRKIVIFVSSYSSEHPQPPQVGFSLAIAMFLTNVVQTALLQQYFQLGMVLGMRWRSELITAIYRKSLRLSSAARQSRSVGDIVNYMSVDTQKVCDLTMFLFVIVSGPFQIVLALTNLYHLVGYGALSGAFVTFLLFPCNVVIASIFKRFQNRQMKNKDARSQFMTEIINNIRSIKLYAWENIFLQKLLQLRNTRELRMLKKIGIVNTIGNFTWLFAPILVSAATFGTFIVLYGKTRVLSVDIVFACLSLFNLLQFPLTMLPIVVSSVLEASVAISRIYGFLTAGELDSNAVQRYPANKEPSGVCLEIKKGTFSWSGPGQNAAEPTLRDIDFVARRGELCCIVGKVGMGKSSLLEACLGNMQKHSGSVFRCGSIAYAAQQPWILNATIQENILFGLELDPEFYEKTIRACCLLRDFEILADGDQTEVGEKGISLSGGQKARISLARAVYSRSDIYLLDDILSAVDQHVNRDLVRNLLGSKGLLRSRCVILSTNSLTVLKEASMIYMLRNGKIIESGSFTQLSSSPDSQLFQLLSEFSKKDTASSTGADTPLSRSQSVITSSTDVTSSASRSSDTVSNYPKATIKGTGRIRKRLTDEDNVKATGQAAEKMERGKVKWKVYWTYFKACSLFLIFLYFLFIIGGIGMNVGTNVWLKHWSEVNTQLGYNPKPYFYLGIYTLFGLLSCALISLSSLTITVFCAIKSCRYLHDSMVKAVLRAPMSFFETTPTGRILNRFSSDVYRVDEVISRVFMFFFRNLFQIVFVLAVICYSSPMFMILIVPLFFLYRYNQVYYTQTSRELKRLDSVTRSPLYAHFQESLGGLSTIRAYDMEDTFISENDIRVDTNHRIWFLYFSSNRWQAIRVEAIGALVVFSSAFFGVLSAVRGNPNSGLVGLSLSYAVQITQSLTFVVRQSVDVETNIVSVERMLEYIGLPSEAPSIIPDHRPPEGWPSHGAIKFDHYSVRYRENLPLVLNDISVNIKPQEKIGIVGRTGAGKSTLTLALFRLIEPTSGDIQLDDINITSIGLHDLRSRLAIIPQENQAFEGTIRENLDPNANATDEEIWHALEAASLKQFIQTLDGGLYSRVTEGGANLSSGQRQLMCLTRALLTPTRVLLLDEATAAVDVETDAIVQRTIRERFNDRTILTIAHRINTVMDSNRILVLDHGKVVEFDSTKKLLENKASLFYSLAKESGLI

SEQ ID NO: 2242 - protein, 1016 aa, Schizosaccharomyces pombe
  unsure (1)..(1016): unsure at all Xaa locations
MRGMSYNITHECDAINILSDNLHEGAISEDMVALSGPAIELLENNVGSSKNSYQEDEGSSSIDENAPLISIKRKRRIRTVKSTSNKELVQRKASKPTKQKSVFTPLEQQYLELKKNYQETILAIEVGYKFRFFGKDAKIASEVLGISCYFEHNFLNASVPSYRIDYHLERLINFGLKVAVVRQTETAALKSTSSSRNTLFDRRVARVLTKGTTLDDSFFRFEQTQHGTLQASQFILCVADNVDKSKAKSGRVQVGLIAIQLSSGTTVYDHFQDDFLRSELQTRLSHFQPCELIYSNKLSSESVALLNHYVSTEKTCGRVVRVQHAVQQDVKLALENLQDFFSSKCIMSGSKIIELHMEKVKSLHSLSIICLDMAISYLMEFSLEDLFVASNFYQPFDSISSMVLSKQALEGLELFVNQTDHTPVGSLFWVLDRTYTRFGQRMLQRWLQKPLVDKENIIERLDAVEELAFNSNSQVQAIRKMLYRLPDLEKGLSRIYYQRGKLFFCFIFLQXCTPSEMFHVLKGFYKAASAFSKNSYSCFKSALLRRLIQQLPSISSIIDHFLGMFDQKEAENNNKVDMFKDIDNFDLSEEPNDVDYELAQEIRELKMSILMVRTEMDFHLQELRDYLEYPNLEFSIWGNVKFCIEVSKGCKKIPPDWIKLSSTRSLFRFHTPKIQSLLIELSSHEENLTISSEKIYRSFLSRISEHYNELRNVTTVLGTLDCLISFARISSQSGYTRPEFSDKELLIHESRHPMIELLSDKSFVPNHIHLSSDGVRCLLITGPNMGGKSSFVKQLALSAIMAQSGCFVPAKSALLPIFDSILIRMGSSDNLSVNMSTFMVEMLETKEVLSKATEKSMVIIDELGRGTSTIDGEAISYAVLHYLNQYIKSYLLFVTHFPSLGILERRFEGQLRCFHMGYLKSKEDFETSVSQSISFLYKLVPGVASKSYGLNVARMAGIPFSILSRATEISENYEKKHRNARKNVFIRKVAKLLMILNAEEIDFKRLFYDLTAFEEI

SEQ ID NO: 2243 - protein, 793 aa, Schizosaccharomyces pombe
MNDFSFEDKGLISRSGFGSRHVRRVVKALALIFSLLILYLTISNVSDSPPKRDSLSLDDIVLQKYKPSYKQVNWIDSQGLKDTFLVKYGDLINIQDPYNLNKTLFSVSDLVYNGIQLDYDSYSISFDAKYVLVSVNKSQRWRHSSFAQYYLYNTETKDVNMLGQDNEHWTISLAEWSPTGHQLSFVYNNDLYVRKNDGNVQRLTYDGTVDVFNGLTDWIYEEEVLSSPSTIWWSPDSDKIAFLKLNESEIPTYHYPLYTAELDPSLPEFDYNKDMAIKYPKPGNPNPSVSLFVADLNSNASSNFSLWHNEPLAEPVVQNVLWVNTSSVLVQFTNRNSTCITARLLDTELKSIHTVKTECLEEGWYEVQQSAKMFPLNNSLVWENWSDGYFDILALDDYNHLAFIPFNGSSPIYLTSGAWDVTDGPIHIDGDFGNVYFLATLKDSTERHLYYVSLDTLEIYGITDNGEDEGYYSTSFSPFGDFYVLNYHGPDVPWQELRSTKDKDYCLSLETNSRLKQQLSSITLPSVEYGKLTFNDTTFNFMERRPRNFDVNKKYPVLFFAYGGPGSQQVAKLFRVDFQAYLASHPDFEFIVVTLDGRGTGFNGNAFRYSVSRHLGEWESYDQGQAGKFWADLPFVDENHVGIWGWSYGGYLTLKTLETQDVFSYGMAVAPVTDWRLYDSVYTERYMDLPQYNKEGYKNSQIHDYEKFKQLKRFFVAHGTGDDNVHFQHSMHLMDGLNLANCYNYDMAVFPDSAHSISYHNASLSIYHRLSEWIGDALGRIDPSTGVRQHRWD

SEQ ID NO: 2244 - protein, 969 aa, Schizosaccharomyces pombe
MDGKPQVEVIVNGQVVPNLDDREYRLIKLENDLEVLLVRDPETDNASAAIDVHIGSQSNPRELLGLAHFCEHLLFMGTKKYPDENEYRKYLESHNGISNAYTASNNTNYYFEVSHDALYGALDRFAQFFIDPLFLEECKDREIRAVDSEHCKNLQSDSWRFWRLYSVLSNPKSVFSKFNTGNIETLGDVPKELGLDVRQELLKFYDKYYSANIMKLVIIGREPLDVLQDWAAELFSPIKNKAVPIPKFPDPPYTDNEVRKICYVKPVKNLRRLDIVFPIPGQYHKYKCRPAEYVCHLLGHEGEGSYLAYLKSLGLATSLIAFNVSITEDADIIVVSTFLTEEGLTDYQRVIKILFEYIRLLDQTNAHKFLFEETRIMSEAQFKTRQKTPAYQYAHVVASKLQREYPRDKVLYYSSVLTEFDPKGIQEVVESLRPNNFFAILAAHSIEKGLDNKEKFYGIDYGLEDLDSQFIDSLLHIKTSSELYLPLANEFIPWSLEVEKQPVTTKLKVPNLVRNDKFVRLWHKKDDTFWVPKANVFINFISPIARRSPKVSVSTTLYTRLIEDALGEYSYPASLAGLSFSLSPSTRGIILCISGFTDKLHVLLEKVVAMMRDLKVHPQRFEILKNRLEQELKDYDALEAYHRSNHVLTWLSEPHSWSNAELREAIKDVQVGDMSDFISDLLKQNFLESLVHGNYTEEDAKNLIESAQKLIDPKPVFASQLSRKRAIIVPEGGNYIYKTVVPNKEEKNSAIMYNLQISQLDDERSGALTRLARQIMKEPTFSILRTKEQLGYIVFTLVRQVTPFINLNIFVQSERSSTYLESRIRALLDQFKSEFLEMSDEDFSKHKSSLINFMLEKHTNLKEESSMYWLRICDGFYDFTRLEKQAEIVSTITKDEFYSFFINNIHYEGENTKKISVHVVSQRCEDEVYEIPNVTIIENGNMFKESMTLSKAAFPLKPFDEIDRSLLFN

SEQ ID NO: 2245 - protein, 944 aa, Schizosaccharomyces pombe
MGRILIAHLFLPSSVGFSFDTVPHDEVGSKFMQKEESKDWIADTPLDESAIVSEEESDDDSLLSDLPEEIDSTNAQSNIATPSPGTVAAAISGIQPPPKTPSSDSPSLENSLSNLNDLFKSRGRHMAFSKNDGTNLSLPPSRHQSPPPSSVLASQRHHRRHDSELEEFARRASRSLSFSMNGTPQRRMTFDAEAWKNVIFKIKPSSFGNASFYNAISAATRSKQFDDHLFVGTCGIPTDSLPDSLKERISHDYITEHSSLVVYPTDTDFVGHYNHYCKNILWPTFHYQIPDNPKSKAYEDHSWANYVKVNKAFADTIVDNYEQDDMIWINDYHLLLVPEMVRERLPRAKIGFFLHIPFPSSEVFRCLATRQEILKGMLGANILGFQIPEFAYHFLQTCSRLVNIDIRKNGVVSFENRQIDVIALPISIDPGFIDRCLASPPVEHWAKVLQDRFRGKHIILSHDKLDPIRGLRSKLISFERFLQKYPEYRENTILLQVAPESLQDSEHLPHISDIVTRINSAYSNIASRHVPVILLRQKLGYAQFLALMMISDALIDNSLREGISLTSHQFIYVQRKRHRPLILSEFVGSASILNDNAIIVNPWDYSKTAEAFRTALTMSEEECQKRNKAMCNLILRHDAASWAVTFQSLIKESWKEQIDMQRIPAFTAQLIKEPYQNAQKRLILLYFEGTISTWGSQYHNVMTSLQRTINLLNMLTSDPKNTVYVFSALSCQELEQLFQRVPKLGIVAENGCFVRSPPKGDATMPVSKKEIAELWKNKVLGTDLTWMKTVSEIFEYYAERTTGAYVENKDATVILHLREAEDDEAAMWAAKECCESVNNFNVPCSATIQNDMVVCRSNKVSKRLAAEDIYSANGGDYDFIFAASNDPDDDTVFSWMKNFKQSKKEVVPFTFSVCVSEHGNSTNADAESSGVFGFLQALEKVYSA

SEQ ID NO: 2246 - protein, 362 aa, Schizosaccharomyces pombe
MSATRRIVLGLIPADGIGKEVVPAARRLMENLPAKHKLKFDFIDLDAGWGTFERTGKALPERTVERLKTECNAALFGAVQSPTHKVAGYSSPIVALRKKMGLYANVRPVKSLDGAKGKPVDLVIVRENTECLYVKEERMVQNTPGKRVAEAIRRISEEASTKIGKMAFEIAKSRQKIRESGTYSIHKKPLVTIIHKSNVMSVTDGLFRESCRHAQSLDPSYASINVDEQIVDSMVYRLFREPECFDVVVAPNLYGDILSDGAASLIGSLGLVPSANVGDNFVMSEPVHGSAPDIAGRGIANPVATFRSVALMLEFMGHQDAAADIYTAVDKVLTEGKVLTPDLGGKSGTNEITDAVLANIHN

SEQ ID NO: 2247 - protein, 251 aa, Schizosaccharomyces pombe
MKTALLLKTKSQPFDPYVEAFEKYGRDTAFIPVLRHKRVHEEQLRDKLKNVRKTYCGLIVTSQRVSETLDEALKQEDETERQKILMETPIFTVGPATDDSIRRLGFQQTHGKDCGRGEVLADLIEEWYTTTKQHKPLLFLVGEKHRDIIQRKLGDDRVDSLIVYATQELENTETQIKDTIRKHPTIDWIVAFSPTSICSLLNTFELKIATIGPTTGDYLKKLGTQPNVVSPAPNPESLASSIVAFDEENSS

SEQ ID NO: 2248 - protein, 372 aa, Schizosaccharomyces pombe
MASATSTPTIADGNSNKESVATSRSPHTHDLNFELPEEYEMINLIGQGAYGVVCAALHKPSGLKVAVKKIHPFNHPVFCLRTLREIKLLRHFRHENIISILDILPPPSYQELEDVYIVQELMETDLYRVIRSQPLSDDHCQYFTYQILRALKAMHSAGVVHRDLKPSNLLLNANCDLKVADFGLARSTTAQGGNPGFMTEYVATRWYRAPEIMLSFREYSKAIDLWSTGCILAEMLSARPLFPGKDYHSQITLILNILGTPTMDDFSRIKSARARKYIKSLPFTPKVSFKALFPQASPDAIDLLEKLLTFNPDKRITAEEALKHPYVAAYHDASDEPTASPMPPNLVDLYCNKEDLEIPVLKALIFREVNFR

SEQ ID NO: 2249 - protein, 308 aa, Schizosaccharomyces pombe
MESLQRLLQGARMGTGMMGDQPLVDNSECVYISSLALLKMLRHGRHGTPMEVMGLMLGEFVDDFTVRVVDVFAMPQSGTGVSVEAVDPVFQKNMMDMLKQTGRPEMVVGWYHSHPGFGCWLSSVDINTQQSFEQLTPRAVAVVVDPIQSVKGKVVIDAFRLINPSTLMMGQEPRQTTSNLGHINKPSIQALIHGLGRHYYSLRINYKKTELEEIMLLNLHKQPWAHGLLLENFNSAAEKNHASIDKMKSLSEQYTERVQNEVTLSPEQLRIQYVGKQDPKKHLDAEVQKCIDNNISSMLACMLDSVAF

SEQ ID NO: 2250 - protein, 393 aa, Schizosaccharomyces pombe
MDKKVYQCTVSAPVNIAVIKYWGKRDVALNLPTNSSISVTLSQDDLRTVTTASCSEKFENDTLWLNGNAEEIFANKRLRVCVEELRKARLDLEEENDDLDKIGALKLHVVSENNFPTAAGLASSAAGYAAFCEAIARLYDLPWTPTQLSRIARQGSGSACRSLFGGYVAWEMGELHSGADSVAVQVEPVENWPEIRVAVLVASAAKKGVSSTAGMQATVASSTLFQHRIQNIVPQRIQEMKTAIRERDFETFAKLTMTDSNQFHACCLDTFPPIFYLNDTSRAVIRVVENINATAGKTIAAYTFDAGPNAVIYFLEENSEIVLNTLYAVTKNAEGWSKQYGSSPVTVDSAAANIVSSGISRVILTRVGNGPRVLTIDESLIDASGNPKFIGSH

SEQ ID NO: 2251 - protein, 778 aa, Schizosaccharomyces pombe
MGSRIFTQSTLRSFSCAPVAANIDAKKVAMSNFEKNKFINYQRIKDNLEIVKKRLNRPLTYSEKILYGHLDDPVNQDIERGVSYLKLRPDRVACQDATAQMAILQFMSAGMPEVAVPVTVHCDHLIEAYEGGPIDLERANVTNKEVYDFLQTACAKYNIGFWRPGSGIIHQIVLENYAFPGGLLIGTDSHTPNAGGLGMVAIGVGGADAVDVMANLPWELKCPKVIGVKLTGQLKGWTSPKDVILKVAGILTVKGGTGAIVEYFGPGVESLSCTGMGTICNMGAEIGATTSIFPFNPRMSEYLRATNRSAIADYAEEFAPIIAADENAHYDQIIEIDLNTLEPHLNGPFTPDLATPISKFKEAVKKNDWPQELKVGLIGSCTNSSYEDMSRAASICQQAIDKGIKTKSLFTITPGSEQVRATLTRDGQLDTMRKAGGIVLANACGPCIGQWKRTDVKKGEKNSIVTSYNRNFTGRNDANPATHAFVTSPDIVTAMVFSGDMNFNPLTDTLKDKDGNDFKFEPPTGAGLPSKGYDPGSNTYVAPSSVNVKDVAIDPHSKRLQRLTPFKKWDGKDMKGLKILIKAKGKCTTDHISAAGPWLKYRGHLQNISNNYMIGAINAENGEANKLKDQLTGEYKTVPNVAIDYRDHGIRWVTLGEQNFGEGSSREHAALEPRYLGGAAVITKSFARIHETNLKKQGLLPLTFADPAAYDKISPFDTVDIDGLTTFAPGKPLTLVVHPADGSAEWSTKLNHTFNKDQIEWFKAGSALNHMANMHKQK

SEQ ID NO: 2252 - protein, 1894 aa, Schizosaccharomyces pombe
MSWHEQDYGFGTSSENSKINSDEFEDSMDVTEFNNPGEESTYPQANSWNDSNKTKDIAEYYDYSWSGQREANQQIPQPVPVQPRYPDEQNFSMNGETYPSEAYDYDYSGQEEAINAMNILQGNLERSNEYYSEGVPYSEEDLGAYAGGMTEDDQMYSNFNETGEFNLDIGSSKFSYLNAKNPYPAWIAENSIPITAENILEIFQELQAKFGFQYDSMLNMYDFFMVLLDSRSSRMDAENALKSLHADYIGGRNANYRKWYFSSSMDIDDSVGLQNCKFSSNGPKIKQAKKKQKRKSNKAETEGTNEPETSVQIDPLNVSMENWENEMKNLDCETQVRQLALYLLCWGEANNIRFCPECLCFIFKLANDFMQSEDYAKSEPIEDDCFYLDNVITPLYEFIRDQQFELLDGKLVRRERDHAQIIGYDDINQLFWYPEGIARIVTVDGTQLITLPKWERFHKLSEVDWKKAFYKTFYESRSWFHLVTNFNRIWVIHFTTYWYYTVFNSPTIIEKNFRQSVGPKPIPSCHWTSVSLGGAVATLLMLLATIFEWIHVPRKFPGSRPLLKRFLILILFFILNVAPTVFVFGFSTEEQQRTTGRLTVAIVHFIFSVFTFIYFSLVPLNNLFHRAYKSSSRTHLANRYFTADYARLQINDMCVSWGLWLLVFGAKFTESYFFLSLSFRDPILVLSTMKPYLCNITFLGSHLCIWQPKILLGIMYVTDLVLFFLDTYLWYILVNTVFSVARSFFLGISIWTPWRNIFARMPKRIYSKILCTPEVDSSYKPKVLVSQIWNSIIISLYREHLLAIEHVQRLIYHQVNSLDGDGSKTLKTPTFFVSQEDSSFNTEYFPAHSEAERRLSFFAQSLATPIPEPIPVDAMPTFTVLVPHYGEKILLSLKEIIREQDKLSRVTLLEYLKQLHANEWKCFVRDTKILAEEDALSNQDLNSQDESMKAEQLHKKFDDLPFYCIGFKNATPEYTLRTRIWASLRSQTLYRTVSGFMNYSRAIKLLYRVENPDVAQLFEGQMDVLEYELDRMASRKFKMCVSMQRYAKFTADEIENTEFILRAYPDLLIAYLDEDPPKEGETTPQLYAALIDGYSELDENKKRKPKYRIKLSGNPILGDGKSDNQNLSLPFYRGEYIQLIDANQDNYLEECLKIRSILAEFEAFDLKTNDPYAETNALYQNNPVAIMGAREYIFSENIGILGDVAAGKEQTFGTLFARTMAQIGGKLHYGHPDFLNAIYMTTRGGVSKAQKGLHVNEDIYAGMTALQRGGRIKHCEYYQCGKGRDLGFGSILNFTTKIGTGMGEQMVSREYYYLGTQLPFDRFLSFYYAHPGFHINNIFIMLSVQLFMVVLVNLGGMYHVVTVCDYDHDQKLTVPMRPEGCYQLNPVVNWLKRCIISIFIVFFISFVPLTVQELTERGAWRALTRLGKHFASFSPMFEVFACQTYAQSVIANLSFGGARYIGTGRGFATARLSFSLLFSRFAGPSIYLGSRTLLMLLFGTMTVWIPHLIYFWISTLAMCISPFIFNPHQFSWTDFFVDYREFIRWLSRGNSRSHINSWIGYCRLTRTRITGYKRRLLGVPVSKGVIDTSRAHFTNMFFTEIFIPLMLVPLTLVSYFFIDSQPGNPDPSKVTNPILRILILAFLPIIVAAVVSMTFAGMACMMGPLLDLCCKKFGAVLAALAHGITVFMFIIVFEVSWYLEAWCLAKTVLSMLCIIAIQRFFFKIIQVLFLTRELKHDGTNLAWWTGKWYSRGLGFHALSQPSRELICKMTELNFFAADFFLCHLLLFLMLPVLLIPFIDRWHSMMLFWLKPSKQIRPPIYSMRQNRLRKKIVQRYGTMFFLLLIAFLALIIIPLVVAKDLLANFEMDILRTYGLMQPRDTNWTENGTNWTTVNE

SEQ ID NO: 2253 - protein, 506 aa, Schizosaccharomyces pombe
  unsure (1)..(506): unsure at all Xaa locations
MDSSNLSSSMPQEGQLKLTEEAIITIKQVDESSAKRSVSNESRKSKDVTRKEQIASDQQGDDQCPQSDTAKDKKTEFKQDEVPNSNGKSIPTFHPCNNIGINDFNHQHYSRVCRNGIDINLIVVGESSLGKTTFVNSFLQSNDTNFRPKKTMDFVEHKATLSDGDQKFNLTIVDTPGFGDKSDNSNWXAIRISSILFSFFFLTXPNSNXPSSWRPIATNLLHRLNAYFQNEVKMDRETSEIDSRIHGCLFFINPNGHRLQPLEIYIMKKIDQFVNIIPVIGKADTMTSDELNHFKKRVIADMVREKIRYFREPHNEKKAKIPIPFAIVGAGAPIEHDGKCIRGRAYPWGLVDIDDPKQSDFCQLRNFLLYTHIEGLKHKTHKLIYDTFRTEKLVALNATPGSQFIRYVDTLHVNHQTCXLKISAEEMNQKYISEQTQLVEEALTKVMKEKYREKENNLELLETNLKTHHKDYKHALKKRITALEEEKNRLIKEIGPEKVKKAGILA

SEQ ID NO: 2254 - protein, 314 aa, Schizosaccharomyces pombe
  unsure (1)..(314): unsure at all Xaa locations
LKVFANFSETSKKLVVVGDGGCGMLDKYRXMTAGLMYXCLMYRKTCLLIVFSSGTFPEVCQXIEQXLFKCSVHMIHVLSSLELSKYTDFXHHARDYVPTVFENYITDITYGPNSKVIELALWDTAGQEEYDRLRPLSYPNSNVILLCFSIDCPASLNNVTEKVCALXFILLNVALGFFNVICVXPLVFHLSHIIFXHFSFSGIPEVQHFCPRTPIVLVGLKADLRKDRNATEVLRTQGLTPVTYQQVCQXXANFFLSFIFFNIFRLNPVALSMNAPYVECSAKENTGVNEVFQLAVGLTIKKSFSFSKKSCVIL

SEQ ID NO: 2255 - protein, 236 aa, Schizosaccharomyces pombe
MRKVLITGGSSGLGKRIAQIWSQKGHQCHIVGRNEFHLKETLQSLSVAKGQQHTLTIADVQSDMKNLKSIFESVEIDTVVHAAGVLQSSLCVRTSEKEIDSIICTNLVSAIKLSKMAILEWFRNKNSERDRLILNISSRLSTYALPGTSVYAASKAGLESFTKVLAAEVASKGIRVNAISPGYVDTPMLSSQIRAIAEKKVPIGRLASTDEIVDACTFLLDNRYTTGTILPITGGL

SEQ ID NO: 2256 - protein, 670 aa, Schizosaccharomyces pombe
MSYLSVGDEVLIRGELGIVRFAGSTDFESGIWLGVELLNGKGKNDGSVKGKRYFSCEKGKGIFVRACSSNVMKRPSVVKSRKKGSENISNFMEKTKAIKQKSRREPSKFERSLARPLCITPIDSSTPTKTATFYTSSTTENLDELNFSTEELSSFDTTLLNSDTSKLSGLDDSSFMEEEFVWQVDNVLQECEKKFTPHSKGSYLKENLKSELRKGRLDELMCENTALKEKIDKLNKELEKVEPQLTFLRSKNSIEKPRNFRREKFLKKFLAMQKEIKYLRKRKLQIRKIPNYKYSDRSLNSKTPKSQDNWTTQVTPSSLLGVSEVSKVLQLKQVQVDITELVKIPKNPFSEKLTISNVNRYLNIVPGSLDLQFSLTNENFVHWNSTVYQELLNLKSNNSSVDGVKTRRQLLEENALLSHKVLKLTEEIQDLETLNQLNTEIEARQSEKLNEVQEETQRLSQLLISSQPALTEVKHLKLCLSDSQEELLQLNAKLEKANIVIDELNSAKLKLSKQVEEESSMKDDLTEMNQRLKEQIESYENEVNSEITSRTLKEFETLKTQYEKNLCNLREQLKTARMKLADKYPQGDNTSENIDWLKHSLRDSNTENSIPSPLTFACKEIRKLVADIKPVSVEKQLALNWKKDIERPSFHHNQQLFNYCQLTDILSKKC

SEQ ID NO: 2257 - protein, 1039 aa, Schizosaccharomyces pombe
MEGFTLETHASRIIEVPLLGQEDQSVEIDCSSLPSDATELCEILVNEQAPREFWTKFAHEYYIRGLREQAILILKSGLETLKDSESLCILNANIAAIYLSMAREAMLKKDTDLRDEQLRNVRTYLEAANNIDSKSEINVLLHGIYRILLNPTDKESLENAARCFDFVLQKSGGNILGFLGKARILYAKGNYRSALKLYQRALVSNPQFKPDPRIGIGLCFWNLDMKTDALSAWTRVQQLDPKNTVVDTYIGLYYYDLAFQNVNNDSFVQNYGKALQHIQRAFKTRNNDPVASSILERYVYSKKNYEGCIKLAENVIQNSFSSSLIADGYYWMGRAYHQMGNNEKAMASYQKAKAADDRHLLSSVGIGQIQILQNDLTSAKLTFERIAEQNQSCFEALVVLGCLHASDSKPDLTKARMLLDRAFNLVGSSKLPRVVDSDLYITQARLWEKEDTKKSLGFLTRALDFLESAHMSVGPELLNNIAVLQYHLGLIPEAHGNIIKAKSVLPDANPELSLLLDYNLARCEEELGNTSVASEAYVSILEKHPSFIDARIRKCLLQLSNPNEETFKEIRHIMNADSQNLEVRAFFGWYLSKQKRRPVEDPEVRHCSQTLRHWHDDIYSLVQLGNAYMRQAREFRVHNDREKLKRQKLYIKAIQSYDQAIKFDPKNAHAAQGIAIILAQNRQFSKALLILSKVREAIKDATTLINIGNCLAELKQFSRAIEVFETVYSSTGESDTYGVLSCLGRVWLQRGRESKNVDYLKESVRYATLALEKNPENPSLLFNVAFVQFQLCELIRQKPENSRTVEDLNFAMQQLDASIETFTKLVSVEHPPYSPTSIEQRAKMAKNTTKRQLERAIQAQIEYEKSVAAKLEDARIQREKEKARRLAEEEALLKEKQERERQLQEERQKMQEEVLEWRKSQQKASEDDMSLSDDEEKQSGKKKKKDRKKRKSKSKQESSDSGVSEDDEIPLSDARNKTKKRRVNRRVISEEYTFDQDSDAEGNQEEEVSRTIEEKQDNDITDNQDDNKELNLFSEEDEE

SEQ ID NO: 2258 - protein, 1039 aa, Schizosaccharomyces pombe; identical to SEQ ID NO: 2257

SEQ ID NO: 2259 - protein, 582 aa, Schizosaccharomyces pombe
  unsure (1)..(582): unsure at all Xaa locations
MASLFDINAAAAVKVSVKFYECLYXQFRDYSIKPRLSYNTVNSITGPLVILEYVFXAFXPYFDELLLTLLXQIRRPQYNEIVNLNLPVSALEKLYILEDVFLNVFCFLFRYFINANXXDGSVRSGQVLEVAGHKAIVQVFEGTSGVDVRKTTIDFTGHSMRIPVSEDMLGRVFNGSGLPIDKGPNLLAEDYLDINGSPINPYARIYPEEMIQTGISSIDGLNSIARGQKIPIFSAAGLPHNEIAAQICRQAGLVKRPTKDVHDGHEDNFSIVFAAMGVNLETARFFQRDFEENGSFERVTLFLNLANDPTIERIITPRLALSASEFLAYQTEKHVLTILTDMTSYADALREVSAAREEVPGRRGYPGYMYTDLSTIYERAGRVEGRNGSITQIPILTMPNDGMFLXIFFLIANFFLDITHPIPDLTGYITEGQIFVDRQLHNNAIYPPINVLPSLSRLMKSAIGEGMTRNDHGDVSNQLYAMYAIGRDAASMKSVVGEEALSQEDRLALEFLGKFEKTFISQGAYENRTIFETLDLAWSLLRIFPREMLTRIPKKILDQYYSRSSAYTESSKDVIDNTPESS

SEQ ID NO: 2260 - protein, 347 aa, Schizosaccharomyces pombe
MWNPKKKSEALAKFKSFPYPKPGTSNVLDSKEGDTRRKYFTKTHLHRLFVFVVLLLCSGYFLKHTLLTRPKESNVVMIFVNNIGGGVLDVKSPRQWELEKISTENKKKYAERHGYHFFVKSTGLKRRYAHEWRESWEKADYIMEAMKKYPHAEWFWWVDLTTFIMEPQYSLEKLIINRLDHIATRNITDSMEFNPKNFHEIPFVDYSEDINFILGQDCNGFSLGSFLVRRSDWTSRLMDFLWDPVVYGQKHMDWPHDEQNAIEYFYENNAWLRSGMGFVPLRLFNSYPPGACAGEGENPRFFYNQKEGDFLVNLAGCNYGRDCLDEINHYKGLAQRKRGWRKLVPFL

SEQ ID NO: 2261 - protein, 623 aa, Schizosaccharomyces pombe
MGELQDGITQEDSIEKKSKNVASHGEKRKVKRKKEDLSMDGSNDGVKDSPDSNDDSQSKKKKKKKLKKSQQPLNEENYPRLQTTENNLQKPLKISDLQELVFWCLADGQAPSWVLVRNKQMIHRAVILLVPGLEPSQFGFQPVRGNKHSFLLPNLLNENGPIQLPDFCEVFDRAWPTRSPGDRFRVFSPVNAFLQSPLSNEQKKKRDKETRAMASFSKPSDYLMSYESFIEDEYPLHPTVMKGEEVTQPSGWVASAGDFHSPPINPKILAIDCEMVRTENGLEIARVTIVDMKSEVIYDEFVKPESPVTDYVTQYSGITEEKLRNVTTVLSDVQSYLKKTVDNNTVLLGHSLNSDLNCLKFTHPHIIDTANIYNHTRGPPSKPSLKWLATKWLRREIQKAGALGHDSAEDALACVDLLKLKVKNGPAFGLFNQDFESIFHRLSRQQPTPLIGAIADYGNPESCIGKAAHKSVSCANDDEVVSAVVSLSDMHNFVWGRFRELEHAAMWNANRNTKQENNSDTDTENDSVEEDQVTSYSSALERFNRRIRLLYDSLPKGSLLLLYTGTGNPIEMSKLNAIRQQFRKEYQTKKWDELSVKWTDEENMKYISAVENTRNGLSFMTIK

SEQ ID NO: 2262 - protein, 304 aa, Schizosaccharomyces pombe
  unsure (1)..(304): unsure at all Xaa locations
MVLEATMILXEFIFVKLLLXHGRIDNSEWMINGDYIPTRFEAQKDTVHMIFNQKINDNPENMCGLMTIGDNRYMINITAXTVLYVQLXNTLQKFXSYSPQVLSTLTRDYGKFLSAMHDLPVRGNAKFGDGIQIAQLALKHRENKIQRQRIVAFVGSPIVEDEKNLIRLAKRMKKNNVAIDIIHIGELQNESALQHFIDAANSSDSWXVYGFFGHFWLLFFTSINNFSHLVSIPPSPQLLSDLVNQSPIGQGVVASQNQFEYGVDPNLDVELALALELSMAEERARQEVAAQKSSEETEDKKMQE

SEQ ID NO: 2263 - protein, 463 aa, Schizosaccharomyces pombe
MSNDVDDESKIETKSYEAKDIVYKSKVFAFKDGEYRKAEILMIQKRTRGVVYYVHYNDYNKRLDEWITIDNIDLSKGIEYPPPEKPKKAHGKGKSSKRPKAVDRRRSITAPSKTEPSTPSTEKPEPSTPSGESDHGSNAGNESLPLLEEDHKPESLSKEQEVERLRFSGSMVQNPHEIARIRNINKICIGDHEIEPWYFSPYPKEFSEVDIVYICSFCFCYYGSERQFQRHREKCTLQHPPGNEIYRDDYISFFEIDGRKQRTWCRNICLLSKLFLDHKMLYYDVDPFLFYCMCRRDEYGCHLVGYFSKEKESSENYNLACILTLPQYQRHGYGKLLIQFSYELTKREHKHGSPEKPLSDLGLISYRAYWAEQIINLVLGMRTETTIDELANKTSMTTNDVLHTLQALNMLKYYKGQFIICISDGIEQQYERLKNKKRRRINGDLLADWQPPVFHPSQLRFGW

SEQ ID NO: 2264 - protein, 292 aa, Schizosaccharomyces pombe
  unsure (1)..(292): unsure at all Xaa locations
MEKEAIYKLIRESPPGEVNQVVHGLLKCXIPQHSNAYNDIRDIGLSDEEAIHEQLKLYHEDYNSSVSISDDEKVIISADNRLEGNRYYDQVLQKSFTINYETMVRLNFSNLFFVIIVKXLTVFIGAENVEDYTEAIKIPDEIVKQIKKVASDHYLSDVTFGIIKKSDEVESFTIVLVSSKYNPKNYWNGSWRCICNYNVSEKKLEGRSHIRVHYYEDGNVWLDASRPISATVEETSKLYEVLAQVENGIQQSFNVELSSLNDKKFKELRRQLPVTRQKINWENVSGIRMRNT

SEQ ID NO: 2265 - protein, 441 aa, Schizosaccharomyces pombe
  unsure (1)..(441): unsure at all Xaa locations
MIFNYVFSNSFSFLYLMVNVQCRIKEIMYWNICLYWDVFSKLIIYNKVCQFGRIHIFHGKNRHQLLRTCHFTPSKRHSAMSFFEALGCKKQNKHKXLXXGLIKNFXAGICAGLAVDLSLFPIDTLKTRLQAKGGFVKNGGFHGVYRGLGSILVGSAPGGMKKKKESNLNVWFLSLVLTNDRHLLNYLLXYITKFTKCIINXLTNATSSLFFTTYENMKSRLSQSGLGLSDPQIHMCSASLGEIAACIVRVPTEVIKQRAQASGGTLSSRNILQTILKSNNVWRDFYAGYGITIAREIPFTLIQFPIWEHLKLKWRIKHSRNKNLAHEAAISGSIAGGIAAALTTPFDVVKTRIMTSQQVCVXFFDXTKEFCAXITTLIYTFDTNLFSDFSYVFTIKSIVAHEGFLALYKGIVPRVLWLSGGGAIFLGCYDVILNFMKAEGL

SEQ ID NO: 2266 - protein, 407 aa, Schizosaccharomyces pombe
  unsure (1)..(407): unsure at all Xaa locations
MESAPIVLDNGTGFVKVISLIKSLFTLXLTLAKVGYAKDNFPRFQFPSIVGRPILRAEEKTGNVQIKDVMVGDEAEAVRSLLQVKYPMENGIIRDFEEMNQLWDYTFFEKLKIDPRGRKILLTEPPMNPVANREKMCETMFERYGFGGVYVAIQAVLSLYAQGLSSGVVVDSGDGVTHIVPVYESVVLNHLVGRLDVAGRDATRYLISLLLRKGYAFNRTADFETVREMKEKLCYVSYDLELDHKLSEETTVLMRNYTLPDGRVIKVGSERYECPECLFQPHLVGSEQPGLSEFIFDTIQAADVDIRKYLYRAIVLSGGSSMYAGLPSRLEKEIKQLWFERVLHGDPARLPNFKVKIEDAPRRRHAVFIGGAVLADIMAQNDHMWVSKAEWEEYGVRALDKLGPRTT

SEQ ID NO: 2267 - protein, 383 aa, Schizosaccharomyces pombe
MSSKLTVNAHYSPLKDEDPLDHIDSQTALDSMETDSTGKSSLYFSKSDDPLSKDIEDGISTRKLEEMSVLEANAKEPDSENAPVSRLTIFFAVSSQIVFAILVTILNKQALNIINAPLLMLSFQMAFTSLMVKMYWRFSSVHFQTLRLASAIQLKKFIFVKILGIVSKTYCLAFVPVSFYQISRGLLLPFTILLSFVLLKQKTRLFPFGGCLLVMLGFGFGVRFESHVAPIGIILGVWSSFTTAIESVAVKHYVHEYPTLDLIYIFSALMSVFCLLLSVASLELLHTVQEVVGMQAIKFFIVLILSSLSNFYLNIATFTQIKVTSPVTYMISVSARSILQTLLAVAFLGETLYGNRIYGVILILVGTLLYTLAKEHERRVASA

SEQ ID NO: 2268 - protein, 891 aa, Schizosaccharomyces pombe
MGRQFICSIYLPYTINFHLDELEGNHESHPAITHQEKVTQTHRDSVKIDDILTRLSISKSESGQATPVLTPQLEGMNDYFSLGPSKRTGGSMTPGLGAMSPIPGSGRSSPLYTQPRSRATSPSRVRQADRFAAPGIGAGALPIRRKRRDSLAKSVALFESARWSVERGVVGNSGLFHAVDAAVRDHGLQNPLWVGLLGMPTESLSEKTKNAISGALLVKHQSLVVYTSDSNFEGHYNHYCRKILWPSLHYQHNEIFSFFHEESNWDDYVAVNRAFADALIKNYKTGDTIWVNDYHLLLVPNMVRERIPSAIIGLFIHVSFPSSEVFRCFARRKELLQGMLGSNLIGFQTEEYKRHFLQSCSRVLYAESTFDRILLDDRYIDVYAHPIGADPVLVDKWLENPETLEVKEVLEKRYANLNIFVGCDKMDPIRGIREKLLAFEQFLYDNPEYQKNTILIQTSTFTEEQKEYGVAISDIVTRINSAFGDFSLDHLPVTILSSDLSYPQYLALLSVADAFIVTSLREGMSLTCHEFILTQRQKKSPLIVSEFIGCASMFSNGAFIVNPWSTLELSLSMKKALTLSTNERNQRYSNCLDVVLTHSASNWVTGFETKLKKSWTSQQKRDFSRLPRFTLNFIGNRYDHAKKRLLILNFDGNAVTWEGRHEFVDFHYGYMVSILSKLIADDRNIVYIASCLEEDELESLFMHVPGVGLIAENGCYVLPHYAENVHQSWIRLYKKQQMDWREPLHDIIQYYSERTPGSSLIDHGFAMEFNYVKAENRENGLRSAGELASSINETQHGCRAVPLDGRVLCEPTTISKATAANYIMTHLIKNPEELDLILVAGNNRTDESVFAWANKSKVSSFTVSMGVGNTEAKAYTDGIPSFFNVLNSLCA

SEQ ID NO: 2269 - protein, 225 aa, Schizosaccharomyces pombe
MSQSQFDPYVQNGGTTVAIAGDGFAILAGDTRSVNGYNINTRFQPRVHEVGDDLVIGASGFEADALALVKRIQQRIDLYHDNHERKMSAQSCACMVRTLLYGKRFFPYYVYTTVAGIDKEGKGEIYSFDPVGSYEREWCRAGGSAANFITPFLDNQVNLHNQYVPGSHGKERKPRRLLKLEEAMKITTDAFTSAGERHIEVGDSVLVKIITKEGVETRIIPLKKD

SEQ ID NO: 2270 - protein, 899 aa, Schizosaccharomyces pombe
MNCEMVTSPESVNLGDSNRAVSPFCLPDCSENAVAQTRSKTLDNAALDLPYVGNRKKSEQDFFKMLSSRDRDAHSTLRKRSNSLSSFLSTKSTSASENKFHGGLNWLSLKLNLLLRLQGRMNSARTNTSMNPYSCDSNENLSTLSSVNQNFNSRQLLATIVPESIQNGCSLLRITKKKVRQRKVSLDPISGYLMLDKNTGKAYKKLCVDDIKEIRQGRDARNYREQYKISSENEKRWFTIIYCADNKLKAMHMISPTLDAHNQWIMALEGLKTYRLNEFIIGLNLVCHQGEKMIDYSENLNPWEKLEKEQSAQLDLGDVHRMCQMLHLNASMEFLEETFQKADADHSGKLSFEEFQHFVSLLKTRSEIVDIFKEYTSGSDKMSLEQFRHFLSTSQKARLDSDSIRTLYVSFCSNDDSKMGLIEFTSFLLSPHNSPVVPVIQDMSRPLNEYLISSSHNTYLLGKQFGGESSIEGYIRSLQRGCKCIEIDCWDGPNGPVVCHGHTFTSMIKFNDVIDAIRKYAFVVSPYPLFISLEIHCCPDQQRQMVSYMKQAFGDTLVMKPVTANESVLPSPEDLLNKILLKVKCSATPLHQFSTDILKVGITDSSTDTTESSELENSELTGLRKGKRRMKNIIVQELQQLAPYARSLKFRNFSLPESKTYSHIFSFSERTIKKHGKAMVPRLSKHNLRYLCRVYPGPLRVGSTNFNPQVYWRLGVQMVALNWQTYDTGLQINDALFIADPPTGYLLKPPCQRIIGTTVGEEGLPRKIKLTIDVISGQQLRRARELSNSETLSPYVEIQVHSMEESPFRWCSKVVHENGFRPFWGETMVYESIISDDFYSMIRFLVHHRGSNGNDSIFANFTCPIDRLQQGYRHIRLLDMQGENLLFSSLFLKIKKEDI

SEQ ID NO: 2271 - protein, 1372 aa, Schizosaccharomyces pombe
MMTASFKGIRISKPIVKEISSFGSLTNIDLHTDPYEKVEAKALSRSRLKNQSVKKTDLRITNDYSSLFVSIENKKNTIPDIHCNNLSKRPVGFTDSYVPGEALLCPDDPNLVNELFDDVLKRLREEKSDSGEQFHWDANVTLSQENKWSFITGYLSRNDKFLKISSNDSELNVKASVISYIEKLSCTPLKLKYVESLAVALRTESVTWVRYFLLMGGHIVLAKILQAIHEKKHLKSPDITLEIAILKSMRCIIGQKIGTDFYLSNKYPIDSVVHCLLSTKLLVRKLAAELLTFLCYSEKPNGINAIMKCMKNFANLKVESMNVFDLWLSQWKRTLLEKVVTEEKKVLEEAALHDKITIEYIISQMLLINAFLENIPSKTALLQFKESLRIGNFKSILLILKKINDEGVLKQLEKCVKLVSLDTANEKHFLKHTPNSAAHQSLLNTNMFNDANFEFMVKEHIKNFLKLLKEHNNPVRIIKLLDCLVLTLQADKGNGNSNNDIDCFYKELKIGNEQGNNAPGYSSVTSGYGTTNSKKVVASYDNTDDNEYSVSKSELYATGDTNNTTNQGYENSERKYVESSKYETDLKNIFDCLCLLFPSEFDPQSSFSAEKIFSKLKHLLTRTRDSYISEDTKILRLLNRSSSKLQDRDQEYLISKNNVNGNGNRDWVQPVNTTSSVSAFASPRIKPKLLFQPNQDEKLKLCKLDLAKANSITLKSEPSSAVSTHSFEVHLSMPGTQIKSANLAEKMETSKHKVFNPKRIDVVSDLPLDYRKSYYGRFSITDTKRFSKIENMRIKEVIDGNPFKAPPPAPLPPPAPPLPTAMSSLQKFEKNDSQIFRKTIIIPENISIDDIFKFCSGSESEVYASKIPGELCNPSKRLKQLHWKRLEVPFEKTLWNIVVADPYLLTLKLTAEGIFKQLEDCYPLREVTVSNKKVKEYTGFMPVDLQQMVSIRLHRFNSLTPIEIAKKFFHCDHDIMELVDFFNDRKFFRQEGLKKQLKPYMSSRNEEVMEVSEKLLELSRFDQIYTLIVVDIDTYYEKRMAALKIKSFLANNFRDFRRQIRKLHCASLELKSSLHFKYFLNLVLHIGNFMNDAPRRAKGYRLESLLRASMIKNDKTGLTLLHTIEKIVRTHFPQLEAFLVDLKAIPEISRFNLEQLEQDCNDICERMKNVEKDFSNEGIFSNHKALHPDDHICEVMVPWIPSGKSMVDELNSDITELKTTLKTTLLMYGENPDEPTSSARFFNNLNEIILEYKKASTVNQKMEKEEELAFLRLQALKASVKSNNAENSGSSKNEEVSATMENLISQLQKGLCDDSLSNKTDCTESSKQTIETLMNYENDKQTLEGSNKKRQTVVLKAECMLKQLENNNELKR

SEQ ID NO: 2272 - protein, 190 aa, Schizosaccharomyces pombe
  unsure (1)..(190): unsure at all Xaa locations
SFSGVKVSPECLEAFQELKLGKSLRYVVFKMNDTKSKXRKRFRWNLRKSNIPFFKNKFIYLHXYIFYVCNVFLCRFYNYVEPFTNFFLFSEIVVEKKSTDKDFDTFLGDLPEKDCRYAIYDFEFNLGEGVRNKIIFISWSPDVAPIKSKMVYSSSKDTLRRAFTGIGTDIQATDFSEVAYETVLEKVTRK

SEQ ID NO: 2273 - protein, 453 aa, Schizosaccharomyces pombe
MKSTVKKSAPREFGGAKGALAIMTGFPCLMYYLWACSKFNDSQFIKPESFTIAGFQNFFRTLGHYIYVGAYPTRYAFLVFWSFCIVQAVMYLTLPGVRTQGLPLKHRNNERLPYLCNAIWSFYTTIVILAVLHVTHVFPITTFIDMFGPLMSVAIITAFVCTFVLYTGTLLFGDRLFDKPHRLSGNPIYDAFMGACLNPRLGKLLDFKMFFEVRIPWFILFFISVGAAVRQYETYGTVSPQVLFVCLGHYLYANACSKGEQLIVPTWDMAYEKFGFMLIFWNMAGVPFTYSHCTLYLFSHDPSVYNWSTQYTTGIYVLLLCCYYIFDTCNGQKNHFRNQIYGTEVHRKTFPQLPWLIIKNPTFIRCANGGTLLTSGWYRYARKIHYTADFFQSLSWALITGFQSPLPYFYPCFFFVVLVHRVSRDIKKCKAKYGADFDEYCRICPYLFIPYIF

SEQ ID NO: 2274 - protein, 496 aa, Schizosaccharomyces pombe
  unsure (1)..(496): unsure at all Xaa locations
MASMVLADGMPTVKDDSTRSRGSDVDSFTSTDNVTQINVEAAISENKNEEKPIQDNSEQEVINYLKFLYXYLFNPHVSIIQRQLNGYVGFASLPNQWHRRCVRQGFNFNVLVLGESGSGKSTLVNTLLNRDVYPPTQKSLTGDFGVNPEPTVMINSSAVEIVENGISLQLNVIDTPGFGDFIDNTDCWQPVLTDIEGRYDQYLELEKHNPRSTIQDPRVHACIFFIQPTGHAISAMELRVMLALHEKVNIIPIIAKADTLTDDELNFTKEMVSPNLDLKLLMKKXXILRDIQYHNIRIFFPPTYETDDPESVAENADIMSRIPFAIIASNTFVVNNEGKRVRGRRYPWGVVEVDNEEHSDFPKLREMLIRTHLEELKEQTNKLYEAYRTERLLSSGISQDHSVFREVNPSAKLEEERALHEEKLMKMEAEMKTIFSQKVQEKEDRLKQSENELRTRHREMKAALEKQKADLIDHKNRLMQAKAAAENEKSKRKFFK

SEQ ID NO: 2275 - protein, 639 aa, Schizosaccharomyces pombe
  unsure (1)..(639): unsure at all Xaa locations
MPPSSSITQEDKATIRKYIPKSTNKIIAAAVVKLYVAYPDPNKWNYTGLCGALVLSYDTTAKCCWFKLVDVVVCVXSFDTQSKLQRVVYNLIELXPSNVLNNSGIIWDQELYQNMDYRQDRTFFHSFELDKCLAGFSFANETDAQKFYKKVLDKGCHPESIENPVLSFITRKGSSRHAPNNSNIQPPSAAPPVPGKENYNAVGSKSPNEPELLNSLDPSLIDSLMKMGISQDQIAENADFVKAYLNESAGTPTSTSAPPIPPSIPSSRPPERVPSLSAPAPPPIPPPSNGTVSSPPNSPPRPIAPVSMNPAINSTSKPPLPPPSSRVSAAALAANKKRPPPPPPPSRRNRGKPPIGNGSSNSSLPPPPPPPRSNAAGSIPLPPQGRSAPPPPPPRSAPSTGRQPPPLSSSRAVSNPPAPPPAIPGRSAPALPPLGNASRTSTPPVPTPPSLPPSAPPSLPPSAPPSLPMGAPAAPPLPPSAPIAPPLPAGMPAAPPLPPAAPAPPPAPAPAPAAPVASIAELPQQDGRANLMASIRASGGMDLLKSRVSIDIITXWLLVLIFSRKVSASPSVASTKTSNPPVEAPPSNNLMDALASALNQRKTKVAQSGMSGFLVFFFKSSXVYXFFQTEEDEDDDEWD

SEQ ID NO: 2276 - protein, 1382 aa, Schizosaccharomyces pombe
  unsure (1)..(1382): unsure at all Xaa locations
MPSLINFDAISSLKSSLHGLSICAFNHLHHVPQHNGSLAHEGPTNQTDYSSRHHESQFSQEAHAEQRSRDDEEANSFEGSCNNSDQSWTSRVTSKKNEAGTESGDASVRRIYVTSIPEEHRHLPSQWFPSNKIRTTKYTPVSFIPKNLWNQFKNIANAFFLFVTLLQCIPLFCPEHLGLSFIPLSVILLTTAIKDGIEDYRRCVLDKKFNNTLTWKLVGFNNANALGEHIGLWRKLKKFISHTVADMSYCLKNSGISSGLATLTVDNISHRHSLESDSAFTLSSVSQDSLEIHEIGNSGPSNSFSVIQEQSTGSSNAKFERVCRKSLLVGDIVKVLADEAIPADLLILSTENSNGVCYVETKNLDGETNLKDKYALCSTKCCKSEYRCSAASFWVECEQPHADLYSLNGVVKAPGAVQSPSESTNGRKIHEEPFSISNVLLCGCTLRNSKWVIGLVLYTGSETRIQKNRGLTPSKRSRITRDLNWTIILNFLLLFAMCLFSGVLRSIYSAQNNSARVFELSKNSNTAPAHGIISIFTSLILFQNLVPISLYITMDIVRSIQSYFIFSDREMYDEKLDCPCSPKSWNISDDLGQIEYIFSDKTGTLTQNIMSFKKCSINGIRYGKSHNEDTCIKKRRNLNYNENLSCKVDLDKKKMLETLSLSDSPNPESITFISSKFVDHLQSNENYIQTEACFEFFKALALCHSVVTDVQDETLIYNAQSPDEEALVKVARDFGFTLLNTKNRRYTIRIRGENKNFRVLDIIPFTSTRKRMSVIIRDEDGIIHLICKGADTVIFPRLSSGQNNIIEKTKKHLASFSSEGFRTLCIARRTIDKQDYLEWKVNFNEANSAIHERNEKVSKVSEMIEQELELLGGTAIEDKLQENVPETIALLAIAGIKLWVLTGDKVETAINIGYSCNLLDPNMTIFRIDANSFGALEEVEAFIRNTLCFNFGYMGTDEEFRFLLKDHSPPSPKHAIVIDGDALNFVLSEQVSFLFLMLCKQCKTVLCCRVSPSQKAAVVALVKKSLNVVTLAIGDGANDVSMIQEADVGVGIKGVEGQAASMSADYAIGQFSFLGRLLLVHGRWDYKRMSQMISFFFYKNVIWTFILFWYQFYNEFDGNYIFDYTYVMLFNLLFTSLPVIIAGCFDQDVDASVSMKNPSLYQRGILGLEWNGKRFWXVXLXRFLFAKYLFXSYMLDGIYQSLVCFGVALFVFKFGDFVSWTGRNIECIEDIGLFISSPTIFVINIFILMNQERLNLISLITWMFSIGVFWIWTFIYSEVGPSYAFHKSASRTCQTFGFWCVTVLTIALCLLPRFSYICLQKLFYPRDIDLLRRRLCAKSDDETSSSSSFATDIEMCEQCNDPLSSKKNSGIVTSVSFDDSNK

SEQ ID NO: 2277 - protein, 250 aa, Schizosaccharomyces pombe
  unsure (1)..(250): unsure at all Xaa locations
MDKESYDYLVKIVLAGPSGTGKSCLLQRFVKNQCKYMQIXQCSSFXWKLGDDQVSHTVGIDFASRIISVGMGNQQKRIKLQIWDTAGQEKFRSVARNYYRGAAGAVLVYDVTNKDSFEELSSWLSDIRAMAPSTICVVLAGSKSDLQNQRQVSTEEAAEFCSEKHISSAHETSSYTGSNVEECFLSVVSTIITRIELGEIDPQDQSLGIQYGDLSFRRPVHPSSTSNWWTSITNWDDLVRLERQTRSYCC

SEQ ID NO: 2278 - protein, 215 aa, Schizosaccharomyces pombe
  unsure (1)..(215): unsure at all Xaa locations
YAPFFGVMGCTAAIVFASFGAAYGTAKAGVGISAMGVLRPDLIVXVYLIKFTVFYVFLFHKMLXCLLLLVIXKAXVGKCNKKPGFTDFLXHIDYCIGSITNLTYHSVKNTIPVVMAGIIAIYGLVVSVLISGNLKQILSLYSGFIQLGAGLSVGLAGLAAGFAIGIVGDAGVRGTAQQPRLFVAMILILIFAEVLGLYGLIVALLLNTRATDNVT

SEQ ID NO: 2279 - protein, 709 aa, Schizosaccharomyces pombe
MHPALLCGPILAIFLQFLVSSCSPLENDDLFLVQVEPEVDPVVAAEAIGAKYVRPLLNLKYHHLIKLHKGSDDSVQSSIRKRGIDAGILELERQTPRWRYKRDASESDELLNEFSNHFGISDPLFYGQWHIFNSNNPGHDLNLREVWDAGYFGENVTVAFVDDGIDFKHPDLQAAYTSLGSWDFNDNIADPLPKLSDDQHGTRCAGEVAAAWNDVCGVGIAPRAKVAGLRILSAPITDAVESEALNYGFQTNHIYSCSWGPADDGRAMDAPNTATRRALMNGVLNGRNGLGSIFVFASGNGGHYHDNCNFDGYTNSIFSATIGAVDAEHKIPFYSEVCAAQLVSAYSSGSHLSILTTNPEGTCTRSHGGTSAAAPLASAVYALALSIRPDLSWRDIQHITVYSASPFDSPSQNAEWQKTPAGFQFSHHFGFGKLDASKFVEVAKDWQVVNPQTWLIAPEINVNKSFGSVNNETITEMVSEFTVTKDMIEKSNFKRLEHVTVRVCIPFNRRGALEILLESPSGIRSILASERPYDENSKGFLDWTFMTVQHWAEPPEGVWKLLVNDRSGGKHEGTFENWQLALWGESENPSNTAPLPYDTLELPKEMVLGIYSEPNSDLTNSSTLLSPTSTSFTSYTVSATATPTSTSHIPIPTVLPPTQPVLEPSYREIVAFITFFLLFAFIFVAVIWTWISAFWKAKAPPPLSQQEIA

SEQ ID NO: 2280 - protein, 646 aa, Schizosaccharomyces pombe
MMNKWAKNWFGLSKKSVSTNSAKGSLPRSPLASIQTNQPVEEGEGGSLPSVSNLGPSSIDHPMEEFASDQSTVGNRNSNDILPEVDHEPSGYLKLQIGSLVLGGPHTDAALAMECSRLNQLFVVVQFGTTEFVSPPLKWESPGRDIGTSSRDSANVSRSSSMMSSHPIPTPAIQRTSSIPNPLTPSYVVFDVAKPVPIDVNIYDHGNNNEFVGRTYIHPSYNYGQFEQFCNSVEVSPAYNRMVDLRLSLNTVFQPLSQHSYGPDDFVPLKLIGKGTFGQVYLVRKKDTERVYAMKVLSKKVIVRRKEVAHTVGERDILVQTSAADSPFIVALRFSFQTPKDLYLVTDYMAGGELFWHLQKSVRFPEERAKFYIAELLLALQALHKRGIVYRDLKPENILLDVQGHIALCDFGLSKANLSVGTTTRTFCGTTDYLAPEVILDEAGYDMMVDFWSLGVLLYEMTCGWSPFYADNTQQLYKNIVFGKVRFPRGLLSVEARDLIKLLLNRNPKHRLGAHGDVEEVMKHPFFDGIDWKKLAAKEISPPFKPIVEGEIDVSNFDVEFTNKAIDRDFSSTDEMSTSAPLSSTVQNGFKGFTYIDASAMDEAFGYHNSNDSASSISSQDDYSKDNSDMDLNRANDEVFMGQIDP

SEQ ID NO: 2281 - protein, 925 aa, Schizosaccharomyces pombe
  unsure (1)..(925): unsure at all Xaa locations
ELLLRFFESAHFTSQLCVAYLSRYPNNIGIHHFLCEKLATYVYRIISLFFMSNTYXFPYEEIEFFIPQLMYVYFDKXRKIFGGKESTKKSSSXVSESRVYDSYAYFIIXXLSYLLIFFPSNVYSVVFVHLXYHTVVILVLNKDSESVALEEFIISQCEQNTQCALITFWYLQAHMVDLGLQPHSSCFKICKRLYNRIQILVFMSSSSLIQSQQKISENVTPALILSGIMLGGVCVPELLKKAGPIAIAQGRKAPRQDPDESDVDVLRRLSTEPRYSLDVLRSSLNNSIVEQHSEVSLRLKAPELTRTHSYQSSATLSIDEQRRVLRSNYFQQEIQFLFALQDISIRLIIVPRQARLSSLRAELALLNNNLPADVNIPLLRSYHKEVSHKIVRIDPKEATILNSAERVPYLIMVEVLSGELSFEPQSKKNKAKVQKIVSHKNQRKRWFDLTDVDPYTNLQDSTDNDISESESEGGDLSMSPLIKGLVPDTLSLSKSFSSFGNVSLQVPSSHRDTDVVLLSGRHSDSDGNGALKRSKIYASEITARMRAAATMLSQLDAEGSRRPKAETERIKNSIILDMQRLEEERLNEPSIYPVSVDISCAEDLRFGKETQKAERKGDRDDPSAATFQEDWYAKKERIRKSSPYGHYPNWDLVSVIVKTGADLRQETFACQLIYAFQRVWLECKEKVWVRRMKILVTGDNSGLIETITNAISVHSIKKNLTKQLREAELAQGKIAGKNVVTLKDYFIKQFGDPNSSRYRQAQTNFLQSLVAYSIISYLLQLKDRHNGNVLIDSEGHIIHIDFGFLLTNTPGNVGFESAPFKLTADYLEILDDRFDEYRSLMKAAFKSVRKNADQIILLVEVMQNNSTMPCFRAGENTSAQLLQRFQLQLGDKECDDFVDLLIQKANCSVWTRLYDLFQNITNGIY

SEQ ID NO: 2282 - protein, 398 aa, Schizosaccharomyces pombe
  unsure (1)..(398): unsure at all Xaa locations
MVDQLEDSVIETNYDEXIDTFDDMNXXAELLRXYXCXYGFERXFCHSAXSXXMPILGERDVLAQAQSGTGKXCYLLNSVLQKIDTSLKQCQALXPCSYXVXLAQQIQXGCCCFRRLMNVXMXMLVLVGTLXSXXYGCLASGVHVVVGTPGRVHDMIQRRXSSYRCRPNXLSXXGXXNVVRGFKDQIYXHFPTXCLLLLKXFFFLPXCXXRCFXSHHQIYAXSHSYPCXKDELTLEGXQAILCCRXKGRVEAXHLCDLYETVTVTQAVIFCNTRRKVXLAYRAAHXAXFYRLLHHGDMDQAQRDTLMHEFRTGSSRILITTXSSCSWYRCPXXVSLVXQLXLTCXXEKTTFTVLXRGGRFGXKGVPLTLLPXDDVAXCVRLNNLQYTHXGNAYEIADLI

SEQ ID NO: 2283 - protein, 409 aa, Schizosaccharomyces pombe
MFRTCTKIGTVPKVLVNQKGLIDGLRRVTTDATTSRANPAHVPEEHDKPFPVKLDDSVFEGYKIDVPSTEIEVTKGELLGLYEKMVTIRRLELACDALYKAKKIRGFCHLSIGQEAVAAGIEGAITLDDSIITSYRCHGFAYTRGLSIRSIIGELMGRQCGASKGKGGSMHIFAKNFYGGNGIVGAQIPLGAGIGFAQKYLEKPTTTFALYGDGASNQGQAFEAFNMAKLWGLPVIFACENNKYGMGTSAERSSAMTEFYKRGQYIPGLLVNGMDVLAVLQASKFAKKYTVENSQPLLMEFVTYRYGGHSMSDPGTTYRSREEVQKVRAARDPIEGLKKHIMEWGVANANELKNIEKRIRGMVDEEVRIAEESPFPDPIEESLFSDVYVAGTEPAYARGRNSLEYHQYK

SEQ ID NO: 2284 - protein, 211 aa, Schizosaccharomyces pombe
MTTEAAPNLLVLTRHGESEWNKLNLFTGWKDPALSETGIKEAKLGGERLKSRGYKFDIAFTSALQRAQKTCQIILEEVGEPNLETIKSEKLNERYYGDLQGLNKDDARKKWGAEQVQIWRRSYDIAPPNGESLKDTAERVLPYYKSTIVPHILKGEKVLIAAHGNSLRALIMDLEGLTGDQIVKRELATGVPIVYHLDKDGKYVSKELIDN

SEQ ID NO: 2285 - protein, 321 aa, Schizosaccharomyces pombe
MSAEQKYFENAQNVHFTLADGSKIPGLGLGTWRSEPNQTKNAVKTALQYGYRHIDAAAIYGNEDEVGDGIKESGVPRKDIWVTSKLWCNAHAPEAVPKALEKTLKDLKLDYLDEYLIHWPVSFKTGEDKFPKDKDGNLIYEKNPIEETWKAMEKLLETGKVRHIGLSNFNDTNLERILKVAKVKPAVHQMELHPFLPQTEFVEKHKKLGIHVTAYSPFGNQNTIYESKIPKLIEHETIQKIAKSKGEGVTGATIAVSWAITRGTSVIPKSVNEQRIKSNFKYIPLTKEDMDEINSIGIRARFNQATFSNEPVFAGLEDGRT

SEQ ID NO: 2286 - protein, 143 aa, Schizosaccharomyces pombe
MPASKEQTDEMKEAFVLYDIDKDGLIPTSHVGSVLRSLGINVTDAELAKLSNELGDAIDEKKFMSFVSNKLRETESEEEYIKAFRVFDKDNSGYIETAKFADYMKTLGEKLSDNEVQLMVQEADPTNSGSFDYYDFVQRIMAK

SEQ ID NO: 2287 - protein, 969 aa, Schizosaccharomyces pombe
MIFRKSISKSPSSKGSTVCFRCGQAFQRRETPISFGGHMWHKDCFCCTKCDKGLEHSDQMLVQTSDGRPVCSSCAHTCTACRMRIKDYALMSGYDSYHRECFRCHDCRKQIIDSNFKRDNRTIFCNDCKQVRHPSRSSDESADYHNFEVDVTIKPTETKSSVESNKSLSIEIMSPQKPPLSPFGGSRDRLVSETPTNMSQAEGGNVPNDGQDSNLASNSADSLLPSAKNRSFSSFTSFESPMKYDDSFFPISPSISPLQKVNKQQQIESPTATFPLSKNTWKNRFHTFHKQSFTPVNDSSSSDSLKPTINEEALDDFAGSASPYKTMSLTDRAEPIVMNGHMRSLHNATSPFRPFSPSYRSSDTHSPRTRSPNVQTHKKTSSQPSDLSSFAQLLSPPQVLSPKPNGGGHKSFRHSHSLSETSQQTLVPSLGSNGEYHLPTNDHSSTPAQSERDSDVEELREQLENLTALTKKLSERLSSSTFDNSKFIRTEDKDTVRSAKLEICEKFFSFADVTDDPTLKDPKHQDLVAAANAYMAMLRESYGTEINNLLERRNELLDDYNNVQKILNESLEASVHLNTKNLELADLNNNLVKQIQHRVPPENQSNLEHTITTSSKNTTSSINPLTAVSSNSGQSSGRPGPLSPNLNVTTRIDIKGKKGSMHLQPRDVNRKVPFKSMHTKSKSADPVVGNEDRTQCDHVFHVNAIFKPSRCYICSESVWGSELRCFHCSISCHSRCLKRLFAESEHEKTMSETVSENSKWMPEMPTRMPPPGPSPTMFGRSLENQLKIEGSVLPQVIAMCVSCVDAHGLEVEGIYRISGSASQVRVLVDEFENGSIRMEHLTSDLFACTSVLKTYLHRLPEPVIPGTQYEELLEAEKIEKEEEKIERVVEVMKTLHPAHLSVFRFLIAHLGRVCKHAEKNLMNSKNVSTVFAPTLMRDKVNRFDLQHATKKSTALQFMLDNVDKILHNL

SEQ ID NO: 2288 - protein, 480 aa, Schizosaccharomyces pombe
  unsure (1)..(480): unsure at all Xaa locations
MAVSAVPHPSKQAQASEEGINQEKCINEGMSATFXHTISSXSMXNVFLIXNEYKIWKKNSPFLYDLIITRALEWPCMSLQWYPEQQMXVNHLNHNVXSCLCDSKNLPLFFVIVLAEHGYTEQKMFLGVRADVGKYLLAVASIQLPYLNQTVPPTTMEGASAGDESSLRVNISNLYSHPESVCSAKLMPQDDSCVATVGNYHNDVLVFDKESFESYSSASESPLKPKYRLTKHTQPCTSVCWNFLSKGTLVSGSQDATLSCWDLNAYNESDSASVLKVHISSHEKQVSDVRFHYKHQDLLASVSYDQYLHVHDIRRPDASTKPARSVHAHSGPIHSVAFNPHNDFILATCSTDKTIALWDLRNLNQRLHTLEGHEDIVTKISFSPHEEPILASTSADRRTLVWDLSRIGEDQPAEEAQDGPPELLFMHGGHTSCTIDMDWCPNYNWTMATAAEDNILQIWTPSRSIWGNEQLEEDATAYLS

SEQ ID NO: 2289 - protein, 1004 aa, Schizosaccharomyces pombe
IKNRMFRRMSDLESYPAVMRDVAELKDDNERLNLDTIKRNALVELKKLRLIKQQESLRHQVMHCQPHLRTIVNAVERMSCRRPKLVPQATRLTEVLERQQRSDRERRLKQKQCDYLQTVCAHGREINVRTKNAQARAQKANRAVLAYHSHIEKEEQRRAERNAKQRLQALKENDEEAYLKLIDQAKDTRITHLLRQTDHYLDSLAAAVKVQQSQFGESAYDEDMDRRMNPEDDRKIDYYNVAHNIREVVTEQPSILVGGKLKEYQLRGLQWMISLYNNHLNGILADEMGLGKTIQTISLITHLIEKKRQNGPFLVIVPLSTLTNWTMEFERWAPSIVKIVYKGPPQVRKALHPQVRHSNFQVLLTTYEYIIKDRPLLSRIKWIYMIIDEGHRMKNTQSKLTNTLTTYYSSRYRLILTGTPLQNNLPELWALLNFVLPRIFNSIKSFDEWFNTPFANTGGQDKMELTEEESLLVIRRLHKVLRPFLLRRLKKDVEAELPDKVEKVIRCQMSGLQQKLYYQMKKHGMLYVEDAKRGKTGIKGLQNTVMQLKKICNHPFVFEDVERSIDPTGFNYDMLWRVSGKFELLDRILPKLFRSGHRILMFFQMTQIMNIMEDYLHYRQWRYLRLDGSTKADDRSKLLGVFNDPTAEVNLFLLSTRAGGLGLNLQTADTVIIFDSDWNPHQDLQAQDRAHRIGQTKEVRIYRLITEKSVEENILARAQYKLDIDGKVIQAGKFDNKSTPEEREAFLRSLLENENGEEENDEKGELDDDELNEILARGDDELRLFKQMTEDLERESPYGKNKEKERLIQVSELPEFYQREEPEKTTDLLQEEPLGRGARRRTPVVYDEAVRDAQWMAEMDMESEARPTRGRPKRNIASVDETPALTLNGKPKKKRGPAPDTLTSEHRSLLRRVCLEIYKAVNELEDDNGRPLNKLFLELPSKKLYPDYYMIIKSPIALDAIRKHINGTFYKTLEAMKSDLMTMFNNARTYNEEGSFVYEDANKM

SEQ ID NO: 2290 - protein, 209 aa, Schizosaccharomyces pombe
  unsure (1)..(209): unsure at all Xaa locations
MASASPSSSRRLTKVSKFLYFYFILTXLIFKWXPEYSDLREHPIPDIRVNLVDDNLFHWACTALGPSDSVYAGGKFHFSLKFPLDYPFQPPTIEFTTRIYHPNVSILSYFCMEXSLITFLNEIHNYLYIYEFSNLFSLDSEGNVCLAILKQQVFKPSIKLRSVLEQILQLLREPNPDDPLVASIAEQYRNDRPSFDKIARDYVEQFAKS

SEQ ID NO: 2291 - protein, 389 aa, Schizosaccharomyces pombe
LASIDTDSHLSPKVLEKLRPTENLAYEDDSLDDDTWRSKRWEFDYQYSGISTFAHLPHVRCLVEQSEDFDIAIIGVPFDTAVSHRPGARFGPKGIRSASSRQMAIRGFNPSLNVNPYESWAKILDCGDIPVSSYDNQLAVRQMTEGYIDLLSRKATASPASNNLKTAGLAKDGIFHPRLITLGGDHSIGLASLRALGHFYGNVSVIHFDSHLDTWNPKRYYPSYWHSDRADFTHGTMFWMASKEGLINNGTSIHAGLRTRLSGTDYYDYEEDNRVGFTFIEAQEIDEIGVNGIVERIKQVVGDTLVYLSIDIDVVDPGLAPGTGTPETGGWTTREMKSILRKLDGHLNLVGAEVVEVSPPYDDRAESTSLAASDFIFEILSSMVKHPLY

SEQ ID NO: 2292 - protein, 315 aa, Schizosaccharomyces pombe
KEFAKNAREAYFTLPNGDKIPSIGLGTWRSGKDETKNAVCAALKAGYRHIDTAHIYGNEKEIGEGIRESGVPRTDIWVTSKLWCNAHRAGLVPLALEKTLQDLNLEYIDAYLIHWPFALLSGPEELPRNEKGELIYEDVPIEETWQAMEELLETGKVRYIGISNFNNEYLDRVLKIAKVKPTIHQMELHPYLPQTEYLEKHKKLQIHVSAYSPLANQNDAYNSDISKLIEHKTLVDIANARGEGITPANIAISWAVKRGTSVLPKSVNESRIVSNFLYIPLTDKEMEAINNIGVVRRFSHGKFAPKPMFVGLQDG

SEQ ID NO: 2293 - protein, 435 aa, Schizosaccharomyces pombe
VFRNIFGDAEIRKIWSDENRTQEYLNWEAALARAEASLGIIPKYAGEEIQRVCKVENIDFSKLEEETINIGYPVLGVVHQLANLCSGDSGKYCHWGATTQDVTDSATVRQMIDSFKIIKGYLEKAIELATVLVIKHRETTMAGRSNLQQAVPITFGFKMARFVATLRRHHQRLCELLPRVSVLEFGGACGTLASLENKGLMVQQKLAEELGLLQPEIAWHTERDRIAEAGCFLGMLTGTLAKFATDIKLLMQTEVAEVFEPFKANRGSSSTMPQKRNPISCVYITASTSFVRQGVAALLDAMVEDHERATGAWEIEWIVLPDVFVHTVGTLKQTVFLLEGLEVHPSRMNENLSITNGLIVSEAVMMALAPKLGRDEAHDLVYRLCHLSIQENKPLVELLLAERQVTNYLSKEEVTSLLNPENYLGSTFEMIERAL

SEQ ID NO: 2294 - protein, 913 aa, Schizosaccharomyces pombe
  unsure (1)..(913): unsure at all Xaa locations
AVGETTITLPDLVPVAGTVVVNQEVPEPVVEVTVPAVGTTISTVPEVVPXAGIVEVNGIDPETIVSVTVPAVGSTTSTVPDVVPXAGNVEVYPTEPDIMVSVTVPAVGSTTSTVPDVVPXAGIVEVNGIDPETIVSVTVPAVGATISTVPDVVPXAGNVEVYPTEPDIIVSVTVPAVGSTTSTVPDVVPXAGIVEVNGIDPETIVSVTVPAVGATISTVPDVVLXAGNVEVYPTEPDIMVSVTVPAVGSTTSTVPDVVPXAGNVEVYPTEPDIMVSVTVPAVGSTTSTVPDVVPXAGIVEVNGIDPETIVSVTVPAVGSTTMTAPDEVSXAVIVDIKETDPEITVSVTVPAVGSTTSTVTRVVPLAGNVEVYPTEPETMVSVIVPAVGSTTSTVPEVVPLAGNVEVKVLEPETMVSVIVPAVGSTTSTVPEVVPLAGNVEVNALEPDTMVSVIVPAVGSTTSTVPEVVPLAGNVEVYPTEPETMVSVTVPAVGSTTSTVPEVVPLAGNVEVYPTEPETMVSVTVPAVGSTTSTVPEVVPLAGNVEVYPTEPETMVSVIVPAVGSTNSTVPEVVPLAGNVEVNALEPDTMVSVIVPAVGSTTSTVPEVVPLAGNVEVKVLEPETMVSVIVPAVGSTTSTVPEVVPLAGNVEVYPTEPETMVSVIVPAVGSTTSTVPEVVPLAGNVEVKVLEPETMVFVIVPAVGSTTSTVPEVVPLAGNVEVNALEPDTMVSVIVPAVGSTTSTVPEVVPLAGNVEVYPTEPETMVSVTVPAVGSTTSTVPEVVPLAGNVEVYPTEPETIVSVIVPAVGSTTSTVPEVVPLAGNVEVYPTEPETIVSVIVPAVGSTTSTVPEVVPLAGNVEVYPTEPETIVSVIVPAVGSTTSTVPEVVPLAGNVEVYPTEPETIVSVIVPAVG

SEQ ID NO: 2295 - protein, 1333 aa, Schizosaccharomyces pombe
MSYANYRYMKARAKRWRPENLDGIQTSDEHLINLFAKILSKHVPEIGKFDPNKDVESYISKLDQHFTEYPSLFPNEHTKRQYTLNHLEELEQQFAERMFSENGSLTWQELLRQPGKVQGSNKGDRLTKTFEGFRNQLDKVQFIRKLMSKANVDDFHTRLFILWMLPYSLRKLKERNYWKSEISEIYDFLEDKRTASYGKTHKRFQPQNKNLGKEFLPKKNNTTNSRNLRKTNISRIEYSSNKFLNHTRKRYEMVLQAELPDFKCSIPCLIDTGTQANIITEETVRAHKLPTRPWSKSVIYGGVYPNKINRKTIKLNISLNGISIKTEFLVVKKFSHPAAISFTTLYDNNIEISSSKHTLSQMNKVSNIVKEPELPDIYKEFKDITAETNTEKLPKPIKGLEFEVELTQENYRLPIRNYPLPPGKMQAMNDEINQGLKSGIIRESKAINACPVMFVPKKEGTLRMVVDYKPLNKYVKPNIYPLPLIEQLLAKIQGSTIFTKLDLKSAYHLIRVRKGDEHKLAFRCPRGVFEYLVMPYGISIAPAHFQYFINTILGEVKESHVVCYMDNILIHSKSESEHVKHVKDVLQKLKNANLIINQAKCEFHQSQVKFIGYHISEKGFTPCQENIDKVLQWKQPKNRKELRQFLGSVNYLRKFIPKTSQLTHPLNNLLKKDVRWKWTPTQTQAIENIKQCLVSPPVLRHFDFSKKILLETDASDVAVGAVLSQKHDDDKYYPVGYYSAKMSKAQLNYSVSDKEMLAIIKSLKHWRHYLESTIEPFKILTDHRNLIGRITNESEPENKRLARWQLFLQDFNFEINYRPGSANHIADALSRIVDETEPIPKDSEDNSINFVNQISITDDFKNQVVTEYTNDTKLLNLLNNEDKRVEENIQLKDGLLINSKDQILLPNDTQLTRTIIKKYHEEGKLIHPGIELLTNIILRRFTWKGIRKQIQEYVQNCHTCQINKSRNHKPYGPLQPIPPSERPWESLSMDFITALPESSGYNALFVVVDRFSKMAILVPCTKSITAEQTARMFDQRVIAYFGNPKEIIADNDHIFTSQTWKDFAHKYNFVMKFSLPYRPQTDGQTERTNQTVEKLLRCVCSTHPNTWVDHISLVQQSYNNAIHSATQMTPFEIVHRYSPALSPLELPSFSDKTDENSQETIQVFQTVKEHLNTNNIKMKKYFDMKIQEIEEFQPGDLVMVKRTKTGFLHKSNKLAPSFAGPFYVLQKSGPNNYELDLPDSIKHMFSSTFHVSHLEKYRHNSELNYATIDESDIGTILHILEHKNREQVLYLNVKYISNLNPSTIMSGWTTLATALQADKAIVNDYIKNNNLNI

SEQ ID NO: 2296 - protein, 1333 aa, Schizosaccharomyces pombe
MSYANYRYMKARAKRWRPENLDGIQTSDEHLINLFAKILSKHVPEIGKFDPNKDVESYISKLDQHFTEYPSLFPNEHTKRQYTLNHLEELEQQFAERMFSENGSLTWQELLRQTGKVQGSNKGDRLTKTFEGFRNQLDKVQFIRKLMSKANVDDFHTRLFILWMLPYSLRKLKERNYWKSEISEIYDFLEDKRTASYGKTHKRFQPQNKNLGKESLSKKNNTTNSRNLRKTNVSRIEYSSNKFLNHTRKRYEMVLQAELPDFKCSIPCLIDTGAQANIITEETVRAHKLPTRPWSKSVIYGGVYPNKINRKTIKLNISLNGISIKTEFLVVKKFSHPAAISFTTLYDNNIEISSSKHTLSQMNKVSNIVKEPELPDIYKEFKDITAETNTEKLPKPIKGLEFEVELTQENYRLPIRNYPLPPGKMQAMNDEINQGLKSGIIRESKAINACPVMFVPKKEGTLRMVVDYKPLNKYVKPNIYPLPLIEQLLAKIQGSTIFTKLDLKSAYHLIRVRKGDEHKLAFRCPRGVFEYLVMPYGISIAPAHFQYFINTILGEVKESHVVCYMDNILIHSKSESEHVKHVKDVLQKLKNANLIINQAKCEFHQSQVKFIGYHISEKGFTPCQENIDKVLQWKQPKNRKELRQFLGSVNYLRKFIPKTSQLTHPLNNLLKKDVRWKWTPTQTQAIENIKQCLVSPPVLRHFDFSKKILLETDASDVAVGAVLSQKHDDDKYYPVGYYSAKMSKAQLNYSVSDKEMLAIIKSLKHWRHYLESTIEPFKILTDHRNLIGRITNESEPENKRLARWQLFLQDFNFEINYRPGSANHIADALSRIVDETEPIPKDSEDNSINFVNQISITDDFKNQVVTEYTNDTKLLNLLNNEDKRVEENIQLKDGLLINSKDQILLPNDTQLTRTIIKKYHEEGKLIHPGIELLTNIILRRFTWKGIRKQIQEYVQNCHTCQINKSRNHKPYGPLQPIPPSERPWESLSMDFITALPESSGYNALFVVVDRFSKMAILVPCTKSITAEQTARMFDQRVIAYFGNPKEIIADNDHIFTSQTWKDFAHKYNFVMKFSLPYRPQTDGQTERTNQTVEKLLRCVCSTHPNTWVDHISLVQQSYNNAIHSATQMTPFEIVHRYSPALSPLELPSFSDKTDENSQETIQVFQTVKEHLNTNNIKMKKYFDMKIQEIEEFQPGDLVMVKRTKTGFLHKSNKLAPSFAGPFYVLQKSGPNNYELDLPDSIKHMFSSTFHVSHLEKYRHNSELNYATIDESDIGTILHILEHKNREQVLYLNVKYISNLNPSTIMSGWTTLATALQADKAIVNDYIKNNNLNI

SEQ ID NO: 2297 - protein, 474 aa, Schizosaccharomyces pombe
MSSTATVTESTHFFPNEPQGPSIKTETIPGPKGKAAAEEMSKYHDISAVKFPVDYEKSIGNYLVDLDGNVLLDVYSQIATIPIGYNNPTLLKAAKSDEVATILMNRPALGNYPPKEWARVAYEGAIKYAPKGQKYVYFQMSGSDANEIAYKLAMLHHFNNKPRPTGDYTAEENESCLNNAAPGSPEVAVLSFRHSFHGRLFGSLSTTRSKPVHKLGMPAFPWPQADFPALKYPLEEHVEENAKEEQRCIDQVEQILTNHHCPVVACIIEPIQSEGGDNHASPDFFHKLQATLKKHDVKFIVDEVQTGVGSTGTLWAHEQWNLPYPPDMVTFSKKFQAAGIFYHDLALRPHAYQHFNTWMGDPFRAVQSRYILQEIQDKDLLNNVKSVGDFLYAGLEELARKHPGKINNLRGKGKGTFIAWDCESPAARDKFCADMRINGVNIGGCGVAAIRLRPMLVFQKHHAQILLKKIDELI

SEQ ID NO: 2298 - protein, 1081 aa, Schizosaccharomyces pombe
  unsure (1)..(1081): unsure at all Xaa locations
MILTRESYALGSIVRIKLVNFVTYDYCELFPGPYLNLIIGPNGTGKSTIVSAICIGLGWPPKVSLSILXKITXLINDLLLGRAKEAREFIKYGKNTATIEIEMKYRDDETVTITRQISQDKSSSFSINREACATSSITSLMDTFNVQLNNLCHFLPQDRVAEFAQLDPYSRLMETERAIDHEGLLPAHEKLIDLRKREREILQNKNQGQSTLNSLKDRQQALEKEVNIFKEREKIKSYIEMLGLAKMLVIYREKTNVFNQLRADKKKLKKDLKDLVEEFQPILDKGEELRSDLKLKDDTFNDYSSASMELNTSNLRARASFSNFMENEKKLYEKVNTNRTLLRNANLTLNEAQQSVKSLTERQGPRPSDNGVQDLQEKMQEVNAEKLQHENEKLESSHELGSIRTLKAQKLIDLDNIKRELSYYNDATKRKLDFMSSAPGWEDAYQTYQLLKEYESAFEAPAYGPIYMNLKCKEKGFAALIEGFFRTDTFRTFIMSNYNDYLKLMDLITSKTKYTPTIREFSSERKKKIEDFEPPCSREKLQSFGFDGYVIDFLEGPEVVLVALCHMLKIHQIPIAKRELPPASVNALNNFRLANGDPVLKTYLAGSSIHLVFRSAYGDREITRRTDPLPSRSIYFSENVEMDLVKRKEEQLNAQLSQLENLQNEERKLQEKVNEHESLLSRTNDILSTLRKERDEKLIPIHEWQQLQERIEHQTLLLRQREKVPEQFAAEIEKNEDIRKENFEALMNSVLKVKENSIKATNNFEKMLGSRLNVIEAKYKLEKHEMDANQVNARLTEVQDRLKDITDKLASAREDAMSLYGSVVDSLQTQSSDRQTAITELNEEFATSSEVDNKISIEETKLKFMNVNSYVMEQYDARKKEIEELESKMSDFDQSVEELQDEMNSIKEDWVSKLEENVQCISDRFSKGMSGMGYAGEVRLGKSDDYDKWYIDILVQFREEEGLQKLTGQRQSGGERSVSTIMYLLSLQGLAIAPFRIVDEINQGMDPRNERVVHRHIVNSVCDNAVSQYFLVTPKLLPDLTYHRNLKVLCICNGAWLPATFRTSLSTYFEKLKKSALISSS

SEQ ID NO: 2299 - protein, 474 aa, Schizosaccharomyces pombe
  unsure (1)..(474): unsure at all Xaa locations
MDFLSHAMLSRSESTQILCELSQIDESTMDPQYTEDDVLARLFVFSSSSPQTVCSLVSIDFXHILVLNVKKYEDVSVGRSNTCNYQLLQFTASYKHFRVYSVLIDDDMDPLVYCEDQSSNGTFLNHRLIGKGNSVLLSDGDILDVRHCASFLFQQKYTTDNDFHHEYAGERFNITQRLLGIGGFSRIYMAMDNNTGGQYACKIIDKKKISTKRFFEDHEMTILRKLDHPNIIKVNMEYNSETQLXVDXMRFVILMINIPXFYFEEMVTGGDLFSYLTKLGTVPEVTTLFIMFQILQGLKYLHEQNIIHRDLKLENILIASSSDTIFRIILTDFGVARCMQKGKRLSTFVGTPEYTAPEIQRLKGRSQVEKENSSGYGKEVDLWSLGVIMFLLLSGNSPSFADGVKEKQVDFRDPVWKSVSRQAKDLISNLLKTNPPDRFTVKQCLSHPWFARHSSRLTKLYETRILKPLKHSRL

SEQ ID NO: 2300 - protein, 495 aa, Schizosaccharomyces pombe
ERIRGAYNQAQMMESGRVLSIGDGIARISGLSNVQAEELVEFSSGIKGMALNLEADTVGCVLFGNDRLVREGEVVKRTRHIVDVPVGEALLGRVVDALGNPIDGKGPIKTTERRRVQLKAPGILPRTSVCEPMQTGLKAIDSMVPIGRGQRELIIGDRQTGKTAIALDTILNHKRWNNSSDESKKLYCVYVAVGQKRSTVAQLVQKLEENDSLKYSIIVAATASESAPLQYLAPFSGCAMGEWFRDNGKHGLVVYDDLSKQAVAYRQMSLLLRRPPGREAYPGDVFYLHSRLLERAAKMSPKHGGGSLTALPVIETQGGDVSAYIPTNVISITDGQIFLESELFFKGIRPAINVGLSVSRVGSAAQVKAMKQVAGQIKLFLAQYREVASFAQFGSDLDAGTRATLDRGLRLTELLKQPQYSPLAVEEQVPLIYCGVKGYLDKIPVDRVVEFEHKFIPYLRSSGAEIMEAIRKEGVLSKTTEDSLKAVIKEFLSSF

SEQ ID NO: 2301 - protein, 758 aa, Schizosaccharomyces pombe
  unsure (1)..(758): unsure at all Xaa locations
ITVSHFGESIFLPYHQDIEWITSTEGTVLYYDQSTFSLSLFYPDGKEYGSNVDSLITSFVLTCKNLHRKRYSSDMEYIAFSCSKDRRWRHSYYEDVYLVERATGRIEHLASDQSKKIVVAEWSPIGHKLVYGLGSNLFIWESFSEPPVCITDQSDLDGLFNGNSDWVYEEEILQSSKAVWWSPDGNCLSYLSIDDSKVPVHVLPFEQLDSKVEDQNRVNNFFHYSTPKDPIPFVKLFVNCFTDSGESIEVDSSFPLSTQHRYITDVAWAGNEKLMFVEVLRGNYERVTSLFDLSSRKTTIENTEVSEHPLALTSSLHLKYLSFESLGNLKERYVRQYFLSNKKRIAIYELDNPVPIYLTPVNISFLSDLYLINNTLXVKVFEYETSNFITDYFTAISSGSPFSRVYRLCTKSLILSEINIQIGSGLFGIKVSNDQNYLLVNYLGPEIPKQFIYSIHEDKVSTSNDHSKNNLPSDSSSTSLGKVKLELCNSLETNEELIITKEKFAFPSVFFKVIKVKNITAYIQEIRPPNFNPRKRYPTVFHLYGAPQSALVTGKYEMDINELMASVYNFLVIKVDIVDISDVSGQHLFSDSHELIIKSWIELLRSYVDTPYIDRHRVGIWGWSFGGYLTLKILENADFIKTGAVVAPVTDWRYYDAYYSENLLGAYSKQTTAIYDKTAVHYSENFRKLCGLLVLHGTSDDNVHIENTMQLTKAMVEKGVYNYYPFIVPNANHEFSDPTDYTFLREKLSGHFHHALYC

SEQ ID NO: 2302 - protein, 232 aa, Schizosaccharomyces pombe
  unsure (1)..(232): unsure at all Xaa locations
MALPKRIIKVCAFCXHFSTNNWXEIETLTRDPPPGIVAAPTEDNLRYFKITMEGPQQSAYEGGKFHLELFLPDEYPMVGFFXKHSIEPTMVLLLALLVQQKFEEWHCQFQTVFKKLYNCVIXVLTTIRMPPNVRFLTKIYHPNVDKLGRICLSTLKSMLNFTRFILFWCTNINKSEDWSPALQIRTVLLSIQALMGAPNPDDPLDNDVAKIWKENEPQAIANAREWTKKYAV

SEQ ID NO: 2303 - protein, 227 aa, Schizosaccharomyces pombe
MSLSDEQVQAEMHKMVSFIKQEALEKAKEIHTLSEEEFQVEKAKIVREQCDAIDQTYDMKLKRASMAQKIAKSNVLNKSRLEILNSKQKVIDDIFSRVEKKLDGIEQKKDAYTKFMADLIVQAMELLGEPVGIVYSRQRDAEIVKAAIPKATEVLKSKNGSIDYELDAETDDFLNDSVLGGVVLVGLGGKIRVDNTLRARLEIVKEEALPEIRRLLFGENPNRKFDN

SEQ ID NO: 2304 - protein, 92 aa, Schizosaccharomyces pombe
  unsure (1)..(92): unsure at all Xaa locations
MSDPARKSFTEQGKEKMTPDSSKSTLDKAKESITGAYDKVASAFTSDEDKSTSQEAHDKGSNALLMTSCKEVLMTXKFMLLAGETQSTKASG

SEQ ID NO: 2305 - protein, 369 aa, Schizosaccharomyces pombe
VFLPSGETYDQEHLDDNRVLGYNPLVPAALVQQEIPVSETSRKVITDSRKEIQAILNKQDDRIIVVVGPCSIHDPKLAMDYAKLLKPKADELQDALCVVMRCYLEKPRTTIGWKGLVNDPNLDGSFAINKGIRMARQMYCDVTNFGIPLASEMLDNISPQFFADLLSFGAIGARTTESQLHRELASALSFPVGFKNGTDGTVGVAIDAIGATAHPHTMLGVTKQGLAAITMTRGNKDTFIILRGGKKGPNYDAEHVAAVRKDLEKANLPPRIMIDCSHGNSSKNHLNQPKVSKSIAEQIRNGDSSIVGVMIESHINEGRQDAPIRPGVKDTLKYGVSITDACVSWEQTAPMLDDLAEAVRARRQNQKSN

SEQ ID NO: 2306 - protein, 170 aa, Schizosaccharomyces pombe
  unsure (1)..(170): unsure at all Xaa locations
KIAFSLFDRHGTGRIPKTSIGDLLRACGQNPTLAEITEIESTLPAEVXFLVMGLESYTPXPCIKXQYXLVVDMEQFLQVLNRPNGFDMPGDPEEFVKGFQVFDKDATGMIGVGELRYGMYLXRSILFSDXXKNAKLIVSVLTSLGEKLSNEEMDELLKGVPVKDGMVNYH

SEQ ID NO: 2307 - protein, 692 aa, Schizosaccharomyces pombe
  unsure (1)..(692): unsure at all Xaa locations
QVNDLYPIAVLIDELKVGNKLFYVXYVQLXLLLKHDEITYRLNALERLSTIALALGPERTRDELIPFLDGMHSIIKLWNYRFKFLKFFIFFNKRCMFVGXHSLNTESIDDEDEVLSALADQLGNFVDYVGGPEYAHVLLSPLENLAATEETVVRDKAVDSLNKVCICLSQEQLEQYFVPLVQRLSTAEWFTSRASSAGLYCAAYSQSENPAVKVSLRQSFSHLCHDEAPMVRRPAATNCAKFVFLVTKQEAIDEFIPLFNSLSNDDQDSVRLLSFDIMVSLAEVLKSDSEIRHYLLQPLRSFVSDSSWRTRYMVAANFVKLAKVVGPSLIKDELIKPFVLLMKDTEQEVRRAIATQIPGFCELLDKRIVLEEIIPVIQELINDPAQHVRAALGMNIGALAPQLGKEKYVCXKXLFFXKPHFTNRYIXTTEYLLPMFLELLKDENPEVRLNIISKLEVVNKGNCKFKIXLLLQLYXLTLVVGIELLSQSLLPAIVTLAEDKQWRVRLAIIDYIPLLAQQLGVEFFNEKMGNLCMSWLEDHVYSIREAAIKNLRKLTEIFGLEWATETIIPKFLAMRSHPNYLYRMTTIFAISVSFSFLLFSSSNVFXEIAPALNAEVIEKQILPTLEQLVNDPIPNIRFNVAKAFEVLKPVLAAGGDSTVYEQQIIPLLEQLTKDNDPDVQYFATQALEQTND

SEQ ID NO: 2308 - protein, 1274 aa, Schizosaccharomyces pombe
MKFRLNANFNFSFRRYCFVQCRNKYHSHVRYLSSAKKSGILRNSYNQRTERYFTNIMIPSDYSNKFYPVDGVVPKHETQAYEFLKKFPEYDGRGVTVGILDTGVDPGAPGLSVTTTGLPKFKNIVDCTGAGDVDTSVEVAAADSNDYLTITGRSGRTLKLSKEWKNPSKKWKVGCKLAYEFFPKDLRKRLQKLETEDMNKSNRKLLQDATDEYAKFKDKFPEAPLDKDNLQTQKELEARIECLKQLAEKFDNPGPLYDVVVFHDGEHWRVVIDSDQTGDIYLHKPLADFNVAQEWSTFGSLDLLSYGVHVYDNGNITSIVAVSGTHGTHVAGIIGANHPETPELNGAAPGCQLVSLMIGDGRLDSLETSHAFSRACSEIIKNEVDIINISFGEDAGIPNKGRVIELLRDELAGKRNVVIVSSAGNNGPAYTTVGAPGGTTFDVISVGAYVTSGMMQAQYNLLSTVHDTPYTWCSRGPTLDGDTGVSIYAPGGAITSVPPYSLQNSQLMNGTSMSSPSACGGISLILSALKAQKKPYTAAAIKKAVMYTSKDLRDDFNTGMLQVDNAYEYLAQSDFQYTGARSFTINGNIGNSKRGVYLRNPTEVCSPSRHMFNVAPKFEDGEEYEKSHFEVQLSLATTQPWIQAPEYVMMAGTGRGIPVRVDPTALAPGHHFGKVLAYDASNESRRCVFEIPVTVMKPSSISNTCFSLRDVSFEPTLIKRHFLVPPKGATYVEIRVKATSELESTNMLWISVNQTIPQTKLNEASTELIMPVTQNEVTTKLVSIDDSYTLELCMAQWWSSLEPMVLDIDVNFHGIKVVNGKEINLISSQGLKRVDCASIRRENFKPDITLKDYVDSFKPTNTVIKPLGDRDIMPDGQQLFELMATYSVEISEKTELKADFAVPHNMYDNGFNGLFFMVFDSQKQRVHYGDMYTSSHTLEKGEYLYKFQLLSVDPSTLERFRNVTLRLTKKLKKPITLPLYADHIDFCDNKTYERENIDAGVVESFVVGTNIEGEQYASELKENSLLTGELKFGDCEKGTVPVTLVLPPKISTKEDTKLGEKCANIVQLQVDLLSKLADQEKEKHLKYLQSSYKNSLEVQLAKLDIVKETNERLSTADSILSLIDTEALSRYYSCQQKVEDTIPRDVVLEKKMALQRDAFIRALVVKCETFSTQGHKDKDNYFQNYQLLLNWLENSDPRVWQIKKDYYKSQNQYGLALKALLELLKENGNSGKMDVAKLLSEEKELLVNLGWNYWHDIVFVETVKRVPPYSYALF

SEQ ID NO: 2309 - protein, 703 aa, Schizosaccharomyces pombe
MSLSRCPTDNSSSRINSSVPLINSSSPATPPESFDPQVFPSSLIHGDNLLPQDDQIASDPRSESNSCNGNTSSSLPCTDSYQYPLKHSCTPSFLRKFNESIENVSYKCLDHSPPDSVPGDFSISLVPQRNFLYSHSSLPPKIISIDRNNRIKLDNSISSNSDNFPPSPKVDTSNTVSPGSKPISEDLEDLNLQSIVQTFEDLPEGIQSYAFFQLLRSCNRQSMRLLLNECEPLLKKDILSNLPFSIVQSILLNLDIHSFLSCRLVSPTWNRILDVHTSYWKHMFSLFGFQINENDWKYANPNLNRPPFLHNDQISDDYFPEIFKRHFLNRKRWLFPSIPPSHLSFPIHVPNFMITSLLLHKDRIITTSGSGTIQIHNAITGVLEARLEGHKEGVWAVKIHENTLVSGSIDKTVRVWNIEKAKCTHIFRGHISIIRCLEILVPSRLIRHGVEIVEPDQPYIVSGSRDHTLRVWKLPKNTDPPYLPDNTNSIDRWEKNPYFVHTLIGHTDSVRTISGYGDILVSGSYDSSIRIWRVSTGECLYHLRGHSLRIYSVLYEPERNICISGSMDKSIRVWDLSTGTCKYVLEGHDAFVTLLNVFQNRLISGSADSTIRIWDLNTGKPLMVLPSNSGYISSFVSDEHKIISGNDGSVKLWDVRTGKLLRFLLTDLTKIWHVDFDAMRCVAAVQRDDQAYLEVINFSGSRP

SEQ ID NO: 2310 - protein, 1407 aa, Schizosaccharomyces pombe
  unsure (1)..(1407): unsure at all Xaa locations
MSTSAIALALSSSKAIEQLDHVQTETPNLKQEMSESPSNSGVASKRKLQSTEWLDPELYGLRRSVCLTLFYSLXNLLRCXSLXGRTRSNPGRYVDTDDQEDVFPSKHRKGTRNGSSFSRHRTIRDLDDEAESVTSEESESDDSSYGGTPKKRSRQKKSNTYVQDEIRFSSRNSKGVNYNEDAYFESFEEEEEEEMYEYATEVSEEPEDTRAIDVVLDHRLIEGHDGSTPSEDYEFLIKWVNFSHLHCTWEPYNNISMIRGSKKVDNHIKQVILLDREIREDPTTTREDIEAMDIEKERKRENYEEYKQVDRIVAKHLNSDGSVEYLVKWKQLLYDFCTWEASSIIEPIAATEIQAFQEREESALSPSRGTNYGNSRPKYRKLEQQPSYITGGELRDFQLTGVNWMAYLWHKNENGILADEMGLGKTVQTVAFLSYLAHSLRQHGPFLVVVPLSTVPAWQETLALWASDMNCISYLGNTTSRQVIRDYEFYVDGTQKIKFNLLLTTYEYVLKDRSVLSNIKWQYMAIDEAHRLKNSESSLYEALSQFKNSNRLLITGTPLQNNIRELAALVDFLMPGKFEIREEINLEAPDEEQEAYIRSLQEHLQPYILRRLKKDVEKSLPSKSERILRVELSDLQMYWYKNILTRNYRVLTQSISSGSQISLLNIVVELKKASNHPYLFDGVEESWMQKINSQGRRDEVLKGLIMNSGKMVLLDKLLSRLRRDGHRVLIFSQMVRMLDILGDYLSLRGYPHQRLDGTVPAAVRRTSIDHFNAPNSPDFVFLLSTRAGGLGINLMTADTVIIFDSDWNPQADLQAMARAHRIGQKNHVMVYRLLSKDTIEEDVLERARRKMILEYAIISLGVTDKQKNSKNDKFSAEELSAILKFGASNMFKAENNQKKLEDMNLDEILEHAEDHDTSNDVGGASMGGEEFLKQFEVTDYKADVSWDDIIPLTEREKFEEEDRLREEEEALKQEIELSSRRGNRPYPSSAVESPSYSGTSERKSKKQMLKDEVLLEKEIRLLYRAMIRYGSLEHRYNDIVKYADLTTQDAHVIKKIAADLVTASRKAVSAAEKDLSNDQSNNKSSRKALLITFKGVKNINAETLVQRLNDLDILYDAMPTSGYSNFQIPMHVRSVHGWSCQWGPREDSMLLSGICKHGFGAWLEIRDDPELKMKDKIFLEDTKQTDNSVPKDKENKEKKVPSAVHLVRRGEYLLSALREHHQNFGIKSSPAISTNGKTQPKKQTANRRQSGKPNVKSAQKIESATRTPSPAISESRKKPSSKDTKIETPSREQSRSQTASPVKSEKDDGNVSLNAEQKARCKELMYPVRKHMKRLRKDSSGLGRAELVKLLTECLTTIGKHIEKTVNDTPSEEKATVRKNLWMFACYFWPKEEVKYTSLISMYEKMK

SEQ ID NO: 2311 - protein, 849 aa, Schizosaccharomyces pombe
MPSGAQGNTQSAAYKRIVNVSRNFQFKAALNKDTREWTFQHRSSGTALYSAIASLGDPSSPWDAVYVASPGPVQISEGNDHTVETKIDEAAVVHRSSSIVISPEDQEIFLKKATEYYRKKNIEADIVPVWGKVQRVPQAKSSSATITPSVSNKLSTAYQSIKSEALKDGPMYADSVLWDVLHYRIPTLDGYQQHNLWKNFTRWSQYFADNIVSNYRPGDLILIHDYSLFLLPRLIRKQLSDAPIVFFLHAPFCTSEVFRCLSKRAEILKGVLASNVIAMQTDSYTRHFLSTCSNVLGLETTSTHIDTSDGFRVVVFSSHVSIDVPRVYSRCNSKPVSLKIQQLKSLYPSDKKLIVGRDQLTKACGVTHKLRAFRELLIHFPKWRGHVVLIQITSLPVGNNYSNEELKKTENLVAQINSEFGSLDYTPVIHFHQLLDPDEYYALLSVANIACVSSVRDSMNTMALEYVACQQKNKGSLILSEFSGTAELLLSAYLVNPYDYSRFAETINYCLNMTEKERERRFSSLWKQATSQSSQQWIYKLINRAAYEVKALESHMTTPLLTYNILIKPYRNAKRRLFLLDYDGTLIESARNSIDAVPTDRLLRTLKRLASDSRNIVWILSGRSQKFMEEWMGDISELGLSSEHGSAIRPPLAGSWSSCAENLDLSWKDTVRDFFQYYVERTPGSYIEEKKHSISWCYQNANTTYSKFQSLECQTNLEDMLKHYDVEISPAKSFLEVHPNYLNKGSIVRRILKRSGSVDFVFCAGDDKTDENMFEVFLPTAFSNSHLIDEIDSTEYSGSHHTDDNSDANKVENVKVATFRVHIGLTDKPTLSDYHLPAPRDLGELLHNL

SEQ ID NO: 2312 - protein, 886 aa, Schizosaccharomyces pombe
  unsure (1)..(886): unsure at all Xaa locations
MCHSKEVKFKTNFHHPYTPYDIQLEFMRSLYSSISDGKIGIFESPTGTGKSLSLICASLTWLDEHGGVLLEDNEKSNDNKSNTSSKIPDWVLEQDLKIQKDLVKETHARLEQRLEEIRKRNQSRKNQMSNNSTTYHRETKRRNINAEASTSDNCNNSNTSVDPMDEYLVTAEYTMPSTSEQSEDLFNNGYSSKVSELLRKLSPDNEKPPIVQKGTNLGAYKEYSFSGNIFLTYCXIYFTSRTHSQLQQLVQEIKKLNNQTFSTPIRVVSLASRKNLCINNEVRKLRPTSALNEKCIELQGTLTTSLDXKFSLILTFTFXDSAHKCPFLQDNTQLWDFRDEALAEIMDIEELVELGQRLKVCPYYGTREAVDSAQIVTLPYPLLLQESARNALNLTLKDNICIIDEAHNLIDAICSMHSSSISFRQVCIAETQLQQYFLRFEKRLNGNNRMHIKQLIKVVYNLKSFFLNCLETNTNSKVINVDSLLVSNGADQINLHHLSEYLNVSKLARKVDGYTKYMHSLGTQELESLNDLRSERFSNGNGYEEDPYTPVLMQLESFLLNIANPAPEGKLFYEKQTGDNPYLKYLLLDPSKHVEILTEQCRSVNLAGGTMSPIDDFITLLFSDEQSRILPFSCDHIVPPENITTILVSQGPAGVPFEFTHKRKDDENLLKDLGRTFQNFISIIPDGVVVFFPSFAFLQQAVKVWEMNGITNRLNAKKPLFIESKDFGDNPLDTFEHYKQSVDAGLSGMLFSVIGGRLSEGINFSDKLGRAVMVVGMPFPNSQDVEWQAKVSYVEEKAKEKGINAKQASQEFYENTCMRAVNQSIGRAIRHRDDYASIILLDSRYNRSSIQRKLPNWLSKNIHSSPNFGPAIRQLATFFRAKKMCD

SEQ ID NO: 2313 - protein, 851 aa, Schizosaccharomyces pombe
MTARNSASIPTSIRKTSENEVSGDETPAGVGNLSTKTASKTSLTFRQSSSDESTSSYSGNHHNINIQHHPNRPFRTNSSSFSPNDYSISESPSKSKKDGVHVSAVQLDNETDSEVESEVEELERELEAIEDSVYPEVRAAVNPTDDVNLPVNTWRTWVLTTIFVIVFAAVNQFFSLRYPALSISFIVAQLILFPLGKLLNLLPNWKIGYGRFSFYLNSSPFNVKEHAAITIAVSLTSSTAYATNILSAQTSFYKQNLSWGYKILIVLTSQMLGYGFAGLTRRWIVYPAAMIWPQTLVSTVLFRTLHGNSGNDIGVLKNNRISANGWTISRYRFFAYVMIGSFVFYWFPGFIFKGLSYFTVLCWIWPKNRVVNQLFGYNSGLGILPLTFDWQQVVYNSNPLASPWWVICNTFGSVVLIFWIVVPILYYKGVWFSNYLPMLSSSTFDHTGVSYNSSRVLNSDYSFNHTKYESYSPLYMPMSYSMSTALNFAAVTAIFTHCALYNGKDIWQRLWKESGKDECIHRKLMRNYKEAPQWWYATLFIVVFGLTIFTVRYYDTQCPVWALIVALLIFIVNFIPQGVLEGITNQHVGLNIITELIGGYILPGKPLANLMIKLYGFIPMRQGLEFSRDLKLAQYMKIPPRILFFVQLFATILGGITQVAVQEWMNYHIPGICTTSQSNGFTCPNGRSIYNASLIWGAIGPAKMFSKGKPYYPLIFFFLIGAVAPFITWGLRKRFPKSWIGKLNAPVLFTGPGNIPPATGINYSSWAIVGFIFNYVIRKRAIHWWRKYNYVLAAAMDSGVAVAGVVIFLCVSYPGGKITWWGNTVYTKTYDWKSVPYRSLGPNETFGYTNW

SEQ ID NO: 2314 - protein, 573 aa, Schizosaccharomyces pombe
MKLNIFKSHGDSNTAEERPVPLEQVEAEDQQHENRFWLGLTAKEFRLMMLAGVGFFLDSYDLFIINLVTPIFEYLYWGGIEKGPNGKGHYPSGIRGLVNAASNIGNIFGQLMFGFMGDFFGRKFVYGKEMIIVIIATILLIAMPKSIHSPLSKMMWVFCWRWLLGVGIGGDYPMSAAITSERSKLNRRGTLISLIFAFQGFGTLAGAIVTIILLGCFEHPLNREGHYRKLEGVWRLQFGLALVPAIGVLIPRLMMEETQKFKNSQQLNSGDNRDPKTSLNFEDDELVKNPSVTKGHPEIHESSENYLSRSNTVENEPENIEKQFESVSAPANRSGFIQYFRQWHHFKHLLGTSVCWFLLDIAFYGVNLNQSVILKNIGFSSGTNEYRTLMKNAIGNLIIAVAGYVPGYWFNVFLVEILGRKWIQLQGFVITGLMFAILAGRWNEISTGGRFACFVIAQLFSNFGPNSTTFIYPAEVFPARVRGTAHGISAALGKCGAILASLLFNFLTSIIGYGNVMWIFCGCMWGGILFTLLLPETKGRDADEIDRVELFYGGDGKVECNSKWKSWYVNGIF

SEQ ID NO: 2315 - protein, 579 aa, Schizosaccharomyces pombe
MKVVPSEKIKPNWWRETSVYQIYPASFKDSNGDGFGDLEGIISKVDYLKALNVESIWLCPIYPSPLKDMGYDVSDYKQIDSRYGTLEDLDRLMKALHERDMKLVMDLVLNHTSDQHEWFKESRSSKTNPKRDWYFWKPARYNEKGERLPPNNWRSYFDTSAWEWDEATQEYYLHLWSVGQPDLNWETPKVREAVHDILRFWLDRGVDGFRLDAINMISKDQRFLDAPITDDRYEYQLAYQYYANGPRIHEYLNGIGNILTEYDAFSVGEMPYVLDTNEILHVVGADRRELTMIFQFDFVDLDLDPNQHKYIEGSWELSDLKKSLKKWQSALLSGGGWNASFIENHDQTRTVSRYLSDSPKYRAYSSKLMALFIIFQSGTPFVFQGQELALANIPRDWPIDEYLDVETQNFWKLFMSGNPSQEEIEKTMDIVNKRARDNGRTPMHWDSSPNGGFTKAGVKPWMRVTNDYKEWNAANQVNDPESPYTFWSKALELRKELKDAVVYGSFELISEEDPSIVAFVRESSTYKLIILLNFTGNKVSYDCPLNLTSYEILLDNYKDFICMTSPVTLNPYQAVLLKL

SEQ ID NO: 2316 - protein, 557 aa, Schizosaccharomyces pombe
MGRTLTSVLVVFISMAGWLGGADTGSISGILGMRDFQSRFADRYNPITNSYSYSAWRQALLTGTVNAGCLFGAMLSSPFTEAIGKKYSIAFFSGCYIIGQILLVTAVPSWVQIMVGKLFTGLTIGALSVLSPGYQSEVAPPQIRGAVVSTYQLFQTCGTLIAACINMGTHKLRKTASWRTSFGINILWGIFLMVGVLFLPESPRYLIYKGRDEEALRIMCQTAELDPESEIIQTNFNTIKSDIEMEMAGGKARWPEVFGKEVRYRTVLGFLTMLLRELIGNNYYFYYATQVFKGTGMTDIFLPAVILGAINFGTTFGALYTIDNLGRRNPLIFGAAFQSICFFIYAAVGDRKLIYKNGTSDHRAGAVMIVFSCLFLFSYCCSWGPMGWVIVGETFPIRYRSKCAAVATSGNWLGNFMVSFFTPFISNSIGFKLGYIYACINMTSAFQIFLMAKETKGLTLEEVNELYESDIKPWDSYKYVRQIESRRIHFSKEEEKREREKSKGYRGQEERFIENADGADNDDSSASSESFASAGAHSRSVFPRRSNVSEESHPTWV

SEQ ID NO: 2317 - protein, 179 aa, Schizosaccharomyces pombe
  unsure (1)..(179): unsure at all Xaa locations
MNSSIKRLHKEYASFQAGDISGLLLLKPVTDVDMFHWKAVIEGPTETPYEGGQWVLDIHVHEGYPISPPSVYFQTKIVHPNISWTVSQFKXSFLDYIHXLTSMVERRSMYGHIKTHWSPAWSLQSACLAIISLLSNYDASSPLNVDAAKLLRTGDKTAYNSLVRCTTYLYAKGKIEDLS

SEQ ID NO: 2318 - protein, 436 aa, Schizosaccharomyces pombe
MGDRFIPIRNVSNEFNFSFQSFKECVLSHGSNLRRKTSGTVCTFFSFIFPLLTTAVQRQFMELLSMELFGSQASRSRAFYYGEDKRKIEKKMLDTPDRKSYSLSPISPQSQDMLRQPQKPKRAFPKTPYKILDAPYLKNDFYLNLLDWGQSNVLAVGLASSIYLWSAASGKVVQLHDFGATNHVTSVLWTGKGTQLAVGTDSGVIYIWDIESTKSVRSLKGHSERVAALAWNDNTLTSGGKDEVILHHDLRAPGCCAEMMKVHEQEICGLQWDRSLGQLASGGNDNNLFVWDYRSSRPLHKFEEHTAAVKAIGWSPHQRGILASGGGTIDRCLTIHNTLTGRLQNKLDTGSQVCNMAWSKTSNEIVTTHGFAKNQVSLWKYPSLKNIANLTAHTNRVLYLSMSPDGQSIVTGAGDETLRFWKLFNKKPKEESTLIR

SEQ ID NO: 2319 - protein, 344 aa, Schizosaccharomyces pombe
DLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 2320 - protein, 573 aa, Schizosaccharomyces pombe; identical to SEQ ID NO: 2314

SEQ ID NO: 2321 - protein, 579 aa, Schizosaccharomyces pombe; identical to SEQ ID NO: 2315

SEQ ID NO: 2322 - protein, 557 aa, Schizosaccharomyces pombe; identical to SEQ ID NO: 2316

SEQ ID NO: 2323 - protein, 179 aa, Schizosaccharomyces pombe; identical to SEQ ID NO: 2317
  unsure (1)..(179): unsure at all Xaa locations

SEQ ID NO: 2324 - protein, 436 aa, Schizosaccharomyces pombe; identical to SEQ ID NO: 2318

SEQ ID NO: 2325 - protein, 344 aa, Schizosaccharomyces pombe; identical to SEQ ID NO: 2319

SEQ ID NO: 2326 - protein, 436 aa, Schizosaccharomyces pombe; identical to SEQ ID NO: 2318

SEQ ID NO: 2327 - protein, 347 aa, Schizosaccharomyces pombe
MKKDLDEIDTDIVTLSSFILQEQRRYNQKHKNEEGKPCIIQEASGELSLLLNSLQFSFKFIANTIRKAELVNLIGLSGIVNSTGDEQKKLDKICNDIFITAMKSNGCCKLIVSEEEEDLIVVDSNGSYAVTCDPIDGSSNIDAGVSVGTIFGIYKLRPGSQGDISDVLRPGKEMVAAGYTMYGASAHLLLTTGHRVNGFTLDTDIGEFILTHRNMKMPLQHSIYSINEGYTAFWDEKIARFIAHLKESTPDKKPYSARYIGSMVADMHRTILYGGLFAYPCSKGNNGKLRLLYECFPMAFLVEQAGGIAVNDKGDRILDLVPKTLHGKSSIWLGSKHEVEEYINFIK

SEQ ID NO: 2328 - protein, 735 aa, Schizosaccharomyces pombe
MPSKFSSKYVDTEAISNDDDNPFATAKSYYSKDTDLSTRVSAGRPRTLSTSMEASAAPTIPELKNLRRRGSLDEHKQPRKFLVDVDKTLNALLESEDTDRNMQITIEDTGPKVVSLGSASSGGYRLYELRGTYQLSNLLQELTLAKDYGRRYILLDERRLNENPVNRLSRLIKGTFWDALTRRIDASVLDVICRDTKDRSGSHVNRIYVPKAEQEMYEYYVRAAKERPYLNLQVEYLPEEITPEWVRDVNDKPGLLALAMEKYQDDEGNTHLRGVPFVVPGGRFNELYGWDSYFESLGLLVDDRVDLAKGMVENFIFEITYYGKILNANRTYYLLRSQPPFLTDMALRVYERIKNEEGSLDFLHRAFSATIKEYHTVWTATPRLDPKTGLSRYRPGGLGIPPETEASHFEHLLRPYMEKYHMTLEEFTHAYNYQQIHEPALDEYFVHDRAVRESGHDTTYRLEKVCADLATVDLNSLLYKYETDISHVILEYFDDKFVLPNGTIETSAIWDRRARARRAAMEKYLWSEADSMWYDYNTKLETKSTYESATAFWALWAGVATPRQAAKFVDVSLPKFEVAGGIVAGTKRSLGKVGLDNPSRQWDYPNGWSPQQILAWYGLIRYGYEEETRRLVYRWLYTITKSFVDFNGIVVEKYDLTRPVDPHRVEAEYGNQGVNIKGVAREGFGWVNASYEVGLTFCNSHMRRALGACTTPDVFFAGIKEESLPAFENLSIHKN

SEQ ID NO: 2329 - protein, 632 aa, Schizosaccharomyces pombe
  unsure (1)..(632): unsure at all Xaa locations
MAERLSVGALRIIKXVNCPNYILKRFRQIGMLTRFFSTSDASSFPPNPILQVLTVKELNSNPTSGAPKRYRVVLSDSINYAQSMLSTQLNHLVAENKLQKGAFVQLTQFTVNVMKERKILIVLGLNVLTELGVMDKIGNPAGLETVDALRQQQNEQNNASAPRTGISTSTNSFYGNNAAATAPAPPPMMKKPAAPNSLSTIIYPIEGLSPYQNKWTIRARVTNKSEVKHWHNQRGEGKLFSVNLLDESGEIRATGFNDQVDAFYDILQEGSVYYISRCRVNIAKKQYTNVQNEYELMFERDTEIRKAEDQTAVPVAKFSFVSLQEVGDVAKDAVIDVIGVLQNVGPVQQITSRATSRGFDKRDITIVDQTGYEMRVTLWGKTAIEFSVSEESILAFKGVKVNDFQGRSLSMLTSSTMSVDPDIQESHLLKGWYDGQGRGQEFAKHSVISSTLSTTGRSAERKNIAEVQAEHLGMSETPDYFSLKGTIVYIRKKNVSYPACPAADCNKKVFDQGGSWRCEKCNKEYDAPQYRYIITIAVGDHTGQLWLNVFDDVGKLIMHKTADELNDLQENDENAFMNCMAEACYMPYIFQCRAKQDNFKGEMRVRYTVMSINQMDWKEESKRLINFIESAQ

SEQ ID NO: 2330 - protein, 450 aa, Schizosaccharomyces pombe
YLANGSFSSGKSIVGAHSLEEFVSKLKKPRVCILLVKAGKPVDYLIEGLAPLLEKGDIIVDGGNSHYPDTTRRCEELAKKGILFVGSGVSGGEEGARYGPSLMPGGNPAAWPRIKPIFQTLAAKAGNNEPCCDWVGEQGAGHYVKMVHNGIEYGDMQLICETYDIMKRGLGMSCDEIADVFEKWNTGKLDSFLIEITRDVLRYKADDGKPLVEKILDAAGQKGTGKWTAQNALEMGTPVSLITEAVFARCLSSLKSERVRASKKLTGPNTKFTGDKKQLIDDLEDALYASKIISYAQGFMLMREAAKEYGWKLNNAGIALMWRGGCIIRSVFLKDITEAFREDPNLESILFHPFFTNGVEKAQAGWRRVVAQAAMLGIPVPATSTGLSFYDGYRSAVLPANLLQAQRDYFGAHTFRVLPEAADKSLPADKDIHINWTGHGGNISATTYDA

SEQ ID NO: 2331 - protein, 899 aa, Schizosaccharomyces pombe
MSVQYDAFSVEQTCADLETDMYNGLSSLQEITRRNKVHGDNDLKVEDEENMVVQFLKQFVKDPLILLLFASSAISVTLGNIDDAISIALAIVIVVTVGFVQEYRSEQSLKALNNLVPHYCNVIRSGKTEHIVASKLVPGDLVILQIGDRVPADLRIVEATELEIDESNLTGENSPRKKSSEAISSNISLTERNNIAFMGTLVRHGHGRGIVVATGSDTEFGRVFLTMQQTEKPKTPLQNSMDDLGKQLSLISLIGIAVIVLVGFFQGKNWLEMLTIGVSLAVAAIPEGLPIIVTVTLALGVLRMSKKRAIIRRLPSVETLGSVNVICSDKTGTLTMNHMTVTKIYTCGMLAAFSLPESEHIELSVRRTVGIEKALLAAALCNNSKVHNKADSILDTTCPWAGFPVDVALIECSERFGLKDPRETYSRISEVSFSSERKYMSVAVQYNSSKMNFMKGATEQVLSSCAYFSDQDGVQHELTAEMKENIQRNEFEMAASGLRIIAVASGINTNKLVFHGLFGINDPPRPQVRESVQYLMTGGVRVIMITGDSVVTAISIARSLGMAIPSNDEEAIRNYALTGAQLDDLDSSSLRDAVSRVVVFARTTPQHKMKIVEALQSLGDVVAMTGDGVNDAPALKLADIGIAMGRQGTDVAKEAADMILTDDSFATILSAVEEGKGIFNNIKNFITFQLSTSVAALSLIAISSVFGFQNPLNAMQILWINILMDGPPAQSLGVESVDEDVMMKPPRPRNAPIISVQLLQRVLLSAFIIVTVTIVVFRVQMQDGNVTARDTTMTFTCFVFFDMFNALACRSETKSVFKLGIFSNRMFNIAVGGSLIGQALVVYASPFQRIFQTEAIGLKDVLILLACTSSVLWVDEIRKWYRRRKGLVRTKSNYLLRNV

SEQ ID NO: 2332 - protein, 449 aa, Schizosaccharomyces pombe
MREIISIHVGQAGTQIGNACWELYCLEHGIQPNGYMNPETASQNSDGGFSTFFSETGQGKYVPRSIYVDLEPNVIDQVRTGPYRDLFHPEQLITGKEDASNNYARGHYTVGKELVDEVTDKIRRIADNCSGLQGFLVFHSFGGGTGSGFGALLLERLAMEYTKKSKLQFSVYPAPQVSTSVVEPYNSVLTTHATLDLADCTFMVDNESCYDICRRNLDIERPSYENLNRLIAQVVSSITASLRFEGSLNVDLAEFQTNLVPYPRIHFPLVTYAPIVSAAKAFHESNSVQEITNQCFEPYNQMVKCDPRAGRYMATCLLYRGDVIPRDVQAAVTTIKAKRTIQFVDWCPTGFKIGICDRPPQHIEGSEIAKVDRAVCMLSNTTSIAEAWSRLDHKFDLMYSKRAFVHWYVGEGMEEGEFSEAREDLAALERDYEEVGQDSMEVDYMEEEY

SEQ ID NO: 2333 - protein, 753 aa, Schizosaccharomyces pombe
LSAEEQTAFDQLFKIADKQDIGVITGEEAVPFLEKSGLAPQVLGQIWQIADAENRGFLTFSGFVIAMRLVALAQEKLPFDYKKSGKIPYFADIHISGVDSSKFVQLNRPNNVSSGDGSDGSFLPPISSDEMTRYQQMFTTVCPTDGLMDGDRASSIFGRAPLSTEILARVWNLVDTHKRGALDIREFNTGMHIINLLLNGSLKSPPVSISPSFIASAASTSSVSAPSQYPGLSRSPPVQAPNIPVSDPWAIPSQDLTSFCQLFSNVDKAHKGYVSGSEAYSFFLASKLPEDVLAQIWDLSDTNSNGKLNIGEFCISLYLIKLKLSGKELPKVLPSSMLSSVAPLMQKSKSVPTSIPSVVPANISSPNPNPTLAPNPTGPSRVTSGTEDLLSLDATPFSPTLAPQHTSSNATKHSAPPVTKSAPFPVVSPLQLNHTPGFPTSPAAKPNSPTSTFFPQSSFGQTIAKNTMDKPSAVRTSVPSQLAAPIPQVASAEQLKLAAEVPKLESQLSQVKKSNDDLQKSSRDVAANLSDVKAKVSEIRKAYDEELAKAKQISLDIETNKAQTEQVNREYSILEATLNALQKQNKQKGEVLEQVVAESEAAKNMVESSNASIQQLKSEVADKEQTLAQLHLQLDEMTQRLVSLDEESKAVSQRKLDLEYKINNSKTQLATATEEYHEHSKQLEAEKQELSKLEDGLKSVNLTEEAPKPEVDSTPRFPSFTSNGITTDKPTLPDTTSSVPTQHNSFDAMHNTL

SEQ ID NO: 2334 - protein, 459 aa, Schizosaccharomyces pombe
MTETVTTTSSDKSEKKNYLFYTSPNHRPPTVVRAEGVYLYLEDGTRIMDATGGAAVACLGHGNKEVIDAMHKQSEKVCYIHSMGFSNEPADKLANLLVSEHPDVFARAYFANSGSEAVETCLKLILQYWQLVGEKQRCHIIARKQGYHGNTLFALSVGGMKPRKQPYEGVFSHTTSHVSPCFEYRYKENGETTEEYVARLAKELEDEILRVGPEKVAAFVAETVSGACTGCATPVPGYFKAMRKVCDKYGVIFYLDEVMSGIGRTGTMHAWEQEGVTPDIQSIAKCLGGGYQPISGALDGHRIMNVFEQKDAAMAGFFTYQAHPIACSAALAVQTILRRDHLVERAAEMGKYLSEKLHETFDSHPNVGNIRGRGLFWGLEIVKDKATKECFPPEYKVGSLANKIGCEHGVFVYPGMGTIDGTRGDHVLLAPPYIITREQIDELVEALSKTITSTVAALP

SEQ ID NO: 2335 - protein, 343 aa, Schizosaccharomyces pombe
IEDRPGQTLTDDHQVKVAIKATGICGSDVHYWKEGGIGDFILKKPMILGHESAGVVVEVGKGVSSLKPGDPVAVEPGCVCRLCDYCRSGRYNLCPHMEFAATPPYDGTLRTYYITTEDFCTKLPKQISVEEGALFEPMSVAVHAMTRGNLKCGSRVLVMGCGTVGLLMMAVAKAYGAIDIVAVDASPSRVEFAQKYVGAKPFTPIAAKENESLPDYAQRYKQAIIEKYGEFDFAVDATGVGICIHTAVLALKRGGTFVQAGNGKPVIDFPINHIINYEINVLGSFRYAHGCYKQSLFLVSNGLVDVKPLITHRFAFKDALKAYETVASGEEGVLKVIIGGPDA

SEQ ID NO: 2336 - protein, 459 aa, Schizosaccharomyces pombe
MTETVTTTSSDKSEKKNYLFYTSPNHRPPTVVRAEGVYLYLEDGTRIMDATGGAAVACLGHGNKEVIDAMHKQSEKVCYIHSMGFSNEPADKLANLLVSEHPDVFARAYFANSGSEAVETCLKLILQYWQLVGEKQRCHIIARKQGYHGNTLFALSVGGMKPRKQPYEGVFSHTTSHVSPCFEYRYKENGETTEEYVARLAKELEDEILRVGPEKVAAFVAETVSGACTGCATPVPGYFKAMRKVCDKYGVIFYLDEVMSGIGRTGTMHAWEQEGVTPDIQSIAKCLGGGYQPISGALVGHRIMNVFEQKDAAMAGFFTYQAHPIACSAALAVQTILRRDHLVERAAEMGKYLSEKLHETFDSHPNVGNIRGRGLFWGLEIVKDKATKECFPPEYKVGSLANKIGCEHGVFVYPGMGTIDGTRGDHVLLAPPYIITREQIDELVEALSKTITSTVAALP

SEQ ID NO: 2337 - protein, 360 aa, Schizosaccharomyces pombe
MAPAEKAFVLRKKMDTAIEDRPGQTLTDDHQVKVAIKATGICGSDVHYWKEGGIGDFILKKPMILGHESAGVVVEVGKGVSSLKPGDPVAVEPGCVCRLCDYCRSGRYNLCPHMEFAATPPYDGTLRTYYITTEDFCTKLPKQISVEEGALFEPMSVAVHAMTRGNLKCGSRVLVMGCGTVGLLMMAVAKAYGAIDIVAVDASPSRVEFAQKYVGAKPFTPIAAKENESLPDYAQRYKQAIIEKYGEFDFAVDATGVGICIHTAVLALKRGGTFVQAGNGKPVIDFPINHIINYEINVLGSFRYAHGCYKQSLFLVSNGLVDVKPLITHRFAFKDALKAYETVASGEEGVLKVIIGGPDA

SEQ ID NO: 2338 - protein, 391 aa, Schizosaccharomyces pombe
MGYKQLIYKLNHPPLRRIDERNDPLFSNGCKNVHLEAQLHPRMNATFVMLARNSDLPGVVSSINSLEKHFNRHFNYPYTFLNDEPFDEKFKETILKLTSANVEFGTLEKDTFGFPGNVDVDAAREAIASQGDRGIMYGDTESYHHMCRFFSGFFYKHPLLLKYQWYWRVEPDVAFTCDISYDPFYYMEENGKIYGYVVALKELEDTVPNLFRYTSAYRRNNNLTSNMWKFFLDAPKKENYDISRKDPTVGLSFSSHLNAMIDSSYSAETSSMEGESYNMCHFWSNFEIANFKFFRNEQYENFFRTMDATGGFWTERWGDAPFHSLAAGLFLSKEQVHYFRDLGYRHSDIHHCGQSLGCNCECIPELSEIESTSGGCVTQWVNLIGDGFLDE

SEQ ID NO: 2339 - protein, 461 aa, Schizosaccharomyces pombe
MAEKSSKKLWGGRFSGATDPLMAEFNKSIYSGKEMCEEDVIGSMAYAKALCQKNVISEEELNSILKGLEQIQREWNSGQFVLEPSDEDVHTANERRLTEIIGDVAGKLHTGRSRNDQVTTDLRLWLCRKIKEVEVYVINLLKVFTNRAEMEIDVIMSGYTHLQRAQPVRWSHFLMSHALPLLGDLGRLRQLYTRVSQLPLGAGALAGNPFNVDREFLRKELGFEGIIMNSMNAVGDRDFVIEFMFWAGMVMLHISRFAEDLIIYSSSEFGFVTLSDAYSTGSSIMPQKKNPDSLELLRGKSGRVLGDMIGLMITVKGTPTTYNKDLQEDKEPLFDAFKTVSDSLQILTGVVSTLTINPTKIAESLTPDLLATDLAEYLVRKGLPFRQTHHISGSAVRMAEERNTTLDKLSVSDLQSLHPLFDEDVSKVFNYEESVEKRCSIGGTAKHCVQEQIEHIRSAIL

SEQ ID NO: 2340 - protein, 271 aa, Schizosaccharomyces pombe
  unsure (1)..(271): unsure at all Xaa locations
VFPLSTIITRVQSSLSFQQAGGFQHLYRGLSSVLVSTLPSGKTKAAVWGSFFIXLKSFIFLNLQQSFPXYSTNFLLXASSFFFVYEYAKARQKPGVRNHLVSASVAEVVSCGILAPAEVVRQRAQISKTSVSQIFQSMIHNYRDLWHSFKGMCGRNVPATAFQFVLYEQFKKKFSATDHVFGAPKGAALSGAITAAVLTPLDVIKTQINLRPESYRKVVRRIYKENGIFGFEKGLGLRVFASSLGLSIYLGTYEHVKSHLHIRKAGEVSVA

SEQ ID NO: 2341 - protein, 445 aa, Schizosaccharomyces pombe
MQTKIFARLAGIGRARFVGTMPDKTKFISKSGTYPQGFSLNGIASGVKANGKKDLAILFSSRPCNAAAVFTKNAFQAAPVQVSRQTLNGCGGKDIHCVVFNSGCANAVTGEGGLMDAQLITAEADNLTRPHWTSWTENSEEFPSSLVMSTGVIGQRLKLDKIQSGLEHAVEDLGSTHEYWMRAAEAICTTDTFPKLVSRELSIAGKVYRIAGFAKGAGMINPNLATLLGLFVTDAPISVDAVRSILRHAINNSFNSISIDGDTSTNDTIAFLANGAAGGSEITKSSPAYKEIRDAVTDIAQQLAKLVVRDGEGATKFVTVQVRGARSEKDAALVASTISNSALVKTAFFGEDANWGRILCAVGYSGAAVNPPATTVSFIPADGTEPLKLLVNGEPQNVDETRASEILSQDELTVDVDLGCGPYAKTNWTCDFSYDYVRINADYRS

SEQ ID NO: 2342 - protein, 686 aa, Schizosaccharomyces pombe
MAFLSACTSWRHVHNAGFTFITKFPFVRNVHKLSYHISPLSSRFSLADISVKENNHPNGPQLRLQTHFFHSSSPMHATKGFRFPKSSTPLTLPAVLSVASFANLLQIPTRRILRDLNRLGIKDVFPEYLITYEYSSLLAEEYGFDVQEAAAYSAPSPKSLNSKKDSGPLRPPVVTLMGHVDHGKTTLLDAFRKSTIASTEHGGITQKIGAFTVPFDKGSKFITFLDTPGHMAFEAMRKRGANIADIVVLVVAGDDGVKPQTVEAIKHIQSADVPVVVALTKSDRPGTPIHKIYEQLLNNGIQVEALGGETQIIPISAKTGKGIPELEAAILTLAEIMEIRASPRDPFQGWIVESSVTKGVGSSATVVVKRGTVKKGMYLVAGKSWCKVRSLVDVNKKSIKQVLPGQAAQVYGWKDLPIAGDLAYEVKSESEAKRILSDIYRQSNEQNFYELAESQNEQRVSALAAKKSGPAAIQEETSVSKSFNIIAKCEDTGSMEALSDYLKPLQFGKVKSRVLYTGVGPVTETDIERAETSDAIIISFGVSVPKATFRLAEKHNVKLLFHNVIYHLMDDVRKLFALRLPPILVQRVTGEAIISAIFDIKAKRAVVHVAGCRVTNGTIEKSHKIRLVRNDKIIWSGEIDSLKHLKEEVTSIKKGRECGILLKNFDEIVTGDKLQTFVEEYKPPDF

SEQ ID NO: 2343 - protein, 847 aa, Schizosaccharomyces pombe
MEKASKNKESGVKKANNSFLQNFGVNTAGKENESTSLPRLPKSEDESIPKQSIKSKNKKKTQHFLSDAFESLKRQEIDTNEKEVIVSAPITSKPAQVFYSKKLERKDEGIRKWEKDPFAPISVKSGAWKKPYTKVPEVSINKATSKRTDLINDKPIVIPIPRASTSTLYFGKHNKPTSENRKGPIGIPTEEILTSQNTQAMLHKLFENNVLDNVKDDSMQRQSSFIPGMHIRLLDHQVQGLTWLKSRETVSKSSASGGILADDVSHENIICCYSVLIIFLMGLGKTIQMIALILSHPLPKKKHSIKSTLVVAPLSLIKQWESEVQTKSKLTAIVYHGASRYKLLKVIHEYDVVITTYQILVSEWVSHNTTGTDGKSPTEAKSYEKKKPSLFAFYWWRIILDEAHTIKNKSSKSALACCALQGINRWCLTGTPLQNNVDELYSLVKFLHINPFNDQSVWKDQISLPLCQGEENLVFKRLRMLLSVIMLRRTKTLLEANAGKDGTGGALKLSKRLVYKVICKFEESERDFYSNLARNMERTMSNFVNSGKLGKNYTNILCLLLRLRQACNHPQSLNFQFEQDVDAFNALDGAANTNKLASDQDVDDLANLLETVEIGSRKKSFCTICMAELPPDFHEKKCKDCSRNFKELDKGIQDPNDKTLYKSSKIREILKILSLDEQEEDDTVRGLRKTIIFSQFTTFLDIIDLHLRKAGIGFVRYDGRMNNRAREKSLDLLRSDSGTQVLLCSLKCGALGLNLTCASRVILCDVWWNPAIEEQAIDRVHRIGQRRDVLVYKLVVENTIEEKIVELQNLKRDLAKQALGDGKKSVFTSKKLTLNDLLFLFNKRAAA

SEQ ID NO: 2344 - protein, 482 aa, Schizosaccharomyces pombe
MTTRRLTRQHLLANTLGNNDENHPSNHIARAKSSLHSSENSLVNGKKATVSSTNVPKKRHALDDVSNFHNKEGVPLASKNTNVRHTTASVSTRRALEEKSIIPATDDEPASKKRRQPSVFNSSVPSLPQHLSTKSHSVSTHGVDAFHKDQATIPKKLKKDVDERVVSKDIPKLHRDSVESPESQDWDDLDAEDWADPLMVSEYVVDIFEYLNELEIETMPSPTYMDRQKELAWKMRGILTDWLIEVHSRFRLLPETLFLAVNIIDRFLSLRVCSLNKLQLVGIAALFIASKYEEVMCPSVQNFVYMADGGYDEEEILQAERYILRVLEFNLAYPNPMNFLRRISKADFYDIQTRTVAKYLVEIGLLDHKLLPYPPSQQCAAAMYLAREMLGRGPWNRNLVHYSGYEEYQLISVVKKMINYLQKPVQHEAFFKKYASKKFMKASLFVRDWIKKNSIPLGDDADEDYTFHKQKRIQHDMKDEEW

SEQ ID NO: 2345 - protein, 318 aa, Schizosaccharomyces pombe
  unsure (1)..(318): unsure at all Xaa locations
MSGYDRALSVFSPDGRLLQVEYGQEAVRRGTTAVRCKPEXNWMEXIAYIYHXQIALRGNECIVIGVERKNVPKLQNVSNFQKIAMVDNHVCLAFAGLNADARILIDKARVEAQNHKLNLADPVSIEYLTRYVAGVQQKYTQSGGVRPFGVSTLIAGFDVGDNTPRVYQTEPAGIYNAWYVRYMFLXNQHCXFTFMDAFFFFFLLSSFLRPICXQRIXKATAIGRASKAAREYLEKNWKEGLSRDETIHLAVSSLLEVVQTASGNIELAIMDPGKDVEFLHSDKIDTIVKEIQDEKEAEAARKKSGRSAPGVSTTSTIQ

SEQ ID NO: 2346 - protein, 267 aa, Schizosaccharomyces pombe
  unsure (1)..(267): unsure at all Xaa locations
MSSQQEKKDYDEEQLRLMEEVCIVVDENDVPLRYGTKKECMFDCWRFIMKLKETHSNKPFRHLMENINKGLLHRAFSMFIFDEQNRLLLQQRAEEKITFPSLWTNTCCSHPLDVAGERGNTLPEAVEGVKNAAQRKLFHELGIQAKYIPKDKFQFLTRIHYLAPSTGAWGEHESMWLIRVSLYXTLDXRTFXLDYILFFKGKVELDINPNEVQAYKYVTMEELKEMFSDPQYGFTPWFKLICEHFMFKWWQDVDHASKFQDTLIHRC

SEQ ID NO: 2347 - protein, 527 aa, Schizosaccharomyces pombe
MSKAATVPVAFQDREKPQEVRLSNIMAARSVADAIRTSLGPKGMDKMIQTGKGEVILTNDGATILKHLSVLHPAAKMLVDLSAAQDVEAGDGTTSVVILAGSMLACAEKLLKKGIHPTVIAESFQRAAGFTVDCMKENALAIELSDRESLLRAATTSLNSKIVSQYSNLLAPIAVDAVLKVIDPRVATNVDLKDIRIVKKLGGIIDDTELIPGLALTQTAVKSAGGPTRIEKANIALIQFQLSPPKPDMENQVVVNDYRQMDKILKEERQYLLNMCKKIKKAGANVILIQKSILRDAVNDLALHFLAKLKIMVIKDIERDEVEFICKSTGCKPIADIESFAEDKLGHADLVEETSSSGEKIVKFSGVKNAGKTVSILCRGANLLTLEEAERSLHDALCVIRCLVKQRALIAGGGSPEIEAAQRLLEHARQLEGREAICIRAFSEALEIIPVTLAENAGLNAIQVVTELRSRHANGEKTAGINVRKGIVTNILEENVLQPLLVNISAIQLAAETTKMIMKIDDITLAR

SEQ ID NO: 2348 - protein, 1458 aa, Schizosaccharomyces pombe
MLELKTNVIQDPELKDSLDLQENDRVEIIGDAVHYIVNDHLNRVFNYTVDQQKIHAALITTFASGKKAIVVILDDIGYVYYVGDNNNDSYIINVPFSTESAWSSPSGLYLQRHRSSDENLNTDLPHIFCLNDPLDELTLIKFDGKKILSLFDSIVYVVGEIVVTHNKKEKKLSFWRSRFIDPESDQSIKSSRNRRRESSFSREKNPDLTRSDSIHYTANTRLSEKFEEQGLAYSTIFSHIESFPITGSTSFDSILGNGVLVITTLVKELEKGYMMLFRLVRDRSPYFLDSLQLHAINLSAIKSKHLQKIVVLSSKGKVSLESPMSPSLPIEGTFRSFRVHGATLYLEDTDGVQRYISLDNRASNSLVKWCLSVIRYVLPLREYEIFYTGHLYALFAFKLSHDEAFISSILACFTFFSRDKVHVEPIEDCNEAYSLSSKFHFKKEILIASQLSSHLDYSTFKNYLMPLAITLHFISEELRLDSVVKPRKDQLVALLLQITTWLKWPRYCEYYNFDIAETFLSIPLSIQVDVEEPVGPTSILQWIIECLRSQSTVPFYGLESYGLPHSCSTMFPQTLSLMQLLDCLLNPNMTLQNLVEEMVRLGISRKRCERYPFGILCIIFTVLEIAAEEYSPNWESEELRLVNRLDVDSFLHPKTPKWVFNKQDQEVKEIKALTSTVTDSTLVDTQSFHPYKVVTDMIFREDRRLAEVNKLLNYSSQITIMTEHFDVDLSSVPMQQKVAQCICVRTLSVPIGAGMLTYGSKNPLPTEKVTPRLFNFTLHLHPGTLIIQPNKEFVTQELTEWPEFNVGVALGLSISKFSKEINTSWIMFNRPETLTAYHAGFLFGLGLNGHLKALATWHSFIYLTSKHDTTSIGLLLGLASSYLGSMDAKVTKLLSVHISALLPVGSNELNISPLTQTAGILGIGLLFHDSCHRRMSEVTMEEILASNESELKNEGYKLAAGFSLGLINLGRGSNLPGMSDLKLVSRLQVGISSQATFQSLEAGSPGAIMALTMIYMKTNDLEVAKKIDIPKSRYLLDFYRPDLILLRVAGKNLIMWDEVKADYEWVKYQIPDIMLSQFDLQEKKVLSSDDLLLYNVLAGICFSLGLRFAGTGNPKAKEILINFLDSFIRLCHLPAKTHDERVTAVTVIRCTQIVALSSSCVMAGYCDLDVLRRLRVLHGRMEPVNYGAQMATHMALGILSLGGGRYSLSRSNLAIAALLISFYPQFPRTTQDNRAHLQAARNLWALAVEERCIIPRNQDTKQPCIVPLNVVQKSGAVQKLEAPILLPPYDSISSVSTLGDKYWNLKIDLDNNSDYRELLRESQTLTLMPYDRTSSKEEPLNLFPKLKDTSSPLWNLVKTSRLFQSSNSPLNVASLQESNNKTSLGVKLLLSMDFDNLTRDRLLSLQILLQFFESCWTGVLLNKFHSRQYLFLSRDLVEDLSLRVWEYVYSHNHNEESV

SEQ ID NO: 2349 - protein, 512 aa, Schizosaccharomyces pombe
MDTTAVASKGSTNVGSSTDTLSTSASLHPSMNAGSVNEYSEQQRHGTNSFNGKPSVHDSVGSDASVSNGHNNHNESSLWTSGIPKALEEATKSKKPDSLVSTSTSGCASAHSVGYQNIDNLIPSPLPESASRSSSQSSHQRHSRDGRGELGSEHGERRSAMDGLRDRHIRKVRVSQLLDLQRRRIRPADHTTKDRYGIQDFNFLQTLGTGSFGRVHLVQSNHNRLYYAIKVLEKKKIVDMKQIEHTCDERYILSRVQHPFITILWGTFQDAKNLFMVMDFAEGGELFSLLRKCHRFPEKVAKFYAAEVILALDYLHHNQIVYRDLKPENLLLDRFGHLKIVDFGFAKRVSTSNCCTLCGTPDYLAPEIISLKPYNKAADWWSLGILIFEMLAGYPPFYSENPMKLYENILEGKVNYPSYFSPASIDLLSHLLQRDITCRYGNLKDGSMDIIMHPWFRDISWDKILTRKIEVPYVPPIQAGMGDSSQFDAYADVATDYGTSEDPEFTSIFKDF

SEQ ID NO: 2350 - protein, 438 aa, Schizosaccharomyces pombe
MGLGFSSKKQLPAYCGPLPVGSLVLELSVPEEFRCEYKTIEHKLRTVKVRIFYPLDPTKDVEPRTDELWLPFHEGIPEVAKGFRWWLLRAFASGLTNLALPVYKGELFHPPNNGKLPVFIFSHGLVGSRNVYSSLCGTIASYGIVVLAMEHRDNSAIISTVRDPLHPEEPPYVVQYREISDFYADATVVLQNERLLFRQQEIQIALQMIRNINDLGTPDENLPFLCSVDSSFYNSVFQSMKGNLNTAQGELIVAGHSFGAATCAFISGSSTKSLYNDYMFHTEFKCSILYDIWMLPVRQLHLSTMRYPTLMIISYEFRRFVDNFQALESWLVNKDSENQNAGESADEKMSVVPLKKYSHVFVYDGTVHANQSDLPILLPRMVLRVLKGKFEADPYEALRINTRSSVQFLRENHVENVQGDNDPSSLQTNIIPGWERIM

SEQ ID NO: 2351 - protein, 267 aa, Schizosaccharomyces pombe; identical to SEQ ID NO: 2346
  unsure (1)..(267): unsure at all Xaa locations

SEQ ID NO: 2352 - protein, 318 aa, Schizosaccharomyces pombe; identical to SEQ ID NO: 2345
  unsure (1)..(318): unsure at all Xaa locations

SEQ ID NO: 2353 - protein, 482 aa, Schizosaccharomyces pombe; identical to SEQ ID NO: 2344

SEQ ID NO: 2354 - protein, 847 aa, Schizosaccharomyces pombe; identical to SEQ ID NO: 2343

SEQ ID NO: 2355 - protein, 463 aa, Schizosaccharomyces pombe
MKLSGISLWLLAASIVHAGKSQFEAFENEFYFKDHLGTISVYHEPYFNGPTTSFPESCAIKQVHLLQRHGSRNPTGDDTATDVSSAQYIDIFQNKLLNGSIPVNFSYPENPLYFVKHWTPVIKAENADQLSSSGRIELFDLGRQVFERYYELFDTDVYDINTAAQERVVDSAEWFSYGMFGDDMQNKTNFIVLPEDDSAGANSLAMYYSCPVYEDNNIDENTTEAAHTSWRNVFLKPIANRLNKYFDSGYNLTVSDVRSLYYICVYEIALRDNSDFCSLFTPSEFLNFEYDSDLDYAYWGGPASEWASTLGGAYVNNLANNLRKGVNNASDRKVFLAFTHDSQIIPVEAALGFFPDITPEHPLPTDKNIFTYSLKTSSFVPFAGNLITELFLCSDNKYYVRHLVNQQVYPLTDCGYGPSGASDGLCELSAYLNSSVRVNSTSNGIANFNSQCQAHSTNVTVYY

SEQ ID NO: 2356 - protein, 410 aa, Schizosaccharomyces pombe
MPQEVKRCVLAYSGGLDTSCILAWLIEEGWEVICYMANVGQEEDWDAAREKALKVGAKKVYVEDLREEFINDTVIPAAQANAIYENVYLLGTSLARPIIARRQIQIAEKENCIAVSHGCTGKGNDQVRFELAYYALKPDVQVIAPWRLPVFFERFAGRKDLLEYAAAKGIPVTQTTKKPWSMDENIVHCSYEAGILEDPSMTPPKDMWKLTVDPKDAPDEVEELSIHFEKGAPTKLECKDGTFSGVVSIFYQLNAIARRNGVGRIDIVENRFSGLKSRGCYETPGLTILRTAHMDLEGLTMEREVRALRDQFVTFNLAKILYNGQFFSPCTRMLLAANNVSQEVVNGVVKLSVYKGNVTVLGRKSDTAHLYDEKLSSMDELGGFDPTWTSGFIQIESMRLRNSDEGKHWM

SEQ ID NO: 2357 - protein, 751 aa, Schizosaccharomyces pombe
MALIFDRFPDLFPTEISKVKFFTKDFSKKDKLTALDTYRSFPGSTWKTIVTFATQEVFYLPEGLEPLKRDFSSMDKLKLIGKITYKLRLKGDTALKFAYLHAPSDVRDKVFDDAFWQEIITPKASLEQQSNNIPTGIQDSSKYTVNGPTERDNKSMKSFVRSFFTSTDSSVADTTIIPSMTQQFDKDPSTLVQSSIDKEIQVKEDGTTSSVAVNAETAVQNVNGTIKESQGTESISFASKNNSAPSADANNGNMTKLVSKEKAFLNTVTTPNADLIISEEDELTEMTLRTANGSEPTKKSNRSEQSKTVANTNVGSKNGTTPRSFAQKSSKRIKPTEGSANLNTVTELTGIGSRIAMNGSSVKASNISTEKSKTIAKPKPAKELSPQATLNSPIQSAEAGNVELKLHPQTPDRIVKVERKVHSLNMTLRSPKAGSAGKENSWRSKYLSEGKNSKAKYTAKQPSYDRAGSSLASPTKSSASPLVKAPKETPERLCTENQSTENEDQANLKESELPKEKSDIQPKNSRSTIEYIETSTRVYEMPKDTIPSRFKTSISTEVHDGRLKKYPYYHVKTPEKGTTVVSRTVTSPKSGAYASPSKASYNQDSSPNASLEQCFVQRSPSKMLTTLRNNSSTFPSLRKNAMIARKSTADSLSSPKRQSVPSTPKASLSPRVHKSMTYSPSEASPLYANKSPKSSTMVPLMKYKSGLNEGMRTSSIYSSTSSPYIRDQYFLNRMLTNGSHNGSPSWRDGLL

SEQ ID NO: 2358 - protein, 429 aa, Schizosaccharomyces pombe
MPVESEHFETLQLHAGQEPDAATSSRAVPIYATTSYVFRDCDHGGRLFGLQEPGYIYSRMMNPTADVFEKRIAALEHGAAAIATSSGTSALFMALTTLAKAGDNIVSTSYLYGGTYNLFKVTLPRLGITTKFVNGDDPNDLAAQIDENTKAVYVESIGNPMYNVPDFERIAEVAHAAGVPLMVDNTFGGGGYLVRPIDHGADIVTHSATKWIGGHGTTIGGVIVDSGKFDWKKNSKRFPEFNEPHPGYHGMVFTETFGNLAYAFACRTQTLRDVGGNANPFGVFLLLQGLETLSLRMERHVQNAFALAKYLEKHPKVNWVSYPGLESHVSHKLAKKYLKNGYGAVLSFGAKGGPDQSRKVVNALKLASQLANVGDAKTLVIAPAYTTHLQLTDEEQISAGVTKDLIRVAVGIEHIDDIIADFAQALEVA

SEQ ID NO: 2359 - protein, 350 aa, Schizosaccharomyces pombe
MTCRIAIRKYSFILCLAVGSVTIYTSEVIGTPLYFVNKELYNKYIAFTKSFAGILFTALVQLFSPTPVTLTYDPELRNLFYLDRNGCLETIAAERNIVIANHQLYSDWMYVWWLSYTAKQHGHVYIMLKNSLKWLPVIGWGMQLFRFIFLSRKWDKDYETMSRHFKFIRNVRDSVSLILFPEGTNLVESTYQRSRVYADKIGVKMPKHLMLPRVRGLFYSISQLRDSMTYLYDYTFYFSDPSPKKYAADAFSLPKLFFEGVPIKRLHIHVRRFPISEIPTEEDQFTDWLYQRWYEKDKLIDTLLETGNFPGPKKLHTTVRLKHRLEILSLFSVLFTCIVAGLFLKLFISH

SEQ ID NO: 2360 - protein, 223 aa, Schizosaccharomyces pombe
  unsure (1)..(223): unsure at all Xaa locations
MAPIKSRRIAVLGSRSVGKSRXAFDXSLCANRFTNHFFXISLTVQYVENHFVESYYPTIENTFSKNIKYKGQEFATEIIDTAGQDEYSILNSKHSIGIHGYVLVYSITSKSSFEMVKIVRDKILNHTVCQIIRIFKFFTNLLAIKGTEWVPIVVVGNKSDLHMQRAVTAEEGKALANEWKCAWTEASARHNENVARAFELIISEIEKQANPSPPGDGKGCVIA

SEQ ID NO: 2361 - protein, 774 aa, Schizosaccharomyces pombe
VRVRPFTEREKGLLAETPKSKEFLGDGSLAVSNTSSNTFCTNGIRKIVRVLDDNVLIFDPPEENPLAKVQKSLLPAGKRFRDVRYAFDRLFGEEASQEDVYKGTTEPLLDSVLQGYNATVFAYGATGCGKTHTISGRPDDPGIIFLTMRALLDRVEGLKRTMNVDISVSYLEIYNEKIRDLLVQDPLSMEKPKSLNICEDAEQNVSVPGLSYFTPTNLEEVMEIIIRGNSNRTMSPTEANAVSSRSHAVLQIYITQTPKSGEKQEESESQNSHKVRSVFSFIDLAGSERASATKNRGKRLVEGANINRSLLALGNCINSLCEPRRRQHVPYRDSKLTRLLKFSLGGNCRTCMIVCISPSSEHYDETHNTLKYGNRAKNIKTKVSRNVVSVDRHVSEYVRTIYELRQKVSILQKRIAEESKQLALNKEVRKISSREIKMLDARSMLKNSFDGSRDLQKSLIEHVRTLRRIEDEITLTKMWISIAKESDAMSGHNIKSVETRLAKLYDQRSLITAKVNPEEICKTFQNSISHIVSSFKGEGADMYADMLQDDVDLLKSIIENQILDAKHESETFSSTSRKLIQNLFLLFPLLPGNAIDVNESLARAFDQLVGIVPSEPTIQVPNLIEKGKAPLLSMFEIPRSPSRFKARSPSKAARVLKKPLKKRVRFSEVPTTSSVPPVEIKNKDSKPKVEKSLDKHNMNNDRSFLVPSRDARNSLTSLSLHSNVAKNKSSHSSKWPTHTLSPIITTALKQPVRRISLVSQPLQKTGGTENTPNA

SEQ ID NO: 2362 - protein, 396 aa, Schizosaccharomyces pombe
  unsure (1)..(396): unsure at all Xaa locations
IQEIEAEMRRTQKNKATEYHLGLVSFFNSFLTGMPFILXQILQCCSNLXRINSKLNXPSPLLKGKLAKLRAQLLEPTSKSGPKGEGFDVLKSGDARVAFIGFPSVGKSTLLSAITKTKVCYFFLNTLFFYXQWXYSRATASYEFTTLTAIPGVLEYDGAEIQMLDLPGIIEGASQGRGGRQAVSAARTADLILMVLDATKAADQREKIEYELEQVGIRLNRQPPNVTLTIKKNGGIKFNHTVPLTHMDYKMAYNILHEYRIHNADILIREDITVDDFIDLVMGNRRYINCLYCYSKIDAVSLEEVDRLARLPKSVVISCNMKLNLDFLKERIWEELNLYRIYTKRKGEMPDFSEALIVRKGSTIEQVCNRIHRTLAEQLKYALVWGTSAKHSPQVV

SEQ ID NO: 2363 - protein, 380 aa, Schizosaccharomyces pombe
MDSTAQQFPLNHDLQVQKDQKGVVEEDEEQIHKRIRNYESHSGFSEYCTLFGHEKSVTCVSVSPNKRWIATSSSDGTIKIWSALTFRLECTLFGHYRGISQVKWATGSKYLASASDDKTIRIWDFEKRCSVRCLKGHTNYVSSIDFNPLGTLLVSGSWDETVRIWNLQDGTCLRMLPAHSEPIISVSISADGTLCATASYDGMARIWDVLSGQCLKTLVEPINVPLSNLQFTENRKYLLVSNLNSQIRLWDYRRNRVVRIFDSHVNTRYSMSWDCYSSKNIPKNTEALPNNDSSYPDDAESFMHDAYLLIPSEDGTIQITDPSTKIIIDDSIRHSDDPETSLLNVTSLGPFIITSGTDPYVRVWAPSLLLSKHEKDGFSP

SEQ ID NO: 2364 - protein, 335 aa, Schizosaccharomyces pombe
MAIPKVGINGFGRIGRIVLRNAILTGKIQVVAVNDPFIDLDYMAYMFKYDSTHGRFEGSVETKGGKLVIDGHSIDVHNERDPANIKWSASGAEYVIESTGVFTTKETASAHLKGGAKRVIISAPSKDAPMFVVGVNLEKFNPSEKVISNASCTTNCLAPLAKVINDTFGIEEGLMTTVHATTATQKTVDGPSKKDWRGGRGASANIIPSSTGAAKAVGKVIPALNGKLTGMAFRVPTPDVSVVDLTVKLAKPTNYEDIKAAIKAASEGPMKGVLGYTEDSVVSTDFCGDNHSSIFDASAGIQLSPQFVKLVSWYDNEWGYSHRVVDLVAYTASKD

SEQ ID NO: 2365 - protein, 758 aa, Schizosaccharomyces pombe
MEKSARQLSVAEQNGESGRLNNGYTSNNIQQYKDETNRHQFEYNQNRNQLLRSIHIIQNLLNELDNYVDRSDCLFHSVWRTDKEKSKFSGNYYPFSPSKMNVITIDLSLRSSSTADEKLISQLGEEAHESLLKVHIEKANKHLFSLFSRVEDTSSKILITGDLNAGKSTLCNALVHKDILPEDQQPCTEVFCEVHDAELNDGKDCVHAIPHGLTYSHTDSSTYKVFPIEDLKRLVYETENWSMLIVYVNDGRPAHESLLHNGITDIALIDAPGLNTDSMKTTSVFACQEEIDVVVFVVNAENHFTLSATDFLRNASTEKSHIFIIVNKFDNIRDKERCKRLILEQIHTLSPGTFADAKDLVHFVSCRVARDPNNREDALYSSFFQMENSLRSFILENRSKSKLAPVRRYLSGLVGDILNICEYNIKLIDFDINHLQQRLTDLSPKFRKVKHEQQFTYQKNESLVEATVQSISQHTHSELEDAIDSLGSFASVKYSGFFFAYQYAISVRDAMQQYLEEKLLESEDYARKRTEEAVLCIQKDVKDNFDSAVLPVFHANQMFIKKHRLQLQKHFRFELGLLDFIDLDLTERLGTWSASLSTILLVLGKTTPSFTTLGAFTGNLGYPIFKYFQNNSLQHLLVPVLGLASICVFGYVIYDIPRALPLKVAEKIKKSLRETDFCHNASIWIGTESRKVLNIPLNDLRRMFHQQWDKQRETISVAENDLRICQKARKFFGEIESRTREAKKKIMMVQLEGCDINY

SEQ ID NO: 2366 - protein, 706 aa, Schizosaccharomyces pombe
SIHIIQNLLNELDNYVDRSDCLFHSVWRTDKEKSKFSGNYYPFSPSKMNVITIDLSLRSSSTADEKLISQLGEEAHESLLKVHIEKANKHLFSLFSRVEDTSSKILITGDLNAGKSTLCNALVHKDILPEDQQPCTEVFCEVHDAELNDGKDCVHAIPHGLTYSHTDSSTYKVFPIEDLKRLVYETENWSMLIVYVNDGRPAHESLLHNGITDIALIDAPGLNTDSMKTTSVFACQEEIDVVVFVVNAENHFTLSATDFLRNASTEKSHIFIIVNKFDNIRDKERCKRLILEQIHTLSPGTFADAKDLVHFVSCRVARDPNNREDALYSSFFQMENSLRSFILENRSKSKLAPVRRYLSGLVGDILNICEYNIKLIDFDINHLQQRLTDLSPKFRKVKHEQQFTYQKNESLVEATVQSISQHTHSELEDAIDSLGSFASVKYSGFFFAYQYAISVRDAMQQYLEEKLLESEDYARKRTEEAVLCIQKDVKDNFDSAVLPVFHANQMFIKKHRLQLQKHFRFELGLLDFIDLDLTERLGTWSASLSTILLVLGKTTPSFTTLGAFTGNLGYPIFKYFQNNSLQHLLVPVLGLASICVFGYVIYDIPRALPLKVAEKIKKSLRETDFCHNASIWIGTESRKVLNIPLNDLRRMFHQQWDKQRETISVAENDLRICQKARKFFGEIESRTREAKKKIMMVQLEGCDINY

SEQ ID NO: 2367 - protein, 1037 aa, Schizosaccharomyces pombe
MVTINISNPVYFSDIKDVESEFLTSIPNGLTHEEAQNRLSEYGENRLEADSGVSAWKVLLRQVLNAMCVVLILAAALSFGTTDWIEGGVISAIIVLNITVGFIQEYKAEKTMDSLRTLASPMAHVTRSSKTDAIDSHLLVPGDVVVLKTGDVVPADLRLVETVNFETDEALLTGESLPVIKDAHATFQMNEDVPIGDRINLAYSSSIVTKGRAKGICYATGMQTQIGAIAAGLRQKGKLFQRPEKDEPNYRRKLNKYYLKVTSYYVQRVLGLNVGTPLQRKLTVLAYILFCIAIILAIIVMAAHSFHVTNEVSIYAISLGISIIPESLIAVLSITMAMGQKNMSKRRVIVRKLEALEALGGVTDICSDKTGTITQGKMITRRVWIPSYGYLSVDTSDANNPTIGTVSGLEAAMQDVLKEKKQEMKNIDPSNQPSDQFIPLLKTCALCNLSTVNQTETGEWVVKGEPTEIALHVFSKRFNYGKEDLLKTNTFVREYPFDSEIKRMAVIYEDQQGQYTVYAKGAVERILERCSTSNGSTLEEPDRELIIAQMETLAAEGLRVLALATKVIDKADNWETLPRDVAESSLEFVSLVGIYDPPRTESKGAVELCHRAGIRVHMLTGDHPETAKAIAREVGIIPPFISDRDPNMSWMVMTGSQFDALSDEEVDSLKALCLVIARCAPQTKVKMIEALHRRKAFVAMTGDGVNDSPSLKQANVGIAMGQNGSDVAKDASDIVLTDDNFSSIVNAIEEGRRMFDNIMRFVLHLLVSNVGEVILLVVGLAFRDEVHLSVFPMSPVEILWCNMITSSFPSMGLGMELAQPDVMERLPHDNKVGIFQKSLIVDMMVYGFFLGVVSLMTWVVIMYGFGTGNLSYDCNAHYHAGCNDVFKARSAVFAVVTFCILIMAVEVKNFDNSLFNLHGIPWGEWNFRYFLHTLVENKFLAWAIALAAVSVFPTIYIPVINRDVFKHTYIGWEWGVVAVAVMFYFFYVEIWKSIRRSLTNPQKKGKFRRTLSNTITTESKLSEKDLEHRLFLQSRRA

SEQ ID NO: 2368 - protein, 460 aa, Schizosaccharomyces pombe
MGKEKGHINVVVIGHVDSGKSTTTGHLIYKCGGIDKRTIEKFEKEATELGKGSFKYAWVLDKLKAERERGITIDIALWKFETPKYNVTVIDAPGHRDFIKNMITGTSQADCAILIIGGGTGEFEAGISKDGQTREHALLAYTLGVKQLIVAVNKMDTTGWSQARFEEIVKETSNFIKKVGFNPKTVPFVPVSGFQGDNMIEPTTNMPWYQGWQKETKAGVVKGKTLLEAIDSIEPPARPTDKPLRLPLQDVYKIGGIGTVPVGRVETGVIKPGMIVTFAPAGVTTEVKSVEMHHESLDAGLPGDNVGFNVKNVSVKDIRRGNVCGDSKNDPPMGCASFTAQVIILNHPGQISAGYSPVLDCHTAHIACKFAELIEKIDRRSGKKIEESPKFVKSGDACIAKMVPSKPMCVEAFTDYAPLGRFAVRDMRQTVAVGVIKAVEKVAPGAAKVTKAAVKAGAKK

SEQ ID NO: 2369 - protein, 436 aa, Schizosaccharomyces pombe
SLRTTSNICHRLNADVLGQLIKKYYSFDNSLKNELLELIDMPQNGDDSSTSITNGNGNTIFPEVDMYLQLLLSMTLYYNEKYEVGAEYIKKVIARLQSYDRRTLDQIAAKLYFYYILFFEKCNRSVECRNTLLSVHRTASLRHDSETQAMVLTLLLRNYIQFNLYDQADRLVSKTSFLTNASNNLAIRYQYYLGRIRAIQLDYTTAHEHLVSAIRKAPNTVYAVQFLEAVYKLHIVVQLLMGEIPERRIFRQKSLEKTLVPYLRISQAVRIGDLCAFTDALSKYEAEFRFDGLYTLICRLRHTVIKTGLRMISLSYSRISLRDVCIKLGLDSEESAEYIVAKGIRDGVIDASIDHSNAFMASNEAMDIYSTEQPQQAFHERIQFCLALHNDSIKSMRYPMDAHKSELEGVEEARRRMDKEMAEADLDDDEPDLGEF

SEQ ID NO: 2370 - protein, 297 aa, Schizosaccharomyces pombe
  unsure (1)..(297): unsure at all Xaa locations
MALKRINRELADLGKDPPSSCSAGPVGDDLFHWQATIMGPVSRGCNSALRTAKILLARIVQLTXYIADSPYAGGVFFLSIHFPTDYPFKPPKVCNYLVLCRLCKYALXACESEEEVCYIQYELKSXLHLVFLEKSVWLTVMQNFLSVMVKEYTQKFFYNCLLLPFIFISLCFTSGTLSIFIRLRPSKXSEGNYIAXHYESDXXSFFFNDNXQHIRRXTFTTRIYHPNINSNGSICLDILRDQWSPALTISKVLLSICSLLTDPNPDDPLVPEIAHVYKTDRSRYELSAREWTRKYAI

SEQ ID NO: 2371 - protein, 573 aa, Schizosaccharomyces pombe
  unsure (1)..(573): unsure at all Xaa locations
MDRRHRVYRVFNQEMYVEPNFKVXDIWVTAAFAKHFVYLTENRICLNFXENXHSLGVKELGQGAYGIVCAARNVASKDQEAVAIKKITNVFSKSILTKRALREIKLLIHFRNHRNVSLLCKNGFLXLITHHHRDVLTRCILMKMQIFIQXKVFYEKXVLIILEKYFLYKSXYNVWNSVDXKIXTAHCLTFAXXCLSYFLXTLLTWXITCIYDLDIINPYNFNEVYIYEELVCYAMIHIWCLFXSRKYLYNYLLTIIIDEADLNAIIKSGQPLTDAHFQSFIYQILCGLKYIHSANVIHRDLKPGNLLVNADCELKICDFGLARGCSENPEENPGFMTEYVATRWYRAPEIMLSFSSYHKGIDVWSVGCILAELLGGTPLFKGKDFVHQLNLILHQLGTPDEETLSHISSSRAQEYVRSLPKQRPIPFETNFPKANPLALDLLAKLLAFDPNRRISVDDALEHPYLAVWHDPSDEPVCDSVFDFSFEYIEDANELRRVILDEVLNFRQKVRRRSHPTNPTVNIPQPAQTVPSNDNGSFNVSSSSSSQTSNKKRHDHSYNETAAIDHKSDDNRHN

SEQ ID NO: 2372 - protein, 506 aa, Schizosaccharomyces pombe
  unsure (1)..(506): unsure at all Xaa locations
MGSLPDQSSCEEFTDSQQDKMTKLLAMQLGPEYISRRSGPGGGSVTYLEAWKAIELANEIFGFNGWSSSIQDIHVDYVSVNFASKFYEKSANRINSXAYIYLFLLIIIKRVEETKEKKFNVGISVIVRVTLKDGSFHEVNKTCPQXYFVIPVKLIIANGIFFEIIHNFFVLNYSISDCGQFLANKWFFXDVGYGSIENCRVKALAYEKCKKEGTTDALKRALRNFGSSMGNCLYDKRYIQKILKMAPAQVIWKHIKFKNNXADRNAKLGEFNYDNLLRANKRPYARFAQKVSTPIESHANKSVKLEHKNSIEKKISNVDKPISDLIENDIHESLPALQNPPIQSHSETDLYAGIKNLLMTKLKNXTXKYRXELDSILMHHERPPIPESPRVEEFEEXDRPINACECRLTNRLLNQFEGDEKVSVDKIDAHDKMTEAQVVKIPPVQFMNARVAAAENPHIKHEGMAFQLHKKSNSILKSSNIDHNRSMPIRRPSLTSNNSANTFSTK

SEQ ID NO: 2373 - protein, 262 aa, Schizosaccharomyces pombe
MSFLELTEVWGKPQKDIFFPSGSEVEESTDAPIQRTVQPIVTGSSVLALKFADGVMIAADNLASYGSLARFYDVERLTKVGDNTIVGAGGDISDYQQIQRLLEKLEIKEGNYGDGYALQPSYIHEYLSKVLYARRNKLDPYWNQLIVAGVDGENKEPYVAFADLRGTTYSAPAIATGFAMHLALPMLRKATDDDRWKTLSKESARATIDECMRVLFYRDARSLNKFSVATITPEGIEFQTDQSVSSKWAFAEKQYGYGTQTV

SEQ ID NO: 2374 - protein, 322 aa, Schizosaccharomyces pombe
MATSSAAAAASTPVNANTITETKNSTFFFDFMMGGVSAAVSKTAAAPIERVKLLIQNQDEMIRAGRLSHRYKGIGECFKRTAAEEGVISLWRGNTANVLRYFPTQALNFAFKDKFKKMFGYKKERDGYAKWFAGNLASGGAAGAASLLFVYSLDYARTRLANDAKSAKKGGERQFNGLVDVYRKTYRSDGLRGLYRGFGPSVVGIVVYRGLYFGMYDTLKPVVLVGPLEGNFLASFLLGWAVTTGSGVASYPLDTIRRRMMMTSGEAVKYSSSFECGRQILAKEGARSFFKGAGANILRGVAGAGVLSIYDQVQLLMFGKKF

SEQ ID NO: 2375 - protein, 458 aa, Schizosaccharomyces pombe
  unsure (1)..(458): unsure at all Xaa locations
MAENENHVLSIRMSHPYYSEKEISRILSTRDPKENNLRMQAFAWISTLSKTLKLYAFPQNYLESNFFLAPVRTSGLAMLLYSRFQLFFPVNEIPLLVCYLDVFRTXVCCAIXNFTYSDIRIFXMLYIGHTIKKDYSFXXCXLSYSKLXTSYSLDLGSFSFKNNXHIXECATACLVVASKIEDTAKKFRDILLAHYLQKHPGSEVDAHSQVCYKVRNNCFLFIRRLAYRCISXSKRTRRRILGLERMTLELICFDFRVRHPHNYMVKFAKSLKCMTAIHFTLXFSSXLIYFQFHLSTASIAWNVCTDAYKTYTMLKYPAHIVAVASISIACKLQQLPQPIIPRSFFAPPALTEAVIADILDLYMHYQPHTCIGNMYTTEKLLGLCVDFQRAQKNSGRPQKPPQIDPHSSSLADEYRESNKRLQESKESCARFILDCDRKYFNTEFEKRMLEERRNKGTV

SEQ ID NO: 2376 - protein, 544 aa, Schizosaccharomyces pombe
MGSDGSSLSPKVSQPGHTEIVDHVSEKVITNGKNVNKKVNAEVDGKSMVEKVKTHEENAEDYHYGGYHPVYIGEEFHHRRYVVERKLGWGHFSTVWLAYDRAAKRRVALKVVRSAEHYRETSIDEIRILQKIREGDEKHLGKKHIISLLDYFVHRGPNGAHVCMVFEVLGENLLSLIQSYGHRGVPVGIVKQIAYQLLIALDYLHRECGIIHTDLKPENVLICIDQDALQHIEAPATTSSPTSNTSSSKTRNNTGYTAKAPIIKRGQSVDNSAQERKTFAKNPTKNSKPAGQVIPSSPFTSTLSRFPSLEGAVSEISLRDSQKHNSHPNSPFSSGDNSLILDGVNGSQEPVPKITVKIADLGNACWTRKHFTNDVQTRQYRSPEVILGCRWGASADCWSFACIIFELLTGDYLFDPRNGNSYSKEDDHIAQIIELLVNYPKQMALSGKHSRDLFNRRGELRNIHKLKFWPLKDVLEQKYHFSAELAQQISDFLSPMLCFDPAKRTNAGYMSNSPWLREVADPTFKIETTGATGEDVPGWATEIR

SEQ ID NO: 2377 - protein, 615 aa, Schizosaccharomyces pombe
  unsure (1)..(615): unsure at all Xaa locations
MGFGKKKVSYFYDGTCKLVRSXLIFEIEDVGNYHYGPQHPMKPHRVRMVXYKAITIYHHXPTXVHNLVVNYNLYEKLNVIVSSISPFYTNKVYKTPVRATRNDMTRCHTDEYIEFLWRVTPDTMEKFQPHQLKVRFHFDYLXITVILVNVGDDCPVFEYVRLSNFLYXQLFSGLYEFCSISAGGSIGKIKVFPKKGALKHPLNLXMEYRTLTNIGLGAAQELNSGNAEIAIKMLLRIFXYFEDQLTTXLSWAGGLHHAKKREASGFCYVNDIALAALELLKYHQRVLYIDIDVHHGDGVEEFFYTTDRVMTCSFHKFGEYFPGTGHIKVCMRLYIWIYFSNILGHGIGTGKNYAVNVPLRDGIDDESYESVFKPVSLFYKFLCSNNLNXVISHIMQWFRPEAVILQCGTDSLAGDRLGCFNLSMKGKXTTVSRFYXFPSTGHSMCVDFVKSFNLPMICVGGGGYTVRNVARVWTYETGLLAGEELDESKYQYVNCLLTHPRPSLNDYLQYYGPDYKLNVLSNNMENHNTRQYLDSITYATFXVLFLRGXPNLALKSSKNLRNLSFAPSVQMHSKYKRLSKNVLTNTLTLETPGDFTFENAEKQNIAKEEIMDERV

SEQ ID NO: 2378 - protein, 403 aa, Schizosaccharomyces pombe
  unsure (1)..(403): unsure at all Xaa locations
MVNDFNEKNGIKKRLLDFFPVVLEGIREILESMQYFPEETEKLLYVSXLSCLYNATANLHLSIKRNTLGGKNNRGLAVLQSLTSLINRELEEAEFRDAALLGWLIEIVSKLVFXFRFVYVKSLGYXRMFSCQGCFLMADDIMDQSIKRRGLDCWYLVVGVRRAINESQLLEACIPLLIRKYFRNMPYYVDLLDTFREVCYNKFNXKAYFQGYFLTELGQQEDLLSSRDGEASLRSFDLMKYDFIITYKTSFYSFYLPIKCALLLSRNSNQKAYDTTIKLSKLLGYYFQVQDDYLDCFGDYTVLGKVGMDIQDNKCTWLVCYAEKFASADQLNLLRAHYGKAGSENIAVIKQLYHELQIPELYHKFEDDMVDSISKEIDLIDESTGLKKCIFTKFFQLIYKRSR

SEQ ID NO: 2379 - protein, 2386 aa, Schizosaccharomyces pombe
MSQHAKRKAGSLDLSPRGLDDRQAFGQLLKEVLALDKEHELGRSNSLPSMTSELVEVLIEVGLLAFKHDDSKSEFISPKMLKEAHLSLQALMLILKRSPTVLREIKSSVTLLDWILPRTISLFADIRFIKLFDSLKEFHKLIYQLISEKSFLWDLYASFMRYWKYYITNVSSIVLQITNATFPYKMPSPNSQPLQSITPNYPTHREDKFDLLIINIEEACTFFFESAHFFAQCSYLKKSNFPSPPLFTAWTWIKPCFFNFVILLKRISIGDSQLFLHLHSRIVQTLCCFSLNFIYHGLPICEKSKHILMSSINLTLGSLKKTYTVANTAISLFFLSLFVLPKTVAGLFYPFGVSLLSDFKVLEQLEPDSDLKKAIILFKCRYQSSEIDQTTLRAFGEICTGKLENTLFSNSELNLFLLHYLSLDNDLSNILKVDFQNGHNICTFAKWCINNNLDEPSNLKHFREMLDYYSSHNVTISEDDLKNFSLVLCTHVAKVNEKTNSIFRTYEVHGCEVCNSFCLLFDERSLFKIPYHELFCALLKNPDIISSSVKQSLLLDGFFRWSQHCSNFNKESMLSLREFIMKALASTSRCLRVVAAKVLPIFIKGPNNLDIVEFHKESKALIFNTLKILAVENTAILETVILSWISLSRVVEEEELHFVLLEVISSVINSGIFYQGIGLSALQQIASTRHISVWQLLSPYWPTVSVAIVQGMGKKPNIASLFAQLMNISEGDFLIRTQAYTLPFLVLTKNKALIVRIAELSQSDVATLCLTNMHKILASLLTTDHPNLEESVMLLLSLATSDFEKVDLTSLLRSDPISITVELLQLYQNDVPHEKIENALRKVAMIVSQVVNDEDLSNKELLYDFFNNHILGILAEFSNILNDLKGKTSINEKIKTIVGIEKMLSLCGGAVKLGLPQILSNLQSAFQNEHLRFYAIKAWFSLILATKEPEYSSIAGLSLVILPPLFPYLEPQEAELVIQIFDFISSDTHKCLQGLKWAIPTSLDSACFSLKAKEIFCSLQNEDFYSELQSIIKCLTNENEPVCYLGLQKLELFFQAKVDELHDTLNLDISNEVLDQLLRCLLDCCVKYASTNMQISYLAAKNLGELGAIDPSRAKAQHIIKETVVLDNFENGEESLKFILDFMQSQLIPAFLVTTDTKAQGFLAYALQEFLKLGGFKSAVINKKKGLTVVTEHWMSLPDLSKRVLIPFLTSKYHLTPIPKIDIRYPIYKENVTIHTWMQLFSLKLMEYAHSQNAEKIFGICSKVVKDQEVNIPCFLLPFLVLNVILTESELEVNKVIEEFQLVINQPGPDGLNSVGQQRYTSFVDVFFKIVDYLNKWLRMRKKRNWDRRSAIARKENRYMSVEDATSRESSISKVESFLSRFPSKTLGIVSLNCGFHARALFYWEQHIRNATAPYAALESDYRVLQEIYAGIDDPDEIEAVSLNFHDYSFDQQLLLHENSGTWDSALSCYEIIIQKDPENKKAKIGLLNSMLQSGHYESLVLSLDSFIINDNHEYSKMLNLGIEASWRSLSIDSLKKCLSKSNLESFEAKLGSIFYQYLRKDSFAELTERLQPLYVDAATAIANTGAHSAYDCYDILSKLHAINDFSRIAETDGIVSDNLDIVLRRRLSQVAPYGKFKHQILSTHLVGYEKFENTKKTAEIYLEIARISRKNGQFQRAFNAILKAMDLDKPLATIEHAQWWWHQGQHRKAISELNFSLNNNMFDLVDEHEERPKNRKETLGNPLKGKVFLKLTKWLGKAGQLGLKDLETYYHKAVEIYSECENTHYYLGHHRVLMYEEEQKLPVNEQSERFLSGELVTRIINEFGRSLYYGTNHIYESMPKLLTLWLDFGAEELRLSKDDGEKYFREHIISSRKKSLELMNSNVCRLSMKIPQYFFLVALSQMISRVCHPNNKVYKILEHIIANVVASYPGETLWQLMATIKSTSQKRSLRGKSILNVLHSRKLSMSSKVDIKALSQSAILITEKLINLCNTRINSKSVKMSLKDHFRLSFDDPVDLVIPAKSFLDITLPAKDANRASHYPFPKTQPTLLKFEDEVDIMNSLQKPRKVYVRGTDGNLYPFLCKPKDDLRKDARLMEFNNLICKILRKDQEANRRNLCIRTYVVIPLNEECGFIEWVNHTRPFREILLKSYRQKNIPISYQEIKVDLDFALRSPNPGDIFEKKILPKFPPVFYEWFVESFPEPNNWVTSRQNYCRTLAVMSIVGYVLGLGDRHGENILFDEFTGEAIHVDFNCLFDKGLTFEKPEKVPFRLTHNMVDAMGPTGYEGGFRKASEITMRLLRSNQDTLMSVLESFLHDPLVEWNRKKSSSKYPNNEANEVLDIIRKKFQGFMPGETIPLSIEGQIQELIKSAVNPKNLVEMYIGWAAYF

SEQ ID NO: 2380 - protein, 1973 aa, Schizosaccharomyces pombe
SIALGQAFSNYAYDLFDLIFASGLSEASYRALSDLAHNIPPLLPVIQERLLDMLSKILSGRPFIPPGCPPQYVARSLKSSKSASLKTGFFPNDVYILALKVLGNFDFSGYILNEFVKDCVVVYLENNDPEVRKTASITCSQLFARDPILSQTSDHAIQVVAEVLEKLLTVGICDTVPDIRLTVLNSLDSRFNKHLAQADKIRLLFIAINDENFAVRESALRIIGRLNVYNPAYVMPYLRKIMLKTLTILDYSTIIRTKEENAKLLCLLIAAAPRLIESHVEPILQILLPKAKDSSSIVAASIVNSLGEICQISGEVIVPFIKDLMPLIIEALQDQSSPIRRAAALKALGNLSSSTGYVIDPYIEFPSLLDILIGITKTEQDITIRRETIKLIGTLGALDPNRHRVLEKGTEKVVPEQKNIPPDISLLMSGIGPSSDEYYPTVVITALMSILKDPSLTIHHTAVIQAVMYIFKTMGLRCAPFLSQIIPEFIAVMRTCPTNILEFYFQQLSILVLIVRQHIRSFLPDLFKLIKDFWNPHSNLQFTILSLIESLARAMQGEFKPYLPSLLVMMLQIFDSDVSVDSVSTKKVLHAFIVFGDTLADYFHMLLDPILRLYERNDVSIGIKESIMITIGRLSMVINLSEYASRIIHPVMRMLSCNNASLIRVSMDTVCALIYQLNVDFAIFIPMIDKCLKMNGVTHETYSILVEQFLQEQPLPIKLNPYEKYDKPKLDVVASAADITSKKLPVNQEILRNAWEASQRSTKDDWQEWIRRLGVALLRESPSHALRACAALAAAYQPLARDLFNASFVSCWSELYDHFQEELVKSIEIALTSPHISPEIIQILLNLAEFMEHDDKPLPIDIRTLGAYAAKCHAFAKALHYKELEFIEEELVTKPSVDTIEALISINNQLQQPDAAIGILKHAQQHDKMNLKETWYEKLQRWEDALSAYEKREAAGAGNFEITMGKLRCLHALGEWDRLSQLAQENWIHAGHDARRYIAPLSVAAAWGLGQWEQMDEYISVMKSESPDKAFFNAIVALHRSQFEEAASYITRARDLLDTELTALVGESYNRAYSVAVRVQMLSELEEIITYKKAEDKPEVREMIKKTWVRRLKGCQRNVDVWQRMLRIRSLVISPRDNMEMWIKFANLCRKSGRISLAKKSLNLLLEDDENLDNSLVLKKTHPSIVYANLKFLWAVDDKRKALNSMQEFTSQLISDINVDPALFVQSTSVNTQKSQEEIQYYFHLLARCYHKQGQWQQEIENNWSEGSFDGVLQSYMYATQFDSKWYKAWHSWALANFEAVKFLEQSEEQIPSAAYEQYIIPAVKGFFKSIALSKGNLQDTLRLLNLWFKFGNNSNVINTLNVGISTVNIDIWLDVIPQLIARIHASSLSVRKSVHQLLSDVGRAHPQALVYPLTVAAKSQSSARQNAALAIMDSLKTHSPRLVEQARLVSHELIRAAILWHEQWHEGLEEASRLYFGDHNIEGMFAVLRPLHEMLERGPETLREISFQQAFGRDLVEARDCCIRFEQTGDISDLNQAWDLYYQVFKKIRKQLPQLTTLDLQYVSPKLLHVHDLELAVPGTYVSGKPVIRIVKFYPTFNVITSKQRPRRLSIKGSDGKDYQYVLKGHEDIRQDERVMQLFGLCNNLLLADPETFKRLLSIQRYPVIPLSPDSGLLGWVLDSDTLHVLIRDYRESRKILLNIEHRLIIQMAPDYDRLTLLQKVEVFEYALLSTTGQDLYRVLWLKSRSSEAWLNRRTNYSRTLAVMSMVGYILGLGDRHPSNLMLDRYTGNIIHIDFGDCFEVAMHREKFPEKIPFRLTRMLVNAMEVSGIEGTFRITCEHVMRVLRTNKESVMAVLEAFVYDPLINWRLAPAYSPSIDEKQSNEPNTLLGETIDGLHRKRLNEEGITLEERQKPEILNQRAITVLNRVSNKLTGRDFKPQQQLDVPSQVEKLILQATSIENLCLCYIGWCSFW

SEQ ID NO: 2381 - protein, 460 aa, Schizosaccharomyces pombe
MSLANRIEEIRCLCQYKLWNDLPSYGEDENVPQNIRRCYQLLDMTSRSFAVVIKELPNGIREAVMIFYLVLRGLDTVEDDMTLPLDKKLPILRDFYKTIEVEGWTFNESGPNEKDRQLLVEFDVVIKEYLNLSEGYRNVISNITKEMGDGMAYYASLAEKNDGFSVETIEDFNKYCHYVAGLVGIGLSRLFAQSKLEDPDLAHSQAISNSLGLFLQKVNIIRDYREDFDDNRHFWPREIWSKYTSSFGDLCLPDNSEKALECLSDMTANALTHATDALVYLSQLKTQEIFNFCAIPQVMAIATLAAVFRNPDVFQTNVKIRKGQAVQIILHSVNLKNVCDLFLRYTRDIHYKNTPKDPNFLKISIECGKIEQVSESLFPRRFREMYEKAYVSKLSEQKKGNGTQKAILNDEQKELYRKDLQKLGISILFVFFIILVCLAVIFYVFNIRIHWSDFKELNLF

SEQ ID NO: 2382 - protein, 610 aa, Schizosaccharomyces pombe
  unsure (1)..(610): unsure at all Xaa locations
MLSLLNPKAESIQRAQALQVGLXYLFKQYRXRWQVNISAAIGLQDVLKSNLGPTGTTKMXVTFIVXQLIILGLVDGAGAIKLTKDGKVLLTEMVSDXEHINCKCFFLSFLFXXFWNFFDYFRSHVAFNNEYXVVYXLYWXQIQNPTASCIAKAATAQDDATGDGTTSVCLLVGELLKQAELYIREGLHPSLISDGFNLAKNEALTFLDSFKTDFEVDREVLLNVAKTSLSTKISSKVVESLAPAVVDAILTIRRPDEPIDLHMVEIMKMQNRSASDTQLIRGLLLDHGARHPDMPKQVKNAYILILNVSLEYEKSEINSGFFYSTSEQRERLVESERKFVDNKLRKIVELKKEVCERDPTANFVIINQKGIDPLSLDVLAKNGIMALRRAKRRNMERLQLACGGVAQNSVDDLNPEVLGWAGSVYERTLGEEKYTFVEDVKDPKSATILIHGPNTYTIQQIQDATRDGLRAVKNAVEDNCLIVGAGAFEVACAAHLRNKFAAKEVKGKAKMGVYAYADALLIIPKTLAANSSYDTQDAIVALQEEASEGYKVGLDLKTGMPFDPEVEGIYDNYRVIRHMLHSATVIASNLISVDQILRAGRSSLKEGPPQ

SEQ ID NO: 2383 - protein, 486 aa, Schizosaccharomyces pombe
  unsure (1)..(486): unsure at all Xaa locations
MHLYQLEDELKKNVFCREDQIKKLSCLLFNKDCRVPSIVLYGVASTAKTFLLRTAFDLSKEENVWINLQDCFTVAHFWYRILIKVGVDKDIALKKGINISGFIYLLEQAMSKRDYHTFLVLSSSPILLLLNTNMSYRVLDQIDDFAEASTILFSQLAQLPIVVSKYLQTHXLTILGNIPNLSIIFVLHSHPAQYLGTLSIAVIFFPQYTQAEILEICQKTPPNLDFLDRSGDSVFEDEIELSVWMQYCSFLWSVFGVQCLNDYRSFRSVLDRYWPKFIQPIVEGDIHPADYAQLHKLAKNFLVSDATVTKRLHIINPTEIKNLLDSKSINLSLVSKYLLVSAFLASYNPSRLDAQFFSFSKTSKRRGRKRKQIQDEGVLFSKIPRTAGSKGRSAVKISQLTLGPKPFEVERLIAIYYAISSPVEKVLTADVFVQIATLASLKMILSASKGVLRSLDSPRYIVNVSREYVLKIADSLSFPLDSYLAG

SEQ ID NO: 2384 - protein, 244 aa, Schizosaccharomyces pombe
MSQARGFDRTITVFSPEGRLYQVEYAFKAFNNAGITSVGVTGKNCACVISQKKVPDKLIDASTVKHVFPITKGIGCVMTGSIADARAQVSRARSEAAEFEYKNGYPMPCDVLAKRMANIAQVSTQRAAMRPLGVAMTLVAVDDEIGPSLFKLDPAGFYIGYKATSAGPKQTETINWLEKRFKKDGIPSNLTDTVETGIQALMSSLSTDFKSTELQIGVVEDDKPFRVLSVEEIEAHLQSIAEKD

SEQ ID NO: 2385 - protein, 496 aa, Schizosaccharomyces pombe
  unsure (1)..(496): unsure at all Xaa locations
MNSQTSVVGVHYRVGRKIGEGSFGVIFDGMNLLNNQLIAIKFVCSLLGXVYGQYXQWTLEPKKSEAPQLRDEYRTYKLLVGNGMFLFCYPKHMVKTLVLTVFANSGIPNVYYFGQEGLHNILVIDLLGPSLEDLFEWCGRRFSVKTVAMTAKQMVSFLSCSYKVFNLFKFSLTFQSFPRVQTIHEKNLVYRDIKPDNFLIGRPSSRNANMVYMVDFGMAKYYRDPKTKQHIPYSERKSLSGTARYMSINTHLGREQSRRDDLESLGHVFMYFLRGSLPWQGLKAANNKHKYEKISEKKQSTSISELCAGFPNEFSKYMTYVRSLEFDEEPDYAFLQELFDDVLRANGDTNDGVYDWMLLNDGKGWESSSSHFSVVAMKRRKNYLGLNVVQNDDSRKKNSTLQTQNMRFKSSYGVRGPRNYSSFDALPSKNAPLVRQEQSASKKTIYAHSSRGYDRVRPMYVSQPSNNAVGVNHPNDNSDSEAKGGFFDMICCRCFS

SEQ ID NO: 2386 - protein, 340 aa, Schizosaccharomyces pombe
MNFQFINSNINNEDKLPMESLKKKFLKQNREIIKVRSKYTIFESLVVNNKHLTFRINTQLSIKIRESENEIQDLIQENFTLKSYLVKLEARFRNQSQTEDLLKNFFPEIQTIHKKISQVQSLLKIIEKKCSSDFLEANVKSQFTTCENKDSKEDYQILHNKRLEYVSFNDELKSLETGQPLYCFQDFQKKVHGPPALSEKPGKCILKDKTNAHVNKIPQDEVNYSLPQKNITIFSKELKENEFESINEGETEEEKAKTSNVCVCIPCKSAEQITDLKGQATGDSSPCDFEESQPRINGREKLRRSVKVINYAIPSLRTKLRRDFDLPSDRKRKRHPRGKA

SEQ ID NO: 2387 - protein, 244 aa, Schizosaccharomyces pombe; identical to SEQ ID NO: 2384

SEQ ID NO: 2388 - protein, 486 aa, Schizosaccharomyces pombe
  unsure (1)..(486): unsure at all Xaa locations
MHLYQLEDELKKNVFCREDQIKKLSCLLFNKDCRVPSIVLYGVASTAKTFLLRTAFDLSKEENVWINLQDCFTVAHFWYRILIKVGVDKDIALKKGINISGFIYLLEQAMSKRDYHTFLVLSSSPILLLLNTNMSYRVLDQIDDFAEASTILFSQLAQLPIVVSKYLQTHXLTILGNIPNLSIIFVLHSHPAQYLGTLSIAVIFFPQYTQAEILEICQKTPPNLDFLDRSGDSVFEDEIELSVWMQYCSFLWSVFGVQCLNDYRSFRSVLDRYWPKFIQPIVEGDIHPADYAQLHKLAKNFLVSDATVTKRLHIINPTEIKNLLDSKSINLSLVSKYLLVSAFLASYNPSRLDAQFFSSSKTSKRRGRKRKQIQDEGVLFSKIPRTAGSKGRSAVKISQLTLGPKPFEVERLIAIYYAISSPVEKVLTADVFVQIATLASLKMILSASKGVLRSLDSPRYIVNVSREYVLKIADSLSFPLDSYLAG

SEQ ID NO: 2389 - protein, 1324 aa, Schizosaccharomyces pombe
MSDKGIFRTSSTPSIVDVTPDRGERPRKLVRSVLESPSQKDVASIVKIEQTPSRPFFNDFLKKRITDSLNERPNLLNKFMSAQDGTPSKSTGFNERSSQLVSEFTTTEDIENCEETTQVLPPRLVVYELRLTNFKSYAGTQIVGPFHPSFSSIVGPNGSGKSNVIDALLFVFGFRASKLRQSKASALIHKSATHPSLDSCDVEITFKEVNSDFTYVDGSELTVRRTAYKNNTSKYFVNGVESSFSAVSNLLKEKGIDLNHKRFLILQGEVESIAQMKPRAISEGDDGLLEYLEDIIGTSKYKPIIEENMQELSNSDDICAEKESRLKLVLSEKAKLEDSKNSVLSFLKDENELFMKQNQLYRTILYETRNKKTLVQNLLNSLEGKLQAHLEKFEQTERDISEKNEEVKSLREKAAKVKNDCTSEKKTRQSYEQQTVKIEEQLKFLLNKEKKLKKSIEALSFEKSEAENSLSSHDIDSQKLNSEIADLSLRLQQEELSLDDIRKSLQGKTEGISNAIEEKQKAMAPALEKINQLTSEKQILQVELDMLLNKENDLINDVESSQSSLDKLRNDAEENRNILSSKLKVLSDLKGEKKDVSKNIERKKETVHNTYRNLMSNRTKLEEMKASLSSSRSRGNVLESLQRLHESDNLNGFFGRLGDLATIDEAYDVAISTACPALNHIVVDNIETGQKCVAFLRSNNLGRASFIILKELAQKNLARIQTPENVPRLFDLLRFNDQKFAPAFYNVLQNTLVAKNLEQANRIAYGKTRWRVVTLSGQLIDKSGTMTGGGTRVKKGGMSSAITSDVSPASVETCDKQVQLEDTRYRQHLSELESLNQRFTEISERIPSAELEISKLQLDVSACDRLVAGEERRILQLKSDLKSIRNNNERKRNLQNKISNMDKEVEAININNEGLVTEIKTLQDKIMEIGGIRYRIQKSKVDDLHEQLKFVKDKLNKMSFKKKKNEQRSQSFQVELSNLTSEYDTTTESIATLKTELQSLNKYVDEHKSRLREFENALWDINSSIDELVKFIEFESKQMNSVKAERIELENQIQEQRTALSEVGNNENKYLKLMSNLKLHNLTEFCDQTTMDSTFPEYSEDELSSVDKSELVSNISVLKKKTEDREVDINVLSEYRRCNKEAEKRDSDYQSELQKRTDLKKVVTDLQSQRLDEFMYGFGIISMKLKEMYQIITMGGNAELELVDSLDPFSEGVLFSVMPPKKSWKNISNLSGGEKTLSSLALVFALHNYKPTPLYVMDEIDAALDFKNVSIVANYIKERTKNAQFIVISLRSNMFELSSRLVGIYKTANMTKSVTINNKEILTD

SEQ ID NO: 2390 - protein, 1216 aa, Schizosaccharomyces pombe
AILKRTNRAKAATAAAPNSTGKSNGIKKAVYTSTRKKTVGVDDLTLLSKITDEEINKNLELRFRNGEIYTYIGHVLISVNPFRDLGIYTMDILKSYQGKNRLETSPHVYAIAENAYYQMKSYHENQCIIISGESGAGKTEAAKRIMQYITHVSKSVGTEIERVSEIILATNPLLESFGCAKTLRNNNSSRHGKYLEMIFNSGGVPVGAKITNYLLEKNRIVNQVRNERNFHIFYQFTKSAPQKYRDTYGIQGPENYVYTSACQCLSVDGISDEKDFQGTMNAMKVIGITEPEQDEIFRMLSIILWLGNIQFQEGQDGGSVISDKSITEFLGYLIGVPVAAIERALTIRIMQTQHGARRGSVYEVPLNPTQALAVRDALSMAIYNCLFDWIVERVNKALVTSDNSVSNSIGILDIYGFEIFENNSFEQLCINYVNEKLQQIFIELTLKTEQEEYVREQIAWTPIKYFNNKVVCDLIESKRPPGLFAAMNDAIATAHADSAAADSAFAQRLNFLSSNPHFEQRQNQFIVKHYAGDVTYSITGMTDKNKDQLATDILNLIHSSNNEFMKSIFPVAEESNSRRRPPTAGDRIKTSANDLVETLMKCQPSYIRTIKPNQTKSPNDYDQQMVLHQIKYLGLQENIRIRRAGFAYRQAFDTFAQRFAVLSGKTSYAGEYTWQGDDKSACEQILKDTNIPSSEYQMGTSKVFIKNPETLFALEDMRDKFWDTMATRIQRAWRSYVRRRSEAAACIQKLWNRNKVNMELERVRNEGTKLLQGKKQRRRYSILGSRKFYGDYLSASKPNGTLWNTCGLSQNDHVIFSMRCEVLVHKLGRTSKPSPRQLVLTKKNLYLVITKIVDQKLTQQVEKKFAVSSIDSVGLTNLQDDWVAIRNKSSQNGDMFLRCFFKTEFITTLKRINRNIQVIVGPTIQYCRKPGKVQTVKTAKDETTKDYDYYKSGTIHVGTGLPPTSKSKPFPRLATGGSTAAARGPRPVVQNKPAATKPVSMPAAKSKPAPMANPVSTAQQTQNRPPAPAMQARPNTTQAAAPVTSTTTTIKQATTVSASKPAPSTVTSAASSPSNISKPSAPVANNVSKPSAVPPPPPPPPAEVEKKDLYLALYDFAGRSPNEMTIKKDEIIEIVQKEPSGWWLALKNGAEGWVPATYVTEYKGSTPQTTASSTNVAAQANNNASPAEVNNLAGSLADALRMRASAVRGSDEEEDW

SEQ ID NO: 2391 - protein, 687 aa, Schizosaccharomyces pombe
  unsure (1)..(687): unsure at all Xaa locations
FYQDIKAFVNKMALRVPKASGPQLFREGYRIMQGVEDAVIRNCNAIRELSEIVRTYNLLSKFHSFTDTFRTRTSLGPNGKNKIGCXLKQLFHFLFSNTHIVVNHLQQTFLTNDAATIIRELEVIHPAAKLVVDATQQQENEVSXFINCTIFFEIHLFEHXISGFFFFADFILSFLYLLIHSCALQKGILESTLITLLSTFSCFIXLYRIDAYFVYLYFKYLYIDLLLKPFSVYXPLAWDAANFVVVFTGELLAKAENMIRMGLTPLEIAKGYEMALSHTMEVLEEICADKIETVESEKELIKAIRTCISSKQYGNEDFLSDLVAKAILTVLPKDPSKFNVDNIRVVKIMGSSLYNSQVVKGMVFPREPEGTVTRSKEAKVAVFSCPLDISQTETKGTVLLHNAQEMLDFSKGEENLIESHIKEIYDAGVRVVVTSGNVNDLVLHYLNRFEILVIRVPSKFELRRLCRVVGATPLARMGVPMPEEMGSVDVVETIEIGGDRVTVFRQVEDITRTATIVLRGATKTYLDDLERAIDDGVNIVKALVKDNRLIFGAGASDMQLCIRLISVGEKTPGIYQHAIKQYGEAFEVVPRTISENAGLDPTDVISKLYAAHHKENGESIGVDVECENDGTLDAKEAGIFDVLLAKKSAIRLATETVLTVLNVDQVVMSKPAGGPKPPGPNPHWDDD

SEQ ID NO: 2392 - protein, 554 aa, Schizosaccharomyces pombe
  unsure (1)..(554): unsure at all Xaa locations
MAYNKSLKSLVFILLASQIVFVLFLCYGKSSRELGVKWNSDIRSWMTSYVGFNGETAAISEEQLIWAEKIPDYNEEIVVRLHLEEENNLSDILQKAQSQNLDIWDYNFDHVDLRLKEENFDFWKSQYRSDILINNLTETLFESIVPDTTNSPFSTEAFLQAVENGHLNHEMFTSFTDIFFKSYQNLESINSWLRLMASLYKDLSELVPVGITAEGRTILGLKLNGRHPSDNGEKIRNKKVIIIQGGSHAREWIGIPSVCYAAWQLLAKYDSDGHVRKLLDKFEWIFIPVLNVDGYEYTWSNDRLVSGLXXSIYXLFVSWSKNRQPLNNSECFGINLDANWAFGFNGNIDPCSNGKRTIFFDDLLQLTNSRYGGLSPFQANETMALFNLITESLSQEQKKVVGFLDVHSYSQSGMFRQSIFIYXLSXFCWPYAYTCDLFPPDTENFEELAIGLVKELHRVNSRYYTYQQACIPYDGFHKHYLPGTAIDWVYFAADVAWPFNIRLRDMGDYVSXYLXNFLLIKQGIFIPAKQIVPTAKEFFAMILYYGEFIAEYAF

SEQ ID NO: 2393 - protein, 239 aa, Schizosaccharomyces pombe
  unsure (1)..(239): unsure at all Xaa locations
MSLILYPKPTSYLYQPFIKAYFSLNMAIFEINNSFLICAVSIALNPLLWNIAARSEYNHKTLTKLANGDSKKACYMLAACIFVAGIVRDLIYQNALKQQPTLGIFMNPLVQGIAKLIFCFGSVLVLSSMYKLGLVGTYLGDYFGFLLPERVSGFPFNVNDNPMYNGSTLCFLSTALRYGKVAGLLLTLEVFFVYRIALKFEEXVANCLNFXIFLYSNHXXPFTAKIYAARDSKQAKKSE

SEQ ID NO: 2394 - protein, 327 aa, Schizosaccharomyces pombe
  unsure (1)..(327): unsure at all Xaa locations
MLRQTLTQASRMRPCISVVGFRGFHARYVVXVYFLXFTNIFEVECIFSNDFLSSPCEATLKEIEQRLKSIKNIEKITKTIKTVAQTKLTRAQRAMEASNKYYRVSDEVFKEAGTKAPEEGKTLMVACSSDKGLCGGIHSSISRLIRRELHDPKTFENTSLCILGEKVRTQLLRFCPESFYLTFAHIGGASPSFEEALQISSNILEHAKDYDRIVLVYNKFASAVSFETVMKNLYTTKAINESPNLSAYEVSDEVHQPLMEFAFANAIFSAMAEAHCSEMSSRRNAMENASKSAGDMINKFSIQYNRQRQASITNELIDIVTGANSLA

SEQ ID NO: 2395 - protein, 168 aa, Schizosaccharomyces pombe
  unsure (1)..(168): unsure at all Xaa locations
MSKSGVPRLLTASERERLEPFIDQIHYSPRYDDIVKETAILWEFSRFFVFPXNETLVSYLSKCXSMKXIADDEYEYRHVMLPKAMLKAIPTDYFNPETGTLRILQEEEWRGLGITQVSNQGFXLLKNKLTFIXSLGWEMYEVHVPEPHILLFKREKDYQMKFSQQRGG

SEQ ID NO: 2396 - protein, 942 aa, Schizosaccharomyces pombe
  unsure (1)..(942): unsure at all Xaa locations
MSFQNPSYINAKHRSFLQPKDTQDSQDLRNWVSHSSVDEETAYSSSTLSSSSSKSFPCYDEYDEIKSPDDQKVEYMKTLRTLEEDAFSYTDSVYDFEERSFDEHEPPIPPLHKTGVFSVPLQPTHTVNSNSDDGYENSSKNEYLDFNSEISASPVNEPMTHSQSYTSIDRLNSSSSHYSKDVPLLCGSLTIDCPTPIDLRGMLGPFMQKNPDEASFLRYSAITCQPEDMNNNGLQLRTWSTGRDIQIAVCLTLSDEDLASFAISLSSIMNNLKHLCSRSKSRVWGNESWEKVLVCVVIDGRNTVHQNVLDLLASIGVYQPHIAKGRVNGKRTLSHMYEFTSTINVDEKLNLTTATGDGNVPMQMLLCVKDRRLGTYNSHRWFLNGIASLARPKVCLFVRNGARLGPTSIYHAWKAFDVDSTIGGMCGKTSIDTGKFGFRLLNPFIASQHFDQMIHNNLRLPYDSCMGYISNALNAIYGFRYVALQDSYPNPGPLADYFEQDQYEIPRRGILQSNAFLAQEQLLFWKVITRKDAKWHLQYVPEACATIEAPNSMAGILESKKSEINSSFSLAVYVIVDFFSLWTTRHKFFRFLLLTVQSLVFAIEKLVNFFSMANFFLAFYFVCNATSYSSLNPYGNWARPLFLVFEYILICLIFSQFMLAMGNRPRRYECLFXKFLILTNCLSCRVLLFISTALFSIIMIYFVFCVFYISLIPLHNSDNSEIVLGNNYFTTLIFSSLLILACYAFVSLICMDPFFIFTCIVQYILLMPTRIYTEQIYALCHLDDASISKDDNQQEFNFDTGITHCSMNDEGYTTISIPKANVLNSVYNSSLKNFSSSNDTSVYHDVQDHCYRKPQSYEDHYQDIRTRYVLVWAVSNLILAIVLIQVFDGMRFINNGYMKYIFWSIVAFTAWKTMGAVTFIATKIISRIANCVKSKLYIFNDP

SEQ ID NO: 2397 - protein, 613 aa, Schizosaccharomyces pombe
MSEVYEGAIGIDLGTTYSCVAVWETANVEIIPNDQGARTTPSFVAFTETERLVGDAAKNQAAMNPRNTVFDAKRLIGRRYEDPETQKDIKHWPFKVIDNNGIPTIEVNYLGEKKQFTAQEISAMVLTKMKEISEAKLNKRVEKAVITVPAYFSDSQRAATKDAGAIAGLNVLRIINEPTAAAIAYGLDAKSDKPKNVLIFDLGGGTFDVSLLKIQGGVFEVLATAGDTHLGGEDFDNALVEHFIQEFKRKQKIDISDDPRALRRLRSACERAKRALSSVTQTTVEVDSLSNGIDFSSSITRARFEDINATTFKATIDPVAKVLKDSKVPKADVHDIVLVGGSTRIPKVQRLVSDFFDGRALNKSINPDEAVAYGAAVQAAVLTNKADSDKTQDLLLLDVVPLSLGVAMEGNVFGVVCPRNTPIPTIKKRTFTTVADNQTTVTFPVYQGERVNCAENEPLGEFQLTGIPPMPRGQAELEATFELDANGILKVTAVEKTTGRSAHIEITNSVGHLSSTKIQEMIENADKFKQQDKDFAKKLEAKSQLESYISNIETTISEPNVMMKLKRGDKSKIEAQLAECMSQLELEDTNTDALRKAELRLKRTVQKAFASLR

SEQ ID NO: 2398 - protein, 623 aa, Schizosaccharomyces pombe
  unsure (1)..(623): unsure at all Xaa locations
MHTAKPVKRYFNLKSSRIGMNPQTKTFEVLVFLLFITYXLMLXGAINRLNSLQSNAKVLEVLRKRGKIPNDQSMVEMRHWLRCIGYQVSYYLXLGITKEXHSNILSRCIXLNEIETSICMSFIVLDCDPFFNFTLFLIIIISLKGQHIMSIKGNINRNCXLGWFSLYLFTKSFCXXFYTVMQLLLTNKSQPSDLNRLNVIHVAGTKGKGSTCAFTSSILQQIQKSGERSIPKCIGMYTSPHLRSVCERIQLNGKPISQELFTKYFFDVWERLENAVGSDSEKPMYFRFLTLMAWHVFISENVDAAIIEVGIGGEYDSTNLIEKPYATAVTSLGLDHTSLLGNTIAEIAWQKAGIYKESAIALTCEQAPEAMNVLKNRAAERNTSLKVVIPPAELTPDMIGLSGVHQLGNTSLAVSLVQEFYEKAGCPFDRDPYQDPAILDGLKYVKWPGRCQIEEINNIKWCFDGAHTKESLEATGLWLASKKNLYEDADARILLFNQQSRDDPIALLRSFLKGLESSGTGISFTHVIFSTNVTWKDAGYNPELLSINTITDNKPVLHVQEDLCKWWKESKGTTSEATVAPTIQEAIETVMSIKQKSRNTFVCVTGSLHLTGGVFVVLDQAVF

SEQ ID NO: 2399 - protein, 292 aa, Schizosaccharomyces pombe
  unsure (1)..(292): unsure at all Xaa locations
MADAEDSRHSKNEGFPNTSLITEKLDLLDLFGSPKVKTEREGRPARLLEGLSAVNAETAFVKTHPLQHEWTLWFLKPPTQGLEWSDLLKEIISFKTVEEFWGIFKTISKASMLPAKSDYSYFLKGIRPEWEDPQNMNGGKWAYQSKHKGSNLDELWLYMVSHGLFILTAVISTLQNVNFXVESINVWKXVLAAIGETLDPTGKEVTGVVCNMRKGFYRIAVWTRNCNDKDVLEKIGYVKFXEXRVGSXLDXQTCSLRFKEVLGISDKETIEYSAHEDSSKAGSMRAKTRMSL

SEQ ID NO: 2400 - protein, 259 aa, Schizosaccharomyces pombe
MLVELLEFTPLSFIDDVINITNQLLYKGVNGVDKAFSQTRFAKKAPQEIEEGLHKFEVLFESVVDRYYDGFEVYTLRNIFSYPPELKGYMRTFGKDVDYSITTEQDAAMDQAIQEAAEKLVVKMQLRRDLRMRLSRKREKKTEIEKHLERISFLNKVPENWQVTLPETTDFLLDQLGNLQHAVKRVVEASPTVHSREVDERITYLEKGYERLSNPIDQQKDFWSHHLSKLESTANTETANNIHKLLLSSEKDVGHTDEP

SEQ ID NO: 2401 - protein, 219 aa, Schizosaccharomyces pombe
  unsure (1)..(219): unsure at all Xaa locations
MSKIKLISSDNEEFVVGMXNGECFELSELTNCLXDQLIAERSMLIKNMLEGMIYTSACXVQXLLWTLLLKSQFQXTVGEINVPIPLPNVSSNVLRKVLEWCEHHKNDLYSGTEEESDIRLKKSTDIDEWDRKFMAVDQEMLFEIVLASNYLDIKPLLDTGCKTVANMIRGKSPEDIRKTFNIPNDFTPEEEEQIRKENVRSLVLYXLNSNRLQEWAEDR

SEQ ID NO: 2402 - protein, 350 aa, Schizosaccharomyces pombe
  unsure (1)..(350): unsure at all Xaa locations
MSWTTIESDAGVFTDLIENLGVKDVEVDELYSLDVDSLRQFPXVIIFLKAXSSMLGLKIVVFFTRVVIFYCSLFIELLWIGTGLTNXFPCNXDIYGIIFLFKWNSKVDKPDGTMDYDSMDNIFFAKQVINNACATQALLSVLLNHSDEIDLGTTLSEFKDFSKTLPPELKGEALGNSEHIRCCHNSFARSDPFISEEVRAATDEDEVYHFIAYTNINNVFYELDGLQAAPINHGSCTKEEFAEKAVSVIQARIANYDPAEIRFNLMVICKDKKASLLTREDLTDEEKAASIAVEDEKRLRWKRENQLRRHNFVGLFVELSKLLVKDRIDKNTWNSTLETAKAKYASQKRP

SEQ ID NO: 2403 - protein, 299 aa, Schizosaccharomyces pombe
  unsure (1)..(299): unsure at all Xaa locations
MEAVGKHVKLFWNVYSDYAVLIAISLSYFVFDVLMLPFTRQFSLEDITISHPFALHEQVPTKYLGVCCLSXXLXTIGKIAXLTLXIICVFFPALVLYGFGKLRNNSLLFWKSLMGLLYSTMVCGLCVSLLKNAVGRPRPDFLARCQPFESTPKTGLVDVLSCSVPWSDKVLQDGFRSFPSGHTSFSFAGLGFLAIFLAGQLKMFRNKTSSWKVVVPLVPLSIASWIGLSRSQDYRHHKEDIAVGALFGFAIAYVVYRQLFPPLDHHNADILYVQAELDEGYTNVHSAGNSSATNAEQMV

SEQ ID NO: 2404 - protein, 192 aa, Schizosaccharomyces pombe
MVSIYVPLIYITILMGSMYGVSRFVRKSKNQESKPVSEEWFGENYSRNIFFSLLQQNPPAEDTLLKAALVLRATEGLRRLMKLKVSRMALNNLLNRGGVGDELIRKFGRLEKETELELMDIAKTANSLQPGWNQFIFQTCNEIIENEKIHSIIDNIPKDIDSISQRWQTEKILYEAADEELRIQAQKELGVL

SEQ ID NO: 2405 - protein, 913 aa, Schizosaccharomyces pombe
  unsure (1)..(913): unsure at all Xaa locations
MDSFRXKGXAAXSESLPXESENSSLGAXTLXFTPSSPXSRISDEAAEALVEEDIEDLDGEALDVEDEEXXRFVGEGMERXVLXLCLRRVLSMLCILSVXHQYINYILFLLLXCKXIYLLDSXVAVXIDRTNLDFQKSSFTFRVKXGTFFXLYSDYQQNLELDRYDIEELDDDNDLEELDIGARRAVDARLRRRDIELDAAAGRXKTCCFLQDEDDDLDSNLGTGFTRHRHRIYDEXFTXCWALDESGELPLEXNCRRXXPXSIAEWVXXLIXVRXYNCSRIQNFLLEXYRXKWXPXXYXXPYXAXLGEVNAESLMXXXMPIXGESKPILAXFXWPMRLHLFSHIDRVALEATLLHYXRLXKNTLXYSCSITNLPTCFTLRDLRXIPSXLPCTGIWCVTRRTGLFPQLKYIRFTCTKCGATLGPFXSRLXRXSKNFXSVQLFQPWSVCNQLXRTVYNNYQRITLQESPGXRPLRXXCLXHREVILLRTWLMLQTRREIDVTGIYRNNFDASLXYQKRVSXSSLQLXKQITYRTXRQWXYXDDFSLSRLTDDEEREIRALAKSPDIHNRIIASMAPSIYGXSLYQNCYCCCFIXVVSPKXITVSIKLEXDINVLLLEIQEPPISISXVCXKNAHRAVXRHRSGCQCCWXXLHPSVKTPLXNGXTLEGGALVLADKVFVXLTSSIKXXSGSTSIHEAMEQQSISISKAGIVTTLQARCTIIAAANPIGGRXXHYNSFXIKMLSXPNLFYLVXDILQVXQDXGXSXNXEQLANFVVSSHIRSHLHLIRIWCLEKVPTEXWYXCQTHSPRSSSXIYPFRSXKSFXXDYSXMDEEXISRLYSDMRRESLATGSYPITVRHLSLLSVXVKHLQNAAQXVCAPFTYRQSHSSXLLIPLXXAQKMSVNEVCXRTFAKYLIXF

SEQ ID NO: 2406 - protein, 449 aa, Schizosaccharomyces pombe
  unsure (1)..(449): unsure at all Xaa locations
GQAQSGNFSNFGDGANGDNXKDQKKDKPKYEXSVPTRTGRRKKKAXKGPDASAKLPTVIPTTRCRLRLLKMQRIHDHLLMEEEYVQNQERLKPQDERTQEEXQSCDEIRGTPXVCRXLXXEIIDDDHAIVSTAGPEYYVSIMSFVDKDMLXAWLQVLLHHKAMSIVGLLLDDTDPMINVMKLDKAPTEXLCRXWWSXIXNSXRSKRLXXLPLTHPXTLXGNGHKPPKGVILYGAXRYWXNFTSKAVANQTSATFLRVVGSELIQKYLGDGPRLVRQLFNAAEEHSPSIVFIDXNXCYRYKALRAQSGAEREIQRTMLELLNQLDGFDTSQRDIKVIMATNRISDLDPALIRPGRIDRKILFENPDEATKRKIFTIHTSKMNLGEDVNLEELIQCKDDLXWCRNXSNRFXSGLLAXAXTPNASCYGRFRQAREKVLKTKDEGGPAGGLYI

SEQ ID NO: 2407 - protein, 443 aa, Schizosaccharomyces pombe
  unsure (1)..(443): unsure at all Xaa locations
MLARNLRCLHPNTFASLKTNVXYHGVKCLASQXKRGXQGWADVPXGTTGPXLXVLXXAYKKDGDVKKMNLGAGTYRDDAGKXLCSASVRQXRNXAVEQKLDKEYAPXHRNSQFPXASNXNWLXAMFXXXVYKDRLVSAQSXXXXWYRCLVYAANFLASFYPSKTIYVSXPYLGKSQGCIFSSGLXRXVLQVXMILLLVVGHXRHVSDLTSAPDGSIILLHACAHNPTGVDPTKAQWDDILKTMQKKNHFALLDMAYQGFASGDFARDAYATRLFASSNVPMLLCQSFAKNMGLYGERAGCFSILANDAEEAARIESQTKILIRALYSNPPVNGARIANHILSNPALREQWAGEVVGMSERLKSMRKALRNILEKDLKNKHSWKHIXXPNWYVLLYWFKSPXSXCFGXTVSHLPHXEWRISXLRSQHFQCKILCRSXSMRYFEL

SEQ ID NO: 2408 - protein, 237 aa, Schizosaccharomyces pombe
  unsure (1)..(237): unsure at all Xaa locations
DREFDTEERRYRTMESAAKKLQKEAKGYLDALRAMTASQTRXANTIDAFYGDAGSKDGVSAYYRQVVEDLDADTVKELDXXLXRTTVXGPISRFCSYFPDINAAITKRNHKLLDHDAMRAKVQKLVDKPSNDTTKLPRTEKEAAMAKEVYETLNNXTGSELPQLIAXSCPYLDPSFEALVKIQLRFCREGYEKMAQVQQYFDNSVREDYSNGLLDDKVEQVXTEYRDLSIAGLHNSQ

SEQ ID NO: 2409 - protein, 437 aa, Schizosaccharomyces pombe
MLARNLRCLHPNTFASLKTNVSYHGVKCLASQSKRGFKVWADVPMGPPDPIFGITEAYKKDGDVKKMNLGAGTYRDDAGKPYVLPSVRQAETELLSQKLDKEYAPITGIPSFRVQATKLAYGDVYESIKDRLVSAQSISGTGALCIAANFLASFYPSKTIYVSDPTWGNHKNVFSRAGLTVKSYKYYDPATRGLDIKGMLSDLTSAPDGSIILLHACAHNPTGVDPTKAQWDDILKTMQKKNHFALLDMAYQGFASGDFARDAYATRLFASSNVPMLLCQSFAKNMGLYGERAGCFSILANDAEEAARIESQTKILIRALYSNPPVNGARIANHILSNPALREQWAGEVVGMSERLKSMRKALRNILEKDLKNKHSWKHITDQIGMFCYTGLNPQQVDVLAKQYHIYLTKNGRISISGLNTSNVRYFAEAINAVTSN

SEQ ID NO: 2410 - protein, 284 aa, Schizosaccharomyces pombe
  unsure (1)..(284): unsure at all Xaa locations
LFHITKMSWHGFKKAVNRAGTSVCIXVLKNCLTLWXVMMKTGHVERTVDREFETEERRYRTMESAAKKLQKEAKGYLDALRAMTASQTRIANTIDAFYGDAGSKDGVSAYYRQVVEDLDADTVKELDGPFRTTVLDPISRFCSYFPDINAAITKRNHKLLDHDAMRAKVQKLVDKPSNDTTKLPRTEKEAAMAKEVYETLNNQLVSELPQLIALRVPYLDPSFEALVKIQLRFCREGYEKMAQVQQYFDNSVREDYSNGLLDDKVEQVLQSMRDLSIAGLNNSQ

SEQ ID NO: 2411 - protein, 500 aa, Schizosaccharomyces pombe
MQKPSLSQDLIWILKSVQSRRSTKGFLQKHSSLKDGSPNKKSFAQPISSSFLNRISITKIDDVDSLSDNTLYGIGRSINSLARLGIQSVIVPTSNPIGMTSPFKYLENGTVVAKKRKLSIFEELQQQQNRVIRVSEIFSKAGVLTRPSYSSVCQLGPEGPSVENVQGIFQALSSLYTVIVPSSILMPNVIEVPIDGNEVLAGLTYSLHKPNFGFWVDRIVILDKNGGMPCSKRQTGSSHVLINLAQEFDELAKTLPPYHRKNLILVRRCLKMLPDDASALITTPEDAMLTNPVLDKNPLIHNVLTDRSIISCSLPRDRSPITKTTVLRSGVPVYTFLGPKCLTDGSVSWERLWVLINDSFKRTLDMDAYLDRLKNSLAAVIIAGDYLGTAIVTYEQPDGTTNEKVPYLDKLAVSQGAQGSAAISDVMFNVMTDLFPKELIWRSRLTNPVNKWYFERSVGSLKSSKTPWKLFWTGDSHVRNLDRVNQYMSVIDKIQPTWLN

SEQ ID NO: 2412 - protein, 679 aa, Schizosaccharomyces pombe
  unsure (1)..(679): unsure at all Xaa locations
MYNDQIHKITYSGVEVFEYTINGFPLMKRCHDNWLNATQILKIAELDKPRRTRILEKFAQKGLHEKIQGGCGKYQGLCXLLTISIGLKLLKXHKIFVSVVFIYQFILFWMPVTNYSFRTWVPSERAVELAHEYNVFDLIQPLIEYSGSAFMPMSTFTPQSNRKPTEAYRRNSPVKKSFSRPSHSLLYPYTSSNNMTSTSRMSGIHDALSLQSDFTRSPDMPSDSFTGSLHDIKASPFSSNNYAQSLLDYFLLPNTTQPPDFVYDRPSDWDVNAGIDEDGHTALHWAAAMGNLEMMHALLQAGANVVAVNYLQQTSLMRCVMFTMNYDLQTFEVVSELLQSAICMNDSFGQTVFHHIALLASSKSKMEAARYYMDILLQNLTATQSVDVAAQIINLQDDHGDTALLICARNGAKKCARLLLSFYASSSIPNNQGQYPTDFLSSKDMSFPENDDSPLNSKIEDNLIDNLKYPQSLDDHLSSKKPISYFSNKLTHQTLPNVFTQLSELSKCHEASLAEKQLTYNLAMEALEQTVRETETCQRLWNERTNNDENYLVNQREDLIHQCKKFLHTLKTARYYLETVQLHQLKKYVTYFSQIWSTDELADISETKNLVGHDTKTNRSSLSSKHEVDLFTAENEAAREKLVEQLCSLQAQRKQKINEILNLLSMGMYNTINTDQSGS

SEQ ID NO: 2413 - protein, 1397 aa, Schizosaccharomyces pombe
IPKRIKHLQFGINGPEEFVKDGTVEVSRRDLYTMTDRSPAEHGALDLHMGTSNKQINCATCGESMADCMGHFGYVKLALPVFHIGYFKATLTILQNICKDCSSVLLSDQEKRQFLKDLRRPGIDNLRRSQICKRINDHCKKMRRCSKCDAMQGVVKKAGPLKIIHERFRYVRKSQDDEENFRHSFDEALKTIPELKMHLSKAHDDLNPLKVLNLFKQITPVDCELLGMDPEHGRPENLLWRYVPAPPVCIRPSVAQEGATTEDDLTVKITEIIWTSSLIRAALSKGTPISNLMEQWEFMQLSIAMYINSEMPGLRPSDMPSKPIRGFCQRLKGKQGRFRGNLSGKRVDFSGRTVISPDPNLRIDQVAVPYRIAKILTFPERVTTQNKKHLQDCIRNGPDVHPGANYVIDRESGFKRFLRFGNRNRIADDLKIGDIVERHLHDNDVVLFNRQPSLHKLSIMAHLVKVRPWRTLRFNECVCGPYNADFDGDEMNLHVPQTEEAKTEALELMGIKNNLVSPRNGEPIIAATQDFITAAYLLSLKDTFLDRKSISNICCYMMDASTHIDLPPPAIIKPRCLWTGKQVFTVLMKPNRFSKVLVNLDAKTRSFSRIKSKTPEMCPKDGYLMIRNSEIIAGVVDKSVVGDGKKDSLFYVILRDYGALEAAEAITRLSKMCARFLGNRGFSIGIEDVQPGKSLSSQKEILVNKAYATSDDFIMQYAKGILECQPGMDQEATLEAKISSTLSKVRDDVGEICMDELGPANSPLIMATCGSKGSKINVSQMVACVGQQIISGKRVPDGFQDRSLPHFHKNSKHPLAKGFVSNSFYSGLTPTEFLFHAISGREGLVDTAVKTAETGYMSRRLMKSLEDLSSAYDGTVRSSNSDVVQFVYGDDGLDPTYMEGDGQAVEFKRTWIHSVNLNYDRHDSAMLPYEIIDYVNRALDDPKFLTNCNRDFIETIRTFVIENIAKYLASVRERRDLAPMLEEPDMDDLDDMEGDEFAPVAKRKSVENIIRVTEKQLRSFVDRCWEKYMRAKVEPGTAVGAIGAQSIGEPGTQMTLKTFHFAGVAAQTTLGVPRIKEIINAAKTISTPIITGQLINDRDERSARVVKGRIEKTYLKDVTSYIEEVYGPVTTYLSIQVNFDTISKLQLDITLADIAAAIWNTPKLKIPSQQVTVNNTLQQIHVHTSSDGKSSETEVYYRLQTYKRVLPDVVVAGIPTINRSVINQESGKIELFMEGTGLQAVMNTEGIVGTKTSTNHVMEMKDVLGIEAARYSIISEIGYTMAKHGLTVDPRHIMLLGDVMTCKGEVLGITRFGVAKMKDSVLALASFEKTTDHLFNAAARFAKDSIEGISECIVLGKLAPIGTNVFQLIRRTEEEEEQKPKELLFDTPSLHQLEITA

SEQ ID NO: 2414 - protein, 277 aa, Schizosaccharomyces pombe
MDQAIAGLAAGTASTLIMHPLDLAKIQMQASMNQDSKSLFQVFKSNIGSNGSIRSLYHGLSINVLGSAASWGAYFCIYDFSKRVVMSMTPFNNGEISVLQTLCSSGFAGCIVAALTNPIWVVKSRILSKRVNYTNPFFGFYDLIKNEGLRGCYAGFAPSLLGVSQGALQFMAYEKLKLWKQRRPTSLDYIFMSAASKVFAAVNMYPLLVIRTRLQVMRSPHRSIMNLVLQTWRLQGILGFYKGFLPHLLRVVPQTCITFLVYEQVGMHFKTQSSKSQ

SEQ ID NO: 2415 - protein, 329 aa, Schizosaccharomyces pombe
MDVVLQYADKYVFDTFYGKIAESFDSSSSFANTAVNSTTLGLAEKVNFAITSGLLDRNNVWRQFTSLFLITWIMGTLSYFLSASFAYYVYFDREEARRHPKFLKNQEHLELMVALKNLPGMAILTAPWFLAEIRGYGYVYDKLDEYGYFYLFFSIALFLLFSDFLIYWIHRALHHRWLYAPLHKLHHKWIVPTPYSSHAFHYLDGYSQSLPYHMFPFFFPLNKYVYLLLFGSVNYWTVLIHDGKYFSNNAVVNGAAHHAAHHMYFNYNYGQFFTLFDRLCSSYRQPDQELFDAELRNEKLQEQRIRFMETVQYTVEGKDDRTYASKKDN

SEQ ID NO: 2416 - protein, 706 aa, Schizosaccharomyces pombe
  unsure (1)..(706): unsure at all Xaa locations
MSSKLTVYQATTSMADSPRDPFQSRSQLPRFLATSVKKPNLKKPSVNSANGMXNLYLTFVYGSDTLXETKNPKLASLEFQLENLKNDLKRKELEFEREQIELQRKLAEEHEQKNSLQLRLTLVEKQLEEQSTSYQKEIEEVRNEKEATQVKIHELLDAKWKEIAELKTQIEKNDQALSEKNHEVMVSNQALQMKDTNLTNLEKLFADSREQLETKCKELAAAEQQLQELSVHNQQLEESIKQVSSSIELEKINAEQRLQISELEKLKAAQEERIEKLSSNNRNVEILKEEKNDLESKLYRFEEYRDKVATLELENEKIQTELNSWKSLITNELPTPEAVSNKLVFLQNTNANLGERVSSLESQLSNKPANQPLGANEKDAAHITELETKLKELHEQNRRLQRQKSLATQEIDLLRENLKSYDDEEAILSEKNTDMKKLERIEGLVKLVDEYKLKLESMPVSLDVDETSDEVSLQKRRRKNEHKDAGYVTELYRKNQHLLFQVKEKTNIEAFLREQIITLESSIATLRQELAQVTEINSCRVLQHRSNPTLKYERIKAAQLEMLNAENSALKALLEDKKVDCLPIQSFKIAERKALDLKKEVAEREKRIQRLKEIFSVKSLEFREAVFSLFGYKLDFMPNGSVRVTSTYSREDNTAFIFDGESSTMKLVGNPSGPEFERLIRFWCDERKTIPGMLAALTLELLDKND

SEQ ID NO: 2417 - protein, 306 aa, Schizosaccharomyces pombe
SNGETSVRIKQSVRGCDVYIVSPASGQVNDHLMELLIMISACKTASAKKVTAVLPVFPYSRQPDQKFSFSGAPLSDLQDAVVPCKKQTGYHPWIAQSGTLVADLLMCSGADHIITMDLHDPQFQGFFDIPVDNLFGRPLLKHYISLNIPNYHNAVIVSPDAGGAKRATAIADALGLDFALIHKNRRHEYGTSLMLVGDVQNKVAILIDDLIDTAYTLVRAAEFVKEHGASKIYALVTHCVLSGDAIERVKLSCIDKLIVTNTAPQTITPSGCFDIIDVAPTFAEAIRRIHNGESISILYDHNQVWV

SEQ ID NO: 2418 - protein, 522 aa, Schizosaccharomyces pombe
  unsure (1)..(522): unsure at all Xaa locations
MVSDFFFPQPGGIESHIFQLSQRLIDLGHKVIGMRLALXXCQLVHALTCIILVITHAYKDRVGVRYLTNGLTVYYVPLHVSFXLKFXSRIALKLNNATVYRETTFPSFFSFFPIFRNIVIRENIEIVHGHGSLSFLCHDAILHARTMGLKTCFTDHSLFGFADAGSIVTNKLLKFTMSDVNHVICVSHTWXVSHEQVFKLLTKKRENTVLRAVLNPKRVSVIPNALVAENFQPDPSKASKDFCEFFVYXGKNLTFLVTIVVISRLYYNKGIDLLIAVIPRICAQHPKVRFVIAGDGPKSIDLEQMREKYMLQDRVEMLGSVRHDQVRDVMVRGHIYLHPSLTEAFGTVLVEAASCGLYVISTKVGGVPEVLPSHMTRFARPEEDDLADTLSSVITDYLDHKIKTETFHEEVKQMYSWIDVAERTEKVYDSICSENNLRLIDRLKLYYGCGQWAGKLFCLLIAIDYLVMVLLEWIWPASDIDPAVDRVSSTFKISKQNFDESLVLTDPKKKTKIKTACLKDAQ

SEQ ID NO: 2419 - protein, 309 aa, Schizosaccharomyces pombe
SDNIAFVAIRNNQCYCGSTLTATEVSSSLCTTPCPGYGSLMCGGDLYWSVYLTGNGVLQTTVSSSSVSSTTSSSSSSSPSSSSTTTTTSPSSSSSSSSSSSSSSSSSSSSSSSSSSSSSSSSSSSSSSSSSSSSSSSSSSSSVPITSSTSSSHSSSSSSSSSSSSSSRPSSSSSFITTMSSSTFISTVTVTPSSSSSSTSSEVPSSTAALALNASKASNHTSLNAGAIVGIVIGCVAFAVVMALCIFLYFYFRRFKIRMSDSANEGKYPSYASELDSRLDPAMMNRKSSESLADSQDYSRKILRVTNLN

SEQ ID NO: 2420 - protein, 344 aa, Schizosaccharomyces pombe
MNTQYGCYLVDSSLTEQGTFTYLDPAYCYNNICGGSDNIAFVAIRNNQCYCGSTLTATEVSSSLCTTPCPGYGSLMCGGDLYWSVYLTGNGVLQTTVSSSSVSSTTSSSSSSSPSSSSTTTTTSPSSSSSSSSSSSSSSSSSSSSSSSSSSSSSSSSSSSSSSSSSSSSSSSSSSSSVPITSSTSSSHSSSSSSSSSSSSSSRPSSSSSFITTMSSSTFISTVTVTPSSSSSSTSSEVPSSTAALALNASKASNHTSLNAGAIVGIVIGCVAFAVVMALCIFLYFYFRRFKIRMSDSANEGKYPSYASELDSRLDPAMMNRKSSESLADSQDYSRKILRVTNLN

SEQ ID NO: 2421 - protein, 329 aa, Schizosaccharomyces pombe; identical to SEQ ID NO: 2415

SEQ ID NO: 2422 - protein, 277 aa, Schizosaccharomyces pombe; identical to SEQ ID NO: 2414

SEQ ID NO: 2423 - protein, 591 aa, Schizosaccharomyces pombe
  unsure (1)..(591): unsure at all Xaa locations
KNQTHIFREMSGKXEKFKGFQYXRXIDDSHLETKVVTDGTTGEKKTISYEPCRVLGSGSFGVVIQAKLVGTPGFIAVKRVLQDKRYKVRCXGVCMREIAVGRRRXLKXGKERARVEFSCVVERNLFWLICFXCHLSLKQPVINICXYXRWFSFTQKRILSISRCIEWFAFXAFGFTSFLPFILLSVLFISSFCSLGXFVYGIFFLINQFXKGNGLSFSYCNEFLFSPDCASRRLXIIRRLFFXHHLQXMLSCNISFFFSSSLPFLPAYXPSYRNRELQIMRAISHPNIIKLIAFFHTHNPSKDETHLCLLLEYMPETVFDDMRWYTRRRKSIPNLSIKLYAFQLFRALAYLHSTGVCHRDIKPQNLLVDYKTGILKLCDFGSAKVLVPSEPNVSYICSRYYRAPELVFGATHYTTKIDVWSAACVIAELFIGRPLFPGDSSVEQLVEIIRVLGTPSYHEISVMNPNYVNHSLPNVRPHTLESVMPHNCTKNAMDLLHKMLTYVPSKRISAIEVLTHPFFDELRDPNCMYHCSRDEGTIERHLPPLFNFNLAELSIRPNLNKAILPPHVYESLDVDINNFEPIVVKQADADS

SEQ ID NO: 2424 - protein, 591 aa, Schizosaccharomyces pombe; identical to SEQ ID NO: 2423
  unsure (1)..(591): unsure at all Xaa locations

SEQ ID NO: 2425 - protein, 433 aa, Schizosaccharomyces pombe
MATQNYKVADISLAAFGRKELEIAENEMPGLIAVREKYAKSQPLKGARIAGCLHMTIQTAVLIETLVALGAEVTWSSCNIYSTQDHAAAAIAATGVPVFAWKGETEEEYLWCIEQQLKSFPSGKPLNMILDDGGDLTALVHERHPELLVDIRGISEETTTGVHNLYKMFKENKLKVPAINVNDSVTKSKFDNLFGCKESLVDGIKRATDVMIAGKVAVVAGFGDVGKGCSTSLRSQGARVIVTEVDPINALQAAMDGFEVTTMEEAVKEGQIFVTTTGCRDIIRGEHFNEMKEDSIVCNIGHFDVEIDVAWLKANAKDVVNIKPQVDRYELKNGRHIILLADGRLVNLGCATGHPSFVMSCSFTNQVLAQIALWTDNTSYPLGVHMLPKKLDEEVARLHLGKLGVKLTTLTSVQSDYLGIPVDGPYKADHYRY

SEQ ID NO: 2426 - protein, 330 aa, Schizosaccharomyces pombe
MSNKSAWQPQFDEIHSSVQEAEGFLQSSNDVQKAIDEVHYPDSLNDLSEISKNLYISSWKTASELVSTSDKGIDYTLSAMSINPNLSVPEQQHLWLQIEDSSSQNILQYFEKSNKFIAFALSKNAKVLVHCFAGISRSVTLVAAYLMKENNWNTEEALSHINERRSGISPNANFLRQLRVYFECNYQLDRSLRPYRQWLFRRYGDFAVLNTRVPSEVAYAETVRARAGQLELRCKKCRFVLASSDYLVSHEPKDENNYSHTRCTHYFLEPIRWMQPELELGNLEGRFDCPKCNSKIGSYKWQGLQCSCLQWVCPALSILQSRVDAVRKLG

SEQ ID NO: 2427 - protein, 482 aa, Schizosaccharomyces pombe
MAPISKVFDYLVIGGGSGKYNSILSGFDGLTFMNIRGLASARRAAKHGAKVALIEASGRLGGTCVNYGCVPKKIMWNIADLVAKMKTAKQNGFPNSQLGSFDWGMIKRKRDAYIGRLNGIYERNVNKDGVAYISGHASFVSPTEVAVDMNDGSGTQVFSAKYILIAVGGHPIWPSHIPGAEYGIDSDGFFELESQPKRVAIVGAGYIAVELAGVFAALGTETHMFIRQSKFLRKFDPIISDGIMDHFQHIGINVHTNSLEFKKVEKLPSGELCIHQQDGSTFNVDTLLWAIGRAPKIQGLRLEKAGVKTLPNGIIIADTYQRTNVPTVLSLGDVCGKLELTPVAIAAGRRLSDRLFGGIKDAHLDYEEVPSVVFAHPEAGTIGLTEQEAIDKYGESQIKVYNTKFNGLNYSMVEQEDKVPTTYKLVCAGPLQKVVGLHLVGDFSAEILQGFGVAIKMGATKSDFDSCVAIHPTSAEELVTLV

SEQ ID NO: 2428 - protein, 482 aa, Schizosaccharomyces pombe; identical to SEQ ID NO: 2427

SEQ ID NO: 2429 - protein, 330 aa, Schizosaccharomyces pombe; identical to SEQ ID NO: 2426

SEQ ID NO: 2430 - protein, 433 aa, Schizosaccharomyces pombe; identical to SEQ ID NO: 2425

SEQ ID NO: 2431 - protein, 316 aa, Schizosaccharomyces pombe
ILDGILVQFLKMDSGSRVNVNIQGTRVLKNKLGKIPDIDISTDGKYLLSASTNDVLLVWDLHTSNKVAFFEAPSVWIMTCAFSPSTKSIAAGGLNNFCVVYDTSVPDADPVELVGHAGFVSCCKYVDDGHLLTGSGDKTCMFWDIEQAKAISVLKGHEMDIVSLDFLPSNPNLFVTGGCDKLAKLWDLRAAYCCATFPGNTSDINSISFFPSNADFVTGAEDGIARCFDIRASAEIFQYSSPSSSPINSVLFSKSGKLLFIAKDKTCEVWDSISSKTITSLTGHENRISSLALTSDGTMLATGSWDECVRLWSSSG

SEQ ID NO: 2432 - protein, 473 aa, Schizosaccharomyces pombe
MTEAKNISDDTDVLSLTTNSLRTSKTLFGAEFGSVTSFDDTVAQNLKRTYKEHLEYGSVLGGTVGKRKNRHYEEDTIGSNALTVRADSENPSSQVITKFSDPNKKIAGQVSMQSLEKIKGVPEAAHRIAGESQASLVKRTLAEQIRPEWHAPWTLMRVISGHLGWVRCVDVEPGNQWFCTGAGDRTIKIWDLASGVLKLTLTGHIATVRGLAVSPRHPYLFSCGEDKMVKCWDLETNKVIRHYHGHLSGVYALKLHPTLDVLVTAGRDAVARVWDMRTRQNVHVLSGHKSTVASLAVQEFDPQVVTGSMDSTIRLWDLAAGKTLTTLTHHKKTVRALSLHPDEFTFASGSSDNIKHWKFPEGAFMGNFEGHNAIVNTLSINSDNVMFSGADNGSMCFWDWKSGHKYQELQSVVQPGSLDSEAGIFASSFDKTGLRLITCEADKSVKIYKQVDNATPETHPNLPWTPSNLRRRY

SEQ ID NO: 2433 - protein, 535 aa, Schizosaccharomyces pombe
MNISLKGAIFSTVGRFNLPKVQGFIRWNSTMKSQQPTLFSEVASLSSTFKNSLSRAGFEKMTPVQQRVLNEVFPNEENAVVQAKTGTGKTLAFLLVAFKDVLKGKPRLNSSKIHSVILSPTRELALQIFEEARKLTYGTGIRVSYAIGGNSKMREENAIRRGNANLLIATPGRLEDHLQNPRILESLSTDSFILDEADRLMDMGFAESILNIHEAVTTTKTRKLCFSATMPPKVSNVFRGILGTDFKLINCLDPNEPPTHERVPQFVIETKLDKVFSSSLSLLQQLTSSNPSSRIIVFLPTISMVDFVGGVLENHLKIPCFILHSGLTTAQRRSITESFRKCQSGILFATDVVARGMDFPNITQVVQITGPSNTDDYIHRIGRTGRAGKTGEAYLILLEQEKPFLNSIKHLPLKRATIEPLSDQALSTLRSDIEKSSKFSRTNALKTLYGSKPHVFSGSSQRRATGKNIHESAIALFSLHDVPGLMEELIYKSRGRGSPKGFRGSQLKYPSSSSSSFQRRPRSLPSRGRYQQSRR

SEQ ID NO: 2434 - protein, 361 aa, Schizosaccharomyces pombe
  unsure (1)..(361): unsure at all Xaa locations
GTYGVVYKARHKLSGRIVAMKKIRLEDESEGVPSTAIREISLLKEVNDENNRSNCVRXVFTXRMHGKCLHXXNFVSNPFLRLLDILHAESKLYLVFEFLDMDLKKYMDRISETGATSLDPRLVQKFTYQLVNGVNFCHSRRIIHRDLKPQNLLIDKEGNLKLADFGLARSFGVPLRNYTHEVYFFSYLAVXLYSQKIWNIDXRSFSINLCRXPFRIVTLWYRAPEVLLGSRHYSTGVDIWSVGCIFAEMIRRSPLFPGDSEIDEIFKIFQVLGTPNEEVWPGVTLLQDYKSTFPRWKRMDLHKVVPNGEEDAIELLSVRFCITIYLRLITNHFVKAMLVYDPAHRISAKRALQQNYLRDFH

SEQ ID NO: 2435 - protein, 381 aa, Schizosaccharomyces pombe
  unsure (1)..(381): unsure at all Xaa locations
NLNRGVLLDANECAYGSVISVDGVEFNRYPDPRQIEVKQRLCDLRNKELSITKPLTPDNICMGVGSDEIIDSLIRISCIPGKDKILMCPPSYGMYTVSAKINDVEVVKVLLEPDFNLNVDAICETLSKDSAIKVFFACSPGNPTAKALKLEDIKKILEHPTWNGIVVVDEAYIDFSAPDMSALTLVNEYPNLAVCQTLSKSFGLAGIRXVNLSFXALILFLYXLXCLVIGFCLTSKPIATIMNSLKAPYNISEPTSRLALDALSPQSIDKMHTYRDAIIQQRVRLCKELTTIKGMGKIIGGYDANFILIQVLDRPEGGKPSNDAAKYLYLQMATMHKVVVRFRGTEPLCEGALRITVGTEEENTILLKTIKLVLQEYYTKK

SEQ ID NO: 2436 - protein, 375 aa, Schizosaccharomyces pombe
MEEEIAALVIDNGSGMCKAGFAGDDAPRAVFPSIVGRPRHHGIMVGMGQKDSYVGDEAQSKRGILTLKYPIEHGIVNNWDDMEKIWHHTFYNELRVAPEEHPCLLTEAPLNPKSNREKMTQIIFETFNAPAFYVAIQAVLSLYASGRTTGIVLDSGDGVTHTVPIYEGYALPHAIMRLDLAGRDLTDYLMKILMERGYTFSTTAEREIVRDIKEKLCYVALDFEQELQTAAQSSSLEKSYELPDGQVITIGNERFRAPEALFQPSALGLENAGIHEATYNSIMKCDVDIRKDLYGNVVMSGGTTMYPGIADRMQKEIQALAPSSMKVKIVAPPERKYSVWIGGSILASLSTFQQMWISKQEYDESGPGIVYRKCF

SEQ ID NO: 2437 - protein, 491 aa, Schizosaccharomyces pombe
MTVVRADKKHRRRGSIYMVTPYMDHDLSGLLENPSVKFTEPQIKCYMKQLFAGTKYLHDQLILHRDLKAANLLIDNHGILKIADFGLARVITEESYANKNPGLPPPNRREYTGCVVTRWYRSPELLLGERRYTTAIDMWSVGCIMAEMYKGRPILQGSSDLDQLDKIFRLCGSPTQATMPNWEKLPGCEGVRSFPSHPRTLETAFFTFGKEMTSLCGAILTLNPDERLSASMALEHEYFTTPPYPANPSELQSYSASHEYDKRRKREQRDANSHAFEQTANGKRQFRFMTRGPSDPWYGIRRPNYNSQPQYQRGSYNREGGNMDRSRNVNYQPKRQQNFKPLTSDLPQKNSEFSETNAMNQTSNHSHADGQRYYRPEQDRSQRLRNPSDYGRQGRQSSQSQQPAWNVSSRYQNNSKVQTTSRASENADTNKTQHNIKYIDSYVPEYSIARQSANQKTNEQHPSSTSLHQQSTSDLKSPSFHENSNVDDTPK

SEQ ID NO: 2438 - protein, 446 aa, Schizosaccharomyces pombe
  unsure (1)..(446): unsure at all Xaa locations
MVYIKCRYVCFCCAFIRXNGGLIDSNYCSNTTSKSIFNELRCPVTLTFLQFGFVAFFSAVCLLFRKQFLGGTGIQKPSKYVLYTTLPLSIFQIGGHVFGSLATTKIPVSTVHTVKALSPLFTVLAYRFMFRHVYSAMTYFSLVPLTFGVTLACSFELSADIVGLLYALISTCIFVSQNIFGSKIFMEAKSHSTHTKKHYNKLNLLLYSSGVAFIVMIPVWLYQEGFAYLPEVGSPVFLNLIYNGLSHFFQNILAFTLLSIISPVAYSIASLIKRIFVIVVSIIWFQQATNFTQGSGIFLTAIGLWLYDRSKKGNLYESCKVKEFEKDALELEEQTMEDEKSYPSSGTQSPFYGKNFLPQITPRLDSVVPLISDSPMTPNSVYSNEGVTSSVSGNATPASVRQSTQNDFSNSNIHDRRSSYTFQLNNFKAPQPSRLWATETVPTLKI

SEQ ID NO: 2439 - protein, 425 aa, Schizosaccharomyces pombe
  unsure (1)..(425): unsure at all Xaa locations
MLWLDQYRPKTLASLDYHKQLSERLISLSSTNEFPHLLVYGPSGAGKKTRVVAILRELYGPGSEKVCFFIVXLSFNXIYMLTMNVLKIDQRTFLTPSSKKLQINIVSSLHHLEITPSDVGNYDRVIMQELLKDVAQSAQVDLQAKKIFKGCLHCKVKSIWNFCALFCSXVSHVIFWLVNFQFFSLFLSALVLTCSLVVVINVADELTRDAQAALRRTMEKYSNNIRLILIANSTSKIIEPIRSRTLMVRVAAPTPEEIILVMSKILTAQGLEAPDSLLNNIANNCDRNLRKAILLLETVHAKSPGNKQLIDTGAQLPLPDWQTFIQQVGDSMLQEQSPARILAVRSMLYDLLSHCIPPTTILKELLSFFLSKVDTKLHPYLIQAAANYEHRTRMGNKSIFHLEAFVAYFMKVYAMLQLGMELPSY

SEQ ID NO: 2440 - protein, 276 aa, Schizosaccharomyces pombe
  unsure (1)..(276): unsure at all Xaa locations
MKPFSPSQTNFEKEQLCFGVYQLKDCYQQVIEALSLGIRVIDSAITYRNEKECEQAIQDFCHQNVNIKREDITLITKIPDSLQGFERTWKAVXQSLRRTGRXKLDVVLIHSXKWPVRRIESWRALLQHQKEGRINKIGVSNYNIHHLEEIISLGLPLPAINQVEFSAFNNRPTFLSYCFNHGILVQAFSPLTRGYRLSDIRLLDLSLKYNKTPANILLRYCLQKGVSPISKASSFVHIHENVKAEQFMLDPSDMDVMDTWDEEFVSKPTWNPIILP

SEQ ID NO: 2441 - protein, 490 aa, Schizosaccharomyces pombe
  unsure (1)..(490): unsure at all Xaa locations
MTKALLKDLNARDAPLREQLEQEATSLPKIVLSERXFCDVELILNGGFSPLDGFMNQKDYLNVVENLRLSTGEVFPIPITXDLNESQPDSLKAGDRVALIDPRDGQTVIAILTVEDKYTPDKANEAEKVFGANDRAHPAVDYLFGRAGNVYVGGKLQAVTPIRHFDFVEYRYSPAQLRSDFQRNNWNRVVAFQTRNPMHRAHRELTVRAAKQHGARVLIHPVVGMTKPGDIDHFTRVRVYEAILQRYPKGSAKLSLLPLXMRMAGPREALWHAIIRKNYGASHFIIGRDHAGPGKNSQGEDFYGPYDAQYLVEQYAQEIGITIVPFQMMTYLPDEDIYKPVDKVEPGTRTLNISGTELRRRLRVGDNIPEWFSYPEVVAILRQSYPPKYSQGFVLAVPATSDKLLPSALVSALNEDGXRHVTLLPRLDAISVFYAQELQRAGAAVVVSLADADASVKVPAEWTTVNIKPKDSVSEVTFAVLSQLSDEGYL

SEQ ID NO: 2442 - protein, 738 aa, Schizosaccharomyces pombe
  unsure (1)..(738): unsure at all Xaa locations
MVHELNYPLIEQFPVYGSYALQAAQFPHCSLFLHLDDPSMPCNTIRMWTIGLIYSTVGAAVNMFFSLRNPTVTLSVLISELLAYPALQIWDLIFPDREFRIGRLKFNFKPGPFNVKEHALIVVMSSVSFGNAXXXXXILAQRVHYKQRFGFGYEICLTLATQLIGYGLAGLSRRLLVRPASMLWPVNLVQCTLNKTLHRKDLRNAVANGWRIPPFRFFLYGFIXSFXWNWFPSYIFQALSLXAWVXWIRPNSPTVNQIFXESTGISILPMTFXWNQISAYILSPLMAPADALMNILVGVILFLWIVTPALNFTNTWYGDYLPISSSGIIDHFGNSYNVTRILTKDATXDLDAYQNYSPIXMSTTYALAFGLSFXXXXSVIFHVILYHGKEIYDRLRDPPAPDIHEKLMKAYDEVPFYWYLSVFLAFFGMMMGTIYGWKTETPWWVIIVGVIFSAVWFIPIGIAQAITNIQLGLNVFTEFIVGYMYPGRPLAMMIYKTVGYITMTQGLAFAADLKFGHYMKLPPRIMFYTQMIATIWSCFVQIGVLDWALGNIDNVCQADQPDNYTCPNATVFFNSSVIWGVIGPKRMFSGKNTYTGLQYFWLAGVLGTIXFWALWKKWPQKWWGQLNGPLICGGTGYIPPATPVNYLAWSGIGLFXXYYLKKIXADWWQKYNFTLSAALDTGTQLSXIIXXXXLQLPMVNXPDWWGNDXAXNTLDATGAAVRKLVXESAGEFFXPAEW

SEQ ID NO: 2443 - protein, 566 aa, Schizosaccharomyces pombe
  unsure (1)..(566): unsure at all Xaa locations
MSPSPVNTSTEPASVAAVSNGNATASSTQVPENNQSDSFAPPSNNSQQNQQSSTIAPNGGAGSVANANPADQSDGVTPSFVGSLKLDYEPNPFEHSFGSTASVGQGNPSLNRNPSLSNIPSGVPPAFARTLLPPVSSIASPDILSGAPGIASPLGYPAWSAFTRGTMHNPLSPAIYDATLRPDYLNNPSDASAAARFSSGTGFTPGVNEPFRSLLTPTGAGFPAPSPGTANLLGFHTFDSQFPDQYRFTPRDGKPPVVNGTNGDQSDYFGANAAVHGLCLLSQVPDQQQKLQQPISSENDQAASTTANNLLKQTQQQTFPDSIRPSFTQNTNPQAVTGTMNPQASRTQQQPMYFMGSQQFNGMPSVYGDTVNPADPSLTLRQTTDFSGQNAENGSTNLPQKTSNSDMPTANSMPVKLENGTDYSTSQEPSSNANNQSSPTSSINGKASSESANGTSYSKGSSRRNSKNETDEEKRKSFLERNRQAALKCRQRKKQWLSNLQAKVEFYGNENEILSAQVSALREEIVSLKTLLIAHKDCPVAKSNXAAVATSVIGSGDLAQRIXLGY

SEQ ID NO: 2444 - protein, 276 aa, Schizosaccharomyces pombe
MKPFSPSQTNFEKEQLCFGVYQLKDCYQQVIEALSLGIRVIDSAITYRNEKECEQAIQDFCHQNVNIKREDITLITKIPDSLQGFERTWKAVEQSLRRTGRPKLDVVLIHSPKWPVRRIESWRALLQHQKEGRINKIGVSNYNIHHLEEIISLGLPLPAINQVEFSAFNNRPTFLSYCFNHGILVQAFSPLTRGYRLSDIRLLDLSLKYNKTPANILLRYCLQKGVSPIFKASSFVHIHENVKAEQFMLDPSDMDVMDTWDEEFVSKPTWNPIILP

SEQ ID NO: 2445 - protein, 1820 aa, Schizosaccharomyces pombe
  unsure (1)..(1820): unsure at all Xaa locations
PFTNSISRVEEVQFGILSPEEIRSMSVAKIEVSVCFVLITYRFXFPETMDESGQRPRVGGLLDPRLGTIGMKFRKRLVFSHILXDRQFKCQTCGETMADCPGHFWYVLQLFGLLXKHLFFSATFXTQXKDSXHLSGHIELAKPVFHIGFLSKIKKILECVCWNCGKLKIDSVSQLLSLSIVLLTLXSQNPKFNDTQRYRDPKNRLNAVWNVCKTKMVCDTGLSAGSDNFDLSNPSANMGHGGCGAAQPTIRKDGLRLWGSWKRGKDESDLPEKRLLSPLEVHTIFTHISSEDLAHLGLNEQYARPDWMIITVLPVPPPSVRPSISVDGTSRGEDDLTHKLSDIIKANANVRRCEQEGAPAHIVSEYEQLLQFHVATYMDNEIAGQPQALQKSGRPLKSIRARLKGKEGRLRGNLMGKRVDFSARTVITGDPNLSLDELGVPRSIAKTLTYPETVTPYNIYQLQELVRNGPDEHPGAKYIIRDTGERIDLRYHKRAGDIPLRYGWRVERHIRDGDVVIFNRQPSLHKMSMMGHRIRVMPYSTFRLNLSVTSPYNADFDGDEMNMHVPQSEETRAEIQEITMVPKQIVSPQSNKPVMGIVQDTLAGVRKFSLRDNFLTRNAVMNIMLWVPDWDGILPPPVILKPKVLWTGKQILSLIIPKGINLIRDDDKQSLSNPTDSGMLIENGEIIYGVVDKKTVGASQGGLVHTIWKEKGPEICKGFFNGIQRVVNYWLLHNGFSIGIGDTIADADTMKEVTRTVKEARRQVAECIQDAQHNRLKPEPGMTLRESFEAKVSRILNQARDNAGRSAEHSLKDSNNVKQMVAAGSKGSFINISQMSACVGQQIVEGKRIPFGFKYRTLPHFPKDDDSPESRGFIENSYLRGLTPQEFFFHAMAGREGLIDTAVKTAETGYIQRRLVKAMEDVMVRYDGTVRNAMGDIIQFAYGEDGLDATLVEYQVFDSLRLSTKQFEKKYRIDLMEDRSLSLYMENSIENDSSVQDLLDEEYTQLVADRELLCKFIFPKGDARWPLPVNVQRIIQNALQIFHLEAKKPTDLLPSDIINGLNELIAKLTIFRGSDRITRDVQNNATLLFQILLRSKFAVKRVIMEYRLNKVAFEWIMGEVEARFQQAVVSPGEMVGTLAAQSIGEPATQMTLNTFHYAGVSSKNVTLGVPRLKEILNVAKNIKTPSLTIYLMPWIAANMDLAKNVQTQIEHTTLSTVTSATEIHYDPDPQDTVIEEDKDFVEAFFAIPDEEVEENLYKQSPWLLRLELDRAKMLDKKLSMSDVAGKIAESFERDLFTIWSEDNADKLIIRCRIIRDDDRKAEDDDNMIEEDVFLKTIEGHMLESISLRGVPNITRVYMMEHKIVRQIEDGTFERADEWVLETDGINLTEAMTVEGVDATRTYSNSFVEILQILGIEATRSALLKELRNVIEFDGSYVNYRHLALLCDVMTSRGHLMAITRHGINRAETGALMRCSFEETVEILMDAAASGEKDDCKGISENIMLGQLAPMGTGAFDIYLDQDMLMNYSLGTAVPTLAGSGMGTSQLPEGAGTPYERSPMVDSGFVGSPDAAAFSPLVQGGSEGREGFGDYGLLGAASPYKGVQSPGYTSPFSSAMSPGYGLTSPSYSPSSPGYSTSPAYMPSSPSYSPTSPSYSPTSPSYSPTSPSYSPTSPSYSATSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPS

SEQ ID NO: 2446 - protein, 358 aa, Schizosaccharomyces pombe
MGILDIVPTGVITGDNVLKLFTYAREHGFAIPAINVTSSSTAIAALEAAREARSPIILQTSNGGAHFFAGKESSNEGQKASIAGSIAAAHYIRSIAPFFGVPVVMHSDHCAKKLLPWMDGMFEADEAYFKIHGEPLFSSHMLDLSEEPKKENIAQVKEYCKRAVPMKIWIEMEIGITGGEEDGVDNSHVSHTELYTQPEDIWDVYRELSSVTPYFSIAAAFGNVHGVYKPGNVKLQPALLGQHQAYVKEQLKTTNDKPVFFVFHGGSGSSVNEFRTGIKCGVVKVNIDTDTQFAYVEGVRDYVLKYKDYLMTPVGNPEGADKPNKKKFDPRVWIHEGEKTMTKRVLTALEDFYTVNTL

SEQ ID NO: 2447 - protein, 362 aa, Schizosaccharomyces pombe
DPPLTVSSTQRISRPPSLQKSITMVGVEPLYQSNGNEKSSKYNVFSESAHGNHQVLSFSPGSSPSFIEQPSPISPTSTTSEDTNTLEEDTDDQSIKWIRGALIGSGSFGQVYLGMNASSGELMAVKQVILDSVSESKDRHAKLLDALAGEIALLQELSHEHIVQYLGSNLNSDHLNIFLEYVPGGSVAGLLTMYGSFEETLVKNFIKQTLKGLEYLHSRGIVHRDIKGANILVDNKGKIKISDFGISKKLELNSTSTKTGGARPSFQGSSFWMAPEVVKQTMHTEKTDIWSLGCLVIEMLTSKHPYPNCDQMQAIFRIGENILPEFPSNISSSAIDFLEKTFAIDCNLRPTASELLSHPFVS

SEQ ID NO: 2448 - protein, 402 aa, Schizosaccharomyces pombe
MAPSEKDIEEVSVPGVLAPRDDVRVLKTRIAKLLGTSPDTFPGSQPVSFSKKHLQALKEKNYFVCEKSDGIRCLLYMTEHPRYENRPSVYLFDRKMNFYHVEKIFYPVENDKSGKKYHVDTLLDGELVLDIYPGGKKQLRYLVFDCLACDGIVYMSRLLDKRLGIFAKSIQKPLDEYTKTHMRETAIFPFLTSLKKMELGHGILKLFNEVIPRLRHGNDGLIFTCTETPYVSGTDQSLLKWKPKEMNTIDFMLKLEFAQPEEGDIDYSAMPEFQLGVWEGRNMYSFFAFMYVDEKEWEKLKSFNVPLSERIVECYLDDENRWRFLRFRDDKRDANHISTVKSVLQSIEDGVSKEDLLKEMPIIREAYYNRKKPSVTKRKLDETSNDDAPAIKKVAKESEKEI

SEQ ID NO: 2449 - protein, 873 aa, Schizosaccharomyces pombe
VRVRPFSTAESANLIASSDRLSFGTSSSLRNPGSGRQIRRVVKVLDGRVLVFDPPDETTATLSATNRRLSTSQQSLARLSRKSNNSAGFGRDLRYAFDRVFDETATQQQVYERTARPLLDNILDGFNATIFAYGATGCGKTHTISGTMQDPGLIYLTLKELFERMDHLRDEKIFDLRLSYLEIYNETIRDLLVSPTPNQAKPLNLREDADRRITVPGLTSLSPESLEEIIDIIMKGNANRTMSPTEANAASSRSHAVLQVTLIQKPRTAGINEDHTLATLSIIDLAGSERATATKLRGSRLFEGANINKSLLALGNCINALCDPHRRAHVPYRDSKLTRLLKFSLGGNCRTVMIVCVSPSSVHYEETHNTLKYANRAKNIKTEVLRNMISVDRHVSQYVKAIVELREQISELENRLAQIDLSSQSNGSDQDAVTQSFAHESKLAEARNLLRMTFEETLPLQNDTINKVEKVKHFDDSIRVLKYWLSCYERILPNSADERVFLVRSKLESLLTRRAEIIADIDPELVYQKFQRSVSHIINTYKQEGATMYADVLQDEVDLLKSIIENQVLDAQNKVDEFTPVLESLLRSSFKASSLLKEGGMQELFSILEKWLLGIGLGEKPNISVLSESYKLNSTSDDSRTINRDRVHSFPTQPLLNNNLPRMFFVKSPKKPVVFSKRSPKKRVRFDDSMSTSDSGASAYNSPIQTSKLKNMNFFNTMHMPSTPAHKRPENKNQIDVEINLTSPVSPMLEDKPEPGLLIKSPLEKKQEVNSESTQLDQLLAEDSSTDDVSLPHLDTIDLDGSPVPKVPDLNFSRANMDSPTFILNNEAIHNFDFSKPKTRQSLSSLTTLHLSNPANIIRKSLSMAENEEEKAT

SEQ ID NO: 2450 - protein, 635 aa, Schizosaccharomyces pombe
  unsure (1)..(635): unsure at all Xaa locations
MSAFKPYTEALEVLKKYEKKDGLSIDDLIRHNFQGGLTFNDFLILPGYIDFVPNNVSLETRISRNIVLKTPFMSSPMDTVTEDQMAIYMALLGGIGVIHHNCTPEEQAAMVRKVKKYENGFILDPVVFSPQHTVGDVLKIKETKGFSGIPITGKXIDXEKEKNEILLKELHSXMGGLVSHYLYXLFPLYYXXMLPTLXFLWRLSMYRXYLMMLFDXLSFFRNDLIVMGSTFLFYXRYCIACFFFHLLLDIVFLIXICXFTNLXENGKLRGKLVGIVTSRDVQFHKDTNTPVTEVMTPREELITTAEGISLERANEMLRKSKKGKLPVVDKDDNLVALLSLTDLMKNLHFPLASKTSDTKQLMVAAAIGTRDDDRTRLALLAEAGLDAVVIDSSQGNSCFQIEMIKWIKKTYPKIDVIAGNVVTREQTASLIAAGADGLRVGMGSGSACITQEVMACGRPQATAIAQVAEFASQFGIGVIADGGIQNVGHMVKSLSLGATAVMMGGLLAGTTESPGEYYVREGQRYKSYRGMGSIAAMEGTGVNKNASTGRYFSENDAVRVAQGVSGLVVDKGSLLRFLPYLYTGLQHALQDIGTKSLDELHEAVDKHEVRFELRSSAAIREGDIQGFATYEKRLY

SEQ ID NO: 2451 - protein, 659 aa, Schizosaccharomyces pombe
MEYYTSKEVAEWLKSIGLEKYIEQFSQNNIEGRHLNHLTLPLLKDLGIENTAKGKQFLKQRDYLREFPRPCILRFIACNGQTRAVQSRGDYQKTLAIALKKFSLEDASKFIVCVSQSSRIKLITEEEFKQICFNSSSPERDRLIIVPKEKPCPSFEDLRRSWEIELAQPAALSSQSSLSPKLSSVLPTSTQKRSVRSNNAKPFESYQRPPSELINSRISDFFPDHQPKLLEKTISNSLRRNLSIRTSQGHNLGNFGQEILPRSSRRARPSELVCPLSSLRISVAEDVNRLPRIDRGFDPPLTVSSTQRISRPPSLQKSITMVGVEPLYQSNGNEKSSKYNVFSESAHGNHQVLSFSPGSSPSFIEQPSPISPTSTTSEDTNTLEEDTDDQSIKWIRGALIGSGSFGQVYLGMNASSGELMAVKQVILDSVSESKDRHAKLLDALAGEIALLQELSHEHIVQYLGSNLNSDHLNIFLEYVPGGSVAGLLTMYGSFEETLVKNFIKQTLKGLEYLHSRGIVHRDIKGANILVDNKGKIKISDFGISKKLELNSTSTKTGGARPSFQGSSFWMAPEVVKQTMHTEKTDIWSLGCLVIEMLTSKHPYPNCDQMQAIFRIGENILPEFPSNISSSAIDFLEKTFAIDCNLRPTASELLSHPFVS

SEQ ID NO: 2452 - protein, 461 aa, Schizosaccharomyces pombe
MSFPYQHTSRSQVQPPLAAPGLSMFAPVSSSNSANSASSVAALLSHAPMYGLGQRRPSFLPGVSVPDTLSVRSGFSIPSSSHHPSAVPSLLSQHRLQQPQPRLYPSAPLNYYWPSYQSVPSAAPPPPSQQRYMPDSAVAYNPNQDQFGNSVNVSAACNNVSAPLIANNCAPSFYQSRHPVADVPVTNNTATTTSETDNTIPGNLNMPSVANVQQRISPVCKTNMEDQEETVYTGGVAAKLDYKMDQMVEYLSIMTCKLYARFLNNAQMHSLANSLPGLVFSFRKVVTQILTSTRLPRASCLLALSYLSDRLDAASQTTDFVNQWTKESLFFQICALLTTALILANKFLDDNTFTNQSWSQVTGFRTALLNSFEQDWLASMSWNLSPGPRGQKAWEWWSASYSLFTSSNATYSGEQKTYSPTTLSTNAPPSPSSGRSCSNCNYYYPYTPVGYYPVYNRYAMT

SEQ ID NO: 2453 - protein, 670 aa, Schizosaccharomyces pombe
AISKPKEHESAIYRNANFPDHLVETYSDDVHTLFDVFRHSVKQFGNKKAMGYRNLVKEHVETKMVTKVVDGEKKEVPKSWSYFELSDYNYLSFNDIYDKALRYAGALRKLGLNKGDKFELYAPTSAFWLLTAEACLSQSMTIVTAYDTLGEEGLLHSLRESGVRGMYTEGHLLKTLVNPLKEIESLEVIIYRNDAKEEDIKTIQEIRPNLKLIKFADFEKMSPPVEPDPPSPEEICCIMYTSGSTGLPKGVILSHKNMVAIVTAIVKHVPEVTSKDYLLAYLPLAHILEFAFENICLAWGGTIGYANVRTLVDTNCRNCKGDINTFRPTIMVGVPAVWEMVRKGIMSKLNAASAVKRSVFWTAYYTKAKLMRHNLPGSCVLDTAVFNKIRSMGTGGRLRYTLSGGSALSPDTKRFLSIVLCPMLIGYGLTEISAAAMVQNPACFNLDDSAGSLLPCTEMKLVDCEEGNYNSHGHPPRGEIWLRGPSLTRGYLNRDKENKESFTPDGWFRTGDVGELTPEGLLRIIDRKKNLVKTQNGEYIALEKLESRYRTSSLVSNICVYADQTKVKPLAIIVPNEPVVRKLATEQAGLSPDASWEEVCHNKKVRQLVYDDLIRIGRSHHFANIELIQNVVLVPIEFTPENGLVTAAQKLQRRKILDRFKKEIDAAYAE

SEQ ID NO: 2454 - protein, 417 aa, Schizosaccharomyces pombe
  unsure (1)..(417): unsure at all Xaa locations
MAGSKWETEETNQFAIENQKLEEEWRKKRRLEKKRKRKILEEEEKAEERNIDACRLYLMGNTPELKSCNSIDDYEILEKIEEGSYGIVYRGLDKSTNTLVALKKIKFDPNGIGFPITSLREIESLSSIRHDNIVELEKVVVGKDLKDVYLVMEFMEHDLKTLLDNMPEDFLQSEVKTLMLQLLAATAFMHHHWYLHRDLKPSNLLMNNTGEIKLADFGLARPVSEPKSSLTRLVVTLWYRAPELLLGAPSYGKEIDMWSIGCIFAEMITRTPLFSGKSELDQLYKVCDFXFFILTLKNSXQXYXIFNLLGYPTREEWPQYFLLPYANKIKHPTVPTHSKIRTSIPNLTGNAYDLLNRLLSLNPAKRISAKEALEHPYFYESPRPKDPKFFPTFPSKAKGESKEKNVFQSFRSASPKK

SEQ ID NO: 2455 - protein, 1065 aa, Schizosaccharomyces pombe
  unsure (1)..(1065): unsure at all Xaa locations
MARLLTKSSQVFDFLADRLSVRKSRRFWETQENLESSTPLLQEPQQSYRSNSFNELPPLSRSVTFAENEQPNEAVKLGTFEGCFIPTTLNVLSILLYLRFPWIIGEAGVLKTLLMLFISYAVGIFTSLSISAICTNGMVRGGGAYYAVSRSIGPELGGSIGLIFYVGQILNTGMNISGFVEPIISIFGKESGTISQFLPEGYWWVFLYTTCVLAMCCILCCLGSAIFAKASNALFVVIILSTISIPISSIFVHPFKDPSLLVHFTGLKWSTLMKNLASAYTENEKGTGYESFKSTFGVFFPATAGLLAGASMSGDLKAPSRSIPKGTISSQATTFLLYLLVILCVGASVTRTGLLLDMDVMEHISLHPLFIISGILSSGAFSSFMGIFGAAKLLQAIARDDLIPGMFFFAKGSSYDDIPYVAIGVTYLITQISLFWDINMLSSMITMTFLLTFGFINLSCFLLRISSTPNFRPTFRYFNRRTTLVGTILSFGVMFYVDRLNAFISFLIAGILVVVIYFTCPPKNWGDVSQGIIYHQLRKYLLQTNKARENIKFWRPQILLLINNPNRSENVIRFCNSLKKGMYTDIFXQYXPINYRSLYILGHVIVSDDFQASMDDLRKQQRLWHQFVLDRGIKAFVELTIAPDEVWGIRGLISSAGLGGIRPNIAVLTFINTNYRRHRIYSGSSFSLENTSEESESDSKKEFVEHDILPVKWVQILEDMLVGSVDVMVTNGFDRLNWPKRKGEKQYIDMFPIHRISGVGSEVNESTPTFATNFETYTMVFQLSWILHTASDWKQGCRLRLITLVEFENEIEAERESMHQMLETFRIKADVVVLCLAAMNLDAYRYIVKNEHVRPSKSSELENLLKDDSWWQEEKKRRGNTVDSLGPIRFPRRMSGYNFRSASFDKSAPPLSVPLSFRLGPHMHSVKSFETESSFGNRSLSPKQENRRTYSDSTIESSLMPNVVREDSSSDRLAPKKKIGRDYSKEKLTFNDLSSRSQYIIMNEIVLKHTKNTSVLFTVLPAPLADTHKSFRKSEEYVDDLLIFMEGLPPCALIHSKSLTITTAL

SEQ ID NO: 2456 - protein, 1333 aa, Schizosaccharomyces pombe; identical to SEQ ID NO: 2149

SEQ ID NO: 2457 - protein, 229 aa, Schizosaccharomyces pombe
MSQFPALEDFDDGLVTAPVDDSKNNTDFLEREKLALGEDAGQFETPEDKDALLNFENDSEAEQTRFEQNFPPIDAEMQASGTFSAPKAPYMGQAEVHPPEDESGDPEPVRKWKEDQMKRIQERDESSKKLRESNIEKARKAIDDFYENFNDKRDKVIAKSRKEQEKLLEENESKSTGTTSWERILKLIDLSDKPEAHGRSTERFRELLISLAKDSNAPGAAGTTVSSSS

SEQ ID NO: 2458 - protein, 726 aa, Schizosaccharomyces pombe
MDPIRFGLSRVPFAHCYNKRVIFRANYLVPLTWLKNNVAYKSTNTLLLPTPNAEYYSTSKLSSQVNVSLNSLSQKASSGSKIYPFKNSFPLPFSRSILPIRSLAFLKLCVRHNSTVPSKDEQAQDISKINTNGTLQTPNKKVNVFRLFTLARGQGWNFFIAGSLLLVSSGVTMSIPYIVGKILDAGSSGDSSVTHIMGIPSGTFYIGLLGLFFLGSACNFGRIITLRLLSERIVSRLRARLFAKCMSLDGAFFDFHKHGDLISRLTTDSSIVGKSLSMYLSDGLRSSVSAIAGIGMMLYVSMRLTGYMSLIVPPIALGAFFYGEYVRKLSRTTQDALGDLTRVSEEKLANVRTTQAFLGERQEVNRYNDYIRNLFVLAKREAFASGIFFGSTGFLGNATVIAILALGGRMVAAGDITVGQLSSFLLYTVYAGGSIVGLSGCFTDIMKGLGAASRLFELLDAKPKIAPTVGIPVPVTVGKAILSFRNVGFAYPTRPSASIFDNLSFDIHPGTNVAIVAPSGGGKSTISQLLLRFYAPSSGKILADGVDISTYNVHQWRSHFGLVGQEPVLFSGTIGENIAYGKSNASQEEIEDAAKRANCSFVLSFPEKWSTQVGTRGLQLSGGQKQRIAIARALLRNPAFLILDEATSALDGEAEVMVDKTIQSLMHNRSMTTITIAHKLATIRRADQIIVVGDGKVLEQGSFERLSRPGTNFYKLMRWQLGKVEP

SEQ ID NO: 2459 - protein, 474 aa, Schizosaccharomyces pombe
  unsure (1)..(474): unsure at all Xaa locations
RFDKFMLTTFSDIEGLLRVVFILNXPHAVHPNVDKKSFIRWRQRDIHEKRAVRKQKMEDIKGAMAMNRRLLSRISEMETVLEKESPSDPYVLLGSFLEAKKSEDMDSAIPGGMSYHHMPMSLLKVIKDAEDTTEEKSMDDSDKCLRRLKSHKERLLKLLEDAQKEYDTLEAESKNYITSEDLHLGFDSTYVQKKEPEKPKKTKTKKETIQVIESLNNPTPPTDFPGAKEQASTGNAPKNPVNENESEDEEGLSLSEDGKKFANIDFGDYSSSEEFLKEHLNILADEEESDAILLEAFNAELEGKPSLAKQYVHQALLISYCRQLGPNGLSIFFQKIKDPNHQSQRLFLEDVHNTYVRIHERSAAISKEQAESGEGVEQIQLCAVDPNTKLSITIPEAGSTDPETQKARAAFESFPPNLQKALMTNDLDKINVVLGKMAVENAEEVVEKLSSTGMLSIEEGIIDTTKGETIPQLS

SEQ ID NO: 2460 - protein, 1047 aa, Schizosaccharomyces pombe
  unsure (1)..(1047): unsure at all Xaa locations
MNSGTTLHLDRLSLETPSERTCFCIKCWESMXGSKFNRRVRRAVFSQNETLSXNWTLLFYFFPAVMNGIYXLLLXSVPSTSQVWFGGKCWHSDWYDXKCKRWDFWIFFFSYRLNKKIXNAPKITLVCASCCFDLLIKTVCXFXCVNCNKKLDPSSEDFSQDDQKQIFCKLCVDICNGCSTPICEFNAVSNSQANHPCCSNCRAFINSNAFGKFKGQHYCLPCLRKQDEENQKAVMESASGFIPLRNIAQTAENTSLTGKFVAYVVFIDIVFMFLTLILGQNQGFQNPHFIASDSPSSVLSGRMQNTSSPTNSLRPQLKVQTNGYETPGDINSAKSYKDIQKDFLLKPKNSFVKTSPSPLANGPSFRSANASPFDSCDSFHSGSSIPIEPVSSRQSSVVNNNSVQQPVAYHAFVQSPTENGTLPQLPKNESVVNPPPLRRSSTMNYKSVSTTTSPSKYGYVSGRIALSPIHLRGALRDVTNKCNLKVPRNRNSLSNLDEYYVNGLESDETPTKARFPRYPTVFNKLDDKRLSSEPNGLKKRLTNSSNYEASPRAKSLNLSQVSLHQACEPEYNRSSLVRASDVFTSNVFDATEESANELAIRISELQAEVGTLLLEATSLASIIEQQTPVSPEAFKQELVADLNYRLDYLRKSFQPELSTLLLRRDALSTTVSKLQNAYSTVMEETAYLNVKNTELVSLNNQLERELAYLREQQHKKRTSSSFGIFNNDKKSNRTISTPSPRESFSRLQMVASSLGFRPKDNKDKESGGYNKRNSKIDLKKSFSKRFHWKRDSPHMSSTPSISEEHLASEEQEDFVPAVGHCKLCGKYSNELRAHYQDCVSSTIDRQYQSKKSESPVWALNPDDFDQNRLTLLRVPTLIVSCINFIESYGMDFEGLYRKSGATSQMKKIVALLRNEDTVLDPSEDISAVTSVFKQYLRNLPNPIITYDQYFPFITAANCASFQDKLDGFIMVIKSLPPAHAEILQLIIRHLARVAAYSHANRMTSKNLAVVFSPTLIRDPDNSRDVIDMTVKNYSLAFLIDHVHEVFA

SEQ ID NO: 2461 - protein, 1009 aa, Schizosaccharomyces pombe
MLRFIPSSAKARALRRSAVTAYRLNRLTCLSSLQQNRTFATQPTDDFLTGGAADYVDEMYDAWKKDPNSVHASWQAYFKNVQERGVSPSKAFQAPPLLDYADSYTALDSSLINGNNYADIDVGIYMKVQLLVRAYQSRGHHLAKLDPLGINVNHNRPSELTLEHYGFTESDLNRTIHLGPGILPNFREAGRKTMTLREIVETCEKIYCGSFAVEFTHISSRKRSNWILSHLETPTPFRYSHDQKIMIFDRLSWADSFERFLFTKFPNDKRFGLEGCEAMVPGMKALIDRSVDEGISNIVIGMAHRGRLNLLHNIVRKPAQAIFSEFRGTQDPDDEGSGDVKYHLGMNYQRPTPSGKRVSLSLVANPSHLEAEDPVVLGKVRAIQHYTSDEASHEQSMGILIHGDAAFAAQGVVYETFGLHALPGYSTGGTVHIVINNQIGFTTDPRFARSTPYCTDIAKSMEAPIFHVNGDDVEAVTFICQLAADWRKAFKTDVVVDIVCYRRHGHNETDQPSFTQPRMYKAIAKHPPTFKIYTQQLLQEKTVSKAEVDAQEKRVWDILESSFESSKNYKSDHREWLSNPWVGFASPKDLMTKILPSYPTGVNIDTLKQIGKALYTLPEGFDAHRNLKRILNNRNKSISSGEGIDMPTAEALAFGTLLEEGHHVRVSGQDVERGTFSQRHAVLHDQSSENVYIPLNHLSPNQASFVIRNSSLSEYGVLGFEYGYSLSSPNALVVWEAQFGDFANNAQCIIDQFIAAGETKWLQRTGIVLSLPHGYDGQGPEHSSARMERYLQLCNEDPREFPSEEKLQRQHQDCNIQAIYVTKPSQYFHALRRNIHRQFRKPLVIFFSKSLLRHPAARSTIDEFDEKHGFKLILEEEEHGKSILPPEKIEKLIICSGQVWVALSKAREENKIDNIAITRVEQLHPFGWKQMAANISQYPNLKEIIWCQEEPLNAGAWTYMEPRIYTILKHLGRDLPVRYAGRPPSASVAAGNKQQHLAEQEQFLNDALL

SEQ ID NO: 2462 - protein, 406 aa, Schizosaccharomyces pombe
  unsure (1)..(406): unsure at all Xaa locations
MALDLRIGNKYRIGRKIGSGSFGDIYLGTNVVSGEEVAIKLESTRAKHPQLEYEYRVYRILSGGVGIPFVRWFGVECDYNAMVMDLLGPSLEDLFNFCNRKFSLKTVLLLADQLISRIEFIHSKSFLHRDIKPDNFLMGIGKRGNQVNIIDFGLAKKYRDHKTHLHIPYRENKNLTGTARYASINTHLGIEQSRRDDLESLGYVLVYFCRGSLPWQGLKATTKKQKYEKIMEKKISTPTEVLCRGFPQEFSIYLNYTRSLRFDDKPDYAYLRKLFRDLFCRQSYEFDYMFDWTLKRKGMRYLGNSAFFIFWVSELLKTNVIXYFMKFTXSHLLTFKLXTQQDQQHQQQLQQQLSATPQAINPPPERSSFRNYQKQNFDEKGGDINTTVPVINDPSATGAQYINRPN

SEQ ID NO: 2463 - protein, 378 aa, Schizosaccharomyces pombe
MSSTALLPPNTDQVLSRRLHGKAAEKKTGLAAIASKDVDEQSRKLQEYFEFWDRNHENESEEDRARRIDGYKSVVNSYYDLATDLYEYGWSQSFHFSRFYKGEAFAQSIARHEHYLAYRMGIKPGSRVLDVGCGVGGPAREITEFTGCNLVGLNNNDYQISRCNNYAVKRNLDKKQVFVKGDFMHMPFEDNTFDYVYAIEATVHAPSLEGVYGEIFRVLKPGGVFGVYEWVMSDDYDSSIPKHREIAYNIEVGDGIPQMVRKCDAVEAIKKVGFNLLEEDDLTDHDNPDLPWYYPLTGDITKCQNIWDVFTVFRTSRLGKLVTRYSVQFLEKIGVAAKGTSKVGDTLAIAQKGLIEGGETHLFTPMFLMIAKKPETDA

SEQ ID NO: 2464 - protein, 833 aa, Schizosaccharomyces pombe
  unsure (1)..(833): unsure at all Xaa locations
MRRSGTSLSRDLERKIHERLVSLKDTIQQTEIEEWPVSTRRAIQFVQERDMSLRRIKKPILEKVVEKVLDTLKAEVEEKLASSQDLVLVDSDMEEQSDSNLMEVKVCFAALLHFYENHFYXVLFTDTNVINKSITSLWSSPNLKEIDGEDEKKSVGQESITGSAKRKDRRSKTNGSKRQKRFVRIYFSGKVIYINXHFFKAEANREPPSDISLSDIGGLDDCINELLELVAMPIKHPEVYQYTGIHPPRGVLLHGPPGCGKTMLANALANELGVPFISISAPSIVSGMSGESEKKVREVFEEAKSLAPCLMFIDEIDAVTPKRESAQREMERRIVAQFLTCMDGMYLISFFLAYXQFRTSFEKTDGKPVLVIGATNRPDSLDSALRRAGRFDREICLTVPSQDAREKILRTMAKGLKLSGDFDFRQLAKQTPGYVGADLKALTAAAGIIAIKRIFNEISPLNKLDLNSDPRFNELDSDMALDSNDSLPLDHSSIIQRYLNAHPDPLSPEELEPLAICPQDFIEALAKVQPSSKREGFATVPGVSWNNIGALKSIRVELQMAIVQPIKRPELYQSVGISAPTGVLLWGPPGCGKTLLAKAVANESKANFISIRGPELLNKYVGESERAVRQVFLRARASSPCVIFFDELDAMVPRRDDSLSEASSRVVNTLLTELDGLSDRSGVYVIAATNRPDIIDPAMLRPGRLDKTLLVDLPDAHERVEILKTLTKQTPLHEEVNLDVLGRDERCSNFSGADLAALVREAAVTALRSAVFADIASNEPEITQHSALEPIRVTNADFELAFKNIKPSVSDRDRQKYQRLAKRWSSASTNDAD

SEQ ID NO: 2465 - protein, 430 aa, Schizosaccharomyces pombe
  unsure (1)..(430): unsure at all Xaa locations
MNSNNKRVALQEISNYVSKSLNVKGWVNAQVREISLQNGCSPSDKHFPSQSWHGISSIEESQIQKDYDSFLASPLEEEIVFTEKQLLVDLDVCSISNVQSPNCSVSEFGIAIEESNDNCAEEDEEEELQMRYSADESVSVEYAKEILSHMEKLEVXKKWEEKGEGKQEDEGVEEVFIYXHFLIRFMPDYRHMSAQPYYVTEMRASVINWIVGVHTCINLLPESLFLSINVLDRFLSLQNVPASKMKLCGATALFIACKYEEIHPPTVKDLEIVLEGEWIGEDICGMEKYMLMVLQYQLGWPGPVSFLRLLTIVNKWESQLRIMIKYFLEVSLVEQRFSSLRASQLVATCAYTGQSILQEENWSNTLPQITGYDYMSLVSYVHLLLKCLENPFDHHYAIYSKYATPYFHGISRQVHDWIATNTNLMAMDGS

SEQ ID NO: 2466 - protein, 361 aa, Schizosaccharomyces pombe
LTTLPLRTLSRWWGYVNRIEIPLWMRVPAFGLYSKIFGCNLTEADPDDVRQYKNLAEFFTRKLKPGARVIDPDAPIVIPADGKILNYGVIEGGQLEQVKGITYSLDALLGDEKLARLKRSHAIPSPDHIPHIRQEEFAKLNGIHYSLQDLMGHDHGERPSHVKDASAQHIDLLSSTKVAAKSQFTLFGSRETNCLYYAVIYLAPGDYHRFHSPTDWVVERRRHFSGELFSVSPFMARRLGNLFILNERVALMGRYKYGFMSMIPVGATNVGSIRIKFDKDLCTNQFGKLGPVGTFDEAVYTSSSSILHGHPLLRGDEVGNFELGSTVVLVFEAPADFEFLVKQGQKVRVGLPLGRVVPSSH

SEQ ID NO: 2467 - protein, 1333 aa, Schizosaccharomyces pombe
MSYANYRYMKARAKRWRPENLDGIQTSDEHLINLFAKILSKHVPEIGKFDPNKDVESYISKLDQHFTEYPSLFPNEHTKRQYTLNHLEELEQQFAERMFSENGSLTWQELLRQTGKVQGSNKGDRLTKTFEGFRNQLDKVQFIRKLMSKANVDDFHTRLFILWMLPYSLRKLKERNYWKSEISEIYDFLEDKRTASYGKIHKRFQLQNKNLGKESLSKKNNTTNSRNLRKTNVSRIEYSSNKFLNHTRKRYEMVLQAELPDFKCSIPCLIDTGAQANIITEETVRAHKLPTRPWSKSVIYGGVYPNKINRKTIKLNISLNGISIKTEFLVVKKFSHPAAISFTTLYDNNIEISSSKHTLSQMNKVSNIVKEPELPDIYKEFKDITAETNTEKLPKPIKGLEFEVELTQENYRLPIRNYPLPPGKMQAMNDEINQGLKSGIIRESKAINACPVMFVPKKEGTLRMVVDYKPLNKYVKPNIYPLPLIEQLLAKIQGSTIFTKLDLKSAYHLIRVRKGDEHKLAFRCPRGVFEYLVMPYGISTAPAHFQYFINTILGEAKESHVVCYMDDILIHSKSESEHVKHVKDVLQKLKNANLIINQAKCEFHQSQVKFIGYHISEKGFTPCQENIDKVLQWKQPKNRKELRQFLGSVNYLRKFIPKTSQLTHPLNNLLKKDVRWKWTPTQTQAIENIKQCLVSSPVLRHFDFSKKILLETDASDVAVGAVLSQKHDDDKYYPVGYYSAKMSKAQLNYSVSDKEMLAIIKSLKHWRHYLESTIEPFKILTDHRNLIGRITNESEPENKRLARWQLFLQDFNFEINYRPGSANHIADALSRIVDETEPIPKDSEDNSINFVNQISITDDFKNQVVTEYTNDTKLLNLLNNEDKRVEENIQLKDGLLINSKDQILLPNDTQLTRTIIKKYHEEGKLIHPGIELLTNIILRRFTWKGIRKQIQEYVQNCHTCQINKSRNHKPYGPLQPIPPSERPWESLSMDFITALPESSGYNALFVVVDRFSKMAILVPCTKSITAEQTARMFDQRVIAYFGNPKEIIADNDHIFTSQTWKDFAHKYNFVMKFSLPYRPQTDGQTERTNQTVEKLLRCVCSTHPNTWVDHISLVQQSYNNAIHSATQMTPFEIVHRYSPALSPLELPSFSDKTDENSQETIQVFQTVKEHLNTNNIKMKKYFDMKIQEIEEFQPGDLVMVKRTKTGFLHKSNKLAPSFAGPFYVLQKSGPNNYELDLPDSIKHMFSSTFHVSHLEKYRHNSELNYATIDESDIGTILHILEHKNREQVLYLNVKYISNLNPSTIMSGWTTLATALQADKAIVNDYIKNNNLNI

SEQ ID NO: 2468 - protein, 232 aa, Schizosaccharomyces pombe
  unsure (1)..(232): unsure at all Xaa locations
MAQIRQEALKKQKSETQKSTEGFVDIGNLAQWTCSSEKSGFPIRLVRDDNIDTYWQXVYLYKYSQGRKCFTNYNFLCLXGSDGSQPHTIHIKFVKRVSIKYVSMYLQYTLDESYTPSTLRISAGTGFQDLEIVTTVQVEEPTGWVHVPVGDFGRNGLLDVHLIQIKILANHQSGKDSHVRLIKIYAPEMYVFCIAKSSLIXNVLTLMQRQPAIAVDEIPYTSLQFISRNQLR

SEQ ID NO: 2469 - protein, 232 aa, Schizosaccharomyces pombe; identical to SEQ ID NO: 2468
  unsure (1)..(232): unsure at all Xaa locations

SEQ ID NO: 2470 - protein, 371 aa, Schizosaccharomyces pombe
MCAKKIVVLPGDHIGPEIVASALEVLKVVEKKRPELKLEFEEHKIGGASIDAYGTPLTDETVKACLEADGVLLGAVGGPEWTNPNCRPEQGLLKLRKSMGVWANLRPCNFASKSLVKYSPLKPEIVEGVDFCVVRELTGGCYFGERTEDNGSGYAMDTWPYSLEEVSRIARLAAWLAETSNPPAPVTLLDKANVLATSRLWRKTVAKIFKEEYPHLTLKNQLIDSAAMLLVKSPRTLNGVVLTDNLFGDIISDEASVIPGSLGLLPSASLSGVVGKSEEKVHCLVEPIHGSAPDIAGKGIVNPVGTILSASLLLRYGLNAPKEAEAIEAAVRKVLDDTSIGGRGLYTRDLGGEASTADITKAVVEELEKIL

SEQ ID NO: 2471 - protein, 1504 aa, Schizosaccharomyces pombe
  unsure (1)..(1504): unsure at all Xaa locations
MSIDADFSDYEDEASGDENVLPNTTTKRVCKCLWNLLLFXNTNNFFRKASTTSSKSRAKKASTPDLRQTSLTSMTASEQIPLVTNNGNGNSNVSTQYQRLTPREHVLRRPDTYIGSIEPTTSEMWVFDSEKNKLDYKAVTYVPGLYKIFDEIIVNAADNKVRDPNMNTLKVTLDPEANVISIYNNGKGIPIEIHDKEKIYIPELIFGNLLTSSNYDDNQKKVTGGRNGYGAKLCNIFSTEFVVETADKERMKKYKQTWYDNMSRKSEPVITSLKKPDEYTKITFKPDLAKFGMDKIDDDMVSIIKRRIYDMAGTVRETKVYLNNERISISGFKKYVEMYLASDTKPDEEPPRVIYEHVNDRWDVAFAVSDGQFKQVSFVNNISTIRGGTHVNYVANKIVDAIDEVVKKENKKAPVKAFQIKNYVQVFVNCQIENPSFDSQTKETLTTKVSAFGSQCTLSDKFLKAIKKSSVVEEVLKFATAKADQQLSKGDGGLRSRITGLTKLEDANKAGTKESHKCVLILTEGDSAKSLAVSGLSVVGRDYYGVFPLRGKLLNVREASHSQILNNKEIQAIKKIMGFTHKKTYTDVKGLRYGHLMIMTDQDHDGSHIKGLIINYLESSYPSLLQIPGFLIQFITPIIKCTRGNQVQAFYTLPEYEYWKEANNNGRGWKIKYYKGLGTSDHDDMKSYFSDLDRHMKYFHAMQEKDAELIEMAFAKKKADVRKEWLRTYRPGIYMDYTQPQIPIDDFINRELIQFSMADNIRSIPSVVDGLKPGQRKVVYYCFKRNLVHETKVSRLAGYVASETAYHHGEVSMEQTIVNLAQNFVGSNNINLLMPNGQFGTRSEGGKNASASRYLNTALSPLARVLFNSNDDQLLNYQNDEGQWIEPEYYVPILPMVLVNGAEGIGTGWSTFIPNYNPKDITANLRHMLNGEPLEIMTPWYRGFRGSITKVAPDRYKISGIINQIGENKVEITELPIRFWTQDMKEYLEAGLVGTEKIRKFIVDYESHHGEGNVHFNVTLTEAGMKEALNESLEVKFKLSRTQATSNMIAFDASGRIKKYDSVEDILTEFYEVRLRTYQRRKEHMVNELEKRFDRFSNQARFIHMIIEGELVVSKKKKKDLIVELKEKKFQPISKPKKGHLVDLEVENALAEEEQSGDVSQDEDSDAYNYLLSMPLWSLTYERYVELLKKKDEVMAELDALIKKTPKELWLHDLDAFEHAWNKVMDDIQREMLEEEQSSRDFVNRTKKKPRGKSTGTRKPRAIAGSSSSTAVKKEASSESKPSTTNRKQQTLLEFAASKEPEKSSDINIVKTEDNSHGLSVEENRISKSPGLDSSDSGKSRKRSQSVDSEDAGSKKPVKKIAASASGRGRKTNKPVATTIFSSDDEDDLLPSSLKPSTITSTKASAKNKGKKASSVKKQSPEDDDDDFIIPGSSSTPKASSTNAEPPEDSDSPIRKRPTRRAAATVKTPIYVDPSFDSMDEPSMQDDSFIVDNDEDVDDYDESD

SEQ ID NO: 2472 - protein, 543 aa, Schizosaccharomyces pombe
DTNGNRQVGHKAQMSNIQAAKAVADVRFFSILLSFKLRFVIYYVADIIGIRTCLGPRAMLKMLLDPVGSVLLTNDGHAILREIEVAHPAAKSMIELARTQDEEVGDGTTSVIILAGEILAAASPLLDRKIHPVVMIRSFKQALEDALSIIDEITLPVNVDDNAEMFRLIRTCIGTKLVARWSDLMCHLALRAVRTVASTSNGRMEIDIKRYARVEKVPGGEIESSCVLDGVMLNKDVTHPKMRRRIENPRIVLLDCPLEYRKGESQTNIEISKDTDWNRILEIEEEQVKRMCDYIIAVKPDLVITEKGVSDLAQHYLLKANITALRRTRKSDNNRIARACGANIVNRLEDLREKDVGTGCGLFYIDKLGDEYYTFLTGCKNPKACTILLRGPSKDIINEVERNLQDAMAVARNVFFHPKLSPGGGATEMAVSVRLAEKARSIEGVAQWPYRAVADAIEIIPRTLVQNCGANPIKALTELRAKHAEGQHSFGIDGETGRVVDMHEYGVWEPEAVKLQSIKTAIESACLLLRVDDIVSGVRKHSE

SEQ ID NO: 2473 - protein, 184 aa, Schizosaccharomyces pombe
  unsure (1)..(184): unsure at all Xaa locations
MFVTPIEHAVQKRKKQKQRVCLNLQRNXSNGXXSVVDPVTRERQLKRNLADLEKDNFSDIRFEIPKDLRMXSDLXYVCSIXLVTVQRRVLPISVRRILSSRKTFVNYLDETVCKLXADFIYSNHIXPNSRYNTCVAKPSYKPPRKFCNVCGYWGKYACQNCGTSYCSKGCEVIHSETRCMKVYA

SEQ ID NO: 2474 - protein, 904 aa, Schizosaccharomyces pombe
MYTTTLSVQGMTCTSCVASIQSMLEGVEGIEQFTISLLLERAIAVHDPSIISPDQIAEKIEDCGFDASVISSTEGEHGVMANYLLLSPMQAEQWTKVHNHINELQGVLSVNCSSSPDAAIRVIYDSEITGPRSIMKEILSMGVKCTFQPVDSSTSRILSLQRGSQIRVWKIRFIISISFSLAVMFLPQIFDSCDSMRAAFLVPHYFGICAGHIISLVLSLPVQFGVGRVYYSAAYHALKRGTANMDVLVSLGSTVAFAASIFFMILYSARHADNPAPIFFDTADMLLTFVTLGRYLESKAKGSTSAALSQLLSLAPSSATIIEDNEQIEILADLIERGDLILVKPGEIIPVDGTVVEGSSYVDESSVSGEPVPVHKTIDDELLSGTANGNGRLLVKATKSPRESQLAVIVDLVQRAQISHAPIQQFADRVAGIFVPVIVALSISTFTFWFLFTKYSSKYPSVFDDPMGKFAVCLKLTISVVVVACPCALGLSTPTAVMVGTGVGALNGIIIKGGEILERLNQVDTVVFDKTGTLTVGKLSVTDISIVDNLEELLDIPKNIFWAFVKASESSSEHPIGKAITEKASEFTDVSEIGIESFNAVPGEGVDVVLRWKERTFHALLGNSLLLEHNNVSIPDDFDSKLKLSSSSGLTCVRIAIDGQFVGFLGCMDQVRPDSYQTVSALKQLGKKVCLLTGDQKATARRVAQGLEIDFSDVYAEAVPSQKAEIIQKLKDQKHCVAMVGDGINDSPSLVLADVGIAPINGSGIALESADVILVRKGVLLDTAVSFDLSRVIVKRIKMNLVWACIYNFVMIPIAMGFFLPWGIYLNPMWASAAMMFSSLSVLASSLLLRRWKKPKSLIFSEADDVETESSTNSSVLQKVYTATRSIFGRNKSSNKYQPVANEV

SEQ ID NO: 2475 - protein, 186 aa, Schizosaccharomyces pombe
MANNVDTRSANTNSPTTTTSFSWFTNNMLQTRLGLGALRQGRLLFAVKSFSTTSVAKIFPPPPQTIKGTVNDAAVFPHHSKLHGSYHWDFERIIAIAMVPQVMIPLFTGTSHPLMDAALACTLITHAHLGFESCVIDYFPARRFKKLSPLMHWILRGCTVLTLIGVYEFNTNDIGLTEGIKKLWKS

SEQ ID NO: 2476 - protein, 457 aa, Schizosaccharomyces pombe
MLRLQNLPKLVRRFATTALPKTETTTLKNGLTVATEHHPYAQTATVLVGVDAGSRAETAKNNGAAHFLEHLAFKGTKNRSQKALELEFENTGAHLNAYTSREQTVYYAHAFKNAVPNAVAVLADILTNSSISASAVERERQVILREQEEVDKMADEVVFDHLHATAYQGHPLGRTILGPKENIESLTREDLLQYIKDNYRSDRMIISSAGSISHEELVKLAEKYFGHLEPSAEQLSLGAPRGLKPRFVGSEIRARDDDSPTANIAIAVEGMSWKHPDYFTALVMQAIIGNWDRAMGASPHLSSRLSTIVQQHQLANSFMSFSTSYSDTGLWGIYLVTENLGRIDDLVHFTLQNWARLTVATRAEVERAKAQLRASLLLSLDSTTAIAEDIGRQLLTTGRRMSPQEVDLRIGQITEKDVARVASEMIWDKDIAVSAVGSIEGLLDYNRIRSSISMNRW

SEQ ID NO: 2477 - protein, 433 aa, Schizosaccharomyces pombe
MTSAFYGGDEVSAIVIDPGSKWTRIGFSGEDIPKCVLPSYCGEFSDGRRLFGEEYIYKSNPGMEIKNAIRNGWVENWDVTVDLWRYGLEQQLKTNPLEHPILITEPFDNPPENRVKTLETMFESLRCPATYLAKQETCAAFASGKGTACLVDIGAERSSVSAIYDGFVLQKGYQVQHFSGNAINDILAQTLRDKNFEVMPKYLVKSKNPVEIGQPANCELRPRDTTDSYHQFQVQRVYDEWKEECALISDVPFSSETTIAESEFEFPDGSRMMFGAERYQIPEHLFVPGSDEEMNEEPSKPIEQTENNEVSQQDSSVTNTSSRILGIPQLFQNCISECDVDIRASLLNNVIVCGGTSLMQGFSLRLQNELSKLYPGSRLKIHASGHVVERSYASWLGGSILSSLGTFHQLWISRQEYEEHGSDRLALIEKRCK

SEQ ID NO: 2478 - protein, 904 aa, Schizosaccharomyces pombe; identical to SEQ ID NO: 2474

SEQ ID NO: 2479 - protein, 184 aa, Schizosaccharomyces pombe; identical to SEQ ID NO: 2473
  unsure (1)..(184): unsure at all Xaa locations

SEQ ID NO: 2480 - protein, 297 aa, Schizosaccharomyces pombe
MGLPVHNQPHKAHSGSPASTFSAALVSSAISNVIGYPLDSIKVRQQTYNFPTIRSCFQNAVKNEGLKGLYRGLTLPLISATLSRSVSFTVYDSLKLTFAHVDPTLRYFISGLGTGTFISLFACPFEYSKLYSQIDMLLRKTNMGRRQETNSKLSVRPPLSSFQSASDIVRRYGFTALWNGYRYHLTRDALGSACYFTIYETFKKNLIANDVKPHFAYAFSGAFCGALSWILVFPVDTAKSIVQRNTLLSIKTPLSSIPWLSFTIYRGIGISLMRSALINSCNFTLFELFRETKVLSK

SEQ ID NO: 2481 - protein, 494 aa, Schizosaccharomyces pombe
MLSEYQCLKNIGFSHKTVLKRRLFRKECTPALKSFYSTQDPALNEVRTEKLKNGVTYVCDPRPGHFSGLGVYVKAGSRYETKKFSGVSHFMDRLAFQATERTPVGEMKAKLENLGGNYMCSTSRESMIYQAAVFNDDVKSMSKLLAETVLAPKIQEDDLVHYRDSIIYENSELWTKPDALLGEFAHVTAFQNNTLGNCLLCTPDKVNGITATSIREYLKYFYRPEHLTLAYAGIPQEIAKEITKELYGHLPSSSLPPLEAIPSHYTGGFMGIKKSEAPPVPYQQEFTHVVIAMEGLPVTDPDIYALACLQFLLGGGGSFSAGGPGKGMYSRLYLNVLNQYPWVETCMAFNHSYTDSGLFGMFVTILDDAAHLAAPLIIRELCNTVLSVTSEETERAKNQLKSSLLMNLESRMISLEDLGRQIQTQNGLYITPKEMIEKIDALTPSDLSRVARRVLTGNVSNPGNGTGKPTVLIHGNVDEVGDVFALCKKAGIGH

SEQ ID NO: 2482 - protein, 494 aa, Schizosaccharomyces pombe; identical to SEQ ID NO: 2481

SEQ ID NO: 2483 - protein, 417 aa, Schizosaccharomyces pombe
  unsure (1)..(417): unsure at all Xaa locations
MTEVLKTNVLQSNENIVQVCNSYLINCXHKMXYYTQKIQDAELAILQKTQNLRRLEAQRNGLNARVRLLREEIQLLQEPGSYVGEVIKTMGKNKVLVKVHPEGKYVVDISPDIDIKEIKPNIRVALRNDSYQLIKILPNKVDPLVSLMMVEKIPDSTYEMVGGLEKQIKEIKEVIELPVKHPELFESLGIPQPKGILLYGPPGTGKTLLARAVAHHTDCKFIRVSGSELVQKYIGEGSRMVRELFVMAREHAPSIIFMDEIDSIGSSRSDSSGGSGDSEVQRTMLELLNQLDGFEATKNIKVIMATNRIDILDPALLRPGRIDRKIEFPPPSAEARAEILRIHSRSMNLTRGIDLKSIAEKMNGASGAELKGVCTEAGMFALRERRVHVTQEDFELAVAKVLNKGDSGEMSLQKLFK

SEQ ID NO: 2484 - protein, 439 aa, Schizosaccharomyces pombe
MPEYEIQVPSYRAAALTAEERTRLLARPIQNTQKIRTIVQPIIEDVKSRGEASLIDYASKFEKVQLKSAVLKAPFDDDLMKISPMIKEDIDIAFNNIFAFHSSQLRPTIAVQTMRGVVCQRMSRPINRVGLYIPGGTAVLPSTALMLGVPAKVAGCPHVVISTPVRKDGTVAPEIVYIANKIGAEAIILAGGAQAIAAMAYGISGVPKVNKIFGPGNQFVTAAKMHVQNDYGALVAIDLPAGPSEVLVIADETCNPESVALDLLSQAEHGLDSQIILLTVSLSPEMFDRIQKAINDHALRLSRSYIIKHAIKKSVIVQVDNVDQAFEWSNLYGPEHLVLHLKNASSYIPKIDNAGSVFVGPWSPVSMGDYASGTNHTLPTYGYASSYSGVSTDSFLKYITTQELTEEGIQRLGPTVIRLAELKGLTAHADAVRVRGVRL

SEQ ID NO: 2485 - protein, 324 aa, Schizosaccharomyces pombe
  unsure (1)..(324): unsure at all Xaa locations
EVVYASRVAETFVEQLKQHVNLFEFAPKLVGFLSNSDPAARMYAGKCLXKFNVPASNHEQFDWTNKTCTEIGFQYELREVPKDDLEDAIVEANNDPSVNGIMIYFPVFNDGQDQYLQQVVSPDKDVEGLCHKYVMNMYHNIRHLDPEKTKKSILPCTPLAIVKILEYLGVYNKIINYGNRLYGKTITIVNRSEIVGRPLAALLANDGAKVYSVDIHNVQCFTRGAGIRSKKHDVADTNFKLEDVAPISDVIICGVPSANYKFPSNLVRDGAVCICFSSEKNFDAASLKEHAGIYVPSIGKVTIAMLLRNLIRLTSYQLNKPVDI

SEQ ID NO: 2486 - protein, 734 aa, Schizosaccharomyces pombe
DHQEFESEDDKYRRNSYSSWSGSNFESSNGSNRRRYRTQMEEPLSSKRRNRFGNGSRRDVDSSKYSHDSDYSYGAHSSWDARDVEYPEEDPESKADRQRWEEEQAHLDRDWYMNSESQNLLGDEVHNPFSDFETVEDRAHEAEFIEKQKKHLSIEASDRFKENSMWEKNRMITSGVSKAPGLESDYSLMEERRVHLLVDELRPHFLDGAEFSSKKVGDITSVRDPQSDLAINARLGSRLVRERREFRERQKAASAATSLAGTSLGNVMGLKDSNDEDAKAGTTPVKVAGRSEQSNKKDTEFARTKSYREQREFLPAFAVREQLLSVIRDNQVLIVVGETGSGKTTQLAQFLYEDGYHRNGMIGCTQPRRVAAMSVAKRVSEEMGVRLGSTVGYSIRFEDVTGPDTVIKYMTDGVLLRESLMQNNLEKYSVIIMDEAHERSLNTDILMGLLKKVLSRRRDIKLLVTSATMNSQKFSDFFGGAPQFTIPGRTYPVDIMFAKAPCSDYVEAAVRQVLQIHLSQPAGDILVFMTGQEDIEATCEIIADRLNQLHDAPRLSILPIYSQMPADLQAKIFDSAEPGVRKVVVATNIAETSLTVHGISYVVDTGYCKLKMYNSKLGIDTLQVTPISQANANQRAGRAGRTGPGIAYRLYTEMAYIREMFETTLPEIQRTNLSNTVLILKSLGVEEISDFDFMDRPPNDTLMASLYELWTLGALDNFGKLTTLGKKMSLFPMD

SEQ ID NO: 2487 - protein, 446 aa, Schizosaccharomyces pombe [sequence omitted]

SEQ ID NO: 2488 - protein, 1185 aa, Schizosaccharomyces pombe
MTSKYDALLHNQSTNTNPFSKLQDRSSLLGEKFTKVLVANRSEIAIRVFRTAHELSMHTVAIYSYEDRLSMHRQKADESYPIGKVGQYSPVGAYLAIDEIVSIAKRTGANLVHPGYGFLSENAEFARKVNEAGMQFVGPSPEVIDSLGDKTKARAIAIRCGVPVVPGTPGPVEHYEEAEAFVKEYGLPVIIKAAMGGGGRGMRVVRSADTLKESFERARSEALASFGDGTVFIERFLDKPKHIEIQLMADKAGNVIHLHERDCSVQRRHQKVVEIAPAKDLDPKIRQALYDDAIKIAKEVKYCNAGTAEFLLDQKGRHYFIEINPRIQVEHTITEEITGVDIVSAQLHVAAGFTLPEIGLTQDKISTRGFAIQCRVTTEDPNNGFAPDIGKIEVYRSAGGNGVRLDGANGFAGSVITPHYDSMLVKCTCHDATYEYTRRKMIRSLIEFRVRGVKTNIPFVLRLLMHDTFIQGNCWTTFIDDTPELFQLYRSRNRAQKLLAYLGDLAVNGSSIKGQNGEPALKSEIVMPVLLDSTGNQIDVSHPSEKGWRKLLLDNGPAAFAKAVRNHKRGLIMDTTWRDAHQSLLATRVRTIDLVNIAPYTSHALASAYSLEMWGGATFDVSMRFLHECPWDRLRRLRKLVPNIPFQMLLRGANGLCYSSLPDNVIYFFCEQAKKNGIDIFRVFDALNDVNNLSLGIDAAKRAGGVVEATMCYSGDMLNPKKKYNLDYYVNLVDKMVEMGIHILGIKDMAGVMKPKAARLLISAIREKHPELPIHVHTHDSAGTAVASMAAALEAGADVVDVATDSMSGLTSQPSFGAVLASVDGTDKQLEFDNNQLREIDSYWAQMRLLYSPFESEIKGTDSDVYNHEIPGGQLTNLKFQATSLGLGTQWAETKKAYIEANKLLGDIIKVTPTSKVVGDLAQFMVQNKLSAEDVENRATTLDFPASVLDFFQGLMGQPYGGFPEPLRTNVLKGRRQPLTDRPGKFLPAADFDAIRKLLSEKFGVSSDCDIAAYTQFPGVFEEYRQFVDRYGDLTTVPTKFFLSRPEMNEEMHVEIDQGKTLIVKFVALGPLNPRTGQREVYFELNGENRHVTVEDKKAAIETVTRPRADPGNPGHVAAPMSGTIVEIRVKEGAKVKKGDIIAVLSAMKMEIVISAPHSGVLKSLAVVQGDSVNGGDLCAVLEHE

SEQ ID NO: 2489 - protein, 439 aa, Schizosaccharomyces pombe [sequence omitted]

SEQ ID NO: 2490 - protein, 450 aa, Schizosaccharomyces pombe
MRTYWLFLLLGGVVSAESLLSPNKRSKEASMDEWTDQQKGIAMGHMLNNIGDSGMHAKDINPGCIIASPSTDSPDYYYQWVRDSALTIMTILDRFFEGDKGLEPIIVKYMDEMVRLQKVPNPSGDFYAGGLGEPKFNVDGTSYDGDWGRPQNDSPALRAIAFIKYMNYLFENGKEVHEVTVWIEAVLADLDYTANHWTEASFDLWEEIKDVHYFTLAVQKRAMQDGTAFAKRIGAPDQAALYQRTIEPIDLKLGEFWDPGMGVIKGYKGRVDRSGLDCSTLLASLYSNEFDMHILPTLLKLQETMTRDYPVNQGWKQAMGRYPEDVYDGVSKSIGNPWFICTSSAAEIIYKAIAYYDNKGLPELTEYNIHFFMKFAEFGDPYNWSVIRKNMHTYADNFLKAVAEFQHPNGSMSEQFSRDDGHQKGARDLTWSYSSLLNAIYRREAIKGSV

SEQ ID NO: 2491 - protein, 577 aa, Schizosaccharomyces pombe
MCETPIGCHTPRRCNRFIDSAALIDCTNKTNQREHSPSFSIEIPTTPSRKRTLASSHFQTPTKRIKYELGELQEEKTDLYPNFPAQLKENKKPKLPTTPQTPKTPKRTIQIVTPKSLNRTCNPVPFATRLLQSTPHRQLFPPTPSTPSTPSYNSTAKLSLRKSYRSAGVVGRENEKSIVESFFRQHLDANAGGALYVSGAPGTGKTVLLHNVLDHVVSDYPKVNVCYINCMTINEPKAIFEKIHSKIVKEEILENEDHHINFQCELESHFTQSANELYNPVIIVLDEMDHLIAREQQVLYTLFEWPSRPTSRLILVGIANALDMTDRFLPRLRTKHITPKLLSFTPYTAQEISTIIKARLKTAATTSEKNNPFTPIKSISEVSDDSINVVSQHADETPFIHPAAIELCARKVAASSGDLRKALDICRHAIELAEREWKAQHDNTLSSVDIPRASIAHVVRATSAMSQSASARLKNLGLQQKAILCTLVVCEKTSLSVADVFEKYSSLCLRDRLIYPLTSSEFCDVANSLETLAIIRLRTKQRNGKPQDRIISLLVPEMDVITAVGDIGTLKRFFDRR

SEQ ID NO: 2492 - protein, 1428 aa, Schizosaccharomyces pombe
MAKKKSKASNSARGYATTSIPSRSASSPANKNQVKGEKNNKTQKVEPKNAFKVENQSNDIGVDTVDAFDHLLLDKTLPTIDAETEVIKNTSLSNSKSFLHSWQTDIRLRKNDNVLGLTEDEIQQILKTFRDSWKSSLKESYAFSNRSSFSLRKRYLWTTFLSLKGMGFEESEIFGAFSSIPIVSIDEYITWMITENLINSEPSNSSFSYEVQPSNYTTFCRMLDEPLPANNPVQSNSRLVPLMKDFSNDIKHTPNKETQPSNQVDDSLKSKDSKPLTMSEVLTQLPEDDIPFDDPFDLTSQYVKVKLKMLRLQIANKKNSEEFSTLNLQLESITSQYLFSSKEAEIVFRKSRIEFMNKLKALQQKLENERIVEEIKKNGIQEDSQSTDDSSKDDDNNSESNDMSPHNDAETRADDDAYLMGDLFNQEEEDIQDTENDLLNANYTLLPLTTDKSGTRPSTTLQYELHKIGSNIKAEFKTMPIGKIGYQSTCFVRCSTGQKTFSDLKTVLPTATLAADYISMIVLFRLMANFTKISLQTFPKSFKEVYGKFSAEKQNTDLAEDAKISEKLDSIIKSKELETPTSATTSKLMAPMDNIGKFSGFERPPETLLNKWRQQLESESAEKFKVFRNQLPATMFRETIIDAVNNSQLLIISGDTGCGKSTQIPAFLLENSTKNGKAVKIYVTEPRRISAISLANRVSQELGGNPPSARSHELVGYSVRLDSKCTPLTPLTYVTTGTFLRLLEVGNEIESVTHLIIDEVHERSIDSDLLLIHVLHLLKQHPHLKIIIMSATLNAEKFQLYFEGSNLITIPGKTYPVHRFYLEDILSQFGNDKSFGNAAGQDVIEEDDYETDQQDASISNKSAEDAIVEMNLIPAWYNEKAINYGLIVYLLKYIFTEGDPKFSKCVLVFLPGISEILRVKSLIEDMPMFRNHRKFCIYMLHSTLSSAQQQSVFNIPPKGCRKIVLSTNIAETGVTIPDVTCVIDTGVHREMRYNSRRHLSRLTDTFVSKANAKQRSGRAGRVQEGICYHLFSKFKHDTQFLSYQTPEILRLNLQEVVLRVKMCQMGDVQDVLGKALDPPSSTNIIRALEKLHQVGALSENEKLTKLGKFLSQLPVDANLGKILVLGCFYKCVDAASSIVAMLTIGSPFRKSVDNEFSANKARLSFAKENTRSDLVLMYYAYCAWREICLSPLGPDEDSFAKEKYLNLEALSMTESLKIQLLSELKDMKLLGASDVDTCKSLKRSICRRFAVIPKEHDINSGNAEILCGVIAASLYPNILRYDYEKRQWSTLSTNKRVRILDVSVNNRSELPNMPSKFVAYTNMMSSTRASEYVNETTMVTLRQLLMMCGLKVENRVSVGQAKLDNFTVYFENVYVSASLSILRRFIETSLNEFFAEPDKRLLNSHLEVIVNIVSRLNYGTKFQKRLKD

SEQ ID NO: 2493 - protein, 215 aa, Schizosaccharomyces pombe
MSDINNNEPAENIEQPKQEPEDGNNSMSVDEQPETSSTNLPTGDNLAPMSVESPAHLNNEDSPKSDDSRERHGSNYVIEPHLELRDMAKDKTLENFLAQMDDYSPLIPDVLLDYYLSLSGFKCVDPRLKKLLGLTAQKFISDVAQDAYQYSKIRTGSSNASSTTFGAQNFGAGGASGIGSSGRRGDRGKTVLTVDDLSAALNEYGINLKRPDFFR

SEQ ID NO: 2494 - protein, 463 aa, Schizosaccharomyces pombe
MQLCIISLWFLAAFIVNADNVQFEDYESNFFFKEHLGTLSPYHEPYFDGLDSAFPETCEIQQVHLLQRHGSRNPTGDVTATDVYSSQYLNNFQEKLLNGSIPVNFSYPENPLCFIKQWTPVIDAENADQLSSRGRLELFDLGRQLYQRYYKLFDSYVYDINTAEQERVVESAKWFTYGLFGDKMYEKTNFILISEGKAAGANSLSMYNACPVFKDNNFHKNATDAAHAVWRNIFIEPIVNRLAKYFDSSYKLTINDVRSLFYICEYEIAIKDHSDFCSIFTPSEFLNFEYDSDLDQAYGGGPVSEWASTLGGAYINNLADSLRNVTNPDFDRKVFLAFTHDSNIIPVEAALGFFPDITPQNPLPTDKNIYTYSQKTSSFVPFAGNLITELFFCSDSKYYVRHLVNQQVYPLIDCGYGPSGTSDGLCELQAYLNSPIRANSTSNGISIFNTECQARPTNVTIYF

SEQ ID NO: 2495 - protein, 709 aa, Schizosaccharomyces pombe
MADEPLLLNFVVDNAQSRKPEALKSSRRWTDRARDRKRQKRNSNESSKSTVKRNSGTNGASTDYKNSQKEKVINPVFDPRKPAHELKGNKRDNTFVTSLFTGDDSEHFSQDVGQNLEDNQISNIGTTKEASNAPIKTTNFAGVQLDTQLADHLNNKMNISAPTAIQSCCLPALLNTDDKDAFIEAQTGSGKTLAYLLPIVQRLIRLPKNLHTRTSGIYAVIMAPTRELCQQIYNVANKLNNNPLSHWIVSCNVIGGEKKKSEKARIRKGVNILIGTPGRLADHLENTEALDVSQVRWVVLDEGDRLMDMGFEETLTKILSYLESQSSIIKKDLSIPSRKVTMLCSATMKDTVKRLSDSALKDALYLKSSIVEETNDGYSQAPEQLLQRYVVVPPKLRLVSLVALLRSHVRSYKKIIIFLSCSDSVDFHFEAFRCAINADEMEEAVKEKPDSEGDIISNAPALRIDGKSNVYRLHGSLSQQIRTSTLNLFSSSEDSGSHILLCTDVAARGLDLPNVDLVVQYDAPFSTDDYLHRIGRTARAGHNGAAIMFLLPKESEYINLLKSSVSANILEQPNGPSGLLSAGFSQGKTNTNDWQDRATEWQLELERFILENEPMRNIAKRAFTSYVRAYATHLSSERSIFNMRDLHLGHIAKSFALREAPGKISGANSSKPRKQGGSVDKGKSKSSKDIAALMHRKAMEHYSTEHNIG

SEQ ID NO: 2496 - protein, 216 aa, Schizosaccharomyces pombe
MRRAFVERNTNETKISVAIALDKAPLPEESNFIDELITSKHANQKGEQVIQVDTGIGFLDHMYHALAKHAGWSLRLYSRGDLIIDDHHTAEDTAIALGIAFKQAMGNFAGVKRFGHAYCPLDEALSRSVVDLSGRPYAVIDLGLKREKVGELSCEMIPHLLYSFSVAAGITLHVTCLYGSNDHHRAESAFKSLAVAMRAATSLTGSSEVPSTKGVL

SEQ ID NO: 2497 - protein, 942 aa, Schizosaccharomyces pombe
MSGETVHGISCYSVVANTEDTYNQTLDFYQKLGFKKVASFGTSDSDNARVCNESLREDWMHVAGNNSAESVTIKFRLVPGELSLSPAAEDSEWRGQKSSLVFYYPNLLDLLKQLSADAIKYQAFPNEKKPDEVYVEDPLGNLIGFSDRYNPFAHANLKKSEESGAASNLESGLATPVVETLKKATTSDKPAGVKKKIAVMTSGGDSPGMNAVVRAVARIAIHRGCDAFAIYEGYEGLVQGGDMIKQLQWGDVRGWLAEGGTLIGTARCMAFRERPGRLRAAKNLISAGIDSIIVCGGDGSLTGADIFRSDWPGLVKELEDTKAITPEQAKLYRHLTIVGLVGSIDNDMSSTDVTIGAFSSLHRICEAVDSISSTAISHSRAFIVEVMGRHCGWLAVLAALATGADFVFIPERPAEVGKWQDELCNSLSSVRKLGKRKSIVIVAEGAIDSELNHISPEDIKNLLVERLHLDTRVTTLGHVQRGGIPCAYDRMLATLQGVDAVDAVLASTPDTPSPMIAINGNKINRKPLMEAVKLTHEVADAIEKKQFAHAMELRDPEFADYLHTWEGTTFIEDESHFVPKDERMRVAIIHVGAPAGGMNSATRAAVRYCLNRGHTPLAIDNGFSGFLRHDSIHELSWIDVDEWCIRGGSEIGTNRDTPDLDMGFTAFKFQQHKIDALIIIGGFEAFTALSQLESARVNYPSFRIPMAIIPATISNNVPGTEFSLGCDTCLNAVMEYCDTIKQSASASRRRVFVCEVQGGRSGYIATVGGLITGASAIYTPEDGISLDMLRKDIDHLKATFALEAGRNRAGQLILRNECASKVYTTEVIGNIISEEAHKRFSARTAVPGHVQQGGNPTPMDRARAARLAMRAIRFFETCRANDLGNDPSSAVVIGIRGTGVSFSSVADVENNETEIEMRRPKNAWWRDMHNLVNILAGKTFAD

SEQ ID NO: 2498 - protein, 419 aa, Schizosaccharomyces pombe
  unsure (1)..(419): unsure at all Xaa locations
MSIDPANDSKLAPEANDATLGDVDRWIEQLKKCEPLSEADVEMLCDKVSEHXGEYICVSGLVGYIPTLQVLIFSXFLEIVQFDMFEFELSSLFRFDFXKDXYYINVGFLEISSYKYMVVKNYVGDSHLYQHFSCFRSFCXPFFLAREVLCQENNVQPVRNPVTVCGDIHGQFHDLMELFKIGGDVPDMNYLFMGDYVDRGYHSVETVSLLVAMKLRYPNRITILRGNHESRQITQVYGFYDECLRKYGSANVWKHFTNLFDYFPLTALIEDRIFCLHGGLSPSIDSLDHVRTLDRVQEVPHEGPMCDLLWSDPDDRCGWGISPRGAGYTFGQDISETFNHANGLSLTARAHQLVMEGFNWAHDGDVVTIFSAPNYCYRCGNQAAILEVDDTMNQVFLQFDPAPREGEPVIARRTPDYFL

SEQ ID NO: 2499 - protein, 420 aa, Schizosaccharomyces pombe
  unsure (1)..(420): unsure at all Xaa locations
MRISRLLIRVLLGFVILFITYILFPSIPKALVNTLNVYKLEERLNYYNDRLLDGNLKSKELENATFVTLARNADLYDLIETINIYENRFNSKHNYPWVFLNDEPFTRTFEVVMSRLTSGPTYFGVVNSSEWDIPKWIDMDIAHSNWNRLSREGVLYGGMKSYRQMCRYFSGFFWRHPLLDPYKYYWRVEPSTKLLCEVNKDPFRQLRLLNKTYGFVITLFEIGQTVPSLWNSTLEFIEKYPETLAKNNLWEWISDDNGKKFSHCHFVSEASNNISIYXLLQWSNFEIADLDFFRSDSYRKYFDFLDKKGGFFYEVXPNVNGRICNIAKTIFRDWGDAPVHSIALSLFLDRNKLHYFDEIGYSHAPLLHCPRKGRCFCKPEEIDCKVXLIYCTFADNLLVSSNSSCIARFINLTNEDYDEL

SEQ ID NO: 2500 - protein, 735 aa, Schizosaccharomyces pombe
MEPAQKKLRQESKNPYLAHLNNGDDSEEVVSSKGLTRRATTVAQAAKAEEGPNNFFNDKPFSQNYFKILETRRELPVYQQREEFLKIYHENQIIVFVGETGSGKTTQIPQFVLYDELPHLTNTQIACTQPRRVAAMSVAKRVADEMDVDLGEEVGYNIRFEDCSGPNTLLKYMTDGMLLREAMTDHMLSRYSCIILDEAHERTLATDILMGLMKRLATRRPDLKIIVMSATLDAKKFQKYFFDAPLLAVPGRTYPVEIYYTQEPERDYLEAALRTVLQIHVEEGPGDILVFLTGEEEIEDACRKITLEADDLVREGAAGPLKVYPLYGSLPPNQQQRIFEPTPEDTKSGYGRKVVISTNIAETSLTIDGIVYVVDPGFSKQKIYNPRIRVESLLVSPISKASAQQRAGRAGRTRPGKCFRLYTEEAFRKELIEQTYPEILRSNLSSTVLELKKLGIDDLVHFDYMDPPAPETMMRALEELNYLNCLDDNGDLTPLGRKASEFPLDPNLAVMLIRSPEFYCSNEVLSLTALLSVPNVFVRPNSARKLADEMRQQFTHPDGDHLTLLNVYHAYKSGEGTADWCWNHFLSHRALISADNVRKQLRRTMERQEVELISTPFDDKNYYVNIRRALVSGFFMQVAKKSANGKNYVTMKDNQVVSLHPSCGLSVTPEWVVYNEFVLTTKSFIRNVTAIRPEWLIELAPNYYDLDDFDNNKEVKSALQKVYQMAARSKKNARR

SEQ ID NO: 2501 - protein, 676 aa, Schizosaccharomyces pombe
  unsure (1)..(676): unsure at all Xaa locations
MLLRDGRIPQYSIYPLPVPPMNSKTPTLGIVCSEGTISLSLEEGFEFVGVPLSGEGLKLRVEALAPSERLQEFLDDEVAYHPEGMFQIXKKIYINQFYYENVHKVVGLSSAWLELDSEDTLIADRSEEVLLKEASYASYCGLSSIILNGPTSPMNVMRYARAVSSALNSTMNLKFLVQLAIESGHEDYFETWKMWDTIRSACGYHPRLKVALELPPACSPPIELVNRWYAEPIEMITMSCMAFVPNPNGYPVLGRKLRAIYALYLRLNPRILLWDNDAPEKIGDSPDYSIYMKHLFDSQPPAPLVEDLADSYKDYLQVPLQPLSYNLENITYEIFERDPVKYAQYEQAIFSALMDRDESSVTRIAVVGAGRGPLVDCALRAAISSSRTVDMIALEKNPNAFSMLLMRNRQDWAGKVTLVFGDMRTWNPDYKIDILVSELLGSMGDNELSPECLDGVQHVLDEETGICIPSSYISYVTPIMSPKLWSEARNMNDPNAFERQYVVLMNSFDFLAADDEFRFQSLWSFHHPNKDSEVYTKNLHNKRFASVRFQASSPGILHGFAGYFEATLYKDISLSIMPATMEAKSPDMFSWFPIYMPIKVSYYILRCTVYXYFLEPMYVPENSQLEFHMWRLTDGMRVWFEWCANAYLVLRNGSQIKLSSTEVHNISGKAFSCNMY

SEQ ID NO: 2502 - protein, 666 aa, Schizosaccharomyces pombe
  unsure (1)..(666): unsure at all Xaa locations
MFQAPRESTLCKHPILRWMVNYXHVVVLSGEKISGEDVRNQNGMLIFFSXLLTFXVLATTAIANVVKSSLGPVGLDKMLVDDIGVCXRPREEKKILDNNGGYWPLTNIYXFDTLVLXSSRIXGNLNWQGRVNLILXIELISIPAIIVHLLLYFFLLSFISIXLVLGVTVTNDGATILSLLDVEHPAGKVLVELAQQQDKEVGDGTTSVVIIAAELLRRANELVKNKIHPTTIITGYRLAIREAVKFMTDVLSCSVDSLGKESLINVAKTSMSSKIIGNDSDFFSTMAVDAMLSVKTSNSKGETRYPVKAVNILKAHGKSSRESVLVKGYALNCTIASQAMKTRVQNAKIAVLDMDLQKTKMALGVHVTIDDPDQLEKIREREVMITLERVKKILNAGANVILTTKGIDDLCLKSIIEAGAMAVRRCKKEDLRRIAKASGATLLSSLSNLEGEETFESSYLGSAEEVVQEKFSDDECILVKGTKAYSSASIVLRGPNEYSLDEMERSMHDSLSVVKRTLESGKVVPGGGAVETALSIYLENFATSLGSREQLAIAEFAQALLIIPRTLAVNAAKDSTELTAKLRAYHAASQNAEVTDVKKRGYKNYGLDLLNGVIRDNVKAGVLEPSMSKLKSLKSAVEACIAILRIDTSIKLDPERQPEDPHAGLH

SEQ ID NO: 2503 - protein, 1016 aa, Schizosaccharomyces pombe
MDMIDEAITEVVRKIERERSVIHGALSMKRLTQNQTVHQQLHSNIEESKKSIIYLEERLEKLKLRKNGVRKSNSEKPSVGIEKNPSFSTTKSAKSFSSTSSNIDSNLDLLNYDTPLTISKISFLLQQLEFKLSVEEQYRKGIEKMAKLYEREHDRRSIAEAEKKYVESAQKITLLKQALKRYHDLHIEIDEEDVPSTESRGNLNARRPQSGLLKITVGSLRNVTHSAGISKQTEMIVAIRAEDLERARTRPSRTDRFNETFEIDLEKTNEVEIVVYEKKNEKLLLPVGLLWIRLSDLVEKQRRKKVEQEVSDKGWVSADKMINQRLSIFLPSALNNISKPESTDRPNTASGNQSVSAWFSLEPMGQINLTMNFTKHNTRKRPMDAGLGRQGAIRQRKESVHEVYGHKFLQHQFYQIMRCALCGEFLKNAAGMQCIDCHYTCHKKCYPKVVTKCISKSSDSASSEYEKINHRIPHHFESHTNIGANWCCHCGYILPLGRKTARKCTECGITAHAQCVHLVPDFCGMSMEMANRVISEIRTTKIYKAQQHKQKSSHHKHHHHKKSKSSSSKHKENDKASVSITTTTTPSITPADPVPTSPKPLAIEPVKRKPVHAGNLEVTSVSDNKLGATVQVVEQKVDDKADALTKPPSLDAVKEPIPVPSVETSVVAQDLTHKAKRIGLEDFTFLSVLGKGNFGKVMLAELKSEKQLYAIKVLKKEFILENDEVESTKSEKRVFLVANRERHPFLVNLHSCFQTETRIYFVMDFVSGGDLMLHIQQEQFSRRRAQFYAAEVCLALKYFHDNGIIYRDLKLDNILLSPDGHVKVADYGLCKEDMWHDNTTATFCGTPEFMAPEILLEQQYTRSVDWWAFGVLIYQMLLGQSPFRGEDEEEIFDAILSDEPLYPIHMPRDSVSILQQLLTRDPKKRLGSGPNDAEDVMTHPFFSNINWDDIYHKRTQPPYIPSLNSPTDTKYFDEEFTRELPVLTPVNSILTKEMQQHFEGFSYSCEDDKPSTTDNA

SEQ ID NO: 2504 - protein, 438 aa, Schizosaccharomyces pombe
  unsure (1)..(438): unsure at all Xaa locations
MPTELSDITIQSVLPCDYSLFKNNLRVSRLPESRFVFSPKEEINCQSLLQGPELVCLMXKDFLXPLKTALDNLNFIHKQKFEHQFRHGYWKLHPHPHHQHDSIIPASWIHDTPHMKLVFHRLQNLPDGDLLLENDPKNNVGYFISGGIAGIVSRTCTAPLDRLKVMLISDTGSKPSPKYPFATLLHTTKVLWNRNGIRSFFVGNGINVLKVMPESSIKFGTYEAMKRVLGISSSSENHSPLYSYLAGGMAGSVAQMFIYPVDTLKFRIQCSDLSRGQHGKSIILSNAKELYKSVGIRGYYRGVLVGILGMFPYSATDLGTFEGLKRTWIGILASRDNVDPQDVKLPNGLVMAFGALSGSTGATIVFPLNVIRTRLQTQGTSAHPATYDGFIDCFYKTTKNEGFRGLYKGLSPNLLKVAPSVAISYLVYENCKKWLGLE

SEQ ID NO: 2505 - protein, 264 aa, Schizosaccharomyces pombe
  unsure (1)..(264): unsure at all Xaa locations
TQLFLSTDLESLEPTCLSKDTIYQWKGIFSLIFFGLFXLVISFTLRFADTILVVQTFGDRLRLRQRVLATAIVLLRRYMLKKNEEKGFSLEALVATCIYLSCKVEECPVHIRTICNEANDLWSLKVKLSRSNISEIEFEIISVLDAFLIVHHPYTSLEQAFHDGIINQKQLEFAWYVYFLYXKSQSIRFFXRSRKXSIVNDSYASSLCLMAHPHQLAYAALLISCCNDENTIPKLLDLIKSTDAFKVILCVQRIISIYYFEDIE

SEQ ID NO: 2506 - protein, 594 aa, Schizosaccharomyces pombe
KNAVAAQGFKKMTPVQANAIPLFLKNKDLVVEAVTGSGKTLAYLLPCFDKVTRRDTDETGLGALIVAPTRELATQIFNVTKELLAYQPDSLDGGKKLVADMYIGGKGTLTNDLASFREKNPSVVIGTPGRLNEMLSHISSKHLEILILDEADTLIDMGFQRTLQSIISQLPKQRRTGLFSATMNDTVSSFLKIAGLRNSVRVSVTVTSKKIDTRTPSSLAIQSLVIPPIYKVQCMIHLLCTIEYEKAIVFFSSCASVEYFNSLFLTYKLPFEIVALHGQQVQSNRSRNFEKFKKSNKKTVLFTTDIASRGLDIPNVDFVLQLDPPLDPKSFSHRCGRAGRAGRAGVAIVLLNDGREEEYEELLRVRKVPITRIDTPIEALDLSRLKVLTHELRKIVSKDRDLYDKGLRAFVSHVRAYTKHHASFIFRIKDLDLGQLATAYALLHLPKMPELKDTEISENIFKKFDIDYATIPYRDQVREQARRRRLEVEKTEPKKLARPAKIKNEAWSKQKEVKEKRNTRREKRKSKKEFLKAQKNEASNNLKQEIVSKAGAQETENDDLIDEESDALSELEEDYRQLKKSKKRKNQASFGFSM

SEQ ID NO: 2507 - protein, 548 aa, Schizosaccharomyces pombe
MSQFAEFKLPAIKNEPPKHYGPNSADREGIVKAYKELEAELPVTIPVIIDGKEVETNTIGEQRCPFEHKKVVARYHRAGAKHVEDAIEAALRGKKVWESLPFADRSAIFLKAAHLISTKYRYKLMAATMIGQGKNIWQAEIDAGMEIIDFLRFNTKYASELYASQPPENTPGVWNRMEYRPLEGFVYAITPFNFTAIAGNLAAAPLLMGNVVLMKPSDHAVLSSYIVYQIFREAGLPAGALQFIPGDAVEVSKVCFNHPEFAGLHFTGSTAVFRSLWGTIGENVANGKYRTYPKIVGETGGKNFHLVHSSAEIKSAVVNAVRAAFEYQGQKCSALSRLYVSKYAWENGFRDELTKQVKSLKVGAPLTDFANFVGPVIHQASFNKLKKVLESAASDSEIEVLAGGKADDSEGFFVEPTVLLSKNPKHDIFVNELFGPVLSVYVYEDDNLDAVCDLIDTTTPYGLTGSIFAQDRVVVRKLTDRLRNAAGNFYINDKCTGAVVGEQPFGGARASGTNDKAGSGMILSRFVSPRSIKDTFAYADSVLYPSNF

SEQ ID NO: 2508 - protein, 407 aa, Schizosaccharomyces pombe
MGCMSSKYADTSGGEVIQKKLSDTQTSNSSTTGSQNARVPVLENWLNIVLRGKPQNVESSGVRVKGNSTSGGNDIKVLLLGAGDSGKTTIMKQMRLLYSPGFSQVVRKQYRVMIFENIISSLCLLLEAMDNSNVSLLPENEKYRAVILRKHTSQPNEPFSPEIYEAVHALTLDTKLRTVQSCGTNLSLLDNFYYYQDHIDRIFDPQYIPSDQDILHCRIKTTGISEETFLLNRHHYRFFDVGGQRSERRKWIHCFENVTALLFLVSLAGYDQCLVEDNSGNQMQEALLLWDSICNSSWFSESAMILFLNKLDLFKRKVHISPIQKHFPDYQEVGSTPTFVQTQCPLADNAVRSGMYYFYLKFESLNRIASRSCYCHFTTATDTSLLQRVMVSVQDTIMSNNLQSLMF

SEQ ID NO: 2509 - protein, 613 aa, Schizosaccharomyces pombe
  unsure (1)..(613): unsure at all Xaa locations
VTSLNXYFKTERTDEARMFNFYEKMPKDTNTVRVFDRGVSIDEXKNLLKLRKKXLEILLFFNPIXHCFLEFYVAIGEDASFVAQNAYHTTSVLKHHNVSNTSYCNLSPSLFIKFAEDVLSNLAKRVEIWGANSAKTGFELLKQASPGNMQMLEDLLVSENYQESTAISDSSVSSVLLAVTTRVKQDQRIIGVAFIDPILKKLGVSEFVDSDAYTNFEALIVQVGAKECIISQSGHESTNGNSAVSINTAEINRLRNIIEGCGALVTTIRSSEFSARDVELELSKVLDSPVTHALVPELGLQLAMASCNALLRYLGPALLNPDMEDDRENTSRKLHLYHHNLEQYMRLDIAAVRSLNLLPPPNGNAHKTMSLYGLLNHCRTAMGARNLRRWIVQPLLDAKSIERRHDLVSALVEDAEARQLLLDDDHLLRSIPDIPKLCRRLTRGSASLEDVVRIYQMAKALPKIVTVLDSLTSEHKDLVDKVYTNVLNNHCKNLEKLIELVETTIDLEALDSHQYIIRAEFDEELLDLRQRLDELQHSIFEEHKRVGSDLHQDTEKKLHLEQHHLYGWCLRLTRTEAGCLRGRSSHYTELSTQKNGVYFTTKRLHSLNNSYMD

SEQ ID NO: 2510 - protein, 1729 aa, Schizosaccharomyces pombe
MDQYWREQEGRGLFEDDANSYVSDDDTMSSLTRMIYDKNSSRDALHSDYDSSSFNVDSSSVAYPAWNQAGEEAPVTMEGVQEILLDLTNKLGFQKDNMRNIFDYVMVLLDSRASRMSPSSALLTIHADVIGGEHANFSKWYFASHFNDGHAIGFHDMSSPIVETMTLKEAEQAWRDQMAAFSPHRMMVQVCLYFLCWGEANNVRFVPECLCFIFECAYDYYISSEAKDVDAALPKEFYLDSVITPIYRFIHAQLFEILDGKYVRRERDHSQIIGYDDINQLFWSYKGLQEIMCADKTPLLDLPPFMRYRHLSDVEWKSCFYKSYYEYRSWFHNVTNFSRIWVMHISAYWYYSAYNSPNLYTKNYHIRLNNKPPASCRWTACGLAGAIASFITLAAVVFEYIHVPRRYHSARRLWPSMLLLISTLLLNIAPVVFIFASSTKEQHYASRLVVGIVHFFFSLVCVVYYSITPLRNLVGFTTKRSGKNLANRFFTANFTPTSKTGAFVSWCLWITVLVAKFLESYFFLTLNLADSIRFLGAMRPYDCRDYILGAGLCKAQPKILLSLLYLTDLSLFFLDTYLWYILISTIYSLAYAFCLGISVWTPWRELFYRVPRRIYTKLLYTDDMEIVFKPKVLISQVWNAIIISMYREHLISRTQIQELLYHQVPSEKAGYHTLRAPNFFYSQQVKHYKQDLFPANSEAARRISFFAQSLAESIPKTSSIDAMPTFTVLVPHYSEKILLSLREIIREEDQLSRVTLLEYLKQLYPVEWRNFVDDTKLLADENDSVIGSIDNEKNGVNKAYDLPFYCVGFKSATPEYTLRTRIWASLRTQTLYRTINGFSNYSRAIKLLYRTETPELVEWTNGDPVRLDEELDLMANRKFRFCVSMQRYAKFTKEEAENAEFLLRAYPDLQIAYMDEDPQSRHNDERHLYSVLIDGHCPIMENGKRRPKYRIRLSGNPILGDGKSDNQNMSIPYIRGEYVQMIDANQDNYLEECLKIRSILAEFEQLTPPLHSPYSVNAKAADNHPVAILGAREYIFSENTGMLGDVAAGKEQTFGTLFARILSLIGGKLHYGHPDFINVLFMITRGGVSKAQKGLHVNEDIYAGMIALQRGGRIKHCDYYQCGKGRDLGFGSILNFTTKIGTGMAEQMLSREYFNLGTQLPFDRFLSFFYAHAGFHVNNMVIMFSLQLLMLVIINLGAMYTVVPVCRYRQFDSLTASLYPEGCYQLKPVLEWLKRCILSIFIVFGIAFVPLAVCELGERGAIRMVIRLAKQIFSLSPIFEIFTCQIYAQSLIANLTFGGARYIGTSRGFATVRVPFSLLYSRFSGPSLYFGSRLMYMLLFGSITAWLPHYIYFWITLTALCISPFLYNPHQFAWTDFFVDYREFMRWLFRENSRNQANSWIGNCQLCRTRVTGYKRKIYGKKADKIAMDSPRARITTMFYGEILGPLGTLFFTCIPFLFINSQPGNDDETQSTNAFIRLIIMSVAPLVLSAIIAFFFFCLGIMLRPILGDRSKTYGVYLAGVAHFLFVCVDVVVFEVLGYLEGWSFSKTLLGFVAIISIHRFAHKFFIICFLSREFRHDGANLAWWSGRWNGQGFGYMVLTQPWREFVCKTTELNMFAGDFLLSHLLLFLQAPVILIPYIDKLHSIILFWLVPSRQIRPPIYTIRQNKLRRQIVLRYATLYFSLFIAFFVLLILPFVFGKSAAGTSMDKFNLIQPATKIVYSSTKNSSV

SEQ ID NO: 2511 - protein, 671 aa, Schizosaccharomyces pombe
GLKRLEYRGYDSSGCAVDGDEGEDFIMFKEVGNVSKLEASIKGSNVNKSTKFINHCAISHTRWATHGIPSPINCHPQRSDPHSEFIVVHNGILTNYRELRTVLESRGMVFESETDTECVAKLAKFIYDTTPGVDFTSLAKLVFRELEGAYALLIKSSHYPGEVVATRRGSPLIVGVKSEQKLKVDFVDVEFPEPAEGLPGTPKPTSLHPVFSNPATNGMLRGDKPDLLHRAQSRAFVSGEGVPGPIEYFFASDATPIIEYTKRVMFLEDDDIAHVRDGELHVHRLRREGGGSTTRTIETLEMEIASVMKGNYDHYMIKEICEQPDSLLNTMRGRVNFVNRLVTLGGLESYYDIIRKSRRLIFVACGTSYHSCVAVRPLFEELTNIPVVVELASDFVDRCPSVFRDDTFIFVSQSGETADSLLALQYTLENGALAIGVVNCVGSSISRKTHCGVHINAGPEICVASTKAYTSQYVALVLMALYLSRDSVSRLERRNEIIDGLAEIGEKVQETLHLNAAIKQTAIEQLINKDKMLIIGRGYHYATALEGALKVKEISYTHAEGVLAGELKHGVLALVDNDMPIVMLLPDDYNFPKAWNAFEQVRARGGKPIIITDKKLDNLEGFTIIKVPKTVDCLQGILNVIPFQLLSYWLAVKRGHNVDQPRNLAKSVTVE

SEQ ID NO: 2512 - protein, 489 aa, Schizosaccharomyces pombe
  unsure (1)..(489): unsure at all Xaa locations
MSWKGFTKALARTPQTLRSKFNVGEITKDPIYEDAGRRFKSLETEAKKLAEDAKKYTDAINGLLNHQIGFADACIEIYKPISGRASDPESYEQEGNAEGIEAAEAYKEIVYDLQKNLASEMDVINTRIVNPTGELLKIVKDVDKLLLKRDHKQLDYDRHRSSFKKLQEKKDKSLKDEKKLYEAETAFEQSSQEYEYYNEMLKEELPKLFALAQSFIAPLFQGFYYMQLNVYYVLYEKMSHCEIQYFDFNTDILESYERRRGDVKDRAEALTITKFKTAKPTYKRPGMGPGGKDATASSSSSFSSKREEAAAEPSSSTATDIPPPYSTPSVAGASDYSTPSAGYQTVQTTTTTTEAAAAQYPQAAFPPPPVMPQPAAAAVTTPVAAPVAAAAAAVPVPPPAPAPAAAPAAEHVVALYDYAAQAAGDLSFHAGDRIEVVSRTDNQNVSTXTXIFIFFLLNKDFTNIYFREWWIGRLNGAQGQFPGNYVQLE

SEQ ID NO: 2513 - protein, 503 aa, Schizosaccharomyces pombe
MSTTLGQESKTDWASLDSDEEVQRISDKVNQLNTSENKNEDQKATNLSDRLGPKITENVDAKSEQDKATNTIAEDANTKQSENDESNLIPNKNEVRVKLADLQADPNSPLFSVKSFEELELKPELLKGIYSMKFQKPSKIQEKALPLLLSNPPRNMIGQSQSGTGKTAAFALTMLSRVDASVPKPQAICLAPSRELARQIMDVVTEMGKYTEVKTAFGIKDSVPKGAKIDAQIVIGTPGTVMDLMKRRQLDARDIKVFVLDEADNMLDQQGLGDQSMRIKHLLPRNTQIVLFSATFSERVEKYAERFAPNANEIRLKTEELSVEGIKQLYMDCQSEEHKYNVLVELYGLLTIGQSIIFCKKKDTAEEIARRMTADGHTVACLTGNLEGAQRDAIMDSFRVGTSKVLVTTNVIARGIDVSQVNLVVNYDMPLDQAGRPDPQTYLHRIGRTGRFGRVGVSINFVHDKKSWEEMNAIQEYFQRPITRVPTDDYEELEKVVKNALKM

SEQ ID NO: 2514 - protein, 825 aa, Schizosaccharomyces pombe
  unsure (1)..(825): unsure at all Xaa locations
MEQLIPLVNQLQDLVYNTIGSDFLDLPSIVVVGSQSCGKSSVLENIGKYCLLKLIXIKNQQLKNYQRCFFLWINFSXFXQYIVINSFVFXVGKDFLPRGTGIVTRRPLILQLINLKRKTKNNHDEESTSDNNSEETSAAGETGSLEGIEEDSDEIEDYAEFLHIPDTKFTDMNKVRAEIENETLRVAGANKGINKLPINLKIYSTRVLNLTLIDLPGLTKIPVGDQPTDIEAQTRSLIMEYISRPNSIILAVSPANFDIVNSEGLKLARSVDPKGKRTIGVLTKLDLMDQGTNAMDILSGRVYPLKLGFVATVNRSQSDIVSHKSMRDALQSERSFFEHHPAYRTIKDRCGTPYLAKTLSNLLVSHIRERLPDIKARLSTLISQTQQQLNNYGDFKLSDQSQRGIILLQAMNRFANTFIASIDGNSSNIPTKELSGGARLYSIFNNVFTTALNSIDPLQNLSTVDIRTAILNSTGSRATLFLSEMAFDILVKPQLNLLAAPCHQCVELVYEELMKICHYSGDSDISHFPKLQTALVETVSDLLRENLTPTYSFVESLIAIQSAYINTNHPDFLGVQGAMAVVLSRKEQNRLMLSQENDEPISSALDTVKPDGIELYSSDPDTSVKSITNKATNEITTLKSDDSAKMQPLDVLASKRYNNAFSTETAERKTFLSYVFGANNATRKAMSIDKSSSYPLNDSLSGGDTNHKNNHPLKMTDLSNEVETMALEDMSEREEVEVDLIKELITSYFNLTRKIIIDQVPKVIMHLLVNASKDAIQNRLVSKLYREDFFDTLLIEDENVKSEREKCERLLSVYNQANKIISTVF

SEQ ID NO: 2515 - protein, 671 aa, Schizosaccharomyces pombe; identical to SEQ ID NO: 2511

SEQ ID NO: 2516 - protein, 739 aa, Schizosaccharomyces pombe
MKIYAVREPVFSGPTPSFQNVSNDIPLVIDNGIIIRTIFLKWLLMNILYRSWQLRAGWGGEKDPKLVFDNLVSRYRDRKLSRTSTLVGNDTLIEVGSRSIARSPFERNVISNWDLMEQVLDYTFLKLGIDRMEHPICMTEPLANPTYVRSTMTELLFELYNAPSVAYGIDGLFSFYHNTKPSSSGIVLNLGNAASHVIPVLNGERILSEAKRISWGGSQSSSYLLKLFQIKYPSFPIKMLPSQAELLMHDHCHVSSDYTHDIAHALDRDILERDEIVLQFPYTEAAAQEKSQEELELIAERKRESGRRLQAQAAIKRKEKAAERDRELATLTELQQQSLVLSRRAFQRALEEAGFEDESQLNAQVKNVQAKIRRAQRDQQRQEESEGSLDVTEIDVEQAFPLLNVPDAELDEAGLRQKRHQRLMKANYDARVRAKAEKAIEEAAEAERAEADERLRLENFSTWVNEKRETHKILLEKISKNKRLKFELNDRKSHASQMRMKSLATLASEQPIQKRKRKDQSEDNFGARDEDWKVYHDVLTAEQLEEERKKLLDQIYSLEKQLLEYDSQFTQANTYDTLNDPRATLLYAFTRGVSDFDVNDVAQAFQLHLNVEQIRVPEVIFSPSIVGIDQAGILEIMRSILQRHSLEEQQKLVSNVLITGGLGSLPGMETRIKRELTSIMPVGSSINVFRASNPLLDAWKGASEWSVTEKFKAAKVTREEYLEKGPEYIKEHSLGNINS

SEQ ID NO: 2517 - protein, 678 aa, Schizosaccharomyces pombe
MKTYEYVLLVIILILSLCYFIYNNFLNKPKAPERRVVATDSIVELMEAEKLTAAVFFGSQTGTAEDFAYRFSTEAKANFNLTNMVFDLENYDLTDLDNFDRSKLLVFFLATYGEGEPTDNAEAFLQLLEGDDTVFSSGKGIEDTPFEGIRYAIFGLGNHTYEYYNAMAKKVDAAMTRLGATRVGNLGLGDDAAGMLEEDYLQWKDDTLPEIGKLFHLQEVHKEYNPMFEVIEKPEISNTSSTVFLGEPSRQQLKGNVASKAPRSQANPFFSSPVRSLELFKSGSRNCLHLELDIADSGMRYQTGDYASICPMNPSQAVDDLLEVLGLKEKRDTVIIVKPIDTLDKAPVLSPTTYDTVFRYYYEICGIVSRQLLSFIAPFAPTPESKQELEKLGNDYDYFKKNVVDLHLNLAQVLRRVSPDAPFTKLPFSMLLENMAHMKPRYYSISSSSVVHPDKVHVTAVVDKKEWTDKNHIFYGLTTNYLLAHCRHMHGEKIPHPNGLEYTLEGPRKNWTGKIPMFVKKSTFRLAPPDVPIIMVGPGTGVAPFRGFVMERANLASKGVKVAKTLLFYGCQYSDKDFLYKEEWQQYKDVLKDSFELITAFSREQDHKIYVQHRLLEHSDTIAKLVEEGAAFYICGDADHMAKDVVNALASILTTVDVDGMKAVKALRDDNRFFEDTW

SEQ ID NO: 2518 - protein, 659 aa, Schizosaccharomyces pombe
FIYNNFLNKPKVPERRVVATDSIVELMEAEKLTAAVFFGSQTGTAEDFAYRFSTEAKANFNLTNMVFDLENYDLTDLDNFDRSKLLVFFLATYGEGEPTDNAEAFLQLLEGDDTVFSSGKGIEDTPFEGIRYAIFGLGNHTYEYYNAMAKKVDAAMTRLGATRVGNLGLGDDAAGMLEEDYLQWKDDTLPEIGKLFHLQEVHKEYNPMFEVIEKPEISNTSSTVFLGEPSRQQLKGNVASKAPRSQANPFFSSPVRSLELFKSGSRNCLHLELDIADSGMRYQTGDYASICPMNPSQAVDDLLEVLGLKEKRDTVIIVKPIDTLDKAPVLSPTTYDTVFRYYYEICGIVSRQLLSFIAPFAPTPESKQELEKLGNDYDYFKKNVVDLHLNLAQVLRRVSPDAPFTKLPFSMLLENMAHMKPRYYSISSSSVVHPDKVHVTAVVDKKEWTDKNHIFYGLTTNYLLAHCRHMHGEKIPHPNGLEYTLEGPRKNWTGKIPMFVKKSTFRLAPPDVPIIMVGPGTGVAPFRGFVMERANLASKGVKVAKTLLFYGCQYSDKDFLYKEEWQQYKDVLKDSFELITAFSREQDHKIYVQHRLLEHSDTIAKLVEEGAAFYICGDADHMAKDVVNALASILTTVDVDGMKAVKALRDDNRFFEDTW

SEQ ID NO: 2519 - protein, 1233 aa, Schizosaccharomyces pombe
MGRLLRLEVENFKSYRGHQIIGPFEDFTSIIGPNGAGKSNLMDAISFVLGVKSSHLRSTNVKELIYRGKILQRDNTDFTDSSNPTTAYVKLMYELDNGEQREYKRAITPSGATEYKIDEEIVTFSEYCGSLQKENILVRARNFLVFQGDVETIASQSPLELSKLVEQISGSLEYKSEYDKSKDEQDKAVNLSAHSFNKKRGINAELRQYQEQKTEAERYQSQKEKRDSAQLVYLLWKLFHLEKSISSNMAEVTRLKADSIQLIERRDENTKEIEKLKEKEGSIRRNLLAFDRKVRKQEKLIASKRPELISIAEKALESKSNLRKIQRKAAEIEKDYSDQASTLQVLENQLTSLSAAEKEFLKDMQEKEQLKGLRLLPEDKEEYEGLRSEADKLNSNLLFKLQTLNRNIKVTSQSKDSLTSIVGDLESKIKSLHESVSSLDTERADLLAKINEKIESLELEKHDQQKKRLTYSELFHKTQELNEELQSCLQKILEASADRNESKQDAKKREALYALKRIYPEVKGRIIDLCTPTQKKYESAIAAALGKNFDAIVVETQAVAKECIDYIKEQRIGIMTFFPMDTIAASPVNQKFRGTHKGARLAIDVLNFESEYERVMISAVGNTLICDSMTVARDLSYNKRLNAKTVTLEGTVIHKTGLITGGSSNNRSAKHWDDHDFDLLTQTKDRLMHQIGEIEYQKSSCVITESDTVKLHSLESEISLLKDKYTVVSRSVEDKKKEIGHYESLIKEKQPHLSELEMELRNFVKSRDELQIQVEKVEEKIFSGFCKRIGISDIHTYDEIHRTFTQSFTQKQLEFTKQKSLLENRISFEKQRVSDTRLRLERMHKFIEKDQESIDNYEQNREALESEVATAEAELELLKEDFASENSKTEKILLAASEKKLVGKRLVSELTKLSGNITLLESEIDRYVSEWHAILRKCKLEDIDVPLREGSLTSIPIDDVSNSGDITMGEEPSEPVINFEKFGVEVDYDELDEELRNDGSESMASVLQEKLREYSEELDQMSPNLRAIERLETVETRLAKLDEEFAAARKAAKNAKERFNAVKQKRLQKFQAAFSHISEQIDPIYKELTKSPAFPLGGTAYLTLDDLDEPYLGGIKFHAMPPMKRFRDMDQLSGGEKTMAALALLFAIHSYQPSPFFVLDEIDAALDQTNVTKIANYIRQHASSGFQFVVISLKNQLFSKSEALVGIYRDQQENSSRTLSINVRDYFFLILKY

SEQ ID NO: 2520 - protein, 571 aa, Schizosaccharomyces pombe
MGIKGLLGLLKPMQKSSHVEEFSGKTLGVDGYVWLHKAVFTCAHELAFNKETDKYLKYAIHQALMLQYYGVKPLIVFDGGPLPCKASTEQKRKERRQEAFELGKKLWDEGKKSQAIMQFSRCVDVTPEMAWKLIIALREHGIESIVAPYEADAQLVYLEKENIIDGIITEDSDMLVFGAQTVLFKMDGFGNCITIRRNDIANAQDLNLRLPIEKLRHMAIFSGCDYTDGVAGMGLKTALRYLQKYPEPRAAIRAMRLDKSLKVPVSFEKEFALADLAFRHQRVYCPKDKTLVHLSPPERELSVHEDAFIGSFFDNQLAIDIAEGRSNPITKCAFDIKDSSMQSFTKTTITISKRKGISKTDISNFFMKSIPPSKRPTKSTSLIDVTNVKVQRTHLANDISSEKQSIKSANEKAYVTPKSNSLKPGFGKSLSDISNSATKNENVPFLPPRTGVSKYFKLQKNTEKEIDEQVPSQSNNTTPTSAKSDSASPQNWFSSFSYQTPNSASPPFSSLSHTLPISALAKIGHDALNRKNHASLPSRRIVYKPPSSPSTPISMNPRPKGILSLQQYKFR

SEQ ID NO: 2521 - protein, 1944 aa, Schizosaccharomyces pombe
MENDEAFDRLIRKIQENQKHPSFEGSNKVLHLALSYLNTNRQNPHWVCDPKLQVAVRECLFLFSFQNDNEYLVWFKKHLNERLQLCPKCIVKYHQSLDDFKSLCLNIFHFDPNTLEIVMEKIYSWDIFRLQEVLKTVPKIDTSSASKPILCAFYEILYSPRILHNKEIFPLFRNRFLESGFLRLSKNLVPGVISLLFSRDDELRRWACSILSDVKTISDNEFKILEGPLLQEIRSLDQKKENENEMQIFLKGLSLLLKHVDHLYFRGLTGKNFNVADFILSGLQSDHTNLCPSFLVCLHSLLYCYGRNFWTPEISPSEVIDKIFNGNAYKRWTEENTSNFSNDQKAENPFEWATSLLKTISIIDEVELINKILINYTMQYKKELEVGFKNVQLLQSLADIFSVLFSEYFMIFPHSDQSLQNKVFELHSTLAIKFDELFRLLNLENEESVEWRLIKKVFEYRLNLDLYILKQFYCHYLDRNRKPPLNIKSVSESFKNFWVYLQNVFREEKFFMVRIVFRACSTVCLIDKLPPKKVDIPFKSDFENALNGFVATFSEMLIQTQCWHLSAQTQLVSNPLTFRGIFSLVFSPILEISTGSISIIKSISLSDSVVDTIGELLRSQFSNTLNSSCYVLLQWLKVRNFGGAKHIVYFNKLIINTIFDSVDGLTSKDATFAKQVEKKESLKNFWESLWKFFTHFFIVLPTWPVHDKDNLVDLMRDTLDFCDMLINIFEEVNGFIFGLSDNDIKIVSANDKGSALAMCIADSLVTVSYWLKLTDSSLLTSVVKVICKMLKICKKLECPISQNVIDIIHRASITSDEQTILTFTEREDLFISLTPYLSEDVLNHSPFNDTNTLETKLQSDDRGLLSKDQTIGIAKKLPESNISTSNHFLLPPKAISASKAINRNAQKSQNLNFLKSKQETTQRIRESAKVPRTSAGNHLSEKLNSDNHIPKALQKLDSADPIRKPSLLHTSKSYSNPDDKNTSTSDEDTSESEEESSNGLFSLAREANSHASKSLPQRRQIQFLDFDSLKTKNVVHPTQLRRNTQQSAQLARLRLNPDVQEFYKVILGWNPLADSFSASNVEMQCVQAKFTYNDSNAYEKVFKPMLFHECWAQVKSAVEEKQYPPIDLILNTRSTVDNFVDIYFTSCSPTEVSFLSDTDICLLSKSQSSGDTNNPKSFQLCKIQSISRKKESLELCLRMNIESIDLQEYAPNIRFTAQKLFNATTSLREFAALKSLRHLPLSQRILDANVTRLPSNFTDDKKQKIMKSYGVNEPQAYAIYASSVNDGFTLIQGPPGTGKTKTILGMIGAVLTSSSQGLQFNVPGQTRKTSKNKILICAPSNAAIDEILLRIKAGVYDHEGIKFFPKVIRVGFGDSISVHAKEFTLEEQMIKQMELTNLKKDQEANNSSDTRKKYDSIIKKRDSLREDLEKFRSTGKNSSILEAQLREITKQKNMLEQSLDDMRERQRSTNRNLDVLKKQIQNQLLQEADIVCATLSASGHELLLNAGLTFRTVIIDEAAQAVELSSIIPLKYGCESCVMVGDPNQLPPTVLSKTSAKFGYSQSLYVRMFKQHNESACLLSIQYRMNPEISRFPSKFFYNSKLLDGPNMSAVTSRPWHEDPQLGIYRFFNVHGTEAFSNSKSLYNVEEASFILLLYERLIQCYLNIDFEGKIGVVTPYRSQVQQLRSQFQRKYGSIIFKHLDIHTVDGFQGQEKDIIIFSCVRSSMSGGIGFLQDLRRLNVALTRAKSSLYIVGNSKPLMQEDIFYSLIEDAKTRGVWRDLSANQFKNSKSISNVSTHLASNNLNLASRDTPIKSPSVGICEEKQEAHKVKKRHNIDSANLSRGTERDEDIPNKRAKNKVSTDQTAADNKVTKPRLDESSSSKQDVLNKIDESEIEQASSKKPGYVEKNKDKGHMKKSKKPKSKLALAAMAHGFAPPKVEHFKRK

SEQ ID NO: 2522 - protein, 175 aa, Schizosaccharomyces pombe
MSKVASAAGKAIDWASVASKLKLDAATASAIANFRSRHAQAVAKLGTLREQATTVDFATYRSVLANKEIVNRIESSMKSFKPVKIDLNSQLKAINAFEAKASEGAKKNVELVKAELQNLSATLKNIEQARPTEEITIEDMKQAVPEIEKIVETMVTKGKWVIPGYREKFGDLSIM

SEQ ID NO: 2523 - protein, 724 aa, Schizosaccharomyces pombe
  unsure (1)..(724): unsure at all Xaa locations
MPRRKSLRSQLLINGIDKSLLSDDSADSSDIDEEEVYGVWTEEPFQKEAGRSYYRSLKKNDVIYRVGDDITVHDGDSSFYLGVICKLYEKAIDKHSGKKYVEAIWYSRAYAKRMEIKPEYLLPDRHINEVYVSCGRDENLTSCIIEHCNVYSEAEFFSKFPAGIPTKRKDLFPCNFFIRRGVHLKVNKYTEPLDWSYYAHNLERIEDLLVEMEENLRPTKKKSGSRGRGRPRKYPLPNVESKESSSKVNSKDENFDLQDDSESSEDNLTIQPQTPRRRHKRSRHNSSNLASTPKRSKLFYILSFFFVYXRXFSGYKQPLQITPLPIRMLSLEEFQGSPHRKARAMLHVASVPSTLQCRDNEFSTIFSNLESAIEEETGACLYISGTPGTGKTATVHEVIWNLQELSREGQLPEFSFCEINGMRVTSANQAYSILWESLTGERVTPIHAMDLLDNRFTHASPNRSSCVVLMDELDQLVTHNQKVLYNFFNWPSLPHSRLIVVAVANTMDLPERILSNRISSRLGLSRVPFEPYTHTQLEIIIAARLEAVRDDDVFSSDAIRFAARKVAAVSGDARRALDICRRASELAENKNGKVTPGLIHQAISEMTASPLQKVLRNLSFMQKVFLCAIVNRMRRSGFAESYVYEVLEEAERLLRVMTTPDAEAKFGELILRRPEFGYVLSSLSENGVLYLENKSSRNARVRLAIADDEIKLAFRGDSELAGIA

SEQ ID NO: 2524 - protein, 201 aa, Schizosaccharomyces pombe
  unsure (1)..(201): unsure at all Xaa locations
MSVKYFEPEEIVEHNNSKDMYMVINGKVYDVSNFADDHPGGLDIMLDYAGKXFDKTFVEVNTILCWRLLCSKAIVYFXSLSFHSSVLHLCAFLIKTLYTAFXTCPLTICFRQDATKAYQDIGHSIAADELLEEMYIGDLKPGTEERLKELKKPRSFDNDTPPXENDLCTMVVSCXQNRLPLLIALIVLPAIAVIVFVKLNK

SEQ ID NO: 2525 - protein, 254 aa, Schizosaccharomyces pombe
MSRKNLIKLNHDPTVTYSTKDDADELFDDLSSSPLHENVSWISWFCSRPGREYFVEVKEDFIEDLFNLTGLNLAVPFYNEALDLILDRTAPDTLENFDMDVIETSAQILYGLIHQRYIITRTGLHQMAEKYSMGIFGCCPRVNCCYTHVLPAGLSDIVGKMPVMLFCPNCLDLYAPSSSRYKNIDGSFFGATFPHLFFESYPELNPKRSIPCGKIYQPRIYGFKVSELSKTGPRMQWLRMYLEDSGSDSESESD

SEQ ID NO: 2526 - protein, 685 aa, Schizosaccharomyces pombe
MTSSSYTDIDTLAINTIRTLAVDTTAHAKSGHPGAPMGLAPAAHVLFSRIMKFNPAHPKWLNRDRFILSNGHACVLQYIMCHLLGYKLTIEDLKQFRQVGSKTPGHPETHNPDLNIETGAGPLGQGIASAVGLAIGKAHSAAVYNKPGFDLFSNYTFCFLGDGCLQEGVSSEACSLAGHLKLSNLIAVWDNNKITIDGATSMSFDEDVEKRFEAYGWNIVRVANGDTDLDGIEKGFREAMSCTDKPTLINLKTTIGYGSELQGTHSVHGSPLKPEDCVHVKKLFGFDPTKTFQVPPEVYAYYKERVAIASSAEEEYKKMYASYKQSYPDLSNQLERILSRKFPEGWEKHLPVYKPGDKAVATRKLSEIVLDALCPVLPELVGGSADLTPSNLTRWEGAADFQPPSSKLGTYAGRYIRYGIREHGMAGIMNGLAVYGPIIPYGGTFLNFVSYAAGAVRMAALNNSRVIYVATHDSIGLGEDGPTHQPIETFAHFRAMPNINCWRPADGNETSAAYYSALTSDSTPSILALTRQNLPQLENSTIENALKGGYVMLENKEADITLVGTGSEVSLCIDTVKTLETEYNLKARVVSLPCWEVFEQQPESYRLSVIPDGIPAMSVEVWATNGWRRYVHEAFGMHTFGDSGPAPKLYEKFHFTTSGVAQRAKKTVDAYKDIPYIRSPVRRAF

SEQ ID NO: 2527 - protein, 624 aa, Schizosaccharomyces pombe
  unsure (1)..(624): unsure at all Xaa locations
MSRHRDVKNLDLDGSYHLILXXFVFFFNVFLDYELDEEPGEEELTEEQEGXXMISXKYXRTISEEFRSAVATVRETLLGVPISEKEIADTVWYYYFDVEKSVNYLLQKASSKAGAKEKQNTDSQKEKKQNKSKEALADAKDPLDESSNGIKNLSLNKNDEPAFQTNGEVKMKNSSESDNQPEKKKIKKQNPTDLVSVPEIFEQSNPKPVVHLVVTGHVDSGKSTMLGRIMFELGEINSRSMQKLHNEAANSGKGSFSYAWLLDTTEEERARGVTMDVASTTFESDKKIYEIGDAPGHRDFISGMIAGASSADFAVLVVDSSQNNFERGFLENGQTREHAYLLRALGISEIVVSVNKLDLMSWSEDRFQEIKNIVSDFLIKMVGFKTSNVHFVPISAISGTNLIQKDSSDLYKWYKGPTLLSALDQLVPPEKPYRKPLRLSIDDVYRSPRSVTVTGRVEAGNVQVNQVLYDVSSQEDAYVKNVIRNSDPSSTWAVAGDTVTLQLADIEVNQLRPGDILSNYENPVRRVRSFVAEIQTFDIHGPILSGSTLVLHLGRTVTSVSLKIVTVNNKRSRHIASRKRALVRISFLDGLFPLCLAEECPALGRFILRRSGDTVAAGIVKELC

SEQ ID NO: 2528 - protein, 1035 aa, Schizosaccharomyces pombe
TVIFHSMQDTEYRYFADACSTSSKSFLRFSFLDAFQGGVSQFFLYSVFFQGLWFGNHLATTKRVNVGQVVTVFGSCLSVASSLQQILPAIPDLIKGKFSSHFIKTLCESHDPIEAAKRSAAKIKSISFERGFRFDNVSFAYPSRDENLFSLINVSVFIPFGELVHIIGPSGSGKSTFISLLLRYFSPTYGNIYLDDFPLEEIDEHVLGSTITLVCQQPVIFDMTIRENIIMRNENASESDFEEVCRLALVDEFALTFDQSYDTPCKEASLSGGQQQRIALARALLRDTEILILDEPTSALDPITKNLVMDAIRAHRKGKTTLVITHDMSQINNDELVLVIDKGHLIQRCARKELVLFEDFENNVSIDEKVLKEEADNPFILPNEESLLEKYWINYNESFSQLSRESLFTSLESPFTDIESPTIVSRRKIVEQRKLRMEKESFQETNVDQTFHLFDDKEHACSLTLIFKSIWKVKKLRWFFLLGLLTSLIQGASVPIFAYVISKCLNLFMQIDPSIGVAFWSSMVLVVAAGSGASYFFSHYIFSISAKIWCDHYRLLAVKVLFTQDQAWFDQIENYPLVLSKILVNNISDMRNMISSLIEEVFIAFTMAIIGIAWSFATGWRLAAVLVAVSPILCLTSRMFSYIYVSTERMCQDVVISTTSILHKTIVNLDTIKGYSVLSFFRENHKNSLRKSWEAFKRRAFWTSLGFAINNSLLYFVRALLFYCSSIFISKEFYTVEQMVQVLSLATFTLLMASTCIMSLPNVSASRIATSRVLKLSSLKPGNLHKSGYLKFPLVGKIEFDGVSFAYPDSERNHLALNNVSLSIEAREKVAIVGISGSGKSTLVELLRKTYPSEDIYIDGYPLTNIDTNWLLKKVAIVDQKPHLLGSTILESLLYGVDRDINSVMDALDKTYMTEVIQNLPNGLDTPLLEFSKNFSGGQIQRLAFARALLRNPRLLILDECTSALDSKSSLLLEKTIQNLSCTVLIITHQPSLMKLADRIIVMDSGIVKESGSFDELMNRHTHFWKLIHRGEWIE

SEQ ID NO: 2529 - protein, 1035 aa, Schizosaccharomyces pombe; identical to SEQ ID NO: 2528

SEQ ID NO: 2530 - protein, 501 aa, Schizosaccharomyces pombe
MLQRLEQLQMQTSNILKELHSTSIFTDSTTSQLHNGGENSVMDTEESSAIDKLSASLQQVNISSPSVPTSQSRVTQGQSLGNTQISNPTSKTNNVRAKARNIRNPSQRLRPSTSLARLSNNAPRIPKEASLHENSISSKESPSVTTSKHVATITKPSTSSIARMSSNARIAAIPRAKSSMAVRSPSRLGNGPNVRSPKVGFNAKSDDSPVVKSPGSNDKPSASPRISVRSLGNSSVVRPPTRTSTTRPLSRVNVTNASGSISKNSTSPSKVKVNASTKIVRPVSAAQTVRPGSRIFRENSASNTQRPNVSATSNSTVRVASSLAVRPVSRNAQARTPSRLEQREVNVKNSSAKIVRPGTSLGVRSPSRIQSTLSSRTTTGNVRTKAANIVRPSSSINRRPPSSINQRPPSNLRILAPSRSRATIHERPSSSILHRHAHSLTSSSFSTKTLATTKEIQNSPTLVESSTVVHHDPSYLQNQTSEINDTNHSSHSSPLDLNRMI

SEQ ID NO: 2531 - protein, 798 aa, Schizosaccharomyces pombe
  unsure (1)..(798): unsure at all Xaa locations
MSCPHLTETNVVIPDNSQVIYREECVRCFNSQVCFLNSLFXNMYSEEFKFVNKRXDEEGGIDLCLTCFQSGCGETGLKHSLVHFEQTLHPIVVTIARQPKQKINDEPPQKITKLEIREDSDEDLYDYFYVPKCLVCNIILDIQDPLLSLSLEAMKNATKASNKSQLTAWENELTTCDHIINLPENETYVTNLDNATCSKCDLAENLWMCLTCGALSCGRKQYGGGGGNGHALSHYDDTGHPLAVKLKSISPDGQADIYCYSCDEERIDPNIKTHMLNFGIDIAKLNKTEKSLAELQLEQNLNWDFGASEEDDASKRLFGPGLTGLKNLGNSCYLASTMQSLFSIKEFAIHELNLFNTYNSVCQTPTTDLQCQLGKLADGLVSGKFSKPSKIGLLNNPSSSILPYQDGLRPFMFKDVVGQGHSEFGTSQQQDAYEFLLYLLGKIRKSSIAKTDITKIFDFETEQKLSCLSCKRVRYSSFSSQGLTLTVPRVKIGEIEGEQIYEEVSIDQCLDATIQPDQMEYTCEACKSKLGATTTTAMKSFPKVLILQANRFDLQGYQVKKLSIPIIVNEDGIYNFDRLMAKDHPNDEDYLPEKTETIEWNQSAIEQLQAMGFPLVRCQRALLATGNSDTETAMNWLFEHMEDPEIDKPIEVSELLPKADSSVSEENVQSLCEFGFTVAQARKGLLESNNNIERAVDWILNHPDESFEEPPLEGSDSSIKNENMGSWESTNVPVNYNLKAIISHKGSSAHAGHYVAFIRKEIDGKQQWVLFNDEKVLQVASLEEAKTTGYVYLFERLD

SEQ ID NO: 2532 - protein, 1112 aa, Schizosaccharomyces pombe
MGVSGLWDILEPVKRPVKLETLVNKRLAIDASIWIYQFLKAVRDKEGNQLKSSHVVGFFRRICKLLFFGIKPVFVFDGGAPSLKRQTIQKRQARRLDREENATVTANKLLALQMRHQAMLLEENNKKATALANASVQNERQMPSSMTLDNSEIKPVLNQRKNYLKPDPYQLPEMDVSFDKLGSSYDPRIMSQDELTQYVSSFTKIEDINLFDFSNIDFDSELFQSLPDTDKYSILSAARLRSRLRMGLSSEQLSEMFPNRMDFSRFQIERLKERNDLTQRLMDFTGMNEFGPSRVVSEKNREYILVKNEGAEGGWALGVISGSTNNEPIIIDDEATKLSSNLIDEDEDEAFYDVPLPSRSHSMNPRELVAAKLKEIKENSFSENQQSDEADYNVTDDLILQLATQQSLEENKKSKELFSLSASEFDKLNSEKKTFEILSTDIPAEDSMNSLLNDEENLKLEHVGDVSNDSLAFAEKKHPENGTSIFMDALPSASREKKTNDLIDPLPFQPMDWGKSIFFEKLKKPTETFMDSKTDIPSEAPDNSKLVEDTNLHTINATVNIESDLDAAKPGIENPIISPLLPVKDDEKDLDLRELNPLEPFENMKEQADDGTVTNPLNVSSDKAMSVYLLSSENAKDTGDIKSESIDAVLPTLETSSPSLSIPTDFQKEASPNKGAAALSSKVEPEVVEKLLDEEEEEMIIRMAEEEKEYDRFVSELNQRHETEEWNQEAFEKRLKELKNQKRSEKRDADEVTQVMIKECQELLRLFGLPYIVAPQEAEAQCSKLLELKLVDGIVTDDSDVFLFGGTRVYRNMFNQNKFVELYLMDDMKREFNVNQMDLIKLAHLLGSDYTMGLSRVGPVLALEILHEFPGDTGLFEFKKWFQRLSTGHASKNDVNTPVKKRINKLVGKIILPSEFPNPLVDEAYLHPAVDDSKQSFQWGIPDLDELRQFLMATVGWSKQRTNEVLLPVIQDMHKKQFVGTQSNLTQFFEGGNTNVYAPRVAYHFKSKRLENALSSFKNQISNQSPMSEEIQADADAFGESKGSDELQSRILRRKKMMASKNSSDSDSDSEDNFLASLTPKTNSSSISIENLPRKTKLSTSLLKKPSKRRRK

SEQ ID NO: 2533 - protein, 891 aa, Schizosaccharomyces pombe
MEYRTNNVPVGNETKSAALNALPKIKISDSPNRHHNLVDAFMQSPSYSTQPKSAVEPLGLSFSPGYISPSSQSPHHGPVRSPSSRKPLPASPSRTRDHSLRVPVSGHSYSADEKPRERRKVIGNYVLGKTIGAGSMGKVKVAHHLKTGEQFAIKIVTRLHPDITKAKAAASAEATKAAQSEKNKEIRTVREAALSTLLRHPYICEARDVYITNSHYYMVFEFVDGGQMLDYIISHGKLKEKQARKFVRQIGSALSYLHQNSVVHRDLKIENILISKTGDIKIIDFGLSNLYRRQSRLRTFCGSLYFAAPELLNAQPYIGPEVDVWSFGIVLYVLVCGKVPFDDQNMSALHAKIKKGTVEYPSYLSSDCKGLLSRMLVTDPLKRATLEEVLNHPWMIRNYEGPPASFAPERSPITLPLDPEIIREMNGFDFGPPEKIVRELTKVISSEAYQSLAKTGFYSGPNSADKKKSFFEFRIRHAAHDIENPILPSLSMNTDIYDAFHPLISIYYLVSERRVYEKGGNWNRIAKTPVSSVPSSPVQPTSYNRTLPPMPEVVAYKGDEESPRVSRNTSLARRKPLPDTESHSPSPSATSSIKKNPSSIFRRFSSRRKQNKSSTSTLQISAPLETSQSPPTPRTKPSHKPPVSYKNKLVTQSAIGRSTSVREGRYAGISSQMDSLNMDSTGPSASNMANAPPSVRNNRVLNPRGASLGHGRMSTSTTNRQKQILNETMGNPVDKNSTSPSKSTDKLDPIKPVFLKGLFSVSTTSTKSTESIQRDLIRVMGMLDIEYKEIKGGYACLYKPQGIRTPTKSTSVHTRRKPSYGSNSTTDSYGSVPDTVPLDDNGESPASNLAFEIYIVKVPILSLRGVSFHRISGNSWQYKTLASRILNELKL

SEQ ID NO: 2534 - protein, 689 aa, Schizosaccharomyces pombe
  unsure (1)..(689): unsure at all Xaa locations
MPKKAALDELKWKEVKLPDHLDDFDGFMGLEEIEGVDIKYQPKGAMKEVIYEVXLFIIXFINKQLPEVHEKKDKKPEKRKKDQKEASEKKKKGKRTSPTIEMTSLGSKVTSKNYNEFSTLEEEDEHNSHGVDVSAWAHFSLSPEMLGSLSKAGFSKPMPIQSLVIPEASIGFDIIGKADTGSGKTLAFGIPILEHCLRNVDAKYVQALVVAPTRELAHQICQHFELIKPSPNIRVMSITGGLAVQKQQRLLNKHPHVVVATPGRLWSVINENNLTGNFKKIKCLVLDEADRLLQKSHFEELSKLLEILGNPMHTQRQTFIFSATFDEGLQQRLKKNMKGNITEKYNSPMGMFNXKYFTFSLTNDCIENMLKEVRFFGKPKFLDANPQSAVASRVLEGLIECAPAEKDLYLYYLIMRYPGKTMVFANGIEDIKRITPFLNELKVPSYPLHAQLDQKKRLQSLEKXVIFIYMLLTNKFKNNPKGVLVCTDVAARGIDIPSVTHVIHYHVPHTADMYVHRSGRTARANEDGVSILMCGPKELSQLKRLCYRLKKKIETFINFPVDMSILDILKTRVVLAHKIVNLTRKDGRVGREEAWLKSMAQELGVESSDDEDPDLPKKSESSKNKKQIAHLRSELAPLLHEKIRTGFSGRYLTSGLVNMAEKLANEEVHDNIIGMDSISALEVLQKRKK

SEQ ID NO: 2535 - protein, 328 aa, Schizosaccharomyces pombe
  unsure (1)..(328): unsure at all Xaa locations
MSDIDDEEFEQLAVSALEEVEKKAGFAQQPTPQKVSRVTAHSILVNPRQVRSXRQIAWFVIAGXKCIFNLAFFFSVVGLSPFXXGLYXLLIKGNPLLVSFLLVDKACSXTIAHVRNVPWEYTDIVPDFVMGTGICSLFLRYVKFPKAXFVYXRTDLHHASLKYHHLHPEYIYSRISKLGKSYNLRILLILVDVENHQASIQELVKTSIVNQYTLILAWSSEEAARYLETYKAYENMSPALIMEKPSTDYLSQVQSFLTSIRGINKSDSLSLLSKFGSLERALVASRDELEQLEGWGPTKVNRFLEAVQQPFMSHSTIKRPEAINLKQT

SEQ ID NO: 2536 - protein, 803 aa, Schizosaccharomyces pombe
MNILPKSIPIRIQSLRRYQGSLKTSLRALSTRPIFEKRLLAETPFSIRPSNASVLIAKRSPKFGWKQVRFYAANPNGGNFRMDLGGGRKQGAALEEYGTDLTALAKQGKLDPVIGREEEIQRTIQILSRRTKNNPALVGPAGVGKTAIMEGLASRIIRGEVPESMKDKRVIVLDLGALISGAKFRGDFEERLKSVLSDLEGAEGKVILFVDEMHLLLGFGKAEGSIDASNLLKPALARGKLHCCGATTLEEYRKYIEKDAALARRFQAVMVNEPSVADTISILRGLKERYEVHHGVRITDDALVTAATYSARYITDRFLPDKAIDLVDEACSSLRLQQESKPDELRRLDRQIMTIQIELESLRKETDTTSVERREKLESKLTDLKEEQDKLSAAWEEERKLLDSIKKAKTELEQARIELERTQREGNYARASELQYAIIPELERSVPKEEKTLEEKKPSMVHDSVTSDDIAVVVSRATGIPTTNLMRGERDKLLNMEQTIGKKIIGQDEALKAIADAVRLSRAGLQNTNRPLASFLFLGPTGVGKTALTKALAEFLFDTDKAMIRFDMSEFQEKHTIARLIGSPPGYIGYEESGELTEAVRRKPYAVLLFDELEKAHHDITNLLLQVLDEGFLTDSQGRKVDFRSTLIVMTSNLGSDILVADPSTTVTPKSRDAVMDVVQKYYPPEFLNRIDDQIVFNKLSEKNLEDIVNVRLDEVQQRLNDRRIILTVTEAARKWLAEKGYSPAYGARPLNRLIQKRILNTMAMKIIQGEIKSDENVVIDVLDGELEFKANKLEPQSTSHED

SEQ ID NO: 2537 - protein, 203 aa, Schizosaccharomyces pombe
  unsure (1)..(203): unsure at all Xaa locations
MGLSISKLFQSLFGKREVSENLXKVXKRRTFINSIVCLCRMRILMVGLDAAGKTTILYKLKLGEIVTTIPTIGFNVETVEYRNISFTVWDVGGQDKIRPLWRHYFQNTQGIIFVVDSNDRERISEAHEELQRMLNEDELRDALLLVFANKQDLPNAMNAAEITDKLGLHSLRHRQWYIQATCATSGDGLYEGLEWLSTNLKNQ

SEQ ID NO: 2538 - protein, 226 aa, Schizosaccharomyces pombe
  unsure (1)..(226): unsure at all Xaa locations
MANPFVRNQSFKSVFFKNLVGITLWVPVLMFVEQHVVSVGTIEGRSMKPAFNPETNMLQRDRVLLWKWNKDYKRGDVVILRXVLGSLQGLSVLSFPFYRYXXATSSPENPEELLVKRVLGVEYDIMKTRPPKKLSLVPVPEGHVWVEGDEQFHSMXVSNNCFFTFSFSSIEILTSLQDSNKFGPVSTGLITAKVIAILFPFSRAGRIDHEGFRKNAVFLSGKRSVK

SEQ ID NO: 2539 - protein, 767 aa, Schizosaccharomyces pombe
MASANFIRQFELGNDSFSYQKRPEDEPSQPLSNRNINKLNDSSTLKDSSSRIFINSQVLRDGRPVELYAVECSGMKYMELSCGDNVALRRCPDSYFNISQILRLAGTSSSENAKELDDIIESGDYENVDSKHPQIDGVWVPYDRAISIAKRYGVYEILQPLISFNLDLFPKFSKQQQIESSSISKNLNTSSFNTRSPLRNHNFSNPSKSSKNGVHTINNMQSSPSPSSSFLLPLTQIDSQNVKRSNNYLSTSPPILEQRLKRHRIDVSDEDLHPSSQLNDNEASSLFPDTPRLNHSLSFVSLVSSLPPLDQNIMQDYHTSKDILTSIFLDVNFADSSALEAKLSDSLDLDVPIDELGHAALHWAAAVAKMPLLQALIHKGANPLRGNLTGETALMRSVLVTNHLNQNSFGDLLDLLYASLPCTDRAGRTVVHHICLTAGIKGRGSASRYYLETLLNWAKKHASGNNGYMLKDFINYLNHQDKNGDTALNIAARIGNKNIVEVLMQAGASAYIPNRAGLSVANFGIFVENALKQPEDSKQTKVSLMSENLSSKEKTAVPPRQKSRDIIASVTDVISSLDKDFQDEMAAKQSMIDSAYTQLRESTKKLSDLREQLHVSETQRTLFLELRQRCKNLMTSIEEQKSELSNLYESFDPNGIHDSISLDADAPLTVNENNNKNLSIAELKFQVAAYERNEARLNELANKLWQRNSNIKSKCRRVVSLCTGVDESRVDSLLESLLQAVESDGQQGEVDMGRVAGFLRVVKEHQA

SEQ ID NO: 2540 - protein, 325 aa, Schizosaccharomyces pombe
  unsure (1)..(325): unsure at all Xaa locations
MGGNKRAYYAVARGRNTGIYSTWXDCVSQENGFVVKYKFHVKQVSIRSYALLQFNLNRFFQDDLLLTFPXWIHLVVXQTLTNFXDEASDQVKGYGGNRYKKFDSYEAAQEFCRTEGSRYSSSSGPYRRSTTSYGYSPYSSSSSNYSARHSDKYRKKISRSYSTEKDIEIFSNDTHEKSIACSDRQVVYADGSSLRNGKKGAVAGCGVFFGNDDPRNISVPLAGEEQTNNRAELQAIILALENTSGDLTIRSDSNYSIKSLTTWLPKWKKNDFKTSNSQPVKNLDLINRASDLMSDRNVSLEYVKGHSTDYGNQQADMLARRGASE

SEQ ID NO: 2541 - protein, 1103 aa, Schizosaccharomyces pombe
  unsure (1)..(1103): unsure at all Xaa locations
MTDRSSNEGVVLNKENYPFPRRNGSIHGEITDVKRRRLSERNGYGDKKGSSSKEKTSSFEDELAEYASQLDQDEIKCKVFWIANHLLVYXLLDSSKDQQWQRPALPAINPEKDDIYFQQIDSEEFTEGSVPSIRLFGVTDNGNSILVHVVGFLPYFYVKAPVGFRPEMLERFTQDLDATCNGGVIDHCIIEMKENLYGFQGNEKSPFIKIFTTNPRILSRARNVFERGEFNFEELFPVGVGVTTFESNTQYLLRFMIDCDVVGMNWIHLPASKYQFRYQNRVSNCQIEAWINYKDLISLPAEGQWSKMAPLRIMSFDIECAGRKGVFPDPSIDPVIQIASIVTQYGDSTPFVRNVFCVDTCSQIVGTQVYEFQNQAEMLSSWSKFVRDVDPDVLIGYNICNFDIPYLLDRAKSLRIHNFPLLGRIHNFFSVAKETTFSSKAYGTRESKTTSIPGRLQLDMLQVMQRDFKLRSYSLNAVCSQFLGEQKEDVHYSIITDLQNGTADSRRRLAIYCLKDAYLPQRLMDKLMCFVNYTEMARVTGVPFNFLLARGQQIKVISQLFRKALQHDLVVPNIRVNGTDEQYEGATVIEPIKGYYDTPIATLDFSSLYPSIMQAHNLCYTTLLDSNTAELLKLKQDVDYSVTPNGDYFVKPHVRKGLLPIILADLLNARKKAKADLKKETDPFKKAVLDGRQLALKVSANSVYGFTGATNGRLPCLAISSSVTSYGRQMIEKTKDVVEKRYRIENGYSHDAVVIYGDTDSVMVKFGVKTLPEAMKLGEEAANYVSDQFPNPIKLEFEKVYFPYLLISKKRYAGLFWTRTDTYDKMDSKGIETVRRDNCPLVSYVIDTALRKMLIDQDVEGAQLFTKKVISDLLQNKIDMSQLVITKALSKTDYAAKMAHVELAERMRKRDAGSAPAIGDRVAYVIIKGAQGDQFYMRSEDPIYVLENNIPIDAKYYLENQLSKPLLRIFEPILGEKASSLLHGDHTRTISMAAPSVGGIMKFAVKVETCLGCKAPIKKGKTALCENCLNRSAELYQRQVAQVNDLEVRFARLWTQCQRCQVSMHQDVICTSRDCPIFYMRIAEHKKLQQSVDLLKRFDEMSW

SEQ ID NO: 2542 - protein, 535 aa, Schizosaccharomyces pombe
MLINEHVRERYHFLRVSLTRVAHLVFANSHESNDLKMVENVSSTPKKGVLEDPSTLTPEVVTPRTPGHRIIKAKGAYTKDRSAKRRRGRIEIERHLLGEFDDNVGSNSLLDVPLYSLEAEPLSPSVMLEDESMEGINQSPQGISVEKLGKEDNRSRSSTPASPSLESHEFSESREAGLSQSNGFEARSHGTGFDEYFDKFSQRKTSSNTLSQLPVLDNQVYLDTVKEICTETEQHTQTLVHFQSRNFHQWYFELVNNFNLLFYGFGSKEHFLSSFVEKKLPCFPIFVVKGYFPQLQLKNVLSSFLEFLEVTPAASVSDMLIQSLSIINSPSFSLGKIVFLVHNIDGESLIDERFQSALAAIASSKNVYFIASVDHVNFALLWDTSLESSFNFVMHDATTFARYYNETTYENSLGIGRANVSNKEKAIKHVLYSLPANSRGIFKFLLIHQLERMMDTQDFDARQGEKVGIEYRSFFQKCSAEFLCSNEPNFRSQLTEFFDHNIIESKRDVSNSEILWVPYPKNLLEILLEDMMEDV

SEQ ID NO: 2543 - protein, 557 aa, Schizosaccharomyces pombe
  unsure (1)..(557): unsure at all Xaa locations
MGREIITLQAGQCGNQSMFTYTTINQIEILITHKLVXVGSQFWQQLCLEHGIGPDGTLESFATEGVDRKDVFFYQVGLLIHFKVSTCXLILVDDTRYIPRAILIDLEPRVCYRILLLVFAEIFKXLMSSLPXVVNNILSDTYGSLYNPENILITKNGGGAGNNWANGYSHAERIFEDIMDMIDREADGSDSLEGFSLLHSIAGGTGSGLGSFLLERLNDRYPKKIIQTYSVFPNSQSVSDVVVQPYNSLLALKRLTLNADSVVVLDNAALAHIAADRLHTQNPTFHQQNQLVIDLYXVFSSTNYSRFQTVMSASTTTLRYPGYMNNDLVSIIASLIPSPRCHFLLTSYTPFTNQQVEEAKAIRKTTVLDVMRRLLLPKNQMVSVNPSKKSCFISILDIIQGEADPADVHKSLLRIRERRYASFIPWGPASIQVALSKKSPYIKTNHRVSGLMLANHTSIASVCFCKFFFETFNTNLCSYSRRTLDQYDRLRKRNAFLEQYKKEAIFEDDLNEFDSSRXVSCLIISYFELIYXCIXQRRRCDLINEYEACEDPNYLSL

SEQ ID NO: 2544 - protein, 375 aa, Schizosaccharomyces pombe
  unsure (1)..(375): unsure at all Xaa locations
MSEVIKSVPPGSQNTSQWIISKDQLVFTPSALDGIPLDQEEIQRSKGCNFIINVGLRLKLYVNYDVSVQXINETNNNNRPQTALATANIYFHRFYLRFSLKNYHYYEVAATCIFLATKVEDSVRKLRDIVINCAKVAQKNSNVLVDEQTKEYWRWRDVILYTEEVLLEALCFDFTVEHPYPYVLSFIKKFVADDKNVTKVAWTYINDSTRSIACLLYSPKTIAAAAFQFALEKNEINLSTTTDGLPVWMEESQVSYEDVKGILYIFLXPXHXQCRVLTLIDSLYKKINPSKQALPIDQKNGSHASSVAPGTPSSLASVSTQATPQHQNSSGRTDSFHSLNTETPSKSTVDDQILSTAAQPKKSSDTDKEMETEAS

SEQ ID NO: 2545 - protein, 230 aa, Schizosaccharomyces pombe
MEPSTPPMRGLCTPSTPESPGSFKGVIDASLEGNSSIMIDEIPESDLPAPQVSTFPPTPAKTPKKQLLPNLMLQDRSNSLERCMEEDREHNPFLSSSDNQLLSRKKRKPTPPPSDGLYYVFRGKRIKKSFRPGTDLSTFKPKLLFADSAPSSSSDNPTSSVDLNDYSQIGILPPNLNSIGNKMFSLKSRVPSSSSGSFVAPPPQMRLPAYSSPQKSRSNTKDENRHNLLR

SEQ ID NO: 2546 - protein, 554 aa, Schizosaccharomyces pombe
MIETIPTKPYEGQRPGTSGLRKKVTVFEQPNYVENFVQATMDVVEPSAKGAHLVVGGDGRYFNFHAIQVIAAIAAGNGVEKIIVGTNGYLSTPAASHIIRKYKLTGGIILTASHNAGGPKNDFGIKYNLGNGGPAPESVTEKIYSITKTISEYKMVKIPPLDLTTTGVRRYGPLTVEVIDPVKDYVQLMKEIFDFDLIRSFLSKNPDFTFVFDALHGITGPYGEALFCKELGMPSSVCQNCKPLPDFGGGHPDPNLTYAKSLVARVDRDNIVMGAASDGDGDRNMIYGANAFVTPSDSVAIIAHHAELIPYFRDGGVHGFARSMPTSGAIDRVGKYKGKNVYEVPTGWKFFCNLFDAKRLSICGEESFGTGSDHIREKDGVWGILCWLNILAGLNAQNPKIKTLIDVKKDFYNIYGRTFYSRYDYEELENEAAGKVMDRMRAIADDKSKVGEAVLPGFVVSEAGDFEYHDPIDGSESKHQGLYIKFENGSRIVTRLSGTGSSGATLRLYMEKHESDSSKFDLDAQVALKPVVHAALEILALEELTGRKEPTVIT

SEQ ID NO: 2547 - protein, 336 aa, Schizosaccharomyces pombe
MAIPKVGINGFGRIGRIVLRNALVAKTIQVVAINDPFIDLEYMAYMFKYDSTHGRFDGSVEIKDGKLVIDGNAIDVHNERDPADIKWSTSGADYVIESTGVFTTQETASAHLKGGAKRVIISAPSKDAPMYVVGVNEEKFNPSEKVISNASCTTNCLAPLAKVINDTFGIEEGLMTTVHATTATQKTVDGPSKKDWRGGRGASANIIPSSTGAAKAVGKVIPALNGKLTGMAFRVPTPDVSVVDLTVKLAKPTNYEDIKAAIKAASEGPMKGVLGYTEDAVVSTDFCGDNHSSIFDASAGIQLSPQFVKLVSWYDNEWGYSRRVVDLVAYTAAKDN

SEQ ID NO: 2548 - protein, 1692 aa, Schizosaccharomyces pombe
MDQSKRLLKSAVPNPPEHFKTGISWLDDLDEKDDDSATSVNYDIPEITEANLCNDSHEALSPCTQPVGNSGRPVEAFKTYPSTPAVPSKSVLFHFYEPDENFSLSDTGRTKSDTALAARESSEKSEVPRDTRSAGIKPYKENNSSNCAISKEAGLRRLIDKDRESFDKNLNQSFTNLTFPEPISDDSDSVEFQRDSLNNNWPASLEGSIHELPRNSDDDGIPASAAHILDLDYHRDSYDSPWKKFLPYPSILSDDSWKAPESWGTSLPTEAIPKQVFTTRFFARPSLGNRKKEFFLRVYRDDRTSVSFICPIGIQTHEVIKLLARLFFLPSSANFYLLLIQFNTERILLPHEQPCIIFERLLSLFGCKVTSDEEINEEDNYSVARLVFTTMDIGADVLRKFSEKKITANLDISRSNLEVIPVKIYPYAHELISLNVSHNLSLDLPLDFMERCVKLKRLDISNNLRSPRGKPITALRQLEVLNMSRNDIYELDPLIFSGLSRNSLKELNIANNKLFFLPHSTRYLVNLTYLDLSYNNFVTFPLIITELSQLETLNFSHNLLSQISSKIGSLVKLKHLYLQFNDLSNRLPQEIGLLKNLETIDLSYNAITNIASLSECPKLNSINVACNLLSFYEYSNPSATFIDFSFCPLTTIDPAFSYSNLVYFDISHAKLIGLKDSVIETLVNVETVKVNYNHFTSISDAISAMQNLKYLSCTNCEMSYVSPNLGKLKHLVHLDLHANNIKIFPEEVWQVSSLKVVNLSSNILEKIKLPVATSKKLTRTISQLKIMRTLSGNPVSSLSSQEFVMPTVEELYLVDNRLGNDCFTALEYFKCLKVLNLSYNYLTEIPSKFFQNFSDLKHLFVSGNELANLSISSTAQVLLETLYANGNRLSSFPKNEALSKSLRFLDISTNNLQNLAVEKAEKKSLTKLPQLEYLNLSGNTWFRFSEHEDTNFTKSYLKNLKFLSIMDLNTKFSNAPSDVLNHFIQRNSPQPNILRYGVCGYLSRSIPVISACELVVNNFLHPQSSLYCVLDSDISAGKNNRVLKFVYDNLASCLAHEINAADSSSEQICNALRRGFLRLNKKLGNVIHYDLRKSSEGDVDSNYVTTMNISEKGYSMDSSCLDIGVSIILVYVRDTRAFVANVGTSMAIMSTRNDSEPTTLSVMHDVYNRDEIRRIVDSCGFISGEIKSTTTRAIGRLSQFPGVQAVPYVNVQYLSELNEFIILANQEFWSVLSKRTVIDVVRANRHSPLLASTKLRDYAIAYGAEKNVLVVIVELNGLFEENSLNFNQLRGDEKTLAISEKNDNMSFVQDLPDDSSLARMNREVSPPKGCIAMVFTDIKNSTLLWERHPIAMRSAIKTHNTIMRRQLRATGGYEVKTEGDAFMVCFQTVPAALLWCFSVQLQLLSADWPNEIVESVQGRLVLGSKNEVLYRGLSVRIGVNYGVTVSELDPITRRMDYYGPVVNRTSRVVSVADGGQIAVSAEVVSVLNQLDSETMSSEKTNVNEMEVRALKQIGYIIHNLGEFKLKGLDTTEMISLVYPVQLQGRLERLIKSRSLGTPTALPETQTYTPVRSRSNSLRPMLARLSDSKSVHGEEGGSGKRSVSSLRNVSPSESTGGYEGCIFDDQQYQLLYELCERLEDHAAILHGFPEPPPCDTGLAAPVNQAEEYSLFYRLTLRIENTIYCVSQMLGHTG

SEQ ID NO: 2549 - protein, 390 aa, Schizosaccharomyces pombe
MVRLPRKFKRVLLLVVLLTLVVFVRFKKQYIPTISVFEGSLIDNRDTLSYFNISNLEPSERSEWLPNKRVNAAFVTLARNEDLNDLLKSIRKLEKTFNHKYHYGWVFLNNEEFSDEFKEHVIEAVSGKCEFGLVPQEQWSIPEYIDQDKMHENWKKLQELGILYADKESYRHMCRFESGFFYRHPLVQKYEYYWRVEPSVDFFCDLDFDPFAYMKENNKAYAFTITVTEYSETIPSLWPSTKEFIKMHPNALHPNNALNFISNDDGETYNGCHFWTNFEIAKVDFWESEVYSKYFDYLDKSGNFFYERWGDAPVHSIAVSLFADRDNIHFFNEIGYWHPGSGHCPLDDATRAKCDCDPYESIDYNGWSCLDKFYTAFEMPFPENWSFYSH

SEQ ID NO: 2550 - protein, 905 aa, Schizosaccharomyces pombe
MKLCLSGSSQAIPSKGISLVAARFQSTASRASYVTPPYEKLMGKLQQVRKFLPGQKLTLAEKVLYSHLVNPEESFSGVSPSDIRGSLYLKLNPDRVAMQDASAQMALLQFMTCGLEKTMIPASIHCDHLIVGHRGANSDIPDSIANNKEIFDFLQSAAKKYGIQFWGPGSGIIHQIVLENYAAPGGMMLGTDSHTPNAGGLGMIAIGVGGADAVDAMTNTPWELKAPKIIGVNLTGAMSGWTTPKDLILHLAGKLTVRGGTGHIIEYFGPGVASLSCTGMATVCNMGAEVGATTSIFPYTDSMRRYLIATHRAEVADAASEVHSEYNYLAADTGAKYDQIIDINLSELTPSLNGPFTPDLSTPVSKFGEAIEKNKWPKKLSAGLIGSCTNSSYQDMTCVVDVVEQAISAGLKPKVPFLVTPGSEQIRATIERDGITERLEEAGATVLANACGPCIGMWKRTDDIASGEPNAILTSFNRNFRSRNDGNPSTMNFLTSPVIVAAKIFSSDLAFDPTHDTLQTPDGKAFKFRPPQGVELPSAGFIAGDSSYIPEPNPQPVPETEVTIDPKSDRLEALEPFEPYQGGEMENLKVAVKVKGKCTTDHISAAGKWLKYKGHLSNICNNTLIGAMNAATGEVNRAYDNGKGMTIPELMWKWKKDGQPWLVVAEHNYGEGSAREHAALQPRAMNGRIILTKSFARIHETNLKKQGVLPLTFVNEADYEKIDAEDKVSTRGIEQLLEGVLDQPITLVVTKKDGSVVEIPCKHTMSKDQIEFFKAGSALNLIREKAHSGVVNQKVIDSIKQQTDHYADAYIFNRHFVIAKGDQLGLPFHLKGVQVGDTIRLDKIASFGSRDFTLFGNPYVDPSLFTIEAVVLSFPKSALSVRVKHKRRHRHDRVMKHKQTYTILR

SEQ ID NO: 2551 - protein, 689 aa, Schizosaccharomyces pombe
MDIKDYYCVETKDSKQPGESYIYRSIHSAGKLLDTPEDGVSTVYDLLCTAAKNHGEKQAMGSRKLIKENREEREIIRKVDNEEVVEKKLWTTYELGPYEYISFNKVYEIALALGSGLVASGITSETTMLFFAATSAKWFTTAQGCSSQAIPIVTAYETLGEDGIYTSLDECKSRAIFTDPNLIPKLLGPLKQSTWVKLIVCSSTPSEDLVELVKSTAPDVEIITYDNLLSLGKEKPQPPHPPKADDICCYMYTSGSTGKPKGVVLLHRNIIAALGGINRILSQHINVKDYVLAYLPLAHIFEFIFEMCCLYWGGVLGYASPRTLTDASVVNCKGDLTEFRPTVLIGVPAVYELIKKGILAKVSSMPAHRQKVFSGSLSLKQYLIERNLPGSAALDAIVFNKVKAATGGRLRYCISGGAALAASTQAFLSSCICPVLPGYGLTETCAGSFVLSPEQWHLYANTVGFPIPSIEFKLVDIPDLGYYTDSSPPRGEVWIRGPAVCNGYLNRPEDNKAAFTEDGWFKTGDVGEIAKGNTLRLIDRKKNIVKSLNGEYIALEKIEAQFFTSPLVSNVCAYADVNHAKPVVIVNPDENGLRTYLTKNSGSSFNGNPNDTLTNLCKDSGVQHLILKELINIGKQQRLASIEIPEGVVLSDFEWTAENNFLTASRKVKRQVIVAHYSDEIQKAYSKKH

SEQ ID NO: 2552 - protein, 1172 aa, Schizosaccharomyces pombe
MKIEELIIDGFKSYAVRTVISNWDDQFNAITGLNGSGKSNILDAICFVLGITNMSTVRAQNLQDLIYKRGQAGITRASVTIVFNNRDPASSPIGFENHPQVSVTRQIIMGGTSKYLINGHRALQQNVQNLFQSVQLNINNPNFLIMQGRITKVLNMKATEILSMIEEASGTRMFEERKEKAFRTMQRKEAKVEEINTLLREEIEPRLTKLRTEKKTFLEYQHIYNDLERLSHLCTAYDYYKLSLKVEELTVQASQKHSHIAEMESSLQTSKQEVLILKEKIKKIEDERMRQMSVSSDRTLDSQLQTVNENITRISTSIELKNTALEEEHGDLQQIRGKAKELETLLRGKRKRLDEVLSVYEKRKDEHQSISKDFKSQEELISSLTTGLSTTEGHETGYSRKLHEARDTLNDFKAEKETNRLKLEGLNKQISLTKPKKAEATKRCDQLNREIDILQNHVEKLKMSLKNTNSDITGEDVLQQKLKQLAKDRGNLLNELDALKSKLAYMEFTYTDPTPNFDRSKVKGLVAQLLTLNEENYDKQTALEITAGGRLYNLIVETEKIGAQLLQKGNLKRRVTIIPLNKITSFVASAERVGAAKKISNNKAQLALELIGYDDELLPAMQYVFGSTLVCDTPESAKKVTFHPSVKLKSVTLDGDVYDPSGTLTGGSVNKSAGPLLQIQKLNSLQLKLQVVTSEYEKLETQLKDLKTQNANFHRLEQEIQLKQHELTLLIEQRETDSSFRLLSDYQQYKDDVKDLKQRLPELDRLILQSDQAIKKIERDMQEWKHNKGSKMAELEKEFNQYKHKLDEFTPILEKSENDYNGVKLECEQLEGELQNHQQSLVQGESTTSLIKTEIAELELSLVNEEHNRKKLTELIEIESAKFSGLNKEIDSLSTSMKTFESEINNGELTIQKLNHEFDRLEREKSVAITAINHLEKENDWIDGQKQHFGKQGTIFDFHSQNMRQCREQLHNLKPRFASMRKAINPKVMDMIDGVEKKEAKLRSMIKTIHRDKKKIQDTVKSIDRFKRSALEKTWREVNSSFGEIFDELLPGNSAELQPPENKEFTDGLEIHVKIGSIWKDSLAELSGGQRSLVALALIMSLLKYKPAPMYILDEIDAALDLSHTQNIGRLIKTKFKGSQFIIVSLKEGMFTNANRLFHVRFMDGSSVVQAR

SEQ ID NO: 2553 - protein, 369 aa, Schizosaccharomyces pombe
MSPTLVVDQENSEEFNTSSFEGPEKLLELWFSAPIKTNLSAGEKANLGLKAVSRNDWDDMLAQAQCKVLSVVNSEEIDAYLLSESSMFVFAHKIILKTCGTTTLLASLPRLLEIASSVGFDRPLRIFYSRKNFLYPERQLAPHTSWEEEVRYLQLFFPSGCSYVVGPTNKNHWHLFSDLADDYSLLEDSLDPEDETLEVLMTDMSPERSLQFYAPSLDVVRSARGDDYVREKNNLSGGHILGSYVADESGVRDLCSTSDKKAVLDAFQFEPIGFSSNMIYKDRYATIHVTPQEHCSYASFETNVSQFQFGRSISETIEKTVKTFGANKFCLTLFQAKGASQEKHFSAKLKSFSSYKREEFIVYDFPGYD

SEQ ID NO: 2554 - protein, 187 aa, Schizosaccharomyces pombe
  unsure (1)..(187): unsure at all Xaa locations
MAGMFRIPIAVVQIAAFVHQIHEYLFQVQMTSGPSMMPTLNSGYXNNALYLWFXLKKGEFVLLDKLHGRFARSCSVGDVVVSAKPSDSKQHVCKRIIGMVSISHGTLSFLYXFYSQGDTIYVDPTSSNKKITIPLGHVWLAGDNIAHSLDSRNYGPVPMGLIKAKVIARVWPHPHWMSNILNDIDVE

SEQ ID NO: 2555 - protein, 428 aa, Schizosaccharomyces pombe
  unsure (1)..(428): unsure at all Xaa locations
MNLTFKNLQQQKFVISDVSADTKVXXLWHIIFLTXTISELKEKIQTQQNYEVERQKLIYSGIXHNFNMXNTNLXVRILADDKTVGEYNIKEQDFIVCMVSRPKTSTSTPKSAASPAPNPPASVPEKKVEAPSSTVAESTSTTQTVAAAAPSNPDTTATSEAPIDANTLAVGAQRNVAVENMVEMGYERSEVERAMRAAFNNPDRAVEYLLTGIPEDILNRQREESAAALAAQQQQSEALAPTSTGQPANLFEQAALSENENQEQPSNTVGDDPLGFLRSIPQFQQLRQIVQQNPQMLETILQQIGQGDPALAQAITQNPEAFLQLLAEGAEGESALPSGGIQIQITQEESESIDRVCYFYFFVLTIXQAFSYVQLGFDRNIVIQAYLACDKNEEVCFFFFFDLLNYQLTIVACCNYLFEHGHESEDEP

SEQ ID NO: 2556 - protein, 1474 aa, Schizosaccharomyces pombe
  unsure (1)..(1474): unsure at all Xaa locations
ECWVSNNNGHWDAARLIEIKDNGGGKVVATVAKSSGVLETVNYQQLQNRNIGQSESPSDLTNLPYLNEPSVLHALHNRYNNKQIYTYSGIVLVSINPYQNLPEFYNDNLIKHFHKDPEAAKVPHLYSIASSCYHALTTDSKNQTIIVSGESGAGKTVAAKYIMRYLTSVQGVDHNGVVKRSVENQVLATNPIMEAFGNAKTIRNDNSSRFGKYVTISFDENLLITGANVNTYLLERSRVVSLLKGERNYHIFYQLITGCTEEQRDKWFLESASSFNYLSQGNCDEISGVDDSNDFTITCRALSTIGISESRQEDVFCLLAALLHLGNIEVCATRNEAQIQPGDGYLQKAALLLGVDSSTLAKWIVKRQLKTRSETIITSSTLEHAISIRDSVAKYLYSALFLWIVHMINASLDHNKVKRAAYKYIGVVDIYGFEHFEKNSMEQFCINYANEKLQQEFNKHVFKLEQEEYVKEGLDWRLIEYSDNQGCISLIEDKLGILSLLDEECRLPSGNHQSFLQKLNNQLPTKHSQFYKKSRFNDGSFMVKHYALDVSYQVHDFLAKNSDAIPDEFISLLQNSKNEFITYLLDFYMQLVSSQNKNPRKTAISRKPTLSSMFKSSLSQLMTTVSSTNVHYIRCIKPNEEKLPWTFSPPMVLSQLRACGVFETIRISSLGFPARFSYEEFAHRFRILLSSKEWEEDNKKLTLNIVNSVIPHDNLNFQVGRSKIFFRSNVIGNFEEAHRATCSKSTVLLQSAIRGFFTRKEYQRTVKFIIKLQSVIMGWLTRQRFEREKIERAAILIQAHWRSYIQRKRYLSLIKCAIVIQSIVRKNIAYSRYINELRESSATLLAKFWRAYNARKTFRGLKKSVIALQCVSRSVLTRRYLRRLQDSAGRTSILYEKQKNLQASITEVSKQLKSNSKKVTVLRNKLNILNNSLSKWKCLIKKPSDFSEPVSMDFTSNDEQLVQLLQAESKLRQASQQLYMAAKKSELGFVQSQTARENLSNYYQALQMTVSEKFEYDTEQLPSRVLFYAMDRYFSIHKKLKQLLELVGVENASLLPNEVVNKQTKDLLYEKRVVFLKQIKQALTVSSLFNAVGYKDGVMRLLETDQNSLLFAGVVNFLIFAGISLDLKTQISEFLSQLCSYFTKIVDGTVIENDKTLDFYEKPLQAVLYWFATLHKIRSFLVHLLSINSHGKQSVVEDLWNPLILKFSKHFSNLENSFHSLVQKLLSCCTEGSINALLNSKCLPEFIDAADENTTPTGMNIYELIDRMNLIHKLLISSALQPNLLELTISHMLQHIGQRAFQTLIHGXGSYQKNYHXHSSRSPYTWKSASQVSYNASLLINWCHQKGISYVNSSLLPLMQSPLVFCLRKNDANDLDVILSVCNLLSPFEVVCLLNRYQPCAGENPLPKSFSKAVEALSCKYKQSGFTNGKITNTNGHAIPIAASKNPLLSLENNHIYEELRLSELINLLAKATL

SEQ ID NO: 2557 - protein, 446 aa, Schizosaccharomyces pombe
MIESCFNVGIWATGLALLMNQGQSPLLSNVGLSVLAYKATAMFIPRVGPSFIKRGFSGKDMNKVEKYVIPETMGAVSALVYFMCMIIFIPVLFYKYLVPNHNPNLPSDGSVAEVAKSQFPHDLLGAYLSALLSILSVSLLGILDDLFDIRWRHKFFLPAIAAIPLLVVYYVDYGVTYVSVPSIVRPFLKRSLINLGFLYYFYMAAVAIFCPNSINIIAGVNGVEAGQSLVLALVIACNDLFYVLSPKNKDALRAHLLSLYLVLPLIGVTAGLLKYNWWPSRVFVGDTFCYFAGMVMAVVGILGHFSKTLMLFFIPQIFNFALSVPQLFGLVECPRHRLPKLNVKTGLLENSYTEFSLNEHPLPKKTLLTISIFEKLRLIRVEYDPSTGRPLRCTNFTIINFVLYHLGPMREDHLTICIMGLQLLTGIFGLIIRHFVAPLVYPEDNI

SEQ ID NO: 2558 - protein, 661 aa, Schizosaccharomyces pombe
  unsure (1)..(661): unsure at all Xaa locations
MAQSSYSSGNSTSDLNKIVLDYLFKKGYSRTEAMLRLEISSVGAIPEEQQDWHIGASETYVQVYILLRDWIDGTLDLYKPKLQKVLYPIFVHSYLDLLQKNDPEMAIYFFESFRIEHEVLHGYDIRALAQLKIASDVEEIEIAQLYRKNKYRINFTRSTFDLLVQFLFENEVNGSGIIIRLLNQYIDIKITMPQVEGKEDPNVQAVYEMDEAKNEQTIISEQEGIPGHSEQLLDYNKQSIQLGLRPLSEEVVTTLKNLLEVKDKDVEGRNEALNKILHPAKNLVELLTEKENLINESTLESPSDPPLPPTKMKDIDYFVSLLESEQNSLILGKNATDPSVFMYTMHNTLSAVNCAAFSDDASMFALGCADSSIHLYSSTNNGPQPLVGSQNEPLQKSSLIGHTRPVFGVSISPQKEFILSCSEDGFTRLWSKDTKSTIVKYAGHNAPIWDVQFSPFGYYFATASHDQTARLWDVEHAAPLRVFVGHQNDVDCKELYLTNNSYEQXLTLIXCVSFHPNAAYLATGSSDHTTRMWDVRTGGTVRVFNAHHSPVSALCMSADGLSLASADESGIIKVWDLRSSNQHVSFVKHSSIVYSLSFSYDNKILVSGGADTDVNFWDLTYRNNLSDGEQSPLLFNFKTKNTIIQNLSFTRRNYCLALSSS

SEQ ID NO: 2559 - protein, 326 aa, Schizosaccharomyces pombe
  unsure (1)..(326): unsure at all Xaa locations
MAPAPPPPPPAPAPAAAAPAPPLMTGDRSALLNSIQKGKKLKKATTNDRSAPVVGGGVVGERKSNTPKSFAAPPVPTGAPSLPTSSNNTQQAEERPSMPALGGLFAGGMPKLRHIGKSSASAAPPSAPAPPTPQSELRPPTSAPPRPSIPPPSPASAPPIPSKAPPIPSSLPPPAQPAAPVKSPPSAPSLPSAVPPMPPKVPPPPLSQAPVANTSSRPSSFAPPAGHAPNVTSESPKFPNRGPSIPSASVPPVPPSSYVLQQRPNRVSLRSLKALFFYXHKTLVDDHGRFHFKDDSYLPIPHPFLGVPKVYRGGSGTTVPLNLSSF

SEQ ID NO: 2560 - protein, 247 aa, Schizosaccharomyces pombe
MAETAEKVILLTGSSKGIGLATAEALQKKAKVIAVSRSLTPELETLLIQNPDSFVHVKGDVTEVGKASIETAIKKFGKLDSVILNAGVLEPIAKIADADINEWRKLFDINFFSVVETVKYAIPHLRKTKGTIVIVSSGAAVRVFPAWAAYCCSKAAINMLVMNLGSEEPDIMSVAVRPGVVDTPMQVSIRNDSNKEAMGGDTHNFFKELKTSGQLVAPQDIAKALSFLALNNNPKLTGQFVEWKSFV

SEQ ID NO: 2561 - protein, 2335 aa, Schizosaccharomyces pombe
MEYFSDLKNKNESIQLAAADQLKEFVHSSTKELSGESLARFNNDINRRIFELIHSHDSHERFGGILAIGKLIEFESEGDVTNLSRYANYLRMTLPSTDWHSMELSAKVLGHLAASGGTLAAEFVEFEVQRAFEWLQGDRQEQKRMAAILIIKALAQNSPTLVYLYISEIFQNLWTGLRDPKPLIRETAADALGASLDVVCQREAKVQLQCFNEVLLQAEHGLRQSSVEYLHGSLLAYKELFEKSGSFIREHYTEFCDLALRLREHRDNSIRRCIVFLLPTLSEYNPKKFQQRYLDSFMVYLLSHIRKDKEKSLAFEAIGRIAMAVNEAMIPYLQNILKVIRDTLTAKVREKTQYEKPVFECIGMLAAAVKLELLEDSRSLLGLIFSCELSVHLRQALVKMAENIPPLLAPIQERLLNMVSQILTGKNFEIRTNDTYTPSFTNIYSAREPDQRSKSTESIILALETLGTFNFTGYSLISFIQESVLSYLENDNSEIRIAAARTCCQVFARDPICRKTNPLAVESVAEVLEKLLTLGIADSDPKIRETVLSLLDERFDRHLAHPDNIRCLFIALNDEVFSIREIAIIIIGRLALYNPAHVMPSLRKTIIQLLSDMEYSGNSRQKEESAQLLKLLVSKARTLIKPYIQSIIHVILPKAADTSPGVSSAIISALGELASVEGEDMPVDVRGSFMKLILVNLQDQSSTLKRLASLKCLRKLCGRSGYVIQPYLDYPPLLGALIGILQSEQPTPIRREVLRTLGVLGALDPYTYLTTEEVSDDLQSSHNNAHGVPQISAAQYPSLENYAMVAVVTLIGILKDSSLSMHHSSVVQAVMHICSQMGSKSTVFLPQVVPTFLQVMQSLSASSAEFYFQQLTTLTSIIGPNIRDYVSDIFNLSKVFWESTTSLLLVILELIDAIAIALQDEFKFYLPQILSCMLKAFSLDNTSSRSVSYKVLQSFVIFGSNIEEYMHLVLPVIIRSFERDTIPLGFRKSALKCIAQLFQSVNFSDHASRIIHPLVRMLGKSNGDLRAVIMDTLCAIVSQLGYDYSIFIPMVNKVLVSHKISHPAYELLVSRLLKGEPLPKDVVVKEFKPRPSTKPFSTQDEVLTKLPVDQASLKAAWESSQKLTRDDWQDWIRRISIELLKESPSSALRSCSTLAGIYHPLARDLFNVSFLSCWDELTESNKKNLVKSIELAMNAPNISVEILQTLLNLAEYMEREDHTLPIPIKVISAHASKCNVYAKALHYTELQFVQETKEEVSISTIESLITINNHLQQSDAAVGMLQYTKEHKQFSLKETWYEKLHRWDDALAAYEHREREGDSSFEINIGKLRCYYALGDWDHLSELAQKAWVTSEQEHREAIAPLAAAAAWGLGQWNLISEYVSAMDRDPQDKEFFSAISAVHLGQYNKAYGHIERHRDILVNDLSSIIGESYNRAYGIMVKSQMLSELEEIIDYKKNMQYENNLDSLKKTWRKRLEGCQKNVDVWHNTLRFRALVLSPQDSPEMWIKLADLCRRSDRLKLSNQCLTYLMGRDPSNAYPLDSLKLLNPHVVYTYLKYLWATDQKNIAVSELEEFTSYLSSKHGYKMGDSSKLVDILASSSVSSEERSFLARCFHKLGKWKKSLQDSVNQESVRDILNCYFYATLFDKSWYKAWHSWALANFEVVGYYEQTEHGVTQDMYEQYIVPAIKGFFHSSVLNQKNSLQDILRLLNLWFKFGEHSDVAAAIVEGFSNVPMDTWLEVIPQLIARIHTSSSSVRASVHQLLSDIGRVHPQALVYSLTVSSKSTNPQQKHSAKSIMDSMLSHSDTLVRQALLVSQELIRVAILWHELWYEGLEEASQAYFSDHDISLMIDIVKPLHETLEKGPSTLSEISFAQTFGYDLRKARSYWQKFLQDGDPTELNQSWDLYYQVFRRIQKQLPRIKHLELQYVSPKLLDACDLELAVPGTYGHNKPVIRISHFHHTFEVISSKQRPRRLTIHGSDGKDYQYVLKGHEDLRQDERVMQLFGLCNTLLTTDSETFKRRLNIERYTVIPLSPNSGLLGWVPHSDTLHFLIKEFRSKRNILLNLEHRMMLQMAPDCDSLTLLQKLEVFEYVMANTDGYDLYHVLWLKSRSSEAWLDRRTSYTQSLAVMSMVGYILGLGDRHPSNLMMDRYSGKIIHIDFGDCFEVAMHREKFPEKIPFRLTRMLINAMEVSGIQGTYKITCELVMRVLRSNTESLMAVLEAFVYDPLINWRLMTKSSFGASTTLRPTSSSVEEKGRSYTHRARHADYAALSETNGVNAEGLNERSIQVLKRVSNKLTGKDFDLKEQLPVKAQVEKLIQQATAPENLCRCYVGWCSFW

SEQ ID NO: 2562 - protein, 366 aa, Schizosaccharomyces pombe
MIRLQKFGEIVGTSRSWKLLSSTIAKRYSSSSNGVKEMTVRDALNSAMEEEMKRDDRVFLIGEEVAQYNGAYKISRGLLDKFGPKRVIDTPITEMGFTGLATGAAFAGLRPICEFMTFNFSMQAIDHIVNSAARTLYMSGGIQACPIVFRGPNGPAAAVAAQHSQHFAPWYGSIPGLKVVSPYSAEDARGLLKAAIRDPNPVVVLENEILYGKTFPISKEALSEDFVLPFGLAKVERPGKDITIVGESISVVTALEAADKLKADYGVEAEVINLRSIRPLDINTIAASVKKTNRIVTVDQAYSQHGIGSEIAAQIMESDAFDYLDAPVERVSMADVPMPYSHPVEAASVPNADVVVAAAKKCLYIK

SEQ ID NO: 2563 - protein, 249 aa, Schizosaccharomyces pombe
MASCCPTSRGAAASNKSYTFKGKEIENFGGLTTYVVGSTSNTRVLIGFMDIFGLSDQIKEGADKLADDGFTVYLPDFLEGKPLPVTALPPKTPEDQKLCNDFFSTRISPNLHWPKLAKVVEAVRANHGPNVTIGTYGFCWGAKVLVTYPATIDFVGIASCHPSFPDSADAANVHCPVLFLCSKDEDAKIIKEWEEAFKTNPAYAKSSFETFSDMFHGWMAARADLSNPEQRKRFDEGYQKVSSFFQSLM

SEQ ID NO: 2564 - protein, 504 aa, Schizosaccharomyces pombe
MSKNSFSSMANSVTSFFQSLTTPNRHADPSFRPSRREKQSRLPTPLQSVAASAYSGVNASQTGLLNDSRANSVTNLPNSSNTSQVGLNNISPAPVGYVPGSKTNELANNSMEMQEISPNGSASLPPPVSESWRRIDRWAEENYYELYCQLCYGATVADVDSLEYELECTLPRDVRESLYIHDGQDRGGQPTGILFGVTLLDIEEIEEESELWRRVAQSYAEATLAGKIDQAVASRQASFPPGAVQCVYAHPGWIPLAKDFVGNNIAIDLAPGPAGQWGQVILFGRDQDTKYVVARSWADFLAIVAYDMENGKWLVDEDDNSLRLIYGPPREQWSYLDILKYRARKAERRKFKKRDGKRTTRPIPKSIAKEDVTNSANSTAPSTGTTVLDDGLDNNYEDIPLYGPSKDEELIKKEELEADTDLGLINTSEINQPANLPDEPTAETSNPVSATTVEAVTTTADNKDEEKNDHVTEDVSQNSTIAEASSLQAQEEEKEIETTSVKQE

SEQ ID NO: 2565 - protein, 521 aa, Schizosaccharomyces pombe
  unsure (1)..(521): unsure at all Xaa locations
MDFYSVKSQPFVRSPLVDQNPSIQNINEEVKRDIQNPLSYKTETSDKELCQTAACATSCSDWYPQQQTHMPHQNAFDSAKATAKMALPPTAFSNYCVKPSLTRNKDIPRTSIRVSKLRYWQRDYRLAFPNFIFYFDNVDEEIKRRVTQKINNLGAVSSSCKNLRRSKLTHIXKVATLFTFEVTHFITTRTTDPEMCQPNDVLYLSKTANMKIWLLDSKSSXYISVTFANFLRLLNRILFTLLNSDSLVNTSASCLQSLLDGEKVYGTSDKDFYVPSKNVEYFREYFLCIRDLSQYYKPIAVREWEKTLDSGEILWPSLAITAQGRCPFNTGRRRELKITKHNHPAHEIRKQLLSCTNQTNQNNVVKNSASVLVRQIMGDYNITESAVDGAKQMPTEFPKPENLLPVEKRAAMSPLNLLEPRLINKQNTLANQSPRQPPNAFDADPLAHKKVKIETKSGYCENCCERYKDLERVSXTNHSKNSTNTSIALGGKHHRRFAEKDENFQGLDDLFLLIRRPIRTN

SEQ ID NO: 2566 - protein, 657 aa, Schizosaccharomyces pombe
  unsure (1)..(657): unsure at all Xaa locations
MLALKLQKKYPELTNEEILTLTDQFNKLDVDGKGYLDQPTTIKAFEDSKKGSYDEVREAIREVNVDSSGRVEPEDFVGVSNVFRNFHDMCLYIASSIGLLMHIIFNVLKKGVEGTEVKKGRITIKGSSSSVSHTINEEERREFIKHINSVLAGDPDVGSRVPINTETFEFFDQCKDGLILSKLINDSVPDTIDERVLNKQRNNKPLDNFKCIENNNVVINSAKAMGGISITNIGAGDILEGREHLILGLVWQIIRRGLLGKIDITLHPELYRLLEEDETLDQFLRLPPEKILLRWFNYHLKAANWPRTVSNFSKDVSDGENYTVLLNQLAPELCSRAPLQTTDVLQRAEQVLQNAEKLDCRKYLTPTAMVAGNPKLNLAFVAHLFNTHPGLEPLNEEEKPEIEPFDAEGEREARVFTLWLNSLDVTPSIHDFFNNLRDGLILLQAYDKITPNTVNWKKVNKAPASGDEMMRFKAVENCNYAVDLGKNQGFSLVGIQGADITDGSRTLTLALVWQMMRMNITKTLHSLSRGGKTLSDSDMVAWANSMAAKGGKGSQIRSFRDPSISTGVFVLDVLHGIKSEYVDYNLVTDGSTEELAIQNGMYIYLIYFXFSLLTHRLARLAISIARKLGAVIFILPEDIVAVRPRLVLHFIGSLMAV

SEQ ID NO: 2567 - protein, 788 aa, Schizosaccharomyces pombe
MEPIIALLIGNGGREHTIAWKLCESPLISKVYVAPGNGGTASNGAESKMENVNIGVCDFEQLVKFALDKDVNLVIPGPELPLVEGIEGHFRRVGIPCFGPSALAARMEGSKVFSKDFMHRNNIPTAVYKSFSNYDHAKSFLDTCTFDVVIKADGLAAGKGVIIPKTKKEAFEALESIMLNEEFGSAGKNVVIEELLEGEELSILTFSDGYTCRSLPPAQDHKRAFDGDKGPNTGGMGCYAPTPVASPKLLETVQSTIIQPTIDGMRHEGYPLVGILFTGLMLTPSGPRVLEYNVRFGDPETQAVLPLLESDLAEIILACVNHRLDAIDIVISRKFSCAVVCVAGGYPGPYNKGDIITFDALKDKNTRIFHAGTSIRDGNVVTNGGRVLAVEATGDSVEAAVRLAYEGVKTVHFDKMFYRKDIAHHALNPKRKTREILTYENSGVSVDNGNEFVQRIKDLVKSTRRPGADADIGGFGGIFDLKQAGWNDPLLVSATDGVGSKLLIALSLNKHDTVGIDLVAMNVNDLVVQGAEPLIFLDYFATGSLDLKVSTSFVEGVVKGCKQAGCALVGGETSEMPGLYHDGHYDANGTSVGAVSRDDILPKPESFSKGDILLGLASDGVHSNGYSLVRKIVEYSDLEYTSVCPWDKNVRLGDSLLIPTRIYVKPLLHVIRKNIVKGMAHITGGGLVENVPRMLPSHLNAIIDVDTWEVPEVFKWLKDAGNVPISDMARTFNMGIGMVVAVASEDAEETMKELTSVGETVYRIGQLVDKESSSERCHLVNLNKWETF

SEQ ID NO: 2568 - protein, 1689 aa, Schizosaccharomyces pombe
MNIAQPVSSEIKSVKFGIYDVDDVEKISVKQIVNPVLLDNLNHPTNGGLYDLALGPYLKNSVCATCHLDERYCPGHFGHIVLPIPAYHPLFFSQMYNLLRSTCLYCHHFKLSKVKVHLFFCRLKLLDYGLLNESEMVENVSLTEAIIKNSNGTPLEDGSDSEDSGLGHDDIAKDAATLMRIRDEFVAKSIADSRQNAHIDAQLTTLLLHERKKVVRAFYHAISSRKQCDNCQSFSPNFRKEGFAKIFEIPLSGKNLQFMEQTGKIRSDVLRDTSKKHHEDEGYDGDSDSSNESEVEGIDLFEEDPNPLKNKSKSPIAHGAKYMTSTEVRNHLRRLFVKENVVLSRLYAHKRGKPASADMFFLQNIAVPPTRFRPASKMGDEVHENIQNELLTRILQSSIQIASLSKDSTVEVNPDEKEGLERRSRAFELLINAFVQLQHDVNSLIDSNRNPSSGGQSRTVPPGIKQILEKKEGLFRKHMMGKRVNYAARSVISPDPNIETNEIGVPPVFATKLTYPEPVTLYNFNEMRNAVINGPHKWPGASHIQNEDGTLISLMPLTIEQRTALANQLLTPQSNLISSPYSYSRLINTNKKVYRHVRNGDMLILNRQPTLHKPSMMAHKARILPGEKTIRMHYANCNSYNADFDGDEMNMHFPQSTNARSEAQFIANTDSQYLVPTSGDPLRGLIQDHVVMGVWLTCKDTFYTRDEYQQLLFQALKPDETGMYGRIKTLPPAIQRPGIYWTGKQIISSVLLNLKPSDRPGLNLKSKAKVPGKYWSPDSEEGSVLFDDGELLCGILDKSSFGASAFGLVHSVHELYGPDIAGRLLSVLSRLFTAYAQMRGFTCRMDDLRLDEQGDNWRRQLLENGKSFGLEAASEYVGLSTDSPIALLNANLEEVYRDDEKLQGLDAAMKGKMNGLTSSIINKCIPDGLLTKFPYNHMQTMTVSGAKGSNVNVSQISCLLGQQELEGRRVPLMVSGKSLPSFVPYETSAKSGGFIASRFLTGIAPQEYYFHCMAGREGLIDTAVKTSRSGYLQRCLMKHLEGLCVQYDHTVRDSDGSIVQFHYGEDSLDVTKQKHLTQFEFSAKNYKSLIQKYKVKSVLSAVDSETASSYAKKALKKPYKYDPVLDKYPPSRYLGSVSEKFQRAVDEYTQKNPDKLIASKKESKLDDSLLNESKFKALMQLRYQQSLVDPGESVGVLASQSIGEPSTQMTLNTFHFAGFGAKNVTLGIPRLREIIMTASANIQTPTMTLRLNDGVSDKRASAFCKEVNKLVLSEVVRQVRVTEKISGQGSDEQSKTYAIRLDLYSRDEYQDEYGVLQEEIESTFSNRFLKILNRIIKSYLAKSKQRKSGGKDDTVPEVGQALKPLEDIDEAPIEGRAQEALEDEDNDATNEKMVSRSKQHASYEGPDEADKVALRQLKGSNKVEDVNMDEEEDEGFKSDESVSDFKERKLLEKQNTVSISERRELQLKTAKEILSNCKHLDFDYVNGEWATVELVFPINTEKLLMVSLVEKACSETVIHEIPGITRCFSKPPDSALDTVPKVITEGVNLKAIWEFYNEISMNDIYTNDIAAILRIYGVEAARNAIVHEVSSVFGVYGIAVDPRHLSLIADYMTFEGGYKAFNRMGIEYNTSPFAKMSFETTCHFLTEAALRGDVDDLSNPSSRLVVGRVGNFGTGSFDIFTPVVDSPAN

SEQ ID NO: 2569 - protein, 302 aa, Schizosaccharomyces pombe
MALGTKHVLHLTKPSSRSSPLNIVIEPAVLFSILDHSTRKSENNQRVIGTLLGTRSEDGREIEIKSCFAVPHNESSEQVEVEMEYHRAMYHLHLKANPREVVVGWYATSPDLDAFSALIQNLYASPAEPGTAPLGTYPHPCVHLTVNTDVSSPLAIKTYVSSPVGITERLADSCAFVPTPFTIRDDEAVRSGLKAVAAPKNDPSRLASLFTDLQQLRRSTLELLSMIERVSDYVQNVIDGSSPANVAVGRYLMKCFSLIPCVEGQDFEKIFSSHLQDVLVVVYLANTLRTQVDIASRLNLLP

SEQ ID NO: 2570 - protein, 318 aa, Schizosaccharomyces pombe
  unsure (1)..(318): unsure at all Xaa locations
MATTVKDTMNVDINAIKKGYDCGKLILKVLTLXEIRMGTTITALRYKDGVILAADSRTTMGVYWNIRTFRSLISNVARCYIANRVTDKLTQLTDNIWCCRSGSAADTQTVADLLKYYLSMYRXVTLEXTEXLXIKAALAGLSFRINYRLTLKSLCLLDDYXSLFACFIFHFIVVKKIIXRLXSIQFGHDPSVHTAATLASEMCYQNKNMLSAGLIVAGYDEKTGGDVYSIPLGGSLHKQPLAIGGSGSAFIYGFCDANFRENMTQEEAVEFLKNAVALAMERDGSSGGTIRMVILNKDGMERKFFAIDTANPIPVFTH

SEQ ID NO: 2571 - protein, 510 aa, Schizosaccharomyces pombe
  unsure (1)..(510): unsure at all Xaa locations
MDLEHKRISRSTLPDYADPDYFEARGERNPVKPQSSNVVPGTSHIGSIKSPADYVFGDIIGDGSFSKVSXYIASQFRSFSTAGRLTYGPSITDEXVVXYSLGRRATDKKSWKEYAIKVLDKKYIVKENKVKYVNIERDSMMRLNGFPGISRLFHTFQDDLKLYYVLELAPNGELLQYIKKVYFFISLFIFPLLTKLWXYRFLDENCVRFYAAEILSSIEYMHSCGIIHRDLKPEKYVXVVVIKCSFPFPNSNLFFSILFDGNMHVKITDFGTAKILPPKYVNSPDYTTFPSSFVGTAEYVAPELLSRQVVSKIVRKPIIPVYFFSDKYLSSDLWAFACVVYQMIVGSPPFHGSNPNNIFKKIMSLEYELPKLLPPDIVPLFSHLFRIQPSDRSTTQQIKQFPFFATITWDNLWTQDPPPMQSFRPNYNIAIPNAPAYYRSNVTAAAAANAAAAFASASIVKHQETARRQELPTVNRFTAPTAHYGYASLRSHQMPVDRLYYKLVPSSESI

SEQ ID NO: 2572 - protein, 250 aa, Schizosaccharomyces pombe
  unsure (1)..(250): unsure at all Xaa locations
MAGKKKHLLKVIILGESGVGKTSIMNQYVFXNMLMLXLSCLKXKLLTKSVXYVNRKFSKDYKATIGADFLTKEVLVDDKVVTLQLWDTAGQERFQSLGVAFYRGADCCVLVYDVNNSKSFETLDSWRDEFLIQASPSNPETFPFILLGNKVDVEEQKRMVCVXSIEFLIQSXEFLANNFRFSKSKALAFCQARGEIPYFETSAKEAINVQEAFETVAKLALENMDSDDIAADFTDPIHLDMESQKTSCYC

SEQ ID NO: 2573 - protein, 1204 aa, Schizosaccharomyces pombe
  unsure (1)..(1204): unsure at all Xaa locations
MDPHWKRHDSSNIPTQPSPSASPKSNKPSSAQRFGNLPWVGKFCQVRXSILQLXNKFFFEFXIFFFHLARFFSFFLLPEYLSLTQLFAPDVIQSQIEYLQALQMQQSLSESENYLQPNFFPFQSGPFSKSRRENTLLPRLNPLAPIGARQPNPSIPQQFSKPINESGTGTMGPAVGELTSPVMKNRAESIFSPVTESFEAFTQGMQTTPQRAGAGVSTATSHTRRRSSAGTDPFSPVSPSNPNFLTPLKPIDGNQEWQQSPLESPLSMHSLQESLHSVEPESPIFQQAPQIPLSNASQQSYINHSSDGASLPQSSFLNFNSSGKRVSVSAAAQQHKNLFLPYLPQASLPKFIGTGKLLVGTLHINRKNRSDAYVITDVLDEPIFICGSKDRNRTLEGDLVAVELLDVNEIMQTKREKEEKKIRRNLSLSGSSKYSVNSKAKMMSISTPMALGMNRGVLSFERSIEKRKNDYEVTGQSLSFVDDVSLTPDSAPKYAGHVVAVLNRPSGETCSGTLALYRPNSLALKNQSSHRRNSSTSSGETGKGPKIVWFKPSDKRIPLIAISSDQVPPTFFTNNDDFKDKVFLAGIKRWPTTSLHPFGTLYESIGTIGDPKVEYKAILHDFSCHTYDFPESLSHCVKRLPTPIPAEELQKRYNLRDKLTFMIGTRDYALHIDTGSIDGVITLGIHVADVAYYVKQDMPLDDEAANRVSEVQLLQGSVPFLPKKVSEEISLIEGHDCLTISIVVQLDLKSGAVLQCSLGPSVIHPSSFISLESAQANLQTNEALQLVDASAHVLTKLRLKTDKKLDLQSLYCFEFCDGQIPNIQNINMSIFEAFPIACSLQQIEHWVNEKVASHLMSVFPSKVILRKNQRPSDFASLVAVSELTGVNLSASSTPSEIMTEIATTKDKRTKMLLQLTLRRMCNESEYTIGTSNAKDVSHFVFSCPYYTHFCHPTRRYIDICVQRQLREAFDGRPDFSKDYRSLLSITQSCNTLSNFYRNAQEKSLHAYLCQLLHSINLRSGLVKHKAFVLAVDQEYIDIVIYEFGLERRISLDLLPLSNCDFNEQKHELYLSWRTNASFFYASSSLEIDTPCFNDFKKKFLDSNGMCKQICDMMDAQVRDLANAAESQESFYSKARGNDSTSKTAKSSSGNQDISGDGKLHSLRMKEPEVVQTIRPGQEVSVLIFADTSATYSLSLITLQSPLSS

SEQ ID NO: 2574 - protein, 316 aa, Schizosaccharomyces pombe
  unsure (1)..(316): unsure at all Xaa locations
IYXLLLVRGSRPGRQVQLSEDEIRFLCNKAREIFISQPILLELEAPLKICGDIHGQYYDLLRLFEYGGFPPEANYLFLGDYVDRGKQSLEVICLLLAYKIKYPENFFILRGNHECASINRIYGFYDECKRRYNIKLWKTFTDCFNCLPIAAIIDEKIFTMHGGLSPDLNSMDQIQRIMRPTDVPDTGLLCDLLWSDPDKDLTGWGDNDRGVSFTFGPDVVSRFLHKHDMDLVCRAHQVVEDGYEFFSKRQLVTLFSAPNYCGEFDNAGAMMSVDESLLCSFQILKPAEKKQRYGYQGSSQNWHMTPPRKNKTGNSK

SEQ ID NO: 2575 - protein, 399 aa, Schizosaccharomyces pombe
  unsure (1)..(399): unsure at all Xaa locations
MSASRTNVNVAIVGKHTINXMLECFVKRKLITXKXIGTGNIGGELLNQIKGFNENASTNGTTSFNVVAISSMEGHYVSKDYQPINLSEWKNLTSQNQGAYSLDALVDFLAKSPLPAILVDNTASEAIAQSYPKFLSKKINIATPNKKAFSASNDVYQNIIKASKESGALLMHEASVGAGLPIISTLKELIATGDEIIKIEGIFSGTLSYIFNVWSPNGKKGTASFSDIVKIAKQNGYTEPDPRDDLNGMDVARKVTILSRIAGVHVESASSFPVKSLIPEPLKSAVNAEEFLAGLPNFDSEFASMREEAEKEGKVVRFVGEADVANKTTLVKLEKYDASHPFANLQSSDNIISFTTKRYHTRPLVVIGAGAGAAVTAAGVLGDMIKIMSQVRASDAPSA

SEQ ID NO: 2576 - protein, 517 aa, Schizosaccharomyces pombe
  unsure (1)..(517): unsure at all Xaa locations
MAESLIQKLENANLNDRESFKGQMKAQPVDMRPKTEVSDXVIRIGVDXQLPDVTKTRGTEFEDYYLKRYDGFFLMKFVYXHMVYSELLMGIFEAGFERPSPIQEESIPIALSGRDILARAKNGTGKTAAFVIPSLEKVDTKKSKIQTLILVPTRELALQTSQVCKTLGKHMNVKVMVTTGGTTLRDDIIRLNDTVHIVVGTPGRVLDLAGKGVADFSECTTFVMDEADKLLSPEFTPIIEQLLSYFPKNRQISLYSATFPLIVKNFMDKHLNKPYEINLMDELTLRGVTQYYAFVDESQKVHCLNTLFSKLQINQSIIFCNSTNRVELLAKKITELGYSCFYSHAKMLQSHRNRVFHNFRNGVCRNLVCSDLLTRGIDIQAVNVVINFDFPKNAETYLHRIGRSGRFGHRGLAISFISWADRFNLYRIENELGTEIQPIPPSIDPSLYVFPNGDYQIPRPLTASADQVLAAQQAKGQEGYHNRPNNNRGGHPRGGGNRGGYRQSNRQPRYRGQQKAD

SEQ ID NO: 2577 - protein, 547 aa, Schizosaccharomyces pombe
  unsure (1)..(547): unsure at all Xaa locations
MAEAHITLSPKVTHEQQTDIDSECEITEVDDENVNENKSQEMIQDIPARDREEIENITRTFVELQENYRLIEKIGEGKLQLPFLVLFXNYLANSFRTFSSVYKAEDLHYGRYINDWDIQSEVLKESSFGKEKIPVNEDSRKPKYVAIKKIYATSSPARIYNELEILYLLRGSSVIAPLITALRNEDQVLVVLPYYEHTDFRQYYSTFSYRDMSIYFRCLFQAMQQTQTLGIIHRDIKPSNFLFDVRTKHGVLVDFGLAERYDGRQQSHSCRCTNSNAAELAHDFSIAQETSLGYIKNDTRPSKRANRAGTRGFRAPEVLFKCSSQSPKVDIWSAGVILLSFLTKRFPMFNSKDDVDALMEIACIFGKSEMRQCAALHGKNDLMSLTEVFVLIFFANLPGCTFETNVSTLTEKRVNFRKLILWASCGSASIYKEKLRHKPSQEERLCLDFLEKCLELDCNKRISAEEALDHDFLYLDNLAYEKKDDDTAFDNSFGETSFEKDEDLTAKHLSHILDFKEQEETDEPTSLSKRKRSIDEILPNDALQDGA

SEQ ID NO: 2578 - protein, 569 aa, Schizosaccharomyces pombe
  unsure (1)..(569): unsure at all Xaa locations
MTSYGNGFRMMAKCLLSLRSGYSVTAPVSKSMANVLWARYGMCCXSXCRYCLLKETGYICXYSTCSXESTFAKCICLKLYFESSGRCXFQNNXIILHKVIFTHEXEFSTMFSSFHSVSSGFTFSYVVSISKIINYIFASTRIKTPPFPESITEGTLAQWLKRKLIHKKKIFCYYKYXLLLIEPGEYVNKDEEIASVETDKIDAPVTAPDAGVLKEQLVKEGDTITIDQDIAVIDTSAAPPEGGSAGPKKDEVKTADADAAKDLSTPQDSSKPIEEKPMPDLGAEQKESAPSSTKPAPDAKEPEFSSPKPKPAKSEPVKQSKPKATETARPSSFSRNEDRVKMNRMRLRIAERLKESQNRAASLTTFNECDMSAVVALRKKYKDEILKETGVKIGFMSFFSKACTQAMKQIPAINGSIEGEGKGDTLVYRDFCDLSIAVATPKGLVTPVIRNAESMSLLEIESAIATLGSKARAGKLAIEDMASGTFTISNGGIFGSLYGTPIINLPQTAVLGLHAIKERPVVINGQVVPRPMMYLALTYDHRMVDGREAVTFLRLVKEYIEDPAKMLLV

SEQ ID NO: 2579 - protein, 423 aa, Schizosaccharomyces pombe
  unsure (1)..(423): unsure at all Xaa locations
MNKGPRHRPKFLSKKGKKLRIMVAGSSYTSYQACINSLCSKQILEAETEIDPLKAHIDRILEIREFNAGELLRFXFSCANCNXDILEDEFHVDLTVIEVNGFGDKIDNSARXYQKVFFXIKANFNALVFEVVTHYLESQFDQALIEESKIKRNSKFTDTVRNLQTKFFRPXLFQSSYFHYLIXCCXVENQENTLVXEXGMKKKFSNDILARDALLYFIAPRGHCLSEFDLEAMKRFSKRVNVIPVIGNSNAFTEEELKNFKDVIMKDLKQCNIKVFDFPWDPEEDEDEVIEDNKRLWESVPFAVSGGVSEEDEEGYQRIVKKFQWGTFVIDDPAHSDFLNLKTVLFISHLDILKSITKQTYYENYRTEKLSNDSPSNTSLXEINYAXASXXVRSLQKQNSIVANEDKRSVNGSERTETRSSID

SEQ ID NO: 2580 - protein, 574 aa, Schizosaccharomyces pombe
MLSKFYEDIDSKLENAMLSQIESSTITCDGKSLNTLPTPKQEDVEFGVPLQPEDTQDLQRKLKPRHMQMIAIGGCVGTGLFVGSGNALADGGPASILIAFAVIGTYVLFTTSALAELSAIYPVSGSFYTYFSKFIDPAWGFAVGIQYWLSFAVTVPLELTVAPLIINFWNASGPVSIWISVFYVIIIAINIWGTEGYGEVEFFLSIMKVISVIGFVILSIIIAAGGVPTDDRGVIGVSYWKQPLVFNNGFKGLCAVSVIAIFSLSGTELVGLAASEAKNPQKTVPAAVKQIFWRIFLFYIVALFMLTLVVPSDLPGLRTSDNSNVLISPFVIAIQLANIRALPSIMNVVILLSTLSVGNSASYAASRALFALAKNGYAPKIFNKTNKRGHPIYAIAVTLLFGSIAYFTEAGVGGALFGWLLSICGLSTTFIWGSICLAHIQFRRAWKIQNRKLEDLPYRSIFGVYGSIYGVAMTILALIAQFYVAVFPIGKKPNPVDFFQAYMAAPILIISFVAWKFFRRTSFVRIEKIDLSEGAHGEQKQNLEPVINIPVEEIDFPMKVATKESMKNVEKNAL

SEQ ID NO: 2581 - protein, 335 aa, Schizosaccharomyces pombe
MDIEKSDKWTYVKERKVGEGTYAVVFLGRQKETNRRVAIKKIKVGQFKDGIDISALREIKFLRESRHDNVIELVDVFSTKSNLNIILEFLDSDLEMLIKDKFIVFQPAHIKSWMVMLLRGLHHIHSRFILHRDLKPNNLLISSDGVLKLADFGLSRDFGTPSHMSHQVITRWYRPPELFMGCRSYGTGVDMWSVGCIFAELMLRTPYLPGESDLDQLNVIFRALGTPEPEVIKSMQQLPNYVEMKHIPPPNGGMEALFSAAGHEEIDLLKMMLDYNPYRRPTAQQALEHHYFSALPKPTHPSLLPRKGGEEGIKHVSSDLQRQNNFPMRANIKFV

SEQ ID NO: 2582 - protein, 628 aa, Schizosaccharomyces pombe
  unsure (1)..(628): unsure at all Xaa locations
MSLGGPQIPVIGKFVCRXKYLXSFAVLKEGTDDSQGRGQLLSNINACVAVQDTIRTTLGPLGADKLMVDDRGEVVISNDGATIMKLLDIVHPAAKTLVDIARAQDAEVGDGTTSVVVFAGELLREARTFVEDGVSSHLIIRGYRKAAQLAVNKIKEIAIHLDLSDEGXDFXFIEFLSGHCLTSLLRISFVKFIIGAFRYTFFITYXKDFXLFYICSVYXYFTEKLRDLLTKCASTAMNSKLIRSNSTFFTKMVVDAVLTLDQEDLNENMIGIKKVPGGAMEDSLLVKGVAFKKTFSYAGFEQQPKFFKNPKILCLDVELELKAEKDNAEVRVDKVQEYQNIVDAEWRIIFSKLEAIVATGAKVVLSKLPIGDLATQYFADRDIFCAGRVAADDLNRVVQAVGGSIQSTCSNIEEKHLGTCDTFEERQIGGDRFNLFEGCPKAKTCTLILRGGADQFIAEVERSLHDAIMIVKHALKNNLVVAGGGACEMELSKYLRDYSLTISGKQQNFIAAFARSLEVIPRQLCDNAGFDSTNILNKLRMQHAKGEMWAGVDMDSEGVANNFEKFVWEPSTVKSNAILSATEAATLILSVDETIKNEPSQQPQAPQGALPPGAANRIMRGRGRGMPR

SEQ ID NO: 2583 - protein, 232 aa, Schizosaccharomyces pombe
  unsure (1)..(232): unsure at all Xaa locations
MSSVPIRTNFSLKGSSKLVSEFFWFVNVSNMPCXLNEEYAVNSILFQRGIYPAEDFKVVRKYGLNMLVSVDEEVKTYIRKIVSQLHSELLFYYHFWNXQIFRMMFAKKIQKLILVITSKCSGEDLERWQFNVEMVDTADQFQNIGNKEDELRVQKEIQALIRQITATVTFLPQLEEQCTFNVLVYADKDSEVPTDWVDSDPRILRDAEQVQLRSFSTSMHKIDCQVAYRVNP

SEQ ID NO: 2584 - protein, 243 aa, Schizosaccharomyces pombe
MSLAFTLLTSKDNTDEDEEHLELSSFNQEKLLEMISVFLSRLTRLNDSKQEATESDQIPLSPTSLKNPCLIFSAKNVPSISIQAYLTRILKYCPATNDVFLSVLIYLDRIVHHFHFTVFINSFNIHRFLIAGFTAASKFFSDVFYTNSRYAKVGGIPLHELNHLELSFFVFNDFNLFISLEDLQAYGDLLLSWYRQNGQNYNPTDVSCSIESPISHTPQQNQQDEQPRRPIMDRRLLSSHSIG

SEQ ID NO: 2585 - protein, 558 aa, Schizosaccharomyces pombe
  unsure (1)..(558): unsure at all Xaa locations
MFRTTKSRVVEKNQNFSSASFESLSYPTRLNFYKKPPVSEISIEEFETWAIDRLVVCFPFSLLFSILLEXANYLVLGEIESAMLRNKTKNELNGIIKKILDKRLPMSSNMARTVKGNSLDEERRKDHYSHFILRLAFSRSXVKMCYIXVLSVEKYLIXTYKCVRVMAXVVNXTXSGYQFAASVKQKALYIXIHLNLLLFFSXRIHXXELRIRFLRAESTLFRFRFVNEETRERQAFIDSLDFQWESVSQEEKDVFYEKLQASSQRNIENESFFKVPFFKVPDLVERRAVFVHKGYAYVPFSEQVSLVVEEFEENLKKALESTAKSLPRLDEDDRLLPILNHLSKGFVAPESSIVAPKSGAITAGQVDSFVSHFPLCAKHLHEVLKRDKHLRHFGRLQYGLFLKVXNLFFMXXFTNFSGYGLSVDEALVFWRKSFTNVTEDKFNKEYRYNIRHTYGLEGNRKNYKGYNCQQILTGPQLGPGDAHGCPYRTYSVNNLVSALASMGIAPDSAGCREVVEAVKARHYHIACTRVFELTHPNVGSLEESIHHPLQYFQLSLES

SEQ ID NO: 2586 - protein, 578 aa, Schizosaccharomyces pombe
MQFCFRILILYISLSIDNNYLVTTLISLKENVFLHIFTLTFLFKAFLLKMAKRSVEELKRSADEEASVKRKEKKSKHEHKKHKKDKPSADKDRISKKDKKKSKKGKSKTKEESIEINAEEGAKIAQPAIGSANASNHNDEEAYDRYIKKHNISFADPKSSENLLPILQFDELDVSAKLREGLKNYKEPTPIQAATWPYLLAGRDVVGIAETGSGKTVAFGIPALQYLNGLSDNKSVPRVLVVSPTRELAIQTYENLNSLIQGTNLKAVVVYGGAPKSEQARAAKNASVIIGTPGRLLDLINDGSIDCSQVGYLVLDEADRMLDTGFEQDIRNIISHTPDPTRNGSRQTVFFSATWPESVRALAATFLKDPVKITIGSDELAASQNITQIVEILDDPRSKERMLDNLLRKHLSSGGKDDKILIFVLYKKEAARVEGTLARKYNVVGIHGDMSQGARLQALNDFKSGKCPVLVATDVAARGLDIPKVQLVINVTFPLTIEDYVHRIGRTGRANTKGTAITFFTPQDKSHAGELVNVLRQAKQDIPEGLFKFGTAVKPKLNAYGSRVVDVPVKAATKIVFD

SEQ ID NO: 2587 - protein, 739 aa, Schizosaccharomyces pombe
  unsure (1)..(739): unsure at all Xaa locations
MSQQLSFNASSAKPDKSFSNYFWVWCLSQRGXLIICQNFRFLCXTQHLNXHSLLGANDEGYHALLSRFSDVKHINEELRSFYHERXEIXGEAGFNMLXSFILTSTLEANIEEDYAKRMAKLSRTTFSSLETGCLKESVQVMKAEVDNMAKSHLQISQLLQDDVENAFTRYAASLKDKKKMIVSGIEKVHKDKLSKHQALVKAQDKYHYLCKKVNYYVSQQNMLFGKELEKNNAKLNKTQNAITASSSDYQSAVAAVRDSYARWTNEWRSTCDKLQDIEEERRHFLKSVMWTFTLLISRSCFNDDQACERIRKNLEQCSVSQDVLEFIDAKSTGTGIPQPPKFYDYYKGEVPDDSVELVQANFQRAQTKIENDNMPLNRPYVLSATARNESSFENTLPNTPSAIQSLTTVSSNSSQNGRSSPKKSFLSKFKLTSRPSTPNVGNTAPDALSSPRNDSPLTSAADEQMKHLSLQEEPKQNPTPAAPGAFPNSNTLPPRYNELGSLPSPNSVSFTEDSRPNVNTPSRRQQIQEEFGSVLQMENRAVSPVYDSRKNGSRSSFTLRKSRSPKRPSSSLSQNASRLPRSLTPGNLEPNYDFGVRVDPASGTAPTDDEPYTDRDSSFVDDTINTKATGNTSNRLSLPAYPTDGGDTSIDNPTSTDGQRILGYGMSNLSIAITITNLNLVSALYDYDAAIPEEISFRKGDTIAVLKLYEDGWWEGFVVGEDDHNRGQFPSNFVREIEV

SEQ ID NO: 2588 - protein, 284 aa, Schizosaccharomyces pombe
MKTTMLMLVLLVCSYIHYVCAQIRFVTPATTDSMDFTAISFSWEESNTGIPLEDITNTVFYICSGSMDAPQPCAVLYTSPSPSSISQAGPFAISQVFGPAGRLYFLWAQSTYAGGIVNDYTDFFTVNGLTGTFDNYEIYASLMALGVYPYVPTLTGFSTFLGVWPTGTMRDWYLSQTTGVLRTGPIQNRPDSTFTAATTDIQPLWETSSYSVFTTFAGPPIATSTVFASPTYMYTLYANYASTASKPTIIATPTAGLRRRDSWAQAAPKRGMRLGEHKRGLLYS

SEQ ID NO: 2589 - protein, 531 aa, Schizosaccharomyces pombe
MGFKRGKNFTLVMLIFVSMAGWMFGADTGSIGGVTSMRDFRERYADRYDPITDQYSLSSARQGLLTGMVNVGSLFGCIISSPIADRFGKRLSIIGFCAVYIIGIIVQVTAVPSWVQIMVAKIWTGIGIGALSVLAPGYQSETAPPSIRGTVVVTYQLFVTGGIFIAACINMGTHKLHKTAQWRVSIGINLLWGIITMIGILFLPESPRYLIQVGKDEEAVRVLSESAELFPDSEEVQNEYHRLKSSIDEEFAGGPCSWASIFGKDIRYRTFLGMFVMSLQQLTGNNYFFYYGFSVMQGAGINSPYLSAMILDAVNFGCTFGGMYVLERFGRRNPLIIGGIWQSICFFIYSAVGSRALYHKNGTSNTRAGAVMIVMACLFIFGFAQTWAPAAYVIVGESYPVRYRSKCAAVATASNWLWNFLISFFTPFIQASIGFKYGYVFASCNLTGAIVIFLFAKETKGLTLEEINELYMSVIKPWESGNFKLNYSEQKKVEKEKSRKGGARGESVEYVERASNTDSSPQYSSHEEDYA

SEQ ID NO: 2590 - protein, 514 aa, Schizosaccharomyces pombe
MALLNRLAKTFSPYYGLNKVEQKLLIKIDWFILSYCCVSYFINYLDRSSINNAYLSGMQEDLKMHGNELQDINVVFTCGYIIGQLPGSYALQRVPARLWFSVMNILWGLMTIFSFAVHSVRALMILRFFMAVAEASTFAGTHYILGAWYKESELCKRAGIFSASGLVGTMFAGYLQTAVHSSLNGKGGLSGWRWLFIIDGILTIPLSLYGLFLFPDVPETTKAPYFTEQEKELSFKRLPARPKKKPLTLKAIKDIVRSWRIYGLCILWIFSGETQAIAVNVLMGQWMKWSNKFSVAQINNYPTVITAVGVVSTLGASVISDKLAGNPRWPFGLFLCVITTVSATILLAWNVPDGAKFFAYFASGCTYAGQAVWFSWANDICRDNDQERGVVVFLMNMCQNIWHIWWAPIMYPNTDTPRFIKGLIGLLVVGGIVFVSSCIVSYMQIRDKRIKRSIQDAKDFDDVFTEHESLELKKIGKNDEESLNTTNAVKEISSPGLVITRQRISMPKETNAQD

SEQ ID NO: 2591 - protein, 385 aa, Schizosaccharomyces pombe
MALLNRLAKTFSPYYGLNKVEQKLLIKIDWFILSYCCVSYFINYLDRSSINNAYLSGMQEDLKMHGNELQDINVVFTCGYIIGQLPGSYALQRVPARLWFSVMNILWGLMTIFSFAVHSVRALMILRFFMAVAEASTFAGTHYILGAWYKESELCKRAGIFSASGLVGTMFAGYLQTAVHSSLNGKGGLSGWRWLFIIDGILTIPLSLYGLFLFPDVPETTKAPYFTEQEKELSFKRLPARPKKKPLTLKAIKDIVRSWRIYGLCILWIFSGETQAIAVNVLMGQWMKWSNKFSVAQINNYPTVITAVGVVSTLGASVISDKLAGNPRWPFGLFLCVITTVSATILLAWNVPDGAKFFAYFASGCTYAGQAVWFSWANDICRDND

SEQ ID NO: 2592 - protein, 524 aa, Schizosaccharomyces pombe
  unsure (1)..(524): unsure at all Xaa locations
MDNENNKNTKNSQQDSSFSEGGIRELLDRLALRSLIEKEEAAAPPKTYEDFKFWKTQPVPKFGMPILVCXNILXDSFIHINAYHNDDECTQEGPIDPNTDINQVPREPYRLLKEFEWATIDVTNDNEVSVVXCFLLRIKKQNLLTFLXLSEVHELLTENYVEDATAMLRFAYISEFLRWALMPPGYVKEWHVGVRVKSSRKLVAFISAVPLSIRVRDKIIKKCAEVNFLCIHKKLRSKRLTPLLIKEVTRRCHLENVWQAVYTAGVLLPSPVSLSRYMHRSLNWKKLYDIGFAPFPLGSTEKKETAKYHLPPNTQTPGLRPMELKDVPAVQSLLSQYMERFELAHLFSEEEVRHWFLYTDKVSSGPVVWSYVVENPESKKITDFFSFYSLPSTVIGNPKYKDIQAAYLYYYASDSCPKDLSSESQLAFVERCKLIVNDALILAKKVSLYGFITCXXFKTVHFDVFNAVTVLDNNLFLKDLKFGEGDGFLNYYIYNYNCPKIPGGIDASKSVDYSRPSGMGFVMI

SEQ ID NO: 2593 - protein, 319 aa, Schizosaccharomyces pombe
MLFNNFLCFAVSAIPLVSAMPLGNAPYHHHHHAGLNASNITVGVNVTNTTAFSKRDGGFPDGVYDCSSFPDDQNGVVRLDYLGFGGWSGVQKNDGKYGTASTCQDNTYCSYACKPGMSKTQWPSEQPDNGVSVGGLYCKNGKLYLTQKDNSNLCEDGKGTAYVKNTLSSNVAICRTDYPGTENMNIPTNIDGGSKQPLSDVDEDSYYNWGGKKTSAQYYVNKSGRSAEDVCVWGNEGDDYGNWAPMNFGSGYTDGKTWLSMSFNPLSSAKLDYNIRIKSDGGSLSGDCYYEDGSFHGSTADSSGCTVSVTGGNAYFELY

SEQ ID NO: 2594 - protein, 775 aa, Schizosaccharomyces pombe
MNEKKKDSLSVLDSNEFFGETTMVSPSIDVSSSPRPNVERFSPCSTKKDLLEGNNIMTRIPEELSRVSLQFDSKGSQQSMIFTNNRCLSDKENLENLQNLLYLHCDLNRPHLSCELPSEHREKCLKRRNSSLSSNLHANKRFLFNSQSDGNKKNETFPSTNYSNVFYPNNCDSKEVASETTFSLDAPNNSVNYSYFSPNLLGNDSKTRQSFPPHSSSSSHNSLHEPVIYDFSSENPSIHPSNHLSSQKNAVLKLAQLISSFEKLPESVRQYLLFHLLSRCGKHAVQNIHKILLPIFQKNFLTGFPAEITNLVLTHLDAPSLCAVSQVSHHWYKLVSSNEELWKSLFLKDGFFWDSIDSKIRTMCLEQSLSACAIMKRVYFRHFNLRERWLHAPEKIKRCSFPIHGVRLITKLQFDDDKIIVSTCSPRINIYDTKTGVLIRSLEEHEGDVWTFEYVGDTLVTGSTDRTVRVWDLRTGECKQVFYGHTSTIRCIKIVQGNQSTTDTDDVEKENRPASNDANSMPPYIISSSRDCTIRLWSLPCLDDPPFVNVNENPDQNNDFTSATTNPFYIRTLRGHTDSVREVACLGDLIVSASYDGTLRVWKASTGVCLHVLRGHVGRVYSVTINPSRQQCISAGTDAKIRIWNLESGELLQTLHGHSNLVSQVTFNQNILVSASAPPDTSLRVWDLNTGSCRDILKCPLGHIFFQHDESKVVSGSHSTLQLWDIRSGKLVRDLLTDLDIIWQVAYNENVCVAAVLRNNRFWIEVLEFGSTKSS

SEQ ID NO: 2595 - protein, 268 aa, Schizosaccharomyces pombe
  unsure (1)..(268): unsure at all Xaa locations
MPSSASEQLLRKQLKVSARNLHIQIFMIVHSILILEHILIDIEIQKNPPQGFSVGLVDDKSIFEWEVMIIGPEDTLYEGGFFHATLSFPQVCIYVSQKNNICCIRXTSWSLTSKNXDYPLMPPKMKVXXIHXFFNXXKLHSLCLKTILTVTVTTEIWHPNVHPNGEVCISILHPPGDDKYGYEDAGERWLPVHSPETILISVISMLSSPNDESPANIDAAKEFRENREYILTYKQKNLLFNNQIVLTFSSTRFKKRVRRLVRRSIEMI

SEQ ID NO: 2596 - protein, 755 aa, Schizosaccharomyces pombe
  unsure (1)..(755): unsure at all Xaa locations
MTSYELSRELGGHKQDVXRKGYLLIPXSXTCSITNIYXVRGVCSISNELIGSASRDGTYSVWEQINGEWTPHFYENHEGFVNCVCYVPAIDKNSRGNYXYXFYLFINFDKGYIFSGGQDKCGILQEVGTNSPSYYLFGHESNICSASALNSETIITGSWDSTARVWALGQCKYVLKGHQSSVWAVLALGEDIFITGSADKLIKIWNGEKLVKSILAHNDCVRSLCQIPGGFASCSNDGVIKLWTSDGEFLYELHGHTSFVYSLTYIHNQQLIASCGEDRTIRIWKGKECLQCITLPTTSVWSVSSLPNGDLVCGSSDGFVRIFTVDKVRVAPTEVLKNFEERVSQFAISSQEVGDIKKGSLPGLEILSKPGKADGDVVMVRVNNDVEAYQWSQKENEWKKIGQVVDAVGNNRKQLFEGKEYDYVFDVDVADGQAPLKLPYNATENPYQAANRFLELNQLPLSYTDEVVKFIEKNTQGHSLESKKEPNLESQSSNKIKTTIFPVSQLLFSNANVPAMCQRLRSLNNTKSNPLPAKSIDSLERALSSKKITDTEKNELLETCLSILDSWSLAERFPALDALRLLAINSSSDLAPIFLEVFSRVVKSVPSSGNFESINVMLALRGLSNVVPNITDAEGVSKLMDCLTSTVPQASSAKDFKIAFATLAMNLSILLIQLNLENTGIELLSILFSFLDDPSPDNEAFYRALMALGTLCTVPDIALAASQIYHAQSIVHGIAERFSQEMRFVDAEKQILSLF

SEQ ID NO: 2597 - protein, 256 aa, Synechocystis sp.
ARHRRLAEITEMIHTASLVHDDVVDEADLRRNVPTVNSLFDNRVAVLAGDFLFAQSSWYLANLDNLEVVKLLSEVIRDFAEGEILQSINRFDTDTDLETYLEKSYFKTASLIANSAKAAGVLSDAPRDVCDHLYEYGKHLGLAFQIVDDILDFTSPTEVLGKPAGSDLISGNITAPALFAMEKYPLLGKLIEREFAQAGDLEQALELVEQGDGIRRSRELAANQAQLARQHLSVLEMSAPRESLLELVDYVLGRLH

SEQ ID NO: 2598 - protein, 312 aa, Synechocystis sp.
MLSLENQRILVTGGAGFLGKQVVAQLIAAGGDRPKITIPRSKDCDLRQASACERAVENQDIVIHLAAHVGGIGLNREKPAELFYDNLMMGVQLIHAAHQAGVKKFVCVGTICAYPKFTPVPFKEEDLWNGYPEETNAPYGVAKKALLVQLESYRLQYGFNGIYLLPVNLYGPEDNFDPRSSHVIPALIHKVYEAQKAGQKQLPVWGDGSPTREFLYSTDAARGIVMGTQAYDKADPVNLGTNFEISIKDLTELICELMEFEGDIIWETDQPNGQPRRCLDTTKAKAEFGFEAQVSLREGLKNTIDWYRQQRS

SEQ ID NO: 2599 - protein, 362 aa, Synechocystis sp.
MSKSKVVLLTGITGQDGSYLSELLLEKGYQVHGIIRRTSTFNTDRIDHLYVDPHDLEAKLRLHYGDLTDGTTLRRILEDVKPTEIYNLGAQSHVRVSFDSPEYTVDSVAMGTLRLLEAIRDYQHRTGIQVRFYQAGSSEMFGKVQEIPQKETTPFYPRSPYACAKVYGHWQTVNYRESYDLFACNGILFNHESPRRGETFVTRKITRAIARIVAGTQKKLYLGNIDSKRDWGYAKDYVRAMWAMLQQEQPDDYVVATGETHEVKEFLEIAFGYVNLNWQNYVAFDERYLRPAEVDLLIGDPAKTKAQLGWEPSVTFTELVHLMVEADLAVLGLTSPNQSGRIKELMAQDMAFIRSQNGHAVD

SEQ ID NO: 2600 - protein, 659 aa, Synechocystis sp.
MGEEPVPADKALGKKFKKKNASWSIEESEALYRVEAWGAPYFAINAAGNITVSPNGDRGGSLDLLELVEALRQRKLGLPLLIRFSDILADRLERLNSCFAKAIARYNYPNTYQAVYPVKCNQQRHLVEALVRFGQTSQCGLEAGSKPELMIALATLPPPLDRQDKHTKPLIICNGYKDQDYLETALLAKRLGHRPIIIIEQLRELEWVLHISQQLNIKPMLGVRARLSCQSLKSSEISSGNGDRAKLGLTMPDIVTVIHRLEENNCLDCLKMLHFHLGTQVSDIALIKEAMREASQLYVELVKLGAKMRYLNVGGGLAVDYDGSKTNYPASKNYNMQNYANDIVAAIQDACELGQVSPPILVSESGRAIMAHQSVLVFDVLGSNQTGFSEPHPPDENAHPLLKNLWECYETITAEQYQEQYHDALQLKTEASSLFNFGYLSLTERGQAEQIHWACCRKIFEITRQLEYIPEDFQALDKIMTDIYYVNLSVFQSAPESWSLDQLFPILPIHHLNEKPSQRVILADLTCDSDGKIDRFIDLWDVKSYLEVHPLENDGNPYYLGMFLVGAYQEIMGNLHNLFGDINVVHIATTPQGYQIESVVRGDTMTEVLGYVQYDSDDLLEGLRRHTELALSNGQITLEESRRLLEDYEQSLRRYTYLS

SEQ ID NO: 2601 - protein, 605 aa, Synechocystis sp.
MLLSPQSNRQVLMAYLSPQWGQVLALAIALGGSIILQVLNPQILRYFIDTAMAGGPQTILVWLALGFMAIAVVRQGLEIVATYCSETVAWTATNNLRLNLARHTLNLDLTFHKNHCPGELVERIDGDVDALARFFSQFVLQVLGNGLLVVGVLVVLWFEQWQAGLGLTLFALVALGILSRLQSLAVGPWQVYRGISADFYGFITEYLAGLEDIRGNGAVDYVMNRFYTLIRNWLRAFHQARLQSTLLWGSTVGLFTVGNAIALALGAYLWRVQGITIGTVYLLFYYASLLQDPIERIREELEQFQQAVASLYRIQDLIRQSPSPRLGRSQALPSGSLSVEGKNVWFSYPTTASLKPGDGNHELPEHRQGHHHEDADYALQNLTWHLPAGKVLGLLGHTGSGKSTFARLLLNFYAIQQGQIQLGGINLGEISQRELHQRVGFVTQDVQLFQTSIRNNLTFFNPHIPDRLILQALNDLGLEPWLATLPQGLDTELGTDGGGLSAGQAQLLAFARVFLKDPGLVILDEASSRLDPLTEQLIERAINRLLEHRTGIIIAHRLKTVERADQILILDRGKVLEYGDRPALAHNPASRFSQLLRTSSAIKLT

SEQ ID NO: 2602 - protein, 222 aa, Synechocystis sp.
MGFFDLFGKKTAMVAPNEALPGRSATMPVPDKHFVNGNPLKAPFPQGMETALFGLGCFWGAERKFWQIPGVYSTAVGYAAGYTPNPTYQEVCTGMTGHNEVVLVAFDPQQVSYDQLLKVFWESHNPTQGMRQGNDVGTQYRSGIYTYSEAQQQAALASKQAYQQALQQAGYGEITTEILPAPDFYYAEDYHQQYLAKNPNGYCGLGGTNVACPIGTEVSLGA

SEQ ID NO: 2603 - protein, 491 aa, Synechocystis sp.
MYIVQIASECAPVIKAGGLGDVIYGLSRELELRGHCVELILPMYDCMRYDHIWGLHDAYRNLEVPWYGSSIFCDVFCGWVHGRLCFFIQPKSSDNFFNRGHYYGALDDHMRFAFFSKAAMEFLLRSNKRPDIIHCHDWQTGLVPVLLYEIYRFHGMDHQRVCYTIHNFKHQGIAGANILHATGLNNDSYYFSYDRLQDNFNPNAINFMKGGIVYSNYVNTVSPHHAWEARFSDISCGLGHTLEIHQQKFGGILNGLDYEVWNPEIDPLLASNFSVKTFGDKAKNKQALRERLLLETDDKKPMLCFIGRLDGQKGVHLVHHSIYYALSQGAQFVLLGSATEPNLSKWFWHEKQHLNDNPNVHLELGFDEELAHLIYGAADIIVVPSNYEPCGLTQMIGLRYGAVPVVRGVGGLVNTVFDRDYDQNHPPEKRNGFVFYQPDEYALETALSRAIALYKDDPVAFKTLALQGMAYDYSWNKPGLQYVEAYEYIRA

SEQ ID NO: 2604 - protein, 332 aa, Synechocystis sp.
MSPMELTPETKAAVVTQGLTKRFDRQGAVTNVDLSIAEGAVYGLMGPNGAGKTTLIRMLATAEEPTKGEIYLFGDRLVAGADNLRIKQYLGYLPDDYPLYEDLNVWDYLDYFARLYHLKNPGRRHRIQEVLELVQLTSKRHSRINSLSRGMKQRLSLARTIIHEPILLLLDEPVSGLDPLARQQFRDIIRVLQAAGMTILISSHVLSDLAELCTAIGVMELGCLVESTTLADLYNRLGQRTISIFLLEGVEQLQDCLKNQPGVEDWQINYDQGDQPNSAPGTHCSVIFSGSPEDSANLLRNLIYAGCRVSQFHCQQEDLESIFLKLGHQQVS

SEQ ID NO: 2605 - protein, 275 aa, Synechocystis sp.
MANQDLIPVVVNGAAGKMGREVIKAVAQAPDLQLVGAVDHNPSLQGQDIGEVVGIAPLEVPVLADLQSVLVLATQEKIQGVMVDFTHPSGVYDNVRSAIAYGVRPVVGTTGLSEQQIQDLGDFAEKASTGCLIAPNFAIGVLLMQQAAVQACQYFDHVEIIELHHNQKADAPSGTAIKTAQMLAEMGKTFNPPAVEEKETIAGAKGGLGPGQIPIHSIRLPGLIAHQEVLFGSPGQLYTIRHDTTDRACYMPGVLLGIRKVVELKGLVYGLEKLL

SEQ ID NO: 2606 - protein, 463 aa, Synechocystis sp.
MVSLTPNPSYSVSLLLELPNHAGTLASVTQAIADAGGSFGQISLIESNLKLTRREIAVDASSSEHAEKIIGAVKALDNVKLLKVSDRTFDLHRQGKISVVSRIPLTSQSDLAMAYTPGVGRICRAIAEDPEKVYSLTIKSNTVAVVTDGSAVLGLGNLGPEAALPVMEGKAMLFKEFAQLDAFPICLDTQDTEEIIRTVKAIAPVFGGVNLEDIAAPRCFEIEARLKKELNIPVFHDDQHGTAIVTLAALLNALKFVGKAMAAVRIVINGAGAAGLAIAELLKESGATDIWICDSKGIVGKHRTDLNSKKQSFAVDAEGTLADAMAGADVFLGVSAPGVVTKEMVQSMAKDPIVFAMANPIPEIQPELIQEDAAVIATGRSDYPNQINNVLAFPGVFRGAIDCRASIITTTMCIEAAKAIASLVHSNTLDSEHIIPSVFDNRVATTVASAVQLAARNEGVAGQ

SEQ ID NO: 2607 - protein, 315 aa, Synechocystis sp.
MHSYTLHAPAKINLFLEILGDRPDGFHELVMVLQSIALGDKITVRANGTDDIRLSCGDSPLANDATNLAYRAAQLMINNFPQAHDNYGGVDITLTKHIPMAAGLAGGSADAAAVLVGLDLLWNLGLTRPELEQLAAQLGSDIPFCIGGGTAIATGRGEILDPLPDGNCFWVVLAKHRSIEVSTPWAYQTYRQKFGKNYLNDDQSQRARRKTIHAGPLLQGIQHRNPGQIASHIHNDLEKVVLPAHQPVAQLRQVLQSAGGLGTMMSGSGPSVFTLCREQAEAEQVLAIAKEKLNDPDVDFWLTHTIGHGIQIMNN

SEQ ID NO: 2608 - protein, 302 aa, Synechocystis sp.
MVAQQTRTDFDLAQYLQVKKGVVEAALDSSLAIARPEKIYEAMRYSLLAGGKRLRPILCITACELCGGDEALALPTACALEMIHTMSLIHDDLPSMDNDDFRRGKPTNHKVYGEDIAILAGDGLLAYAFEYVVTHTPQADPQALLQVIARLGRTVGAAGLVGGQVLDLESEGRTDITPETLTFIHTHKTGALLEASVLTGAILAGATGEQQQRLARYAQNIGLAFQVVDDILDITATQEELGKTAGKDVKAQKATYPSLLGLEASRAQAQSLIDQAIVALEPFGPSAEPLQAIAEYIVARKY

SEQ ID NO: 2609 - protein, 746 aa, Synechocystis sp.
MPQLISVPNLSTDVHLGQTFPLGATVYADGVNFCLFSKHAERVTLLLFDRPNDPAPARTIELHRGRNRTFYYWHVFVKGLKAGQVYAYRVDGPHEPEKGHRFDPDKVLLDPYAKAIVGKDIYDRKAAMALGDNCAQALRSVVVDTSVYDWEDDHAPRTPYAASIIYELHVGGFTRNPNSGLSENKRGTYAGLIEKIPYLKELGITAVELLPVHYFDPEDAQPGLTNYWGYSTIGFFAPHQGYSAADDPLEVVDEFRDMVKALHKAGIEVILDVVFNHTAEGNEKGPTLSFRGIDNRTYYILDEDKSSYSNYSGCGNSVKANHPVVGGLILDSLRYWVSEMHVDGFRFDLASVLVRDTKGVPLHGSEIATANIIWAIESDPILAGTKLIAEAWDAAGLYSVGKFVELADWFAEWNGPFRDDVRRFVKGDNGAVPALASRLLGSPDIYYRQDTDINRSINFVTCHDGFTLVDLVSYNEKHNEANGEKNRDGTNDNFSWNCGVEGETDDPKINQLRLRQIKNFLTILFFSQGTPMLLMGDPVGRTQQGNNNGYCQDNELSWFDWSGEETHSDETHFLRGIIALTQSLSLFLEESLLPVLNFALPRFPDENDGSEGDGQDGEEPVYKPLPPVDEAALREMYLKATKDLPGSCVVWHGVKLAQPDWSYTSHTLAVTLFHPGAEEILHLIFNAYWEPLNFELPPLNDGLIWHRLVDTYLPTPLDFQEPAIASPVEGETYWVQPRSSVVLMAK

SEQ ID NO: 2610 - protein, 306 aa, Synechocystis sp.
MHSPNKFTSGPKQFLESEAITSYADAAVVVVPIPYEATTSYRKGCEHGPEAVLEASDQLEAYDEELGTSPCHDLGIYTCAPLADSNKHPALAGDAMVTEVCDGIAPFVEDGKFVVAIGGEHAITTGVVRAMQRGTSEPFTVVQIDAHGDMRDKFEGSCHNHACVMRRVLELGLPTLPIAIRAICQEEADLIREKNIPVFWAREMADNPNWINEAIASITTQKVFLTIDMDGFDPGFMPGVGTPEPGGLGWYEGLNFFRRLFQTKQVIGCDLMELAPVRGSVVSEFSTAKLAYKLMGYWGESQRKKL

SEQ ID NO: 2611 - protein, 631 aa, Synechocystis sp.
MCGIVGYIGTQTAVNILIEGLERLEYRGYDSAGIATVTEGKIESVRAKGKLFNLKEKLENHSNFSRLGIGHTRWATHGKPEEHNAHPHLDNQQRIAVVQNGIIENYQTLRDQLKEKGYQFYSETDTEVIPILIADILKDLPSDDPDEALLEAIGKAVHQLEGAFAIAVLDAHCPEQLIVARQQAPLILGFGQGEFFCASDVTALVHHTTTVLSLENGEIARLTPLGVEVYDFNLKRVRKLPRTLDWSATTVEKQGFRHFMLKEIYEQPAVVRTCLATYLNEQWRAADHPSHSPVFLGLDPQLTKNLQHIQVLACGTSWHAGLVGKYLLEQLAGIPTTVHYASEFRYAAPPLTPHTLTIGVTQSGETADTLAALEMEKQRRLTLEDDYKPLILGITNRPESTLATMVNEIINTHAGIEIGVAATKTFVAQVLAFYFLALDIAFQRHSLSLEAIEHIMVGLRQLPAQIETILEQQGSAIEALAHEFAETQDFIFLGRGINFPIALEGALKLKEISYIHAEGYPAGEMKHGPIALLDAKVPVVAIAMPGSVHDKVISNAQEAKARDARLIGVTPMDDSQARSVFDDLLLVPHVEEMLSPIVAVIPLQLLSYHIAARRGLDVDQPRNLAKSVTVE

SEQ ID NO: 2612 - protein, 314 aa, Synechocystis sp.
MPNLKAIRDRIQSVKNTKKITEAMRLVAAAKVRRAQEQVLSTRPFADALAQVLYNLQNRLSFAETELPLFEQREPKAVALLVVTGDRGLCGGYNVNAIKRAEQRAKELKNQGIAVKLVLVGSKAKQYFGRRDYDVAASYANLEQIPNASEAAQIADSLVALFVSETVDRVELIYTRFVSLISSQPVVQTLFPLSPQGLEAPDDEIFRLITRGGKFQVEREKVEAPVESFPQDMIFEQDPVQILEALLPLYNTNQLLRALQESAASELAARMTAMSNASDNAGQLIGTLTLSYNKARQAAITQELLEVVAGANSL

SEQ ID NO: 2613 - protein, 503 aa, Synechocystis sp.
MVSIRPDEISSIIRQQIESYDQSVQVSNVGTVLQVGDGTARIYGLEQVMSQELLEFEDGTIGIALNLEEDNVGAVLMGDGFGIQEGSTVKTTGQIAQIPIGDAMVGRVVDSLGRPIDGKGPISSTATRLLESPAPGIIERKSVCEPMQTGITAIDAMIPIGRGQRELIIGDRKTGKTAIAIDTIINQKSEDVICVYVAIGQKASTVAQIIDTLTEKGAMAYTIVVAANANDPATLQYLAPYTGATLAEHFMYQGKSTLVIYDDLSKQAQAYRQMSLLMRRPPGREAYPGDVFYIHSRLLERAAKLSDALGGGSMTALPVIETQAGDVSAYIPTNVISITDGQIFLSTDLFNAGFRPAINAGISVSRVGSAAQTKAMKKVAGKLKLELAQFAELEAFSQFASDLDAATQAQLARGQRLRQLLKQPENSPLSVWEQVAISYAGLNGYIDTIPVDKVTEFAQGLRDYLKANKAKYVEIINSSKALTDEAETLLKEGIKEFTQGFAA

SEQ ID NO: 2614 - protein, 185 aa, Synechocystis sp.
MKGSLYSSKIAEPYAQALIGLAQQQNLTEVFGDNLRSLLTLLQDSPDLSAVLSSPVVKDEDKKSVLRSVLGDGGNGYLLNFLMLLVDKRRIVFLEAICEQYLALLRQFTNTVLAEVTSALKLTDAQKDQVKERVKQLTGAQAVELETKVDGDILGGIVIKVGSQVFDSSLRGQLRRVGLSLGTAL

SEQ ID NO: 2615 - protein, 478 aa, Synechocystis sp.
MQATMSQDFDYDLVIIGAGVGGHGAALHAVKCGLKTAIIEAKDMGGTCVNRGCIPSKALLAASGRVREMSDQDHLQQLGIQINGVTFTREAIAAHANDLVSKIQSDLTNSLTRLKVDTIRGWGKVSGPQEVTVIGDNETRILKAKEIMLCPGSVPFVPPGIEIDHKTVFTSDEAVKLETLPQWIAIIGSGYIGLEFSDVYTALGCEVTMIEALPDLMPGFDPEIAKIAERVLIKSRDIETYTGVFATKIKAGSPVEIELTDAKTKEVIDTLEVDACLVATGRIPATKNLGLETVGVETDRRGFIEVNDQMQVIKDGKPVPHLWAVGDATGKMMLAHAASGQGVVAVENICGRKTEVDYRAIPAAAFTHPEISYVGLTEAQAKELGEKEGFVVSTAKTYFKGNSKALAEKETDGIAKVVYRQDTGELLGAHIIGIHASDLIQEAAQAIADRKSVRELAFHVHAHPTLSEVLDEAYKRAV

SEQ ID NO: 2616 - protein, 676 aa, Synechocystis sp.
MTTLTPFIPLNFPITAIVGQEAIKLALLLGAIDPGLGGIVIAGRRGTAKSVMARAIHTLLPPIEIIKGNRYQCDPKNPGSWDDDTLEKFADVPLDQLETQVIPAPFIQIPLGVTEDRLLGSVDVEKSVKQGEAVFQPGLLAQAHRGVLYIDELNLLDDQIANQLLTVLTEGKNQIEREGMSFQHPCQPLLIATYNPEEGPLRRHLLDRIAIALSADGILGLDQRVAAVDQVLAYADSPISFIDQYDAELDDLKTTIILAREWLKEVSLTPEQVSYLVEEAIRGGLQGHRGELFAMRVAKAIAALDGRSDVQADDLRQAVELVIVPRSVLMDNPPPPEQAPPPPPPPQNQDEGKDEQEDQQDDKEDDKDNEPEAEQDPPSIPEEFIFDPEGVSLDPSVLYFAQMAQKQGKSGSRSVIFSDDRGRYLKPILPKGKVRRIAVDATLRAASPYQKSRRLRHPDRQVIVEQGDIRGKKLVRKAGALIVFLVDASGSMALNRMQAAKGAVMQLLTEAYENRDQVSLIPFQGENAEVLLPPTRSIAMAKKRLETLPCGGGSPLSHGLMQAVNVGMNAKRSGDIGQVVIVAITDGRGNIPLARSLGDEIPEGEKPDIKAELLEIAAKIRGLGMQLLVINTEKKFVSTGFGKELAQKAGGKYYQLPKATDQGIASMARQAIADMQ

SEQ ID NO: 2617 - protein, 483 aa, Synechocystis sp.
MVNLNQQDLPLVNALKALAQQPDTPFYAPGHKRGQGISPSFKQWLGPNLFQADLPELPELDNLFAPTGAIAKAQELAADLWGAEHTWFSVNGSTAGIVAAILATCGDGDKILLPRNVHQAAIAGIIHAGAVPIFLEPEVNPDWDLALGVTEETLSKALQEHDDAKAVFLLNPTYHGVVGDLQKLIKLSHRVNLPVIVDEAHGAHFAFHPSLPRPALELGADIVIQSTHKMLGALSQCAMIHGQGNLINPPRISQCLQLIQSTSPNYVLLASLDDARHQMANGGREKMAELLNFTLHYRQQLSQIPGLTLLEITKPLPGALILDPTRITVDVTAWGMSGFEVDDLLREKFQITAELPTLRQLSFIVSIGNQAQDLGHLLEALTQLAPTNPQQPFHLTLPVLPGTILAMTPRRAAHAAQKSVTVNEAIGKISAGLLCPYPPGIPVLVPGEIITPEAIAFLTEVLNLGGTISGLASEELTHLAVVN

SEQ ID NO: 2618 - protein, 834 aa, Synechocystis sp.
MQINNHVFKGLADFRSVSWQRQIIVAIAIYGTIYISQLFITYAGTASSPIWIPTGMAVGFLSIWGYQVWPGMVGGLLLGEIMALHGLESAANFILTVAITGVVSLVNLFSVYLSDILTANNYLFSKIKNIIRFIVFVCFGSRLPAAIICPFLLYLFEKISFGLYSEIAYTWLLSDAFALLIVTPFIIACNHNFKVFIKLLQEQWLEAASIIFFILLIVKIIANGYPIEYLLIPFLLWSAFRFTEVGSSLLTIVVSALLVLILALDQEKAAIKDQLLLLQSILACISMTTLVLNAVLSENERSKNQLFTTNQILIEQNQKLQELYQQRELERAQREKILIEYNESLQKQVDLVRAKEIAESEAKAKSTFVANMSHELRSPLNAIIGFSQLMLRTKNLPMEQYENAGIIQRSGEYLLNLINNILDFSKIEAGKTHLNRHNFDLYLLLDDLEDMLHLKAANEGIELIFIRDHDLPRYVYGDEIKLRQILLNLLSNAIKFTTEGEVVLTSNFRNAEQQEVINPETSTEPKNKYWLDFTIKDTGKGISEVELSHLFEAFSQTESGRNAQEGTGLGLAITRQFIKLMGGDINVSSVVDQGTTFSFSILVDLGEITLSREPNSAKKVLALTPGQPVYKILVVDDKSVNRQLLIKLLAPFGFEIEEASNGQEAIALWESWEPHLIFMDMRMPVMDGYEATKYIKGQVKGNATAVVALTASVLEEEKAIVLSAGCDDFLRKPFRENTIFDSLTKHLGVTYVYESAPNKNDNHEDTALKPESFLIMSQDWLTQLSHYLLEADTEQVMKLIAEIPASESELEQNLTKLVRRFEFEKILDLIEPLS

SEQ ID NO: 2619 - protein, 249 aa, Synechocystis sp.
MSHTLTKLDLPTLQTELENATAQQIITWAAQTFGPGLVMSTSFGIQAAVMLHLVTSIVPNIPVIWIDTGYLPLETYQFADQLTGRLQLNLKVYQSPLSPARMEALYGKLWQQKDVESLNRYDQIRKVEPMQRALKELEAIAWLTGLRRDQTRHRQNLKPVDLQGNQYKVLPILDWNSKMVYEYLTAHDLPYHPFFDQGYVSVGDWHSSRPLMAHDEDERDTRFHGLKQECGLHLPLSPEAGQSLDSSAL

SEQ ID NO: 2620 - protein, 189 aa, Synechocystis sp.
MAQDLIKEQLQGVNLFLIGMMGSGKSTVGPLLAEQLGYRFFDADVLIERVAGKAIADIFAEDGEDTFRDLETEVLGHLAAQTRSVIATGGGVVLRRQNWSYLHHGLVIWLDGSLELLLARLQGDEARPLLQVENLEERLGNLLAQRQPLYAQADLRFPLQADQDPLAIAGELLATIPGLLKPQCSAEQN

SEQ ID NO: 2621 - protein, 391 aa, Synechocystis sp.
MGKNLLEQLRQFTVVVADTGDIQAIETFTPRDSTTNPSLITAAAQMPQYQEIVDSTLLKAKDEAGENASIKDIVRLAFDRLAVAFGLKILQIIPGRVSTEVDARLSYDTEATIAKARYLIGEYAKAGIDKKRILIKIASTWEGIKAAEVLEQEGIHCNLTLLFGLHQAIACAEAKVTLISPFVGRILDWYKKSTGKEYDSHEDPGVQSVTTIYNYYKRFGYKTEVMGASFRNIGEIIELAGCDLLTISPQLLDQLRNTEGDLPRKLDPATVPQDIEKIVMDKATFDKMHAEDPMASEKLAEGIAGFTKALEVLEHLLEERLKVLDGQEHIKHGAEEIFHAYDLDGDGFITREEWAGTDVVFDALDRDHDGKITAAEMSAGLGAAFRLASVG

SEQ ID NO: 2622 - protein, 214 aa, Synechocystis sp.
MGLAIAVGSFLISPFSKVIPDPVVDINPVSTTARGTEKAVFAGGCFWGLEAMFEEVRGVKDVQTGYSGGTEATANYARVSGGGTDHAESIEIVYDPAQVSYGELLKIFFSVGHDPTQVNRQGVDQGRQYRSAIFATTPEQKQVAQAYIDQLEESQAFDQAIATEVNDFDAFYPAEDYHQDFVQRNPAHPYVLVHDLPKLRKFRQQYSDKLKAQS

SEQ ID NO: 2623 - protein, 266 aa, Synechocystis sp.
MLILKNSMASPHPFPWPQRFTVMALTFAWGLSLPVLAQTKSAVQWYNDGVDKLAAQNFSGAIADFTESIKLNDQDADAYYNRGYAKHVLGQYQAAITDYNQAISLNPEFAYALGNRCYAYFLLSQYDKAIQDCSNAIEINPNYADFYVYRGNSQSQLGNETTAIADYNDAIRINAQHANAYYNRALTHNRLKQDQQALADYNQSIQLDPDSAEAYFNRGLTQYRLGDEPKAIADLTKAAELFNAQEKKDMAQKAEAILTQIRAIDA

SEQ ID NO: 2624 - protein, 475 aa, Synechocystis sp.
MYEKLQPPSVGSKITFVAGKPVVPNDPIIPYIRGDGTGVDIWPATELVINAAIAKAYGGERKINWFKVYAGDEACELYGTYQYLPEDTLTAIKEYGVAIKGPLTTPVGGGIRSLNVALRQIFDLYTCVRPCRYYPGTPSPHKTPEKLDIIVYRENTEDIYLGIEWAEGTEGAKKLIAYLNDELIPTTPALGKKQIRLDSGIGIKPISKTGSQRLVRRAILHALRLPKAKQMVTLVHKGNIMKFTEGAFRDWGYELATTEFRAECVTERESWILGNKESNPDLTIEANAHMIDPGYDTLTEEKQAVIKQEVEQVLNSIWESHGNGQWKEKVMVNDRIADSIFQQIQTRPDEYSILATMNLNGDYLSDAAAAVVGGLGMGPGANIGDSAAIFEATHGTAPKHAGLDRINPGSVILSGVMMLEFMGWQEAADLIKKGIGAAIANREVTYDLARLMEPKVDKPLKCSEFAQAIVSHFDD

SEQ ID NO: 2625 - protein, 361 aa, Synechocystis sp.
MGEIKRIGILTSGGDCAGLNAVIRSVVHHAIGTYGWEVIGIQEATQGLMENPSKAIALHRDNIDHLLMMGGTFLGTTNKGNPFAFPMADGTVRDRTEDIIAGYRQLGLDALIGIGGDGSLAILRRIAQQGGINLVGIPKTIDNDVGATEISIGFDTATNIATEALDRLHFTAASHNRVMVLEVMGRDAGHIALAAGIGGGADIILIPEIPYRIQSVCNKIRQRQAEGKNFCLVMVSEAVRTELGDQVKQIQQFGEDRYGGIGKYIAEQIAQRTGAETRVTVLGHIQRGGIPSPFDRLLGSVFGVAAVDLIAEGKFDHMVAWRNRQTISVPIEEAIQTYQTVQLDGTLVKTARGLGICLGND

SEQ ID NO: 2626 - protein, 453 aa, Synechocystis sp.
MRVCVIGTGYVGLVTGVCLAHIGHQVICVDNNEEKVKLMRAGQSPIYEPGLSELMVANMESGRLVFTTDLGKGVQESAILFIAVGTPALEDGSSDTRYVEAVARSIGEHLDEQYRVIVNKSTVPIGSGDWVRMIVTEGNEAHQQQTGQAIAVNFDVVSNPEFLREGSAVYDTFNPDRIVLGGNNPQALALMRELYTPLIERRVGENPELPPVPVVMTDLSSAEMIKYAANAFLATKISFINEVANICDRVGADVTQVAQGIGLDSRIGSKFLNAGIGWGGSCFPKDVSALIHTAKDYGYTTSILNAVVEVNQVQRLIVVEKLQQELKILKGKVIGLLGLTFKPDTDDMRDAPALNIIQQLNRLGAKVKAYDPIVSQSGVSHGLSGVKIESTPAMLADQCDALILVTEWQEFLKLDFPVLASRMHQAVIIDGRNFLDKEKLQGAGFRYLGVGRS

SEQ ID NO: 2627 - protein, 434 aa, Synechocystis sp.
MPMAVVSLPFSPQNFPHSSSCSVQDLPPHQQMAIAQALAEPEHAPSHWVAPESQQELQCLLSECDRNNWPVIPCGNQSKLAWGGLAKPVQLLVSSAGLNRIVDHAVADLTVTVEAGVKLKDLQAILQPHQQFLPLNPLYHDQATVGGIMATGCAGPWQQRYGGVRDLVLGFSFVRWDGQLAKAGGRVVKNVAGYDLMKLFVGSYGTLGFISQITFRLYPLPSHSQTVFLTGDTNQLAKLSQALRRSGLAPTAALICSPALVQALNLGEELGLLVRFQNLEPVVQAQIDEVKKLAQTLTLASQSFDNQAESELWQRWENAMAGQGTTETILCKFGLLPAKAADFLQQLPGLGHVQLGNGIGWVRFGQLDREKLNQQRQICQNYGGYVTVLEASPECKKHWDVWGQSGHGLAMMGRLKNQFDPHNTFSPGRFVGGF

SEQ ID NO: 2628 - protein, 340 aa, Synechocystis sp.
MTVSPTTQPQTNHSLPPADAKQRVSQFMQTLQDEICQGLEALDGKGKFQEDSWQREEGGGGRSRVLADGDFLEQGGVNFSEVWGKSLPPSILKQRPEAEGHEFYATGTSMVLHPKNPYIPTVHLNYRYFEAGPVWWFGGGADLTPYYPFAEDAAHFHHTLKNACDQTHGEFYPVFKRWCDEYFYLKHRQEMRGIGGIFFDYQDGNAPLYRGPDPNGPAAQYSNQLAPIEPLGWEDLFSFAQRCGRAFLPAYSPIVEKRRNTEYGDRQRQFQLYRRGRYVEFNLVYDRGTIFGLQTNGRTESILMSLPPLVRWQYCYSPEAGSPEAELTEKFLVPQDWVNS

SEQ ID NO: 2629 - protein, 635 aa, Synechocystis sp.
MVTTPTAAPRKPSKVEGIKERSNYLREPLATELLNDANYFTDDAVQILKFHGSYQQDNRDNRVKGQEKDYQFMLRTRNPGGLIPAQLYTALDDLSKTHGNQTLRVTTRQGLQIHGIVKKDLKMAIATVVNNLGSTLGACGDINRNVMAPAAPFRDKPEYGYAWDYANKVADLLSPQSGAYYEIWLDGEKVISGEEAPEVKAARQKDLNGTNLNDPKEPIYGQQFMPRKFKISVTVPGDNSIDVYTHDISLVVITDRHGELRGFNVLAGGGLGRTHNKEETFARAADPIGYVSKDDVYDLVKAIVATQRDYGDRHNRRHARMKYLLADWGVEKFRKQVETYMGKPFQSFKPLPAWRYQDYLGWHEQGDGKLFFGLSVENGRIKDEGDFQLKTALRKVVDQFQLPLRLTANHNILLYDINAQDKAAIEQIFQQHGVVTDPEAIDTLVRYSMACPALPTCGLAVTESERIMPSVNARLRDLLNSLDLPNESIVTRMTGCPNGCARPYMAEIGFVGSAPNSYQVWLGGSPNQERLAAAYTEKMPLEQLESLFEPLFVYFKQSRKGKESFGDFCHRVGFTALREFSHGYTAPAKGGKNRKNQRRVSLSDEMYAQLKARSERDNCPMNQIVQQALTAYLGK

SEQ ID NO: 2630 - protein, 391 aa, Synechocystis sp.
MQFADRLNAFGGNVFADMDLAKAQARAQGQTIIDLSLGSSDLPTPAPILATIAKALEDPSTHGYLLHQGTLPLRQAIAVWYEKRFGLAVDAETEVLPLIGSQEGTAHLPLAVLNPGDVALLMDPGYPSHMGGVYLAGGEIYPMALRSENQFLPVFTAIPNSVLAKAKMTVLSYPHNPTTAIASLEFFQTAVQFCRDHDLVLVHDFPYMDLVFDGIAMPPSVLQADRQKSCAIEFFTFSKSYNMGGFRIGFAIGNIQLISALKKIKAVVDFNQYAGILQGAIAALESPPETVQQTVQIFAQRRATLIDALAKIGWAVPLPTATMYVWAPLPESWLGNSLEFCQKLVAKTGVALSPGSGFGAGGEGYVRFALVQEPDILATAAKKIGQFLDQN

SEQ ID NO: 2631 - protein, 351 aa, Synechocystis sp.
MIVVMKVGTPEIEIERIGKEFAERGLTPEKIVGKHKVVMGLVGETAGLDPLQIQEVSPWIEDVLRVEQPFKRASLTFRHGEYSEVIVSTPAGPVAIGKNHPVAVVAGPCSVENETMIVETARRVKAAGAQFLRGGAFKPRTSPYAFQGHGESALGLLAAAKEATGLGIITEVMDAADLEIIAEVADVIQVGARNMQNFSMLKKVGAQDKPVLLKRGMAATIDEWLMAAEYILAAGNPNVILCERGIRTFDGHYTRNCLDLSVLPVLRSLTHLPIMIDPSHGTGKSEYVPSMAMAAIAAGTDSLMIEVHPNPAKAMSDGPQSLTPDRFDETMKQLAVIGQTVGRWPKVAALA

SEQ ID NO: 2632 - protein, 409 aa, Synechocystis sp.
MTEGHPDKVCDQISDTILDALLTLDPNSRVAAETVVNTGLTLVTGEITSQAHINFVELIRQKIAEIGYTNADNGYSANSCAVMLAIDEQSPDISQGVTAAQEQRHALSDDELDKIGAGDQGLMFGYACNETPELMPLPISLAHRIALRLSEVRKSGQLAYLRPDGKTQVSILYEDGSPVAIDTILISTQHDEHIGDITDNDAVQAKIKADLWDVVVGHCFSDIALKPTDKTRFIVNPTGKFVVGGPQGDAGLTGRKIIVDTYGGYSRHGGGAFSGKDPTKVDRSAAYAARYVAKNIVAAGLADKCEVQVSYAIGVARPVSVLIDTFGTGKVDEEKLLEVVLANFELRPAGIIQSLNLRNLPAERGGRFYQDVAAYGHFGRNDLDLPWEYTDKVDVLKAAFASSPQAVAV

SEQ ID NO: 2633 - protein, 360 aa, Synechocystis sp.
MLDKSFWQGKSVFLTGHTGFKGSWLTLWLSQLGAKVSGYSLDPLTNPNLCELAEIAKCLRSDTRADVNDLANLQKAIAEARPEIVFHLAAQPLVRRSYRDPVGTFATNVMGTAHLLEALRASDSVRVVVIVTTDKVYRNVEWCWPYREDDQLGGHDPYSASKAACEIVVASYRDAFLREQGVAVASARAGNVIGGGDWSEDRLIPDVVRALDAKTMVIIRRPQAIRPWQHVLEPLAGYLLLAQKLWHSPELAGAYNLGPETKDAATVRQILEFASRIEPGLQVEYGDGNEGPHEAGWLSLEIAKARTLLGYRPSWGVEEAVRRTMIWYRSQRQGESPLTLCQTEIEEYEKELMALSDLAI

SEQ ID NO: 2634 - protein, 320 aa, Synechocystis sp.
MKIALISGISGQDGAYLAQLLIEKSYAVWGTSRDAQISNFRNLKILGIRESIKVVSMALTDFRSVLQVVSQVNPDEIYNLAGQSSVGLSFEQPVETLESITIGTLNLLEVVRFLDKPIKLYSASSSECFGDTGNSAADENTAFRPRSPYAVAKSAAFWQVANYREAYNLYACSGILFNHESPLRPERFVTQKIIATACRIAQGSQEKLYLGNTSISRDWGWAPEYVEAMYLMLQQAKPDDYVIATGASYLLQDFVEITFSSLGLNWREHVIIDQSLFRPTDLAMGKANPRKAQEQLGWKAEYKTPDVVKMMINARSNGKY

SEQ ID NO: 2635 - protein, 257 aa, Synechocystis sp.
MDIHRLPALADNYIFLLHDRQRNQAAVVDPAEAKPVLDCLETLGADLVTIYNTHHHGDHVGANRELLAKYPNLEVYGGVEDQGRIPGQTVFLRDGDRLSFADREATVYFVPGHTRGHIAYYFAPGSGETIGDLFCGDTIFAGGCGRLFEGTPAQMVQSIGKLRQLPDQTRLWCAHEYTLGNLKFALTVDPSNKDLQERFQTVQGDRQRGQATIPSWLGTEKRTNPFLRWDNPAIQARVGMTEPARVFGKLRGMKDNF

SEQ ID NO: 2636 - protein, 177 aa, Synechocystis sp.
MQQRGVTIWLTGLSGAGKTTITHALEKKLRDSGYRLEVLDGDVVRTNLTKGLGFSKEDRDTNIRRIGFVSHLLTRNGVIVLVSAISPYAAIRQEVKHTIGDFLEVFVNAPLAVCEERDVKGLYAKARSGEIKGFTGIDDPYEPPTNPDVECRTDLEELDESVGKIWQKLVDLKYIEG

SEQ ID NO: 2637 - protein, 409 aa, Synechocystis sp.
MLRLITQSGDIVQELRRLHHRPVPSPWPVMAQVVAAMEHWAAMDQDAPPRVSGAELDAAYQRISQEKLSVIRQACAALEQVYRPQLPKTQVSFPEDGTVRGQRFYPVRRAGFYLEAKRGDALGNLLRQGMLAKTVGVAERVLVTETISSTILVAAQEMGIEEIYLAAGVPAIAMLTWGAKNIAPVESITGAGCPRVMAAKQLVSGVVTIDQTLARTNLMVLADGEANGQWLALDLLAHAEQYPNASAVLLTDRLELGEEVIQSVNRYCREQEHSVHTEKALAHYGLVAIVEDLEACGSWINEFCPHILLLAMEDPWTMVEKVQRAREIYIGHRSPSILGHYLSGANRLQTQDGAMATASELAFHCFLRSSQLLDYGNNPPPPWLKDLVNWQGLTAIEERLGQLGRLKES

SEQ ID NO: 2638 - protein, 616 aa, Synechocystis sp.
MSKNNKKWRNAGLYALLLIVVLALASAFFDRPTQTRETLSYSDFVNRVEANQIERVNLSADRTQAQVPNPSGGPPYLVNLPNDPDLINILTQHNVDIAVQPQSDEGFWFRIASTLFLPILLLVGIFFLFRRAQSGPGSQAMNFGKSKARVQMEPQTQVTFGDVAGIEQAKLELTEVVDFLKNADRFTELGAKIPKGVLLVGPPGTGKTLLAKAVAGEAGVPFFSISGSEFVEMFVGVGASRVRDLFEQAKANAPCIVFIDEIDAVGRQRGAGLGGGNDEREQTLNQLLTEMDGFEGNTGIIIVAATNRPDVLDSALMRPGRFDRQVVVDRPDYAGRREILNVHARGKTLSQDVDLDKIARRTPGFTGADLSNLLNEAAILAARRNLTEISMDEVNDAIDRVLAGPEKKNRVMSEKRKTLVAYHEAGHALVGALMPDYDPVQKISIIPRGRAGGLTWFTPSEDRMESGLYSRSYLQNQMAVALGGRIAEEIIFGEEEVTTGASNDLQQVARVARQMVTRFGMSDRLGPVALGRQGGGVFLGRDIASDRDFSDETAAAIDEEVSQLVDQAYQRAKQVLVENRGILDQLAEILVEKETVDSEELQTLLANNNAKLALLV

SEQ ID NO: 2639 - protein, 696 aa, Synechocystis sp.
MDSGHGAQSRIKLGQTGYKLSTYFCKSGPNWENQPQIHWNSLFSTVKIQLSLFPSSFHLIMVTPINYHSIHCLADIWAITGENFADIVALNDRHSHPPVTLTYAQLREEITAFAAGLQSLGVTPHQHLAIFADNSPRWFIADQGSMLAGAVNAVRSAQAERQELLYILEDSNSRTLIAENRQTLSKLALDGETIDLKLIILLTDEEVAEDSAIPQYNFAQVMALGAGKIPTPVPRQEEDLATLIYTSGTTGQPKGVMLSHGNLLHQVRELDSVIIPRPGDQVLSILPCWHSLERSAEYFLLSRGCTMNYTSIRHFKGDVKDIKPHHIVGVPRLWESLYEGVQKTFREKSPGQQKLINFFFGISQKYILAKRIANNLSLNHLHASAIARLVARCQALVLSPLHYLGDKIVYHKVRQAAGGRLETLISGGGALARHLDDFYEITSIPVLVGYGLTETAPVTNARVHKHNLRYSSGRPIPFTEIRIVDMETKEDLPPETQGLVLIRGPQVMQGYYNKPEATAKVLDQEGWFDSGDLGWVTPQNDLILTGRAKDTIVLSNGENVEPQPIEDACLRSAYIDQIMLVGQDQKSLGALIVPNFDALQKWAETKNLQITVPEPSASSEGMQASGLYDPQVVGLMRSELHREVRDRPGYRADDQIKDFRFIPAPFSLENGMMTQTLKLKRPVVTQTYQHLIDEMF

SEQ ID NO: 2640 - protein, 278 aa, Synechocystis sp.
MAPQTNFSATTILSTPRENSMLDLSGKHAFVTGIANNRSIAWGIAQQLHQAGAEIGVSYLPDEKGRFEKKVRELTEPLHPTLVLPGDVQDDAQVDALFHSVKEKWGKLDILIHCLAFADKSGLTGNYTDIPKEAFSQAMEISTYSLGRLARGAKPLMTNGGSIITLTYFGGVKVIPNYNLMGVAKAGLEMTVRYLAAELGPQNIRVNGISAGPIRTLASSAVGGILDMIHHVEEVAPLKRTVTQTEVGNTAAFLASDLSSGITGQIIYVDSGYEIMGM

SEQ ID NO: 2641 - protein, 1331 aa, Synechocystis sp.
MFTNVKSTIRRVDPEALNGRQLLKVVYVVLESQYQSALSAAVRNINRTNSSLAIQLTGYLIEELRDPENYANFKHDVSEANLFIASLIFIEDLADKVVEAVTPYRDNLDAAIVFPSMPQVMRLNKMGSFSMAQLGQSKSAIAQFMKKRKENSSGAGFQDAMLKLLRTLPTVLKYLPVEKAQDARNFMLSFQYWLGGSQENLENFLLMLTDKYVYPDLGLDKLVNYQEPVVYPDMGIWHPLSMQMFENVKDYLEWYNQRPDISEDLKDPLAPCIGLIMQRTHLVTGDDAHYVGMVQELEAMGARVICVFSGGLDFSKPVNEYFWDKSVNGVEPLPIVDAVVSLTGFALVGGPARQDHPRAIESLKKLNRPYMCALPLVFQTTEEWEASDLGLHPIQVALQIAIPELDGAIEPIILSGRDGSTGRAIALQDRLEAIAQRAMKWANLRKKPKLDKKVAITVFSFPPDKGNVGTAAYLDVFGSIYEVMKGLQGNGYDVQDLPGSAKELMEAVIHDAQAQYNSPELNIAHRMSVEQYERLTPYSVRLEENWGKPPGHLNSDGQNLLIYGKEFGNVFIGVQPTFGYEGDPMRLLFSRSASPHHGFAAYYTYLNHIWKADAVLHFGTHGSLEFMPGKQMGMSGECYPDNLIGTIPNLYYYAANNPSEATIAKRRGYASTISYLTPPAENAGLYKGLQELNELIGSYQTLKDSGRGIQIVNTIMDQARICNLDQDVNLPDINAEEMDQGQRDTIVGSVYRKLMEIESRLLPCGLHVIGQPPSAEEAIATLVNIASLDREDEGIWALPTLIAESIGRNMEEIYRNSDKGILADVELLQDITLATRAAVAALVQEQINADGRVSFVSKLNFFKIGKKAPWVKSLCDSGYPNVNEEKLKPLFEYLEFCLEQVCADNEFGGLLQALEGEYVLPGPGGDPIRNPNVLPTGKNIHALDPQSIPTLAAVQSAKVVVDRLLERQRAENGGNYPETIASVLWGTDNIKTYGESLAQIMWMVGAKPVPDALGRVNKIELVPLEELGRPRIDVVVNCSGVFRDLFINQMNLLDQAVKLAAEADEPLEMNFVRKHALEQAEEMGIGVREAATRIFSNASGSYSSNVNLAVENSSWEDESELQEMYLKRKSFAFNSDNPGMMDQNRDMFERALKTADATFQNLDSSEISLTDVSHYFDSDPTKLISTLRDDGKAPAAYIADTTTANAQVRTLSETVRLDARTKLLNPKWYEGMLSHGYEGVRELSKRLVNTMGWSATAGAVDNWVYEDANSTFIKDEEMCKRLMDLNPNSFRRMVSTLLEVNGRGYWETSDENLERLQELYQEVEDRIEGVE

SEQ ID NO: 2642 - protein, 330 aa, Synechocystis sp.
MVIMEAKSNYPKTMSFANADTPPQVVVLGAGAWGSSLAYVLNNNDIPTQVWSRRSPQSLESMVAGADVIVSAVSIKGVPSVAARLEAMDLQRRTILVTATKGLDPETMTTPSQIWQAALPSQPIAVLSGPNLSKEIDQGLPAATVVASSDQAAAEEIQTIFAADNFRVYTNNDPLGTELGGTLKNVMAIAVGVCEGLGLGTNAKSALITRALPEITRVGLHFGAQPDTFWGLAGLGDLLATCSSMLSRNYRVGYGLSKGQSLEEILANLGGTAEGVNTTDVLIKIANREKIAVPITRQVYRLLHGKITPPQAVEALMERELKAEFEDFDL

SEQ ID NO: 2643 - protein, 434 aa, Synechocystis sp.
MTRILKLSHLTPQQLNQLKRRSEQNIDQALAIAKEVIEQVKMEGDAGVLHYSRQFDFAGATAENLRVSEAEFAEAEKLVDPELRRAVEHAFRNIEKVHAGQMPPPMHLAEIEPGVFAGEKITPLPTVGLYVPRGKGAFPSMMLMLAVPARVAGVKKIVVCTPPDKEGKVEPVSLVTARMAGVDEVYKLGGVQALAAIAYGTKTVSKVDKLIGPCSIYGAAAKRLLSGIVDVGLPAGPSESIVLADETTDPKLAALDLLIEAEHGSDSAALLVTHSASLAEKALGYLGEYLEKLPPWRKKFCEDGLGSYGGILLTDSLQASLDFINDYAPEHLQVLTADPLKLVGKIDNAGEILLGNYTPSSAATYAIGVNAVLPTGGFARSYSAVSVFDFLKRSTLAYLTEEGFAGVKETVTTLADYEDFPAHALAIRERENLL

SEQ ID NO: 2644 - protein, 518 aa, Synechocystis sp.
MNNSTVSSIDITPQDRYNQQLLAHVHPPDWINPSPKDQYDLVVIGAGTAGLVVAAGAAGLGIGLKVALIEKHLMGGDCLNFGCIPSKALISSARVVGVMNNANSLGIKKPDSIEIDFPAVMARMRQIRTGISHHDSAQRFRDLGIDVFLGEGHFVRNNQIEVGGAILNYKKAIIATGAKAVKPNIPGIEEVGFLTNETVFSLTACPDRLGVIGGGPIGCELAQAFQRLGAQVTLFHRGSHLLNKEDPEAAAIVQESLIKDGIELILNAKLERAELTDRGKVLHYRANGDSGTIVVDEILVGAGRAPNVEELNLEAVGVKFDRRGVKVNDYLQTTSPQIYAAGDICMDWKFTHAADAAARIVIKNTLFSPFGLGRSKLSSLTMPWVTYTDPEIAHVGLNETMAEALDIGYKIIKIPFSQVDRAIAADETEGFLKIIHVANSDEILGATIVASHAGEMISEITTAIVNKIGLSKLAGVIHPYPTQAEAIKKAADTYRRTLLTNNTKNLLKLLTKFPSKLF

SEQ ID NO: 2645 - protein, 640 aa, Synechocystis sp.
MHISELTHPNELKGLSIRELEEVSRQIREKHLQTVATSGGHLGPGLGVVELTVALYSTLDLDKDRVIWDVGHQAYPHKMLTGRYHDFHTLRQKDGVAGYLKRSESRFDHFGAGHASTSISAGLGMALARDAKGEDFKVVSIIGDGALTGGMALEAINHAGHLPHTRLMVILNDNEMSISPNVGAISRYLNKVRLSSPMQFLTDNLEEQIKHLPFVGDSLTPEMERVKEGMKRLVVPKVGAVIEELGFKYFGPIDGHSLQELIDTFKQAEKVPGPVFVHVSTTKGKGYDLAEKDQVGYHAQSPFNLSTGKAYPSSKPKPPSYSKVFAHTLTTLAKENPNIVGITAAMATGTGLDKLQAKLPKQYVDVGIAEQHAVTLAAGMACEGIRPVVAIYSTFLQRGYDQIIHDVCIQKLPVFFCLDRAGIVGADGPTHQGMYDIAYLRCIPNLVLMAPKDEAELQQMLVTGVNYTGGAIAMRYPRGNGIGVPLMEEGWEPLEIGKAEILRSGDDVLLLGYGSMVYPALQTAELLHEHGIEATVVNARFVKPLDTELILPLAERIGKVVTMEEGCLMGGFGSAVAEALMDNNVLVPLKRLGVPDILVDHATPEQSTVDLGLTPAQMAQNIMASLFKTETESVVAPGVS

SEQ ID NO: 2646 - protein, 1965 aa, Synechocystis sp.
MSVYNLDLSLVYGKLSAFAGLESFWQNFEIIYGNNYDVVAVEALRSRWAIGDFSDLPVIEVLSAETLGSAVGAYAQSINKIYLSDQFVATAPPDALIEVILEEIGHFVDAQVNAVDTIGDEGQLFADLVLGDVVSASELARIKAEDDTHTIIINGQSLQVEQSVQSLIGESVTVNVRFTGSGSDGSFNFDLFTQTFTVTSGQEITDQAITATFNSSGSPQTLTGNVDIDVSENTIYVNFSGTQQGGALTFIFTSLADESIGSVESVIQTNVSGFTTGVNQPLTPSVSNNNVTVGFFPFGSQPGVNLSQTSTLTYGTPPTDNTPPNAPSTPDLSASSDSGLSSTDNITNDTTPTFNGTAEANSTVTLFSGGSTQIGSTTANGSGNWTITASTPADGNYSITAKATDAAGNVSTASSALGITIDNTTPNLASAIEISDTALKIGDTATVTFTFSEAVIGFTNADIIVVDGSLSSPTSSDGGITWTATLTPNANAESNSNVITLDNTGISDLAGNNGTGTTTSVSYAVDTIPPTLTSIDDGDDDNIVPIDTPLTYTLTFSEDIDSTTVTADDFDNAGTATISIGTITETSSGVFSVVVTPNTSGTIILQIPNGAVLSDMAGNNLAVPVQDDDELQVNQGPSAVIVPNASLAENTDTTNPLKVADIAITDDGLGSNDISLSGIDAAFFEVIGQSLFLKAGTVLNFESKASYTVTVNVDDDTVGSTPDLTADFKLTINNLDEVAPTITSGDTAKAIAENSGANQIIYQVKATDDGDISAGITFGLKPGDDADSFIINATTGEVKLIGNPDFETQSSYKFTVTADDGVNPATEQLVNLAIIDLDEIAPTITSGDTAKAIAENSGANQVIYQVTATDDADVSAGITFGLKPGNDADLFIINSTTGQVILTENPDFETQSSYKFTVTASDGVNPATEKIVTLAIIDLDEIAPTITSGDTAKAITENSGANQVIYEVIATDDADVSAGITFGLKPGNDAGSFTINPITGKVTLIDDPDFETQSSYKFTVTASDGVNLATEQLVNLTIIDLDEIAPTITSGDTAKAIAENSGANQVIYEVIATDDADVSAGITFGLKPGNDAGSFTINPITGKVTLIDDPDFETQSSYKFTVTASDGVNLATEQLVNLTIIDLDEIAPTITSGDTAKAITENSGANQIIYQATADDNADISAGVTFGLKPGDDADSFIINAITGQVTLLDNPDFETQSSYKFTVTASDGVNPVTEQVVNLTIIDLDEIAPTITSGNTAKAIAENSGANQVIYQVTATDDADISAEVTFGLKLGDDATSFSIDSTTGKVTLINNPDFESQSSYKFTVTASDGVNPATEKIVTLAINNLDEIGPTITSGDTATPIDENSGANQLIYQVIATDDADVSAGITFGLKPGNDAGSFTINPITGEVTLIDDPDFETQSSYKFTVTASDGVNPATEKIVTLTINDLDELGPNITSDNIATAINENSGANQIIYQVTADDGDDISAGVTFGLKPGDNANQFSIDPTTGQVTLLDNPDFETQSSYKFTVTASDGVNPATEQLVNLTIIDLDEIAPTITSGDTAKAIAENSGANQVIYQVTATDDADTSAGVTFGLKPGEDANSFTINAATGEVELIGNPDFETQSSYKFTVTASDGVNPVTEQVVNLTIIDLDEIAPTITSGNTAKAIAENSGANQVIYQVTATDDADISAGVTFGLKPGDDATSFSIDSTTGKVTLINNPDFESQSSYRFTVTADDGVNPVTEQQIALEILDDNVAVIENGFFFAQFLDNTRQALLFQNQPFSTDQSVNWKILDTETVDGSNQVLWYNQVTEEVGVWLTDNNWNWISSDTWQVKSSRTFNTELLFGTDINGDSLIGDQYTVLENQGAVGLLEGIFGAYYVQPGDDPVTPLKFLGQPFENQFGSWQALAAERVENINRVLWQNFDTGEIGIWRTDNNWNWLSSNVFTPNSTEIATVESLFGISL

SEQ ID NO: 2647 - protein, 307 aa, Synechocystis sp.
MEQVRNYYQILGVPRNATAEEIKKSFRKLARQYHPDVNPNDKTAEEKFKDINEAYDVLSDETKRRELDSRLFGRFRRPPTSRFSPNSNGGRSPNGTSVNGQVRTPTGRTGTRQPAQSWQDFSETRRTKVVSPARPVPRDVEANLTLPLEKAYRGGKERIRLEDGRSLEVEMPGGMGDGQRIRLKQQGINGGDLYLKINLSPHPLFTLQGTDIACQVPVTPSEAILGGAIEVMTIDGLVKMTVPAGLKNGQKLRLAKKGFPNNQGDRGDQLVEIRVEIPPEPSPEELELYRRIREKETFNPRQKFFDF

SEQ ID NO: 2648 - protein, 788 aa, Synechocystis sp.
MLTSINRSANFGSKENNMGKVVGIDLGTTNSVVAVMEGGKPIVIANAEGMRTTPSVVGFNKEGELVVGQMGRRQAVLNPQNTFYGVKRFMGRRYTDLTPESKRVAYTIRRDDRDNIKVRCPRLKKDFAPEEISAMILRKLAEEASRYLGEKVTGAVITVPAYFNDSQRQATRDAGKIAGLEVLRIINEPTAASLAYGLDQGRIQKILVFDLGGGTFDVSVLEVGDGIFEVKATSGDTQLGGNDFDRRIVDWLAEKFLEAEKVDLRQDRQALQRLTEAAEKAKIELSGVGTTEINLPFITATEDGPKHLETQLSRSEFEDLCGDLVTRLQRPVKRVLKDAGLSPVQIDEVVLVGGGTRMPMVKGLVRSFIDREPNENVNPDEVVAIGAAIQAGILDGEVKDILLLDVTPLSFGLETIGGVMKKLLPRNTTIPVRKSDIFSTGENNQTVVEVHVLQGEREMASDNISLGRFKLSGIPPAPRGVPQVQVSFDIDANGILQVTARDKTTGREQSITVQGASILSEGEVNRMIQEAETFAAQDRERRERIEKRNSAKALTDQAQRRLKEVTLDFGSAFTVSYRRQVDALCSEILDSLEKDDERRLDRAQADLQDVLYELNREVRLQYDDKEEGFFEAIKKTFTGDFDDDDDYYNRRPAPRDDYRGGNDYGRYDDYNYNAPSRREAPMPRAGAGRGPSLSKDYRSTAYADWDQSRVTRQRPYQGESLGGTYDDRRSSPQDDYSRGDRQKDYDYRENAPSRSGRGGNGRYGERPAQPGRNAPLQNGWDDDDDDWF

SEQ ID NO: 2649 - protein, 383 aa, Synechocystis sp.
MRALVIGGDGYCGWATALYLSNKGYEVGILDSLVRRYWDAQLGAETLTPIAPIRQRLDRWYELTGKKIDLFIGDINDYPFLTNALRQFQPDAVVHFGEQRSAPFSMIDREHAVLTQANNVLGNLNLLYALKEDFPDCHLVKLGTMGEYGTPNIDIEEGYITIEHKGRKDTLPYPKQPGSFYHLSKVHDSHNIHFACKIWGLRATDLNQGIVYGVLTEETGMDEMLINRLDYDGVFGTALNRFCIQAAIGHPLTVYGKGGQTRGLLDIRDTVRCIELAIANPADKGQFRVFNQYTELFSVGDLAQMVQKAGADLGLKVEIDHLENPRVELEEHYFNAVNTNLLDLGLQPHFLSDSLLDSLLNFATKYKDRVDQKHILPKVTWRG

SEQ ID NO: 2650 - protein, 429 aa, Synechocystis sp.
MTYSPVVESVEAQAFAVTDLSPAAEFKTADFDTYVMNTYGRFPIAIARGQGSTLWDTEGKSYLDFVAGIATCTLGHAHPALVRAVSDQIQKLHHVSNLYYIPEQGELAKWIVEHSCADRVFFCNSGAEANEAAIKLVRKYAHTVLDFLEQPVILTAKASFHGRTLATITATGQPKYQQYFDPLVPGFDYVPYNDIRSLENKVADLDEGNSRVAAIFLEPLQGEGGVRPGDLAYFKRVREICDQNDILLVFDEVQVGVGRTGKLWGYEHLGVEPDIFTSAKGLAGGVPIGAMMCKKFCDVFEPGNHASTFGGNPLACAAGLAVLKTIEGDRLLDNVQARGEQLRSGLAEIKNQYPTLFTEVRGWGLINGLEISAESSLTSVEIVKAAMEQGLLLAPAGPKVLRFVPPLVVTEAEIAQAVEILRQAIATLV

SEQ ID NO: 2651 - protein, 369 aa, Synechocystis sp.
MKSRAAVAFEVGKPLQIVEIDVAPPQQGEVLVKITHTGVCHTDAFTLSGDDPEGLFPVVLGHEGAGIVVEVGEGVTSVQLGDHVIPLYTAECGKCLFCRSGKTNLCVAVRATQGKGVMPDGTSRFSYNGQSLYHYMGCSTFSEYTVVAEVSLAKINPEANHEHVCLLGCGVTTGIGAVHNTAKVQPGDSVAVFGLGGIGLAVVQGARQAKAGRIIAIDTNPAKFELAKQMGATDCINPKDHDQPIQQVIVEMTGWGVDHSFECIGNVEVMRSALECAHRGWGQSVIIGVAGAGQEISTRPFQLVTGRKWMGTAFGGVKGRSQLPGMVEQSMRGEIQLAPFVTHTMELKDINQAFDLMHDGKSIRSVIHY

SEQ ID NO: 2652 - protein, 357 aa, Synechocystis sp.
MTATLAAPSKTRRVVFPFTAIVGQDEMKLALLLNVIDPKIGGVMIMGDRGTGKSTTIRALADLLPEIEVVANDPFNSSPSDPEMMSEEVRIRVDSQEPLSIVKKKVTMVDLPLGATEDRVCGTIDIEKALSEGVKAFEPGLLAKANRGILYVDEVNLLDDHLVDVLLDSAAGGWNTVEREGISIRHPARFVLVGSGNPEEGELRPQLLDRFGMHAEIRTVREPELRVKIVEQRTEFDQNPHPFCDQYQTEQEALQAKIVNAQNLLPQVTIDYDYRVKVSEVCAELDVDGLRGDIVTNRAAKALAAFEGRTEVTVDDISRVIVLCLRHRLRKDPLESIDSGSKVEKVFKRVFGVVDEA

SEQ ID NO: 2653 - protein, 665 aa, Synechocystis sp.
MSHRPRSDRHSFSSPSRFWHRLGMGLLVAGTLALPVSTLAQEGGEGAQPKASPSPIQSPNSSNGEATPRSFFNSGSPRSAEPKMNYGQLIDAIKANQVAKVEVDTNRRQAIVTLKDAPPGSKPQTVQLLDNNPELLNLLRSRSETIDLDINRTPDNSALYGLLTNLLVVAILIGLVVMVVRRSANASGQAMSFGKSKARFQMEAKTGVGFDDVAGIDEAKEELQEVVTFLKQPEKFTAIGAKIPRGVLLIGPPGTGKTLLAKAIAGEAGVPFFSISGSEFVEMFVGVGASRVRDLFKKAKENAPCLVFIDEIDAVGRQRGVGYGGGNDEREQTLNQLLTEMDGFEGNSGIIVIAATNRPDVLDLALLRPGRFDRQVTVDYPDVQGRELILAIHAQNKKLHEEVQLAAIARRTPGFTGADLANVLNEAAIFTARRRKEAITMAEVNDAIDRVVAGMEGTPLVDSKSKRLIAYHEVGHALIGTLCPGHDPVEKVTLIPRGQAQGLTWFTPDEDQSLMTRNQMIARIAGLLGGRVAEEVIFGDDEVTTGAGNDIEKITYLARQMVTKLGMSSLGLVALEEEGDRNFSGGDWGKRSEYSEDIAARIDREIQAIVTAAHQRATRIIEENRNLMDLLVDALIDQETIEGEHFRQLVESYQQSQKQPALAGK

SEQ ID NO: 2654 - protein, 204 aa, Synechocystis sp.
MALHFSAIAYPDPAVTPTDSSYLLVMLHGWGADARDLSDLAPMLDLPNYQWRFVNAPFTHPQIPQGRAWYDLESQNFEGLAQARQGLRAYLLGLAEETGIPLARTILGGFSQGGAMALDVGLTLPLAKIFSLSGYLHFQPESQPQAIAPILLIHGTEDPVVPLRMAQQAKAELESIGASVEYQEFPMGHAIPPMALARLKSFLS

SEQ ID NO: 2655 - protein, 650 aa, Synechocystis sp.
MANLRTHFVCFDDVPAKELSPPAVSDFPRLQTSMNDLILAVRQLEIAFPDADTREKLLAVKGVDFELERGEILGIVGESGSGKSVTSLGIMGLVPKPGWVEPSSEIDFFAQAQSSPVNLVALPEGDKRQYRGGKIAMIFQEPMSSLNPVYTIGFQIIEAIRLHQNVTQEEAQNQAIALLQEVRVLPKDEVLEEEFLAQEQAQPRGKVTQNLASYIQQRKQSFLKRYPHELSGGQLQRVMIAMAISANPRLLIADEPTTALDVTVQAEILRLLRDLCKQHQEMSLIFISHDLGVINEIADRVAVMYRGEIVEQGLKEQILHSPQHPYTKGLLACRPRLEIQLDHLPTVGDFLNADGPPPSYQVITPAQESDRLAQLQAKPPLLEVQNLTVSYGQGGLFGKKSVFKAVNDVSFQVYPGETLGLVGESGCGKSTLARALLRLTPIQTGRIIFDGQNVAALPEKSQQWRRLRREMQIIFQNPYNSLNPRMTIGRAIQEPLIIHEPKQSTKQQRQRVAELLERVGISPQWFNRYPHELSGGQRQRICIARALALNPRFIICDESVSALDVSVQAQVLNLLKELQRDLQLTYIFISHDLSVVRFMGDRIMVMNRGQLAEPINTAQEIIENPQSAYTKKLIQSIPRFPETLNWLQSA

SEQ ID NO: 2656 - protein, 593 aa, Synechocystis sp.
MTKPIAPLLSLLNYSRVHRAKIYWAVTCSLLNKIFDLAPPALIGLAVDVVIKQQDSFLSRWGIVSVQSQLLVLTVASAVIWALESIFEYAYERLWRNLAQDIQHDLRLDAYAHLQQLDLAYFEERSTGRLMAILNDDINQLERFLDVGANEILQVLTTVVVIGGAFFVITPDIAWMAVVPMPFVLLGSIYFQSLLTSRYALVREKVSNLNSRLSNNLSGIMTIKSFATEAEEVERLRQDSDAYRDSNQRAIALSAAFVPLIRVIIFAGFSTILYFGGLDAVRGNLAVGSYSMLVFLTQRLLWPLTGLGKTLDLYQRAMASTQRVMQLLATPIQAHPGELSLHPSQVQGELVFQNISFAYPHRSAVLKNVSLRVPAGQTIGIVGATGSGKSTLVKLLLRLYEWDSGDILLDGVDLKKYFLGDLRRSVGLVSQDVFLFHGTVRENIAYGSADATLAQIERAANLAEAEEFINQLPQGYDTIIGERGQKLSGGQRQRLAIARAILKNPPILILDEATSAVDNETEAAIVRSLEKITKNRTTITIAHRLSTVRYADQIYVLENGMVQEMGSHESLLAHQGLYAKLWRVQTGLRSGVS

SEQ ID NO: 2657 - protein, 745 aa, Synechocystis sp.
MAQTINLQLEGMRCAACASSIERAIAKVPGVQSCQVNFALEQAVVSYHGETTPQILTDAVERAGYHARVLKQQVLSSQQTEDRKPVFSAKLVTGLVISAVLFFGSLPMMLGVNIPHFPHIFHDPWLQWLLATPVQFWSGAEFYRGAWKSVRTRSATMDTLVALGTSAAYFYSVAITLFPQWLTSQGLAAHVYFEAAAVVITLILLGRSLEQRARRETSAAIRKLMGLQPQTALVKRGEHWETVAIAELAINDVVRVRPGEKIPVDGVVVAGNSTVDESLVTGESFPVDKTVGTEVIGATLNKSGSLDIQVSKLGQDSVLAQIIQLVQQAQASKAPIQHFVDRITHWFVPTVIVVAIAAFCIWWLTTGNITLAVLTLVEVLIIACPCALGLATPTSVMVGTGKGAEYGVLIKEASSLEMAEKLTAIVLDKTGTLTQGKPSVTNFFTLSPTSTEESLQLIQWAASVEQYSEHPLAEAVVNYGQSQQVSLLEIDNFQAIAGCGVAGQWQGQWIRLGTSNWLTDLGVTGTEHQPWQSQAQQWEKEQKTVIWLAVDTEVKALLAIADAIKPSSPQVVQALKKLGLSVYMLTGDNQATAQAIADTVGIRHVLAQVRPGDKAQQVEQLQQKGNIVAMVGDGINDAPALAQADVGIAIGTGTDVAIAASDITLIAGDLQGILTAIKLSRATMGNIRQNLFFAFIYNVIGIPVAAGLFYPLFGLLLNPILAGAAMAFSSVSVVTNALRLKKFCP

SEQ ID NO: 2658 - protein, 293 aa, Synechocystis sp.
MKTAWVFPGQGSQAVGMGVDLLSTAIAKEKYQQAEEILGWSVVEKCQGDEASLALTQNTQPCLYVIEAILADLLRDKGFQPDYVAGHSLGEYSALYAAGVFDFATGLQLVKQRSEVMASASGGMMAALMKFDQTQLQQALTDNTEVVLANDNSPEQVVISGTVAGVEAILANVKARRAVPLKVSGAFHSSFMAQPSQSFAQTLTACHFNDATVPVLSNVDPSPTQNGDRLKEKLIQQMTGSVRWRETMVNLGEIGATDYWEVGPGKVLTGLCKRTCPDLNLKNIGQLDDLNSL

SEQ ID NO: 2659 - protein, 461 aa, Synechocystis sp.
MTKKTWSDRFEGTLHPAIALFNASIGFDIELIEYDLDGSIAHGKMLAKTGIISPGEAEQLVQGLEQIRQEYRAGNFNPGVDQEDVHFAVERRLTELVGDVGKKLHTARSRNDQVGTDVRLYLRAQIDDIRQRLRDFQAVLLQLAETNVETLIPGYTHLQRAQPVSLAHHLLAYFQMAQRDWQRLGEIRARTNVSPLGSGALAGTTFPIDRHYSAELLGFAGVYANSLDGVSDRDFAIEFLNAASLIMVHLSRLSEEMILWASQEFSFISLTDSCATGSSIMPQKKNPDVPELIRGKAGRVMGHLQGMLVLMKGLPLAYNKDLQEDKEALFDAVKTVQVSLEAMTILLDEGIVFRQERLAEAVAEDFSNATDVADYLAAKGVPFREAYNLVGKVVKTSLAAGKLLKDLTLAEWQALHPAFEEDIYQAITPQQVVAARNSYGGTGFEQVKMAIANAKAELSQT

SEQ ID NO: 2660 - protein, 148 aa, Synechocystis sp.
MWRYAQVFIKLLLRRPLSAVTVIPVLSDSSIVLVKRRDTGQWSLPGGLIDWGETVAITAARELQEETGLRLIKIDRLLGVYSSPDRDPRMHSVTISLVVKAQGDLLIGDRQEISEVKAFAVEDLPLGALSHDHDQQLQDFLRGETIIA

SEQ ID NO: 2661 - protein, 390 aa, Synechocystis sp.
MSDATPFRPPSEAEEALIKETRLPLTGWQQEVDQGLTYGLEAAASIKDRSIPTFSRGELPHYAGINTFMKAPYLEDVREVGKYDVAIVGVPHDSGTTYRPGTRFGPQGIRRISALYTPYNFEMGVDLREQISLCDVGDIFTIPANNEKSFDQISKGIAHIFSSGAFPIILGGDHSIGFPTVRGICRHLGDKKVGIIHFDRHVDTQETDLDERMHTCPWFHATNMANAPAKNLVQLGIGGWQVPRQGVKVCRERATNILTVTDITEMSLDAAADFAIARATDGTDCVWISFDIDCIDAGFVPGTGWPEPGGLLPREALYLLKRIIRETNVCGMEVVEVSPPYDISDMTSLMATRVICDTMAHLVVSGQLPRTEKPAYIHAEANMAVDEPWQ

SEQ ID NO: 2662 - protein, 972 aa, Synechocystis sp.
MGWKTIFVAPMNSSTTVWSIAPEAVYERLETSPQGLSGEEAARRLQRYGLNELAEPVQRPLWLRFVDQMTHFMALLLWVAGILAFVSGTPQLGWAIWAVIWINGLFSFSQEFRAEKALATLKKVLPAQVKVYRDGTLQSVLARELVRGDVVQLEEGDRVSADLRLVSADSLYVDVSVMTGESLPVARFAESAQIREVVPKRGGQVLVHGGERALQDPVKAQEIRNLVLAGSTIATGRGVGVVYATGAETEFGHMAHLTTNVKREPSTLEVQISQIVRVITLIAVGMGVLVFVLASLVTHLELKESFIFAIGIIVALVPEGLLPTVTLSLAMGVQRMAKRNALVRRLSAVETLSATTVICTDKTGTLTKNEMTVRSLWIPATNHGQTLTVPGEGYDPSTGKITFPPGKDEKQQVKLLLIGSALCSNAHLIHPSGSSRWQEMGDPTEAALLVAALKADFDLEQLQQDYPRRREVPFDSRRRMMTVVLDWQKAGENLPFLTSGRNDLPWENLAFTKGAPLEVLRCCQSILKAGQVTELTSGDRQIITEANDHYAKEGFRVLGLAVRADHENLLEASPQTLEQQLIFVGLVAMFDPPRPEVPEAIARCHGAGIAITMVTGDYGLTAEAIARSIGLVKEKVRVVTGDGLTHLSDAQLRQILKYRSGLIFARMAPEQKLRLVQAYQGLGQIVAVTGDGVNDAPALRAANIGIAMGLNGTDVAREAADIVLTDDNFATIVSAVEEGRTVYQNIRKFITYILASNVAELVPFLAMIFLNIPPALLIMQILAIDLGTDMVPALALGIEKAEVGTMKLPPRQKNQALLDRALLLRAYCFLGIIEAGLGMAGFFLVWGSYGYGLAELQAVTTSILHHTADPILMAIYAQATTMTLAVIVACQDGNVFACRSERTSAFKLGWFSNPLIWIGIATEWMLILSLMYFPSLQAIFTTTPLTNWQFALLLSCPPLLLGAEELRKFKFL

SEQ ID NO: 2663 - protein, 601 aa, Synechocystis sp.
MTPSPAAPPSDNDWRLLLRLLPYVKRYPKELAAALVLLIPVAFSGAVQPLIIGQAVSLLREEPAWGFLDAMPLDRALHTLVIILAVTIVIRLLFLGLQGFIVQKMGQEITADVRQDLFEHVTSLSVNFFHRTPVGRLVTRITSDVEALGEVFASGAIGVVSDIVSILAIIVTIFWVQWQLALLLVGMLVPVTVLIIYFQQQYRKANYQAREELSRLNSQLQENVAGINVVQLFRREELNSRSFRRVNEKYRRAVDKTIFHDSAVSATLEWISLVAIAGVLGLGGWLILRDNLEFGVLAAFILYGQRLFNPLRQFADKFTMFQSGFTAIERIGELMEEPVEIKDQAVITPIEINGALRGSHGEICFENVWFGYKPDEYVLKNLNFTIKPGEKVALVGPTGAGKSSIIRLLCRLHDPSRGRILVDGIDIRELSQQQLRRFIGVILQDSFLFAGDVKRNITLGEEYSLEEVQRAAQLTSVDRLIEELPQGYHTQLRERGSNLSGGQKQLLAFARVAIREPYVLVMDEATASLDVRTEADIQAALLHLLQDRTSIIIAHRLSTIRNVDRIFVLKHGEIVETGNHDQLLDLKGLYASLYQLQMLGG

SEQ ID NO: 2664 - protein, 670 aa, Synechocystis sp.
MVVATQSLDELSINAIRFLAVDAIEKAKSGHPGLPMGAAPMAFTLWNKFMKFNPKNPKWFNRDRFVLSAGHGSMLQYALLYLLGYDSVTIEDIKQFRQWESSTPGHPENFLTAGVEVTTGPLGQGIANGVGLALAEAHLAATYNKPDATIVDHYTYVILGDGCNMEGISGEAASIAGHWGLGKLIALYDDNHISIDGSTDVAFTEDVSKRFEAYGWHVLHVEDGNTDLAAIAKAIEEAKAVTDKPSMIKVTTIIGYGAPNKSDTAGIHGAALGTDEVAATRKNLGWDYAPFEVPQEVLDYTRKAIERGASYEAEWNQAFAQYKTKYPTEAAAFERQLSGALPEGWDKTLASFTPDQKGLATRKYSEECLNALAPVLPELIGGSADLTHSNLTELHCSGDFQKGAYQNRNVHFGVREHAMGAICNGIALHGSGLLPFGATFLIFTDYMRAAIRLSALSEAGVIWVMTHDSIGQGEDGPTHQPIEVLASLRAIPNLTVIRPADGNETSGAYKVAIAKAKENAPTLLSLTRQAVPNLPGTSIDAVAKGAYTIVDSEGVPELILIGTGSEVQLCVAAAEKLAAQGKKVRVVSMPSWELFETQDAAYKESVLPKAVTKRLSVEAATNFGWHKYVGTEGDTVSIETFGASAPGGVCLEKFGFSVDNVLAKAKTLLS

SEQ ID NO: 2665 - protein, 416 aa, Synechocystis sp.
MANLEKKRVVVTGLGAITPIGNTLQDYWQGLMEGRNGIGPITRFDASDQACRFGGEVKDFDATQFLDRKEAKRMDRFCHFAVCASQQAINDAKLVINELNADEIGVLIGTGIGGLKVLEDQQTILLDKGPSRCSPFMIPMMIANMASGLTAINLGAKGPNNCTVTACAAGSNAIGDAFRLVQNGYAKAMICGGTEAAITPLSYAGFASARALSFRNDDPLHASRPFDKDRDGFVMGEGSGILILEELESALARGAKIYGEMVGYAMTCDAYHITAPVPDGRGATRAIAWALKDSGLKPEMVSYINAHGTSTPANDVTETRAIKQALGNHAYNIAVSSTKSMTGHLLGGSGGIEAVATVMAIAEDKVPPTINLENPDPECDLDYVPGQSRALIVDVALSNSFGFGGHNVTLAFKKYQ

SEQ ID NO: 2666 - protein, 77 aa, Synechocystis sp.
MNQEIFEKVKKIVVEQLEVDPDKVTPDATFAEDLGADSLDTVELVMALEEEFDIEIPDEVAETIDTVGKAVEHIESK

SEQ ID NO: 2667 - protein, 415 aa, Synechocystis sp.
MVVRPQGGVNAGHTIVVNDQTFKLHLIPSGILYPDTECIIGSGTVIDPKVLLQEFDQLEALDVSLDRLYISQTAHVTMPFHRLLDQASEEKRGEHKIGTTGRGIGPTYADKSERMGIRVVDLMNPEILRKKLLWTVEYKNVVLDKLYDLPPLDPETVIAEYTTYADRLRPHVVDSSLKIYDAIHQRKNILFEGAQGTLLDLDHGTYPYVTSSNPIAGGACVGAGIGPTMIDRVIGVAKAYTTRVGEGPFPTELDGELNQHLCDRGAEFGTTTGRRRRCGWFDGVIGRYAVRINGLDCLAITKLDVLDQLAEIKVCVAYELDGKTCDHFPGNAAEFARCQPIYKTLPGWQCSTEECRTLEDLPPQALDYLKFLAELMEVPIAIVSLGASRDQTIIVEDPIHGPKRALLYANGDPLA

SEQ ID NO: 2668 - protein, 276 aa, Synechocystis sp.
MGIRNYRPMTPGTRQASVSDFTEITKSKPEKSLTTNRHDQKGRNNRGVITSRHRGGGHKKLYRIIDFKRNKQNIPARVAAIEYDPNRNARIALLFYTDGEKRYILAPAGLQVGMTVIAGEEAPFEIGNTLPLSRIPLGSEIHNVELVAGRGGQMVRSAGAFAQVVAKEGDYVTIKLPSKEVRMVRKECVATLGRVSNAEFRNLKLGKAGRKRHLGRRPHVRGSVMNPCDHPHGGGEGRAPIGRSGPVSPWGKPALGAKTRNKKKRSSALIVRRRTK

SEQ ID NO: 2669 - protein, 297 aa, Synechocystis sp.
MSSTQDYIGEEAATRVKILSEALPYIQHFAGRTVVVKYGGAAMKDSNLKDKVIRDIVFMASVGIRPVVVHGGGPEINTWLDKVGIEPQFKDGLRVTDAATMDIVEMVLVGRVNKELVNLINQAGGKAVGLCGKDGQLMTARTMTNKDVGFVGEVSSVDARVVETLVKSGYIPVISSVAADEFGQAHNINADTCAGELAAALGAEKLILLTDTRGILRDYKDPSTLIHKLDIQQARELIGSGIVAGGMIPKVTCCVRSLAQGVRAAHILDGRLPHALLLEVFTDLGIGSMIVASGYDL

SEQ ID NO: 2670 - protein, 326 aa, Synechocystis sp.
MVENLSKVYPIALKSPGLKGTLQHFWQRRYRQILAVQDISFTIPPGAMVGFLGANGAGKTTTLKMLTGLIKPSGGKVRVAGFDPFRRQTAFLRRTSLVMGQKQQLIWDLPTLDSLRINGAIYEIPDQVFEQRLGELSEMLDLTTELKQPVRKLSLGQRMKAELLAALLHHPTVLFLDEPTLGLDVNAQVAVRRFLQEYNRRYQATVLLTSHYMADITTLCERVLLIHQGQLMYDGDLEALVERFSPYRQVAVELSAPIPLEKLQLYGEVESVEGLLVRFLLKRESLTTAIAKLLAELPVSDLSVSDPPIEEIIGRLFSQGNLDNKL

SEQ ID NO: 2671 - protein, 1200 aa, Synechocystis sp.
MVYVKRIELSHFKSFGGTTAIPFLPGFTVVSGPNGSGKSNILDALLFCLGLATSKGMRAERLPDLVNNTFKGNRGSSEASVSVTFELHDGENLSEPGANHNGNGNGAKISKEWTVTRRLKVTKGGNYSSNYYINGETATVTELHEQLNELRIYPEGYNIVLQGDVTRIITMNSKERREIIDELAGVAEFDRKIVKTKETLTEVQDREERCQIIATELERTLERLAADRQKAEKYQALRQQVQEKQGWAKVIQYKAVEQQRQKLWGQLERDREQSQQIQQALDQRSQAIQTQQTELEKLNAQVKALGEEEQLAVAAQLATQKAQRDQLQQRYNDGDRQITNHQQQVGQIQAEISQSQQQFLHIQQEKSFHNTQTLPQLEAAVQTSQQQLEQLRHQAQAIASASEAWVQEQTQLSRTVNQLQDELIPQRSQLAQLEERQQQLLTNLAELTPLLTKVSVELEEKQFAQGQFNFQGEALTSQIQTLASDLAQLEQERSLLQETQTRLLKEQQEKQRQLDKLEAASQAQQEVQGTYATKVILQSDLPGVCGLVAQLGQVEPQYQLALEIAAGGRLGFLVVEDDGVAAAGIEILKQAKAGRATFLPLNKIRPPKGQNPNLSYAHGYIDLAVNLIDGDRRYADIFAFIFGNTIVFDTLVNARNHLGKHRIVTLEGDLLEASGAMSGGSRNQRSGLRFGTMVSEDTAEVKQLRQRLQDIQQVQGRNEELLLERTVRSRQLTQQLMEMRQQQREAQLHGEQTERDIARLSQQQTQINQQQINQQQKLAELQQNLALLQQSLPPLEQQLASAQQQLTALETSQTHQQWQTIQIQIRTVEAEYQRQLQALRQGEDHLKDLQNSSQRLEEKIAQAQEKIAQHQAQDLTLAQEQEQLKIALAEMNGAIQTTEAQLAKLSEKLGSTKQERDRLETQLNQLRSQQQEQQWQWEKLQTNQQEYQENLTQLQTQLEALEQDLPDPWPEIPLLQDRDEANLDFANILEELERSIRNGQKRLEAMEPVNMLALQEYEKTEARLGELSEKLQTIAGERTELLLRIENFTTLRRRSFQDAFDAVNKNFQIIFAELSDGDGYLQLDDAEDPFNGGLNLVAHPKGKPVRRLSSMSGGEKSLTALSFIFALQRYRPSPFYGFDEVDMFLDGANVEKLSKMVRKQAQQAQFIVVSLRRPMIEAAERTIGVTQARGAHTQVLGIKL

SEQ ID NO: 2672 - protein, 211 aa, Synechocystis sp.
MALQLGDVVPDFTQESSQGPISFHEWAGDSWVVLFSHPADYTPVCTTELGTVAKLKPEFDKRNVKVIALSVDDVESHKGWICDIDETQNTTVNYPILADGDKKVSDLYGMIHPNALNNLTVRSVFIIDPAKKLRLTFTYPASTGRNFDEILRVIDSLQLTDYHQVATPANWQDGDKCVVVPSISTEDAKVKFPKGVEEIKPYLRLTPQPNK

SEQ ID NO: 2673 - protein, 563 aa, Synechocystis sp.
MGIAEKSMIQVLDRQLVDLIAAGEVIDSPLAVVRELVENALDAGADRILVRVWWDQWRLEVLDNGQGMDVTELKTSVLPHATSKISTQADLQRIKTLGFRGEALHSLAQVARLTISSRSVASPGCGWRITYSPQGSPEQIEPVAIAMGTRVEVRQLFANFPQRRQAFAKSQQFWRPMVTYLQQLALCHPQVTWQLWQDERLRLSLSPGPNPEAILLQCLKSLQAGQLGYTQQSLSLPVDLENQATSAQLSLTFGYPDRCHRPRPDWLIIAINGRPVNVPELTQTILAVFHRTLPRQRYPLCFAHWQLPPQCIDWHRHPAKTEIYLQDLPHWQGQLKTLLHQSLAILGNDAPPRLNQLLKAAEPKGVYQLQGASSLTETVLGYPKAFKAIAQVCQTYVVVEHDQGIWLVEQHVAHERVLFEQLQRHWQCLPLEQPLVLQGFNPEQVERLQNLGLEIDPFGEDIWAVRSLPALLQGQEEIIAILRELSQVFSLSTAQAAIACRSAIKNGMELDRIAINKLIEQWQQCDNPHTCPHGRPIYLALDESSLARFFRRNWLVNPKTSGS

SEQ ID NO: 2674 - protein, 1092 aa, Synechocystis sp.
MPQFKAITTIAIIFYRSHYLSGNTTPIDALCQALEKHNLNPLAIYVSSLREPDVQAEILAILENLDQPLGAILNTTSFSLAKLQRQIGNLEMIPLWQKLNVPVLQVILSGGDRQQWQEGLRGLNPRDLAMNVALPEVDGRIITRAISFKAMAARHPQLETEVAIYEPVLDRVEWIAELTKNIINCAQTEIFQRKIALILANYPNKDGRLANGVGLDTPASCLQILEALKIAGYHLSAIPKDTETLIKQLTQGVTNDQELAQYRTVNQTIVTEKVWQFFYSLPQSVQQAMTERWQVRENWDNLPDQFAISGIQFGNIFVGIQPARGYDFDPSLNYHAPDLEPTLHYLAFYLWLRQEFSAQAIIHLGKHGNLEWLPGKSVVLSDHCHPEIALGPLPNFYPFIVNDPGEGTQAKRRSQACIIDHLTPPLTRAELYGDLEKLEALIDEYYEAQALDPTRVKTIGDRLRKLLATSNLQTDLGLTPPALKDLQPLLTSADSYLCELKEAQIRDGLHILGQTPTGEQLRDLAISIARSPSYQRLGLTQAIAFDLELEFDPVLDDPNEPWQLSSTMQMKLQQWELTQFIELFNSCRIGGQVIEILEEIAKQLVGSLLEIVIVDQKVNLFFQKPDSKTKSNLDYIEQTLLPMLQQTPQEITNLLRGLNGEYIASGPAGAPSRGRPDVLPTGRNFYAVDIRAIPTETAWDIGRRAAETLIERYTQDHGEYPQTLAISIWGTSTMRTGGDDIAQVLALLGVQPVWDSPSRRIVDFEILPTTVLKRPRVDVTIRISGFFRDSFPNLVEFLHQAIAAVSQLDEPANLNPLAEKVKQETEQWQQLGLATEEAVTKATYRIFGSKPGAYGAGLQGLIEAQNWQDDSDLARAYLNWSCYAYDRQGVGHNQPEVFAQRLQNLQIVLHNQDNREHDLLDSDDYYQFQGGLTAAVRSLTGKNPTVYFGDNSNPAQPKVKLLTQEIAKVYRSRVVNPKWIAGVMRHGYKGAFEMAATLDYLFAYDATAHCVEDFMYTGIAQAYLLDEEVQKFVQQHNPWALRDMAERLLEAEQRQLWSNVDPQLLDQLRAIAHGAEEILENSQIYPRQEKLK

SEQ ID NO: 2675 - protein, 152 aa, Synechocystis sp.
MTTVWKVLVLHGPNLNLLGQREPGIYGSLTLGEIDACLREDGVDLEAEVSTFQSNSEGQLVTAIHGALGNYHGIVFNAAAYTHTSIALRDALAAVQLPCVEVHLSNIHKRESFRHISHIAPVAIGQICGFGLNSYRLGLRALVDYLNGQADS

SEQ ID NO: 2676 - protein, 404 aa, Synechocystis sp.
MHSQKLVTAMKILVLAWEFPPRIVGGIARHVAELYPELVQQGYEIHLITVATEESPSQEMVDGIHIYRVPVPPSNDFFQWVDNMNRAMEQRGQALFQEQKKFDVIHAHDWLVGDVAINLKHHGKIPLVVTIHATEYGRYNGLYNDTQRYIAGKEGILIYNGWRVIVCSNYMRHELERAFGTPWDKIDVIYNGIRPEKKHRRPDFDYRNFRRKFAEDGEKIVYYVGRMTYEKGISVLLTAAPQVLEALNDQVKFVIIGGGNTDRLKQLAWNLGIWEHCFFTGFMSDEDLDKFQTIADCAVFPSLYEPFGIVALESFAARVPVVVSNTGGLAEVVRHHSTGIVTQTNNPDSLAHGILEILSNPSLAKQLVEAAYKDLGIRFNWSKLAKETAAIYERVVEERQTVEW

SEQ ID NO: 2677 - protein, 362 aa, Synechocystis sp.
MGNTFGSLFRITTFGESHGGGVGVIIDGCPPRLEISPEEIQVDLDRRRPGQSKITTPRKEADQCEILSGVFEGKTLGTPIAILVRNKDARSQDYNEMAVKYRPSHADATYEAKYGIRNWQGGGRSSARETIGRVAAGAIAKKILAQFNGVEIVAYVKSIQDIEATVDSNTVTLEQVESNIVRCPDEECAEKMIERIDQVLRQKDSIGGVVECAIRNAPKGLGEPVFDKLEADLAKAMMSLPATKGFEFGSGFAGTLLTGSQHNDEYYLDEAGEWRTRTNRSGGVQGGISNGEPIIMRIAFKPTATIGQEQKTVSNIGEETTLAAKGRHDPCVLPRAVPMVEAMAALVLCDHLLRFQAQCKTL

SEQ ID NO: 2678 - protein, 610 aa, Synechocystis sp.
MNRASPMTQAVPGLWAVITTFWPQIRAQWRLLLVAMVTLLADVGLRLLEPWPLKLLIDGVLIPTQTQPSLSLWGFTNLNAAWLLMLIAVGVIIIAVSRAIATYWNTVSLAIVGSRVMAQVRDQLYGHLQRLSLRYHYQARSGDLIIRVSSDANRLQEILLTAALPLVVSLLTLGGMVGVMAWLDLKLTLLSLATFPLFWLAANRLSAKIRHASLTQRHQEGAVASTAAESLSAIKLVQALSLEQAFADLFSRQNQRSLQENIETKRLAANLERLVDVLIAFGTALVMGYGGHLVIEDALTAGTVLVFLTYLRNAYKPVQNFAKYTGRLAKAAASGERILNILAETPDIQDKPGAIPAPFFQGRIEFKYVSFGYHPDQAILDGLNLTVRPGEKIALVGASGSGKSTLLSLLLRLYDPTAGKIFIDGHDLRDYQLTSLRNQMAVVLQESLLFAATIRENIAYGIEGATMAEIEAAARLANAHKFILELPQGYDTVVGERGTTLSGGQRQRLAIARAAMRQTPILILDEPTSGLDKVNEQLVFEALERLAENRTTFLVTHNLQLAIAADQILYLYQGQIREQGTHAELLARQGVYADLFQRQTLATVTKSLGR

SEQ ID NO: 2679 - protein, 324 aa, Synechocystis sp.
MAETLLFAALRQALDEEMGRDVNVLVLGEDVGLYGGSYKVTKDLYEKYGEMRVLDTPIAENSFTGMAVGAAMTGLRPVIEGMNMGFLLLAFNQIANNAGMLRYTSGGNYQIPMVIRGPGGVGRQLGAEHSQRLEAYFHAVPGLKIVACSTPYNAKGLLKAAIRDNNPVLFFEHVLLYNLKENLPDYEYIVPLDKAEVVRPGKDVTILTYSRMRHHCLQALKTLEKEGYDPEIIDLISLKPFDMETISASVKKTHRVIIVEECMKTGGIGAELIALINDHLFDELDGPVVRLSSQDIPTPYNGMLERLTIVQPPQIVDAVKAIIG

SEQ ID NO: 2680 - protein, 509 aa, Synechocystis sp.
MVTLLENPFRTGLRQERTPEPLILTIFGASGDLTQRKLVPAIYQMKRERRLPPELTVVGFARRDWSHDHFREQMRKGIEEFSTGIGSEDLWNEFAQGLFYCSGNMDDPESYLKLKNFLGELDEKRNTRGNRVFYLAVSPNFFPPGIKQLGAAGMLSDPVKSRIVIEKPFGRDLSSAQSLNRVVQSVCKENQVYRIDHYLGKETVQNLMVFRFANAIFEPLWNRQFVDHVQITVAETVGVEERAGYYESAGALRDMVQNHLMQLFCLTAMDPPNAIDADSIRNEKVKVLQATRLADINNLENAGIRGQYKAGWMGGKPVPGYREEPGVDPSSTTPTFAALKLMVDNWRWQGVPFYLRTGKRMPKKVSEIAIQFRQVPLLIFQSVAHQANPNVLSLRIQPNEGISLRFEAKMPGSELRTRTVDMDFSYGSSFGVAAADAYHRLLLDCMLGDQTLFTRADEVEEAWRVVTPVLSAWDAPSDPLSMPLYEAGTWEPAEAEWLINKDGRRWRRL

SEQ ID NO: 2681 - protein, 352 aa, Synechocystis sp.
MAGCPAFSLLDFSASINPLGPPASVLAAIESALPALRHYPDPQYIHLRQAIADHHQLSMDWVLPGNGSAELLTLAGRTFASLDCTYVVGPAFGDYGRSWRGAGAELKTIPWQVDQPWPWRKLRSPSEIANTSAVQSSHHGLILNNPHNPSGTLLAREEILALLPHYQWVLLDEAFMDFLPPGEEQSLVGDLEKHPNLIILRSLTKFYRLPGLRLGYALAHPDLLAQWQAWRDPWPVNVLAEAAAIASLEAEEFRQLVWQWLPPARSALQQDLASLPGLFPLPSQTNFLLVKTTIPAPELQEELLTKCQILIRDCLSFPELGEDFFRVAVRTMADNQKLTQALATIMATAAPS

SEQ ID NO: 2682 - protein, 478 aa, Synechocystis sp.
MADRQSLEEALRRIWGYDHFRYPQGEVIDCLLARRDCLVVLPTGGGKSICFQLPALLGEGLTLVVSPLVALMEDQVQSLRRQNLPAACLHSQLSRPERKQVLYQLGQQQLKLLYLSPETLLSEPVWNLLRQPQVKLQGIMLDEAHCLVQWGDSFRPAYRRLGALRRGLGRDKGQIPLAAFTATADRQQQNLIVEGLNLRSPECFQVSPHRPQLHLKVKMVLSEYCRRQQLRRFLLKHLQESGLIYVRTRTMAINLAQWLQERGFDSEAYHGGLGPHQRRQLEQKWLTGQISSVVCTNAFGLGIDKPDTRWVLHYQAPLMLMDYLQEVGRAGRDLQPAECLTLVSEPTGWLDSGDRQLRQYFLSQASKYLQRAEVLSQQIPSQGNLGQLKAHFPDLEMALAWLHRRGNLEWLDPFNYRINPGHYQANPLEELKSQYRLMTQYLTTSRCRWQTILVAFGDNSPAARRPCGTCDNCLVGRC

SEQ ID NO: 2683 - protein, 628 aa, Synechocystis sp.
MAIKPQPQWQRRLASVLLWGSTIYLLVNLLAPALFRSQPPQVPYSLFIDQVEGDKVASVYVGQNEIRYQLKPEAEDEGKEKAAEGQILRTTPIFDLELPKRLEAKGIEFAAAPPAKNSWFGTLLSWVIPPLIFVGIWSFFLNRNNNGAPGGALAFTKSKAKVYVEGDSTKVTFDDVAGVEEAKTELSEVVDFLKFPQRYTALGAKIPKGVLLVGPPGTGKTLLAKAAAGEAGVPFFIISGSEFVELFVGAGAARVRDLFEQAKKQAPCIVFIDELDAIGKSRASGAFMGGNDEREQTLNQLLTEMDGFSAAGATVIVLAATNRPETLDPALLRPGRFDRQVLVDRPDLAGRLKILEIYAKKIKLDKEVELKNIATRTPGFAGADLANLVNEAALLAARNKQDSVTEADFREAIERVVAGLEKKSRVLSDKEKKIVAYHEVGHALVGAVMPGGGQVAKISIVPRGMAALGYTLQMPTEDRFLLNESELRDQIATLLGGRAAEEIVFDSITTGAANDLQRATDLAEQMVTTYGMSKVLGPLAYDKGQQNNFLGQGMGNPRRMVSDDTAKEIDLEVKEIVEQGHNQALAILEHNRDLLEAIAEKILEKEVIEGEELHHLLGQVQAPGTLVV

SEQ ID NO: 2684 - protein, 714 aa, Synechocystis sp.
MDSPAILPTTRTLCPYCGVGCGLEAVASPQKSVVDAGHAHKIRGDRQHPSSQGMVCVKGATVMESMDKQRLLYPMFRSSLDQPWQQISWEAALEIVVDKIQQVKQTLGVSGLCMYASGQMQTEDYYVAQKLFKGCLGTNNFDTNSRLCMSSAVSAYSLSFGSDGPPCCYEDLEITDCAFLIGTNTADCHPIIFNRLRKHHKQNPHVKLIVVDPRCTATAEVADLHLAINPGSDITLLHGIAYLLKKWNLIDQKFIDNHTQDFEQYCQVIDHYPPEKVTQICGISLEQLETAAHYWGNAKTVLSLWSMGMNQSFQGTAKGRCLINLHLLTGQIGKPGSGPFSLTGQPNAMGGREAGGLSHLLPGYRSIKNPQHRQEVEQLWQISPGRINPEPGLSAWEMFMGLENQQVGFLWIVATNPVVSMPDLERVKKALQQSTFTIHQDAYSPTETAEYAHLLLPAAQWSEKTGTMTNSERRVTLSPAFRSPPGEARPDWEIFAEVGRRLGFENQFNFVDSAAVHREYVQLTAERLCDQSGVSYEKLQKLGPLQWPCRQSDQESQLLSTKRLYTDYKFCTENGRANFCLDHSRGLAEPVDPNYPFVLTNGRLYGHWHTQTRTGHIEKIKKMHPKPILEMHPKDAEKLGIKSQDLVAIKSRRGSAQLEVLVTRAIAPGTVFMPMHWGFLWDDNAEVNSLTHATACPISKQPELKACAVNITPV

SEQ ID NO: 2685 - protein, 214 aa, Synechocystis sp.
MALKLYFLRHAQTAYSATGGYCGTPENDPGLTPEGILMAKEFAEAYAQHPWQAVYVSPLQRARQTVQPLCDRLGIEMQIRPGLREVAYGEWEGLHPDEVYQRDHDLYMQWLTDPAWNSPPGGERGIDIARRGTRVLEEIEDRFDDGNVLLVSHKATIRILLCCLLGIDVGRYRDRFAMPVTGLSVVELSSRGPLFHCIAERSHLSPYLRSLPST

SEQ ID NO: 2686 - protein, 793 aa, Synechocystis sp.
MPMTVVPDYLAHLNPSQRRAVEHFCGPLLVVAGAGSGKTRALTYRIAHLIRQHRINPENILAVTFTNKAAKEMKERLEKIFAQAWAQQEFSQRWELLGKYEQKQLLSRVYKTVTKPLWIGTFHSLCSRILRYDIDKYQDSSGRRWTKQFSIFDESDVQSLFKTIVTKDMDLDEKQFNPKSIRYQVSNAKNLGQSPETYLRENPSYKGRVIAEVYQAYQNQLAANNALDFDDLILIPTRLFQQNESVLGYWHRKFNHILVDEYQDTNRIQYDLIRLLSTNGEERQSEWDWRGRSTFVVGDADQSIYSFRMADFTILLNFQEDFGDRLLDGETTTMVKLEENYRSRENILQAANHLIEHNSQRIDKILKATRSGGDDIILYQADDERDESRFVINKILSLRKNNPELNFGDFAILYRTNAQSRAFEEQLLNNNIRYNIVGGFRFYDRQEIKDAIAYLRVLVNPADTVSLLRIINTPRRGIGKSTIEGFVNASKELDIPLWEIITDETSVNTLAGRSGKKTLQFARMLQEIQSQIGELSASEALSLVLEKSNYVDDLKQKGTEEADNRLANLGELDNAVRQFEAESEDPSLVDFLASASLTSDLDDLEESGDEVSLMTLHSAKGLEFPVVFLVGLEQGTCPHARSLNDPLDLEEERRLCYVGITRAQENLFLTHARMRYIWGSLETKIPSQFLQELPPDLLADGSTGRRTGRNAPAADPKGPSIAQKQARKKTGSQSTQPAKDLIWNVGDRVMHNNFGEGTVTHILGKGHKANLAIKFPGIGVKIIDPSFAPLRRL

SEQ ID NO: 2687 - protein, 575 aa, Synechocystis sp.
MLEQDVVIVGGGLAGCRAALEIKRLAPDTKVAIVAKTHPIRSHSVAAQGGIAASLKNVDAEDSWEAHAFDTVKGSDYLADQDAVEILTKEAPEVIIELEHLGVLFSRLPDGKIAQRAFGGHSHNRTCYAADKTGHAILHELVNNLRRNKVEIYDEWYVMKLIYEEGEAKGLVMYEIATGRIEIVRAKAVMVATGGYGRVYNTTSNDYASTGDGLAMAAIAGIPLEDMEFVQFHPTGLYPVGVLISEAVRGEGAYLINSEGRRFMEDYAPSRMELAPRDITSRAITLEIRAGRGVNADGSAGGPYVYLDLRHMGREKIMSRIPFCWEEAHRLVGIDAVEQPMPVRPTVHYCMGGIPVNTDGRVRKNANELTEGFFAAGECACVSVHGGNRLGSNSLLECVVYGRRTGRSIAEYVQGRSLPEIDEAVYKTEAQTRIDQLLNQQGTVRINTLRQAFQDCMTSHCGVFRSESFMAEGLEQVQNLKAQYGQIFLDDKQPQWNTEVIEALELQSIMAVGELILTSAIQRQESRGSHAREDFPSRDDEQFLRHTLASFDGEQIKVEYMPVVINRFEPKERKY

SEQ ID NO: 2688 - protein, 849 aa, Synechocystis sp.
MEHLPMAFNTTNPLIQVEDDRTGLSVETLKRALADNLFYLQGKFPAIATKNDCYMALAYTIRDRLLQRWLNTFQTYLNCDNRVVCYLSAEYLLGPHLGNNLINLGLWEPVQQAVEESGLSLDELIDIEEEPGLGNGGLGRLAACFMDSLATLEIPAIGYGIRYEFGIFDQEIKDGWQVEITDKWLQLGNPWEIARPESAVLVKLGGHTEPYTDDQGNYRVRWIAGSLVKGIPYDTPILGYKVSTANNLRLWKSEAAESFDFQRFNVGDYYGAVQDKMSSENLTKVLYPNDEQIQGKELRLAQQYFFVSCSLQDMIRIHLSDNPTLENFHEHFAVQMNDTHPSIAVAELMRLLVDEHHYEWQRAWAITEATFGFTNHTLLPEALEKWSLPLFGEMLPRHLEIIYEINQRFLDQVRMKYPNDGDRLARLSIIDEAGEKSVRMAYLATVGSHAINGVAALHSQLVKETILKDFYELWPEKFSNKTNGVTPRRWMVLSNPRLSNLISSRIGDGWIKNLDELKQLEPFADLAGFRQDWCKVKREVKQDLARYIHTRTDLVVNPDSLFDVQVKRIHEYKRQHLNILHVIHLYLQIKNNPNLDVTPRTFIYGGKAAPGYFTAKLIIKLINSVADVVNNDPTIGDRLKVIFLPDYNVKFGQRVYPAADLSEQISTAGKEASGTGNMKFSMNGALTIGTLDGANIEIREEVGAENFFLFGLTTPEVEKTLAEGYQPWEYYNNNANLKAVVDLINSGFFSHGDTALFRPLMDSLLGQDPYLVFADFQAYVDCQNQVGEAYKDQENWARMAILNVARMGKFSSDRTIREYAEDIWAIKPVVIELEDLCPDGQCLLISPNK

SEQ ID NO: 2689 - protein, 307 aa, Synechocystis sp.
MAEVVCFGEMLFDCLADQLGVPLEQVKSWTNYAGGAPANVACALVKQGVSAAFVGRLGADQAGQELKNVLQQCQVNTDGLQIDPHRPTRLVYVTRTGDGDRHFAGFGEYHTGDFADTAMQGETIPESLFTSAQYLVMGTIALAYAPSRTATERLVALAKKHQVKIFLDVNWRSVFWDDEAQAKERIPALITHAQILKCTDEEAVWLFGHQDPVTIHQKLPHLQGVLVTAGDKGCSYSLGKNHGEVPAFKVNVRDTTGAGDSFVAGFLAQALTHGENLFIDPHLSCQAVTYASAIGALTTLHPGAIAR

SEQ ID NO: 2690 - protein, 534 aa, Synechocystis sp.
MGRMAKYIGAGDVRSILIMAGVAAGIFLVRGMAQYGQDTLMAKAALNMALTLREQTYAHLQRLSLSYFEEAKTGDLSYRLTEDIDRIGEVVNKLFHDFVPSALQLVVVFGYMFYLNWALTCAVLVIAPLMAVLIGFFGEQLLKFSRRSQTRISNLSSLLTETLGAIRLVKAFAAEDYQLDLFREEAQQHRRSQFLAERMKALQFVVVGFLEAMGVVVLFCLAAWQISLGNLTGIEFISYVTGVAMLIDPISHITSNYNLFKQGEASVDRIFEIFDLQPSVEDSPTAIAIDHLQGAVDYDHVDFAYLEDKLVLKGINLQAQPGEMIALVGASGAGKSTLVNLLMRLHNVTGGCLRIDGHAIDSITLKSLREQIAIVPQENILFSGTIAQNIAFGKTDLDLAAIEEAARIANAHQFITELSQGYYTYVGERGVTLSGGQRQRIAIARAVLRNPSILILDEATSALDSESEALVQEALERIVQERTVFVIAHRLATVRKATRIVVLERGEIVEMGSHQELMAHQGRYARFHAQQFAS

SEQ ID NO: 2691 - protein, 591 aa, Synechocystis sp.
MQTSPLPRRTKIVATIGPATQSKEVLRQLIQAGATTFRLNFSHGDHAYHQQSIRLIRQIAFELNQPVGILQDLQGPKIRVGKFLNDAGSVQLKNGDPYTLTSRPVECTETISSISYEYLADEVPSGARILLDDGKLEMLVEEVDTVARDLHCRVIVGGTLSSNKGVNFPGVCLSVKAMTDKDKEDLMFGLDQGVDWVALSFVRNPQDIDEIKGLIAAAGKSVPVIAKIEKHEAIKDMQAVLEKCDGVMVARGDLGVELPAEDVPILQKKLIATANRLGIPVITATQMLDSMVNSPRPTRAEVSDVANAILDGTDAVMLSNETAIGKFPVEAVAIMAKIAERIEQEDINPSQAEASRTSIPNAISSAVSQIAETLNAAAIMSLTKTGSTARHVSKFRPKTPILAVTPHVDVSRQLQLVWGVKPLLVLDLPSTSQTFQAAINVAQENHFLRDGDLVVMTAGTLQGVAGSTDLIKVEVVKAILGRGVGIGQGAVSGRARVASRPQAIAQFTQGEILVVPSTNADCVDMMRRAAGIITEEESLTSHAAIIGLRLGVPVIVGFKGATQKIRDGAIVTIDAQKGLIYSGALPPVSKG

SEQ ID NO: 2692 - protein, 855 aa, Synechocystis sp.
MMSPRLFHQEQSMIDQSTLNTSPQPTITIEDDRTGMSVATLKRAFLDNLFYLQGIDRSQATLYDYYVALAYTIRDRLLHRFIKTVATYKQEKVKVVCYLSAEFLMGRHLGNNLINLGLYDKIDQVMKEFDLDLNEIIEQEPDPGLGNGGLGRLAACFLDSLASLEVPAIGYGIRYEFGIFHQRIQDGWQVEVPDNWLRFGNPWEIPRADESVEVKLGGHTEIIHNEKNQPKVVWIPERTILAIPYDTPVPGYQTNTVNPLRLWKAEASEEFNFEAFNSGLYDRAVAEKMDAETISKVLYPNDNTPAGRELRLAQQYFFVSASLQDLIRIHLRTHPNLDTFYELTAIQLNDTHPAVAIAELMRLFVDRYDYDWDKAWDITQKTFAYTNHTLMPEALERWSVDLFAKLLPRHLEIIYEINHRFLTGLQTWFPNDEALVESLSLIEENHGKKIRMANLACVGSHAINGVAALHTELLKKDTLRDFAKLWPQKFFNKTNGVTPRRWILLSNPELSALVTEKIGDGWLKNLDEMRQIEKFVDDPEFCRRWREIKQNNKRNLAAYLLKYRNVQIDVNSLFDVQVKRIHEYKRQHLAALEIIHLYNRIKQNPHAEIVPRTFIFGGKAAPGYFMAKLIIKLINAVGEVVNNDPDVRGRLKVVFVSNFNVSLGQRIYPAADLSEQISTAGKEASGTGNMKFAMNGALTIGTLDGANIEIREEAGPENFFLFGLTAEQVYAMKENGYHPHTYYDNNFDLKAVIDRIAHGYFSPGNPNLFHPIVESLLHHDPYMLLADYQAYVGCQDEVSKAYADQDRWTKMSILNSARMGKFSSDRTIREYCKEIWDVPPVKISLDEYHPEYADL

SEQ ID NO: 2693 - protein, 132 aa, Synechocystis sp.
MELEHPDDLYYLDSHEYVRFDGETATIGLSAFAVDELGDIVFVELPEEGDKVEFEQSMGAVESVKAASDLYSPVTGTVIEKNSALEDQPELLNQDPYGEEGWLIKVRLDDVEDAKEGLMAAGDYRATLETGD

SEQ ID NO: 2694 - protein, 354 aa, Synechocystis sp.
MTGSFFCYLFPRSFSMLKIGINGFGRIGRLVARIAMANPQVTLVGINDLVPASNLAYLFKYDSTHGSYGGTVVAKEEGIVIDDQFIPCFSQRDPAQLPWGDLGADYVVESTGLFTTYATAENHLKAGAKRVIISAPSKDPEKIPTFVVGVNHLNYNADTDKIVSNASCTTNCLAPIAKILDDNFGIVEGLMTTVHAMTATQPTVDGPSKKDFRGGRGAAQNIIPSSTGAAKAAALVLPQLKGKLTGMAFRVPTPNVSVVDLTFKTEKATSYEEICAAMKTAAEGELKGILGYTADDVVSMDFRTDPRSSIFDAGAGIGLNSNFFKVVSWYDNEWGYSCRVIDLMLTMASKDGLV

SEQ ID NO: 2695 - protein, 247 aa, Synechocystis sp.
MTALTAQVALVTGASRGIGKATALALAATGMKVVVNYAQSSTAADAVVAEIIANGGEAIAVQANVANADEVDQLIKTTLDKFSRIDVLVNNAGITRDTLLLRMKLEDWQAVIDLNLTGVFLCTKAVSKLMLKQKSGRIINITSVAGMMGNPGQANYSAAKAGVIGFTKTVAKELASRGVTVNAVAPGFIATDMTENLNAEPILQFIPLARYGQPEEVAGTIRFLATDPAAAYITGQTFNVDGGMVMF

SEQ ID NO: 2696 - protein, 248 aa, Synechocystis sp.
MPMAIDISNKTVLVTGANRGIGKVLVESFLEHGAAKVYAAVRKLESAAFLVDKYGNKIVPILIDLADPESIAAAAQTATDVEIVVNNAGVQKVANPLAEEAIACLKFEMETNVYGLISMAQAFAPVLKANGGGAFVQLNSVVSLKSFCNVATYSASKAAAYSITQALREVLAGQGTLVQSVHPGPIATEMTHASGRADIAESPTLVAEAIIAALQSGEFHVFPNDTMAKGMGDAYQSFGKNVIEVSFD

SEQ ID NO: 2697 - protein, 326 aa, Synechocystis sp.
MRIFPVFLLTFSLFLIKEEIVTAEVKVSAPVVNQSGIKLNLERQFTGSDVAINRIHFSPDGQFLLTAAADGVGTLWTKEGEMLGQLQGQKPPMFNARLSPDRQILITTGYDGTIRLWNLQGELLEEQQPHRAAVADAIFSPDSQIIVTCSDDGQTKIFTRQGQEIASVLKSGTARNLAYHPQGLLIASVSDSGSLHLINPNGKIEREISTGQGRINNVNFSPNGEQLLTSGINGSAKLWNLAGELIHEYKVVPTGWVNSAQFYPKGEWLATASDDGTIRFWQKDGQLIYELPLVNARLTSLSFSPDGKQLAATSSQGQVWVFNLSY

SEQ ID NO: 2698 - protein, 707 aa, Synechocystis sp.
MERIDIHPTHTANGYKLRCGQPFPFGATIVPGGVNFSIYSSHSTACTLVLFEKRAPQPFVEIPFPESFRIGNVYCMVVFDLDFENLEYGYRMEGPNNFQQGHWFDPSKVLLDPYAKVVSGRDVWGTQPNWDDIYQHRGRLSFDDFDWENDSPLDVPLEDMVIYEMHVRGFTKDPSSGVKENHRGTFAGILSKIPYLQELGVNTIELMPIFEFDEFEHSRYHPETGEFLVNYWGYSTVNFFAPKAGYAATGKFGMQIDELKNLVKELHKVGISVILDVVFNHTAEGNERGPTISFRGLDNKTYYMLTPEGYYFNFSGTGNTLNCNNPIVRGMVLDCLRYWTAEFHIDGFRFDLASILGRDPWGYPLANPPLLETLAFDPILARSKLIAEAWDAGGLYQVGSFPSYGRWAEWNGKYRDTVRKFIKGDAGVIGEMAQRLQGSPDLYQGAGRPPSTSINFVTAHDGFTLADLVAYNGKHNYANGENGNDGANDNYSWNCGVEGPTDNPDILRLRARQMRNAIAILLVSQGVPMLLMGDEMGKTQDGNNNTYCHDSPFNWLNWHLLEQNQAWFRFVKHCIAFRLAHPVLRNSEHFQNCDYLGVGFPDISWHGVKPWHADWSADSRVLAFMLCGRHAKGGRVKDNQIYVAMNMHYESLWFELPAPPVGTTWHVFANTGAQPPEDIHPPGQEPPLSSQSSLLIGDRSVVILLAK

SEQ ID NO: 2699 - protein, 254 aa, Synechocystis sp.
MTEVNLSVVSCSSTGKTDPGLVRQYNQDSFYLDPEGRFYIVADGMGGHAGGEEASRIAVERVRDYLDTYWQSEITSEQLLRDALMDANEGILEDQKINLERRDMGTTAVLIAFREDGAWRAHVGDSRLYRLRNQQLERVTEDHTWVARALKMGDIDPAQAKVHPWRHVLFQCLGRQDLNFIEVEALDAQPGDTFMMCSDGLTEEVPDNLIEKILTGQGNCDDQAVQLIEEAKNAGGSDNITIVLVDFSEDNQDS

SEQ ID NO: 2700 - protein, 481 aa, Synechocystis sp.
MVASPIHSRGLDLPLPSTMGEFGLSLPRSPLFGTDGIRGKAGELLTAPLALSLGFWAGQVLREQTDTAGPVIIGQDSRLSSDMLANAMAAGLNSAGVEVWQLGLCPTPCVAYLTRKTAAIGGIMISASHNPPEDNGIKFFDHQGLKLPKSLATAIEAGLRGQNQTSGLNASQWGRSYGQPHRVQYYQDFLLGSLPQPLNFQGLKVVLDLAWGASVNLAPHIFRSLGAEVIALHDLADGSQINVDCGSTHLHRLQRAVRETGADLGFAFDGDADRVMAVDAQGRPVDGDYILFLWGKTLQESNHLPDNLIVGTVMANLAFERAWEKLGGKLIRTAVGDQNVQAQMWETGAMLGGEQSGHIICHHHSYSGDGLQAALHLATLVQKSGLSLSELLSESFQPYPQILRNVRVLDRERRLHWQECAPLQQAIATAEKSMGTTGRILVRASGTEPLIRVMVEAACAETAAHWSDQLTSTVQCHLGDS

SEQ ID NO: 2701 - protein, 320 aa, Synechocystis sp.
MTVSTSAPTVRIGSRKSQLALVQTYWVQEELQKHFPDRQFDVETMETQGDKILDVALAKIGDKGLFTQELEDGMLGKRTDLAVHSLKDLPTNLPAGLMLGCVTKRVNPADALVLNAKHQGKDLASLPEGAVIGTSSLRRLAQLRYHFPHLTFKDVRGNVNTRLAKLDSNEYDAIILAAAGLERLDMANRIDQLIPPEISLHAVGQGALGIECREGDQEILSLLKVLEDENSRDRCLAERAFLRQLEGGCQVPIGVNTHLDGDNLTLTGMVASLDGQRLIKDTLSAPRKEAEKLGQDLALKLREQGAGEILAEILAEAGRG

SEQ ID NO: 2702 - protein, 435 aa, Synechocystis sp.
MRNHQSIHRLVLDNGITLICAENPAADLVAGRIFLKQAGACWDSPQKVGLSNLMATVITKGTKRRSALDIAEFVESLGANLGADAASDYWALSLKTVTADFPVILDLAAEILRYPRFDVGEIELEKRLIVQAIQSQREQPFNVAFHQLRQSMYPNHPYGYSILGSEEVVPHFTAQDLWEYHQAYFRPDNLVISLAGRLTLAQAQDWVETSFGDWVIPEQSIVCPILTPLNACPQEQLTPQATQQSVVLLGYLGVGVKHEDYAPLKLLSTYLGNGLSSRLFVELREKRGLAYDVSAFYPTRLGSSQFVTYMGTAPENTAIAIAGLRAETDRLCEERLEEGEIKAAQNKLLGQYALGKQTNGEIAHLFGWYETLGLGIAFDSEFQEQVQKVTEVDAQRVAQTYLAEPYLSVVGPEEGLAKYFDLVAEGQSQVSSALV

SEQ ID NO: 2703 - protein, 248 aa, Synechocystis sp.
MELTGKTALVTGGGIRVGRALVMALAEAGCNVFIHYGNSQTGALEVQQEVEALGRKAFTYSADLSDAQATQGIIPKAQEVFGQVDILINSASVFPLEDKFFQVDLDLWEWIFAVNLRAPFQLSQAFAQQVAGDRQGKIININDARIPRPRPDHFVYRLTKRGLWDMTEILALELAPNITVNGLALGQILEAPEAPDPEEFMRDYAERRIPLKMTGNPKVVTDAALYLLQQDFLSGTTIRLDGAEYLKF

SEQ ID NO: 2704 - protein, 463 aa, Synechocystis sp.
MVCHSDYIAKIRETCLTKNVVISATTTLLENPLGEPMNIAVVGLSHKTAPVEIREKLSIQEAKLEEALTHLRSYPHIEEVTVISTCNRLEIYAVVTDTEKGVVEITQFLSETGNIPLATLRRYLFTLLHEDAVRHLMRVAAGLESLVLGEGQILAQVRTTHKLGQKYKGVGRLLDRLFKQAITAGRRVRTETDIGTGAVSISSAAVELVHRQVDLSSQKTVIIGAGKMACLLVKHLLAKGATDITIVNRSQRRSQDLANQFPQAQLTLCPLTDMFTAIAAGDIVFTSTGATEPILNCENLTGCVINRKSLMLVDISVPRNVAADVHAMEQVRAFNVDDLKEVVAQNQASRRQMARQAEALLEEEIAAFDLWWRSLETVPTISSLRSKVEDIREQELEKALSRLGSEFAEKHQEVIEALTRGIVNKILHEPMVQLRAQQDIEARKQCLRSLKMLFDLEVEEQFG

SEQ ID NO: 2705 - protein, 252 aa, Synechocystis sp.
MTSPTAPLISFDQLQKNFGALQVLRGVTGEIYPKDVISIIGPSGCGKSTFLRCLNRLEPISGGRLEVAGVDLSGAKIDQKHLRQLRVRVGMVFQHFNLFPHLTVLQNLLLAPRKVLRIPMAEAKDRALTYLDKVGLGTKADNYPDQLSGGQKQRVAIARGLCMKPEILLFDEPTSALDPELVGEVLNVMKQLAEEGMTMAVVTHEMQFAREVSNRVFFFNQGIIEEEGDPNEVFRNPKSDRLRAFLSRIQSS

SEQ ID NO: 2706 - protein, 331 aa, Synechocystis sp.
MQVQFQILRQKPQQSPYLEKFDLEVEPGATILECLNQIKWEQDGSLNFRKNCRNTICGSCSMRVNGRSALACKENVGSETRLFTQVNEAGIPVVTVAPLGNLPVIKDLIVDMQPFWDDLERVEPYVSTQGRKVPEREFLQTPAEREKLNQMGNCILCGACYSECNAKSVNPDFVGPHALAKAQRLLTDSRDGATADRLESYNNATAGAWGCTRCYLCNEVCPMEVAPMDQIGKIKSALLAQKTAQDSRPVRHRKVMVDLVKAGGWVDERKFGIYVVGNFFRDLKGIASILPLGLRMISSGKFPLGFEPSAGTEEVRSLIEQVQEAEKLANF

SEQ ID NO: 2707 - protein, 391 aa, Synechocystis sp.
MANPVTLPQTFLLLGSGELGKEFTIAAQRLGNRVIAVDRYPDAPAMQVAQVAEVISMLDGNALEAVVKKYQPDWIVPEVEAIRTEKLLELEAGGYRVIPTAQATNLTMNRDRIRELAAQQLGVRTARYNYATSLAELEEVSQAIGFPNVVKPVMSSSGKGQSVVNNAGEVQQAWSAAIAGARGDQTKVIVEEFIPFELEITLLTIRQWQGETLFCDPIGHRQERGDYQESWQPAPLTQRQLAQAQAIAKTVTDALGGAGIFGVEFFITPEEVIFSELSPRPHDTGMVTLISQNLNEFELHLRAILGLPIPQIKQTGPAASAVILALEAGEKLSYAGLAEALTESGTDVRLFGKPNARPHRRLGVALAQAESVDAARRLAQTVAEKVIVQTE

SEQ ID NO: 2708 - protein, 508 aa, Synechocystis sp.
MPHHYDRVNINKLLTRTRITMVTTPDWVKKAVFYQIFPDRFAIGQQQAIAVAQQPKLEPWEAPPTVQGYKGGNLWGVIEHLDYLQDSGITALYLTPIFQSACNHRYHTHDYYQVDPLLGGNEALQALLTQAHRREMKVVLDGVFNHASRGFYFFNDILENGPHSPWLDWFHIEDWPLSAYDGSLPANYRGWVDLRALPQFNHDHPDVREYLMRVGEYWIAQGIDGWRLDVPDCVKAEGFWQEFRCRVKAINPEAYIVGEIWCDASPWLAGDQFDGVMNYRFTEPTVAFAIGDRLQKEHLRGEEYRPYPALTAEAYGERISQLLQQHPWEIQLTQLNLLNSHDTARLLTLANGDRPSVNLALLLMFTFPGAPCVYYGDEVGLPGEADPDCRRVFPAKTDWDLDCWEFYRQLIALRHRYQCLQLGDYKIIATAGMGYVFQRQYGDETLMVAVNSGDNIIEIILSPDIINLDKIDIAEPVFSANGETVIDRNTAGLLLTMAPQSGAAFAII

SEQ ID NO: 2709 - protein, 912 aa, Synechocystis sp.
MDCRLKCTNQCTSLMMAFDKSHTIKGCSTEFSLSMTDTPILGTVKEPQRDYRTLDRQKLTPMFQHYTEVKEQYQGALLLYRVGDFFECFFQDAVIIARELELILTSKEGGKEIGRVAMTGVPHHALDRYARQLVEKGYAVAICDQVEDAAEAQAEKRMVERQVTKLLTPGTLTDDSMLPAKRNNFLAAIAMVEDKWGLAHADISTGEFFTCQSSNLDDLAVELLRLQPSEVLIPTSAPDIRNILRPGEPSEHIPKQLPTSFCYSLRSQAPFSLVEAKQRLLTTFRVKSLEGMGCEGLPLAIRAAGGLLEYIEDTQKAHVVPIQPLKTYGLTDFLVLDHQTRRNLEINQTVRDGSFHGSLLWALDRTSTTMGSRALRRWLLQPLLDLKGIQARQDTIQELYHHPALRQDLRQLLRQIYDLERLTGRIGANTASARDVYGLASSLVRLTDLAELAQEGHSPYLKALQTVPPELEELGKYVLAHIVENPPLHIREGNLIRSGVNPTLDEMRQSLEDDNQWLANLEVTEREKTGIANLKVGYNKAFGYYLSLPRSKSEQAPDNYIRKQTLVNEERYITPELKERETRILTAQADLNQLEYEIFTEVRATVAEKAQPIRDVAKAVAAIDVLAGLAEVAVYQGYCRPIMQMEPGLIDIEAGRHPVVEQSLGAGFFVANDTQLGHDHWHPDLVILTGPNASGKSCYLRQVGLIQLMAQTGSFIPAKTATLSICDRIFTRVGAVDDLATGQSTFMVEMNETANILNHATAKSLVLLDEIGRGTATFDGLAIAWSVAEYLAGEIQARTIFATHYHELNELASLLENVANFQVTVKELPEEIIFLHQVTPGGADKSYGIEAGRLAGLPSSVITRARQVMAQIEKHSKIAVGLRKGNRGKVMASQAAAEAAEDQAKQLDIFGF

SEQ ID NO: 2710 - protein, 271 aa, Synechocystis sp.
MTNLSGSMPSSTAADLQPALRVEGLGFYYGTKKVLEGVTMAIPVGKVTAMIGPSGCGKSTLLKAFNRIAELEGRVKVTGKIEFFGQNIYDQKVNINSLRREIGMVFQRPNPFPTSIYDNIVYGVKLCCNVSRAELDEIVERSLTRAVLWDEVKDSLKKSALGLSGGQQQRLCIARALAVNPKVLLMDEPCSALDPISTLKIEELINSLRENVTITIVTHNMQQALRVSDYTAFFNTDESRIGQLVEFDTTQNIFSSPQETQTRDYVAGRFG

SEQ ID NO: 2711 - protein, 232 aa, Synechocystis sp.
MLFRQLFDPETSTYTYVIADPKGRSAALVDSVLEQVDRDLNLLKELDLKLTFCLETHVHADHITGAGKLRQLTGCQNLVPQYAEVDCADRHLQDGEIVHVGSIPIQAIATPGHTDSHLAFLVNQTHVLTGDALLIRGCGRTDFQSGDAGTLYDAIHGKLFTLPEDVFVYPGHDYRGHTVSTIGEEKRFNPRLLGRDRQNFIEFMDSLNLPDPKKIMEAVPANQLCGQRTVAV

SEQ ID NO: 2712 - protein, 367 aa, Synechocystis sp.
MGEALNKGIYCPFDRNCAMVSIRPSVRHTPAYVPGEQPQTNDFIKLNTNENPYDPPAQVLAAVAAELPKVRLYPDPVSTQLRQAAADLYGVDLNQVLAGNGSDDILNIVVRTFVDPGETVAFLDLTYSLYETIASVHGAKVQKIATDANFDLTGPVICPEAKLIFLASPNPPKGKHLNREFLWQTCAQAEGVVVIDEAYGDFSDEDHWDFLQEFDNVIISRTLSKSYSLAGMRVGLAIAAPALIEEMDKVRDSYNLDRLAQVLGTAALRNQAEFVPLWEKVRHTRTRLMEQLAELDFQVCPSDANFVFAAPRWMAAADLYQALKEKKILVRYFNHPRITDYLRITVGTDGEIDQLLLAIASLKGSLG

SEQ ID NO: 2713 - protein, 898 aa, Synechocystis sp.
MSKLVIVESPTKARTIRNYLPQDYRVEASMGHVRDLPASAEEVPAAYKDKSWANLGVNVEDHFSPLYVIPKSKKKVVKELQTALKNADEVILATDEDREGESISWHLLQLLQPKVPIKRMVFHEITQEAIRSALENCRDIDENLVHAQETRRILDRLVGYTLSPLLWKKIAWGLSAGRVQSVAVRLIVQRERARRAFKTAGYWDLKAELEQNKNPFQAKLMTLGGTKLANGSDFDPNTGALLPDKQVVVLDEAQAIALKERLTGKPWAVVNTEEKPGVRKPSPPFTTSTLQQEANRKLGISARDTMRVAQKLYEEGYITYMRTDSVHLSDQAVTAARNCVQQMYGKEYLSPQPKQYTTKSKGAQEAHEAIRPAGTEFRIPNQTGLKDRELALYELIWKRTVACQMADARITQLSVLLKVEDAEFRAAGKRIDFPGYFRAYVEGSDDPDAALENQEVILPPLKVGDRPNCREIDTVGHETQPPARYTEASLVKTLESEGVGRPSTYASIIGTIIDRGYVQMRSKALTPTFTAFAVVSLLESHFPDLVDTGFTSRMEQKLDEIAIGKTQWLPYLQGFFLGESGLENQVKVRQDQIDPAIAKAIELENLAAKVKIGKFGPYIEIPQGEEIITASIPQDLTPADLNPEQVAVLLKQKTEGPDKVGIHPETGEPIFILIGAYGPYVQLGEATEENKKPKRTSLPKGVKPEDVTLEMAVGLLALPRNLGEHPESGKNIKASLGRFGPYVVHDQGKDGKDYRSLKGDDDVLTITLERALELLAEPKRGRGSRTPLKQLGLHPEDQEPVNLFKGPYGVYIKHGKVNASLPEGETEETITLEKALPLLAEKAGSGKKTSRKKATTTAKGTKKTTSKKASATGTAKKTTTKRTTRKKAASPDQSSEAG

SEQ ID NO: 2714 - protein, 409 aa, Synechocystis sp.
MAAHPNPWHWKTIMRDVFIVAAKRTPLGRFGGSLTNFSAADLGAHVMKSVLAQAGVGGDQLDLYIMGNVLRAGHGQLIPRQAALKAEIPDTVDGYAVDMVCSSAMMSVINAALTIRAGEGDLILAGGTESMSQTGFYLSHRARWGYKFLMGAPENLTDLLLHDGLTDSTNGEGMGEQTEKLAAEHGFSRIELDEVACLSQQRAAHATESGYFDSEIAPIEITSRKGTQVLASDEGIRSDTTVESLGKLRSAFAKDGVLTAGNCSQITDGAAALLLASGEAVEKYQLKPLAKILGGSWAAGTPSRFPELPITASQKLLAKLDKTLADFDLFENNEAFSVSNLLFERRLGVDRDKLNVNGGAIALGHPIGASGARIMVTLLYALQQRDKTLGLAALCHGTGGGTAIALERV

SEQ ID NO: 2715 - protein, 240 aa, Synechocystis sp.
MLSLGLEDKVIVVTGGNRGIGAAIVKLLQEMGAKVAFTDLATDGGNTEALGVVANVTDLESMTAAAAEITDKLGPVYGVVANAGITKDNFFPKLTPADWDAVLNVNLKGVAYSIKPFIEGMYERKAGSIVAISSISGERGNVGQTNYSATKAGVIGMMKSLAREGARYGVRANAVAPGFIDTEMTLAIREDIREKITKEIPFRRFGKPEEIAWAVAFLLSPVASSYVTGEVLRVNGAHHT

SEQ ID NO: 2716 - protein, 1014 aa, Synechocystis sp.
MSPSQPHPPIATFEPESFLILVVDDVKENIYVISELLEGEGYSTTFVTSGPEALQRVTQAQPDLILLDLMMPGMDGLEVCDRLKQDPQTRDIPVIFLTASNEKQDLLQAFAKGAVDYVTKPFSPPELLARVKTHLELKQTRDNLHHTLLEQARTAEALACTSTRLGILVQNMQAGVLMTDAQGTIVVVNPEFARLFNLGFPADLLLGKNLTAIAPRINGLISHGQGVTHNFLAIESPEPLLKVELALEDGRFFERDYVPIMLGDSSQGHFWLYRDISQRKQVEMIQGQSLEMERRMRQQLAEQNQELVAATTAAEAANRSKSEFLATMSHEIRTPMNAIIGMTGLLLDTDLTTQQKYFAQTIRNSGETLLTLINDILDFSKIEAGKLDLEVYPFDLGQCLEEALDVVVPSARQKSLTLIRRFLTPIPPNLQGDVTRLRQILVNLLSNAVKFTEAGQVKVTVEVVDHDAAKGEYQICFAVQDTGIGIAPNQQQALFQAFSQGNSSITRRFGGTGLGLAICVRLTALMGGTIWAESNGCVVGNPPELWQIGQPTIEGSTFYFTVNLTVLPSCAYSVHNLRHSLFIGRSVLVADYDEGRGTRMRNLLASWRLQAEQITFSSPAKLGEDLKSRLTQKNYGALILHCPYPEGRGKQFTDFDLGKITTWAPTEQDIPVLVATDIYLSPGERYSGDKPPVQAWIKSPINPDELENTLVDVLGQTEPPTLVSTEAISGPLFPYSSSNLTILLAEDNLINQQVAKLLLKKLGYPVDVVNNGQEALSALAKGDYDVVLMDVEMPEMDGLTATEHIRRSQGRSERPWIIAVTAYSMEGDRERCLASGMNDYVSKPIRLEALQQALQVAATALQSTSQDRMATVSCVSAFEAKPSPSSPCPEDPAGTTLPPIDQDIICSLRDLDRENGQLILREIIDIYCQTAPELLQRIKLAIANQDWGNLSSAAHTLGSSSANLGAVLLAQQAKTLENLTRQRDSRAMDPGHFPTLAASYERVQGELKTMLDRL

SEQ ID NO: 2717 - protein, 425 aa, Synechocystis sp.
MEEFAVVIIGAGPAGGQCARQLAQQGVRVLLVEQHSNFSQNNYSSAASPLETMALFDLPPGVVARYWRNLAIAATEKEQIWYSDQPRGVVFDFAKLRQFLADTVTKAGGQVWLGHRFWGYQQVGDGLEVTLRRSSKNSLSSDSVEKVEKVTVKTQVLIDATGSKRAVINCGQPKATDNNQYYRGIGTEYLITVDETTHQRFADTLVFFLGYRWSPQGYSWIFPMDNHQLKVGTAIFAGQHRYLGELKPLRSYTEAIIRDYLKLEKSQYHLEEIHGSVLDYAVNQGDTYHRGSVLAIGDAVSTVNFLGGEGIRHGMQGANIAVPFVADYLRGHVQAFEKYEQAMKAHFAEPWQRTEKLSQRVYLEFGDRQIDLGVTYLSYLRYDDVLDLLFHYRFDRIYGGITPLLLKKVAQFSQQCRQWLRKLSP

SEQ ID NO: 2718 - protein, 905 aa, Synechocystis sp.
MDFPTLSSYLHHHRPGEDILADLHTDPGLGLTAEAVAQRYEQYGRNELKFKPGKPAWLRFLLQFHQPLLYILLIAGTVKAFLGSWTNAWVIWGVTLVNAIIGYIQEAKAEGAIASLAKAVTTEATVLRDGQNLRIPSQDLVIGDIVSLASGDKVPADLRLLKVRNLQVDESALTGEAVPVEKAVELLPEETPLAERLNMAYAGSFVTFGQGTGVVVATANATEMGQISQSMEKQVSLMTPLTRKFAKFSHTLLYVIVTLAAFTFAVGWGRGGSPLEMFEAAVALAVSAIPEGLPAVVTVTLAIGVNRMAKRNAIIRKLPAVEALGSATVVCSDKTGTLTENQMTVQAVYAGGKHYEVSGGGYSPKGEFWQVMGEEVDNVLLDGLPPVLEECLLTGMLCNDSQLEHRGDDWAVVGDPTEGALLASAAKAGFSQAGLASQKPRLDSIPFESDYQYMATLHDGDGRTIYVKGSVESLLQRCESMLLDDGQMVSIDRGEIEENVEDMAQQGLRVLAFAKKTVEPHHHAIDHGDIETGLIFLGLQGMIDPPRPEAIAAVHACHDAGIEVKMITGDHISTAQAIAKRMGIAAEGDGIAFEGRQLATMGPAELAQAAEDSCVFARVAPAQKLQLVEALQEKGHIVAMTGDGVNDAPALKRADIGIAMGKGGTEVARESSDMLLTDDNFASIEAAVEEGRTVYQNLRKAIAFLLPVNGGESMTILISVLLALNLPILSLQVLWLNMINSITMTVPLAFEAKSPGIMQQAPRNPNEPLITKKLLHRILLVSLFNWILIFGMFEWVNRTYDDLALARTMAIQALVAARVIYLLSISQLGRSFLGYVTGKRQTITKASILLLGIAVAIALQIGFSQLPFMNVLFKTAPMDWQQWAICLLPMIPMVPVAILANRLDP

SEQ ID NO: 2719 - protein, 166 aa, Synechocystis sp.
MAMSTPEVTPTLSDSNGNEAGVQTQFTIQEISDLLPHRYPFALVDRIIDFQPGKCAVGLKNVTINEPFFPGHIPDRPIMPGVLIVESMAQVGGVILTQLPGMRGKFFAFAGIDGVRFRRPVVPGDQLIMTVELQSFKLQRIAKMQGEARVDGQLVCGGEMLFSLID

SEQ ID NO: 2720 - protein, 260 aa, Synechocystis sp.
MAATLSRLDISVDGVSVTYNNARLALYNATCTVEPGTITALVGPNGSGKSTLFKSIMGFLQPSQGRVRIGGFSVQKAQKQQLMAYVPQADEVDWNFPVSVFDVVMMGRYGYMNVLRIPSAKDRRLVMESLERVGMVKYRDRQIGELSGGQKKRAFLARALAQEGKVILLDEPFTGVDVKTEKGMIDLLMELRDEGHTILISTHDLASISTFCDHTILLNRTILAQGKTEETFTKENLELTFGGLPMLSLNQMFESTEVDA

SEQ ID NO: 2721 - protein, 754 aa, Synechocystis sp.
MGTQPARKLRNRVFPHPHNHRKEKPMANDQVPASKCPVMHGANTTGQNGNLNWWPNALNLDILHQHDRKTNPMDDGFNYAEAFQQLDLAAVKQDLHHLMTDSQSWWPADWGHYGGLMIRMAWHAAGTYRIADGRGGAATGNQRFAPLNSWPDNVNLDKARRLLWPIKKKYGNKLSWGDLIILAGTMAYESMGLKVYGFAGGREDIWHPEKDIYWGAEKEWLASSDHRYGSEDRESLENPLAAVQMGLIYVNPEGVDGHPDPLCTAQDVRTTFARMAMNDEETVALTAGGHTVGKCHGNSKAELIGPEPEGADVVEQGLGWHNQNGKGVGRETMSSGIEGAWTTHPTQWDNGYFYMLFNHEWELKKSPAGAWQWEPVNIKEEDKPVDVEDPNIRHNPIMTDADMAMIKDPIYRQISERFYREPDYFAEVFAKAWFKLTHRDLGPKSRYLGPDVPQEDLIWQDPIPPVDYTLSEGEIKELEQQILASGLTVSELVCTAWDSARTFRSSDYRGGANGARIRLEPQKNWPGNEPTRLAKVLAVLENIQANFAKPVSLADLIVLGGGAAIAKAALDGGIEVNVPFLPGRGDATQAMTDAESFTPLEPIHDGYRNWLKQDYAVSPEELLLERTQLMGLTAPEMTVLIGGMRVLGTNHGGTKHGVFTDRVGVLSNDFFVNLTDMAYQWRPAGNNLYEIGDRQTGEVKWTATKVDLVFGSNSILRSYAEVYAQDDNREKFVRDFVAAWTKVMNADRFDLPRG

SEQ ID NO: 2722 - protein, 621 aa, Synechocystis sp.
MVASIPNPKTNFLKTVPSQRQTGAYILMDSLKRHGVKHIFGYPGGAILPIYDELYRFEAAGEIEHILVRHEQGASHAADGYARATGKVGVCFGTSGPGATNLVTGIANAHLDSVPMVVITGQVGRAMIGSDAFQEIDIFGITLPIVKHSYVVRSAADMARIVTEAFHLASTGRPGPVLIDIPKDVGLEECEYIPLDPGDVNLPGYRPTVKGNPRQINAALQLLEQARNPLLYVGGGAIAANAHAQVQEFAERFQLPVTTTLMGIGAFDENHPLSVGMLGMHGTAYANFAVSECDLLIAVGARFDDRVTGKLDEFASRAKVIHIDIDPAEVGKNRAPDVPIVGDVRHVLEQLLQRARELDYPTHPHTTQAWLNRIDHWRTDYPLQVPHYEDTIAPQEVVHEIGRQAPDAYYTTDVGQHQMWAAQFLNNGPRRWISSAGLGTMGFGLPAAMGAKVGVGDEAVICISGDASFQMNLQELGTLAQYDIQVKTIILNNGWQGMVRQWQQTFYEERYSASNMSQGMPDINLLCEAYGIKGITVRKREDLAPAIAEMLAHNGPVVMDVVVKKDENCYPMIAPGMSNAQMLGLPEVPVRDNGPRMVECNHCQTQNFITHRFCSGCGAKL

SEQ ID NO: 2723 - protein, 647 aa, Synechocystis sp.
MVIAASPSVPCPSTEQVRQAIAASRDFLLSEQYADGYWWSELESNVTITAEVVILHKIWGTAAQRPLEKAKNYLLQQQRDHGGWELYYGDGGELSTSVEAYTALRILGVPATDPALVKAKNFIVGRGGISKSRIFTKMHLALIGCYDWRGTPSIPPWVMLLPNNFFFNIYEMSSWARSSTVPLMIVCDQKPVYDIAQGLRVDELYAEGMENVQYKLPESGTIWDIFIGLDSLFKLQEQAKVVPFREQGLALAEKWILERQEVSGDWGGIIPAMLNSLLALKVLGYDVNDLYVQRGLAAIDNFAVETEDSYAIQACVSPVWDTAWVVRALAEADLGKDHPALVKAGQWLLDKQILTYGDWQIKNPHGEPGAWAFEFDNNFYPDIDDTCVVMMALQGITLPDEERKQGAINKALQWIATMQCKTGGWAAFDIDNDQDWLNQLPYGDLKAMIDPSTADITARVVEMLGACGLTMDSPRVERGLTYLLQEQEQDGSWFGRWGVNYLYGTSGALSALAIYDAQRFAPQIKTAIAWLLSCQNADGGWGETCESYKNKQLKGQGNSTASQTAWALIGLLDALKYLPSLGQDAKLTTAIEGGVAFLVQGQTPKGTWEEAEYTGTGFPCHFYIRYHYYRQYFPLIALARYSHLQAS

SEQ ID NO: 2724 - protein, 172 aa, Synechocystis sp.
MDLKALIRDIPDFPKPGIMFRDITTLLNSPEGLRYTIDSLVEQCESQELVPDHVVGMESRGFLFGMPLAYQMNAGFIPVRKPGKLPAPVHRVEYDLEYGKDSLEIHQDAVAPHHRVLIVDDLIATGGTAKATAELLTKLGCEVLGFAFIIELAALNGRQCLPDLPIISLVEY

SEQ ID NO: 2725 - protein, 330 aa, Synechocystis sp.
MTISTTDTSLIIWPAMGCGTWAWGNKLLWGYQPAMNGELERVFRECVAAGITFFDTGDSYGTGRLQGQSEKLLGQFSQAYEGLNQDKICLATKLAPYPWRLTPQAMVGAGMASQQRLQRPIDLVQLHWSTANYAPWQEQPLLKGLVQLCQRGHAKALGLSNFGPKRLQKAYDFCQNEGVSIVSLQVQYSLLSTDPVSKLGLKELCEQLGIKLIAYSPLTLGLLTGKYGPQGPFPPGIRGLLFRRLLPKIQPLLDTLQAIAREREKTMAQVALNWCICQGTMPIPGAKNCQQVQDNLGALGWQLDRGEMDELNNQAAALPQTMVQNIFQSR

SEQ ID NO: 2726 - protein, 287 aa, Synechocystis sp.
MRQRYICSAQENLASLGVKAGQKALAMAGLQPEDLDLIILATSTPDDLFGTAAQIQGGLGATRAFAFDITAACSGFVVGLNVAAQFLRTGVYQRVLIVGGDVLSRWVDWSDRTTCVLFGDGAGAVVLQRQAQDNLLAFEMYTDGTGNGCLNLSYQANPQPLTAEKTVAQGTYQAITMNGREVYRFAVAKVPEIIEKVLFKAQLTTSDLDWVILHQANQRIMDAVGDRLGIPSEKIISNVGEYGNTSAASIPLALDQAVREGKIKEGDLIALAGFGAGLTWAASIVRW

SEQ ID NO: 2727 - protein, 362 aa, Synechocystis sp.
MSQTYNVTLLPGDGIGPEIMAVAVAVLGKVADQFGFAFNFQEALIGGAAIDATGQPLPEATLAQAKDSDAVLLAAIGGYAWDNLPRSQRPETGLLAIREGLGLFANLRPATIFPQLIDASSLKREVVEGVDIMVVRELTGGIYFGKPKGIFETETGEKRGVNTMAYTVGEIDRIAKVAFETARKRRGQLCSVDKANVLDVSQLWRDRVMAIAVDYPDVELSHLYVDNAAMQLVRSPRQFDTIVTGNLFGDILSDIAAMLTGSIGMLPSASLGSDGPGLFEPVHGSAPDIAGQDKANPLAQVLSAAMMLRYGLDQPQAADRLEDAVKKVLEQGYRTGDILSPGTQLVGCRQMGEQLLSILDEM

SEQ ID NO: 2728 - protein, 249 aa, Synechocystis sp.
MKPVVLITGIAGGIGQATAELFAQQGWLVTGIDRQADPKCPYIDHYQQADCGDPKALAAAFDNLVGETQNLHSLINNVALQICQPILETSLDDWDQVMAVNLRAAFLLAKMSHPYLQQTHGSIVNISSVHALATSANIASYAASKGGLIALTRAMAIEWAADQIRVNALLPGAVNTPMLREGLSRGHLVEQSPQHQLQELGSKTVMGRVGQPSEIAQAIAFLADNEQSSFMTGQTITIDGGAIARLSTE

SEQ ID NO: 2729 - protein, 327 aa, Synechocystis sp.
MFPTIRPRRLRQTDVLRRMVRENTLTVNDLIYPLFAVPGNAIAKEVVSMPGVYQLSVDKIVDEAKEVRDLGIPAIILFGIPEDKDTDATGAWHDCGIVQKATEAVKKAVPDLVVIVDTCLCEYTNHGHCGYLETGDLTGRVLNDPTLELLKKTAVSQANAGADVIAPSGMMDGFVQAIREALDDHDFQNIPILSYAAKYASAYYGPFRDAADSSPQFGDRRTYQMDPGNSREALKEVELDLLEGADMVMVKPALSYMDIIWRIKEMTNLPVAAYNVSGEYSMVKAAALNGWIDEQKVTLETLTSFKRAGADLILTYHAKDAARWLQD

SEQ ID NO: 2730 - protein, 361 aa, Synechocystis sp.
MATTIPVPLPQSPYQVQIVPGGLAAIADHLAPLGLGKKIMVVSNPEIYDYYGEVVIQALQRAGYEVFQHLIPAGETHKTLASINELYDVAFQANLERNSTLLSLGGGVIGDMTGFGAATWLRGINFVQVPTSLLAMVDASIGGKTGVNHPQGKNLIGAFYQPRLVYIDPVVLKTLPEREFRAGMAEVIKYGVIWDSELFTALEEAEDLSSIDRLPDELLTKIIQRSCQAKVDVVSQDEKEAGLRAILNYGHTVGHGVESLTGYGVINHGEAVAIGMEAAAKIAHYLGLCDQSLGDRQRQLLLKTKLPTEMPPTLAVENLLASLLHDKKVKAGKVRFILPTAIGQVTISDAVTDEVIKATLG

SEQ ID NO: 2731 - protein, 425 aa, Synechocystis sp.
MVATPVKQKYDIKDISLAPQGRQRIEWAAREMPVLKQIRERFAQEKPFAGIRLVACCHVTTETANLAIALHAGGADSLLIASNPLSTQDDVAACLVADYGIPVYAIKGEDNETYHRHVQIALDHRPNIIIDDGSDVVATLVQERQHQLSDIIGTTEETTTGIVRLRAMFNDGVLTFPAMNVNDADTKHFYDNRYGTGQSTLDGIIRATNILLAGKTIVVAGYGWCGKGVAMRAKGMGADVIVTEISPVPAIEAAMDGFRVMPMAEAAHQGDIFITVTGNKHVIRPEHFAVMKDGAIVCNSGHFDIEIDLKSLKEQAKEVKEVRNFTEQYILPNGKSIIVIGEGRLVNLAAAEGHPSAVMDMSFANQALACEHLVKNKGQLEPGMHSIPVEVDQEIARLKLQAMGIAIDSLTPEQVEYINSWASGT

SEQ ID NO: 2732 - protein, 633 aa, Synechocystis sp.
MRFAIEQLGLLFGCQRVHVIYHDPAKDCLHMAEEWCAVGIAPRLSTFQGVPVATYPWLWANLQDSEGVLVRDVEQMPPEAEMDKVSLQFDLVKSILVVPMVKDAQVLGYISMVHLHDNYGWNPEELNLAKLVGQFLAIAQARHQAETTLTQAKEAADAANRAKTEFLASISHELRTPLNAIIGFSQLLHRDPSLAPHRPTLDIINRSGEHLLELINDILEMSKIEAGRTTLNEKIIDCHRLLDNLQALFQLRAQEKQLLLKVERSPEVPEWIKTDGGKLRQVLINLLANAIKFTAQGGVTLKVKCLTAPQTDEGQGASIWLHFLVSDTGPGIAAHEMDELFVPFAQTETGLKSCQGNGLGLPISQKFVQLMGGQIQVRSKVDQGSAFFFAIPVQVMAAPKPTPETSAVTLPPLDQYNQKVLVVDDRPESRLLLRQLLTSLGFVVQEAENGEMAIALWESWHPQVILMDMQMPVLDGRSTTQKIKASPQGQHTIIIALTASAFEGERAEILSAGCDDFLSKPFRPEELIALLAKHLAVALPSQGQPPASPLRPFPVITAPSLSEQLAKTPQSWRQKMAKMALECNDDDLITLVESLPTLSPSLAHLLATWAREYRFEQIFLVVESSFGAVTLAG

SEQ ID NO: 2733 - protein, 483 aa, Synechocystis sp.
MVAVKEATNVGKITQVIGPVIDAQFPSGKLPRIYNALKVQGRNSAGNEVAVTCEVQQLLGDNQVRAVAMSSTDGLVRGMDVVDTGAPISVPVGTGTLGRIFNVLGEPVDNKGPVPAGETFPIHRPAPKLVDLETKPQVFETGIKVIDLLTPYRQGGKIGLFGGAGVGKTVIMMELINNIAIQHGGVSVFGGVGERTREGNDLYNEMIESNVINADKPEESKIALVYGQMNEPPGARMRVGLTALTMAEYFRDVNKQDVLLFIDNIFRFVQAGSEVSALLGRMPSAVGYQPTLGTDVGDLQERITSTKEGSITSIQAVYVPADDLTDPAPATTFAHLDGTTVLSRGLAAKGIYPAVDPLDSTSTMLQPSIVGSEHYDTAREVQSTLQRYKELQDIIAILGLDELSEEDRLTVDRARKIERFLSQPFFVAEVFTGAPGKYVSLADTIKGFKAILAGELDDLPEQAFYLVGDIEEAKAKGAKLKEG

SEQ ID NO: 2734 - protein, 404 aa, Synechocystis sp.
MDRQGKQKTAPIEALAMGVVVTGLALDTALGDQLQTWTKLLQGKTAIKPKQPFINLPSFPLALQGNYPRSLGQLVPPLVQAAIDDAQLDPAEQPWGVAIGSSRANQCHWEDWVGRNIKPPVAPNFKLVDWWQTLPDQAARLAAQLLPEVTVMQCPMAACATGLWAIAQGVELIRTGHCQRVLAGAVEAPITPLTLAGFSKMATLAPDGCYPFDRQRQGLVLGEGGALLVLETRELAQKRKARIYGEILGWGFSCDALHRSTPAFDNHSAQQAVKHCLTRSGLTPEQIDLIHPHGTGTLFNDQREAALIQTLFPQNPLITSSKGATGHTLGASGAIAVALTLLSLHQQKLPPCVGLKEPEFPLNFVRIESVQPATSPLNYGLCLSFGFGGQNGAIAVGHAPLPTK

SEQ ID NO: 2735 - protein, 490 aa, Synechocystis sp.
MVYTPAPIKFGTDGWRGVIAAEFTFERVVLVAAAAAQVLAAEFGSSGREHRLIVGYDRRFMAEQFALLVAQTVQELGFEVWLSESYAPTPAFSWAAHHENALGALVLTASHNPANYLGLKVKGAFGGSVGSDVTEKIEAQLQNSLPQPQAGGSLQYFDPWPSYCQGLQAKVNVQPIREAVQQGKLRVFADVMHGAAASGLERLLGCPIDEINGDRDPLFGGASPEPLPKYVPKLLAALQTAAKAGGPELRVGLIFDGDADRIAAVDGQGNFLSSQGLIPILIYHLATQKGLQGEIVKTVSGSDLIPKLAELYGIPLTETAIGYKYIADRMLTSPVLIGGEESGGIGYGGHIPERDALLSALYVLETVVQSQQDISEQYGRLQEKVCFVSEYDRIDLPLASMDVRTALVQTLNENPLTAIAGEQVTDLLTTDGYKFRMAGGGWLLIRFSGTEPLLRLYCEAPTSSRVQTVLHWAKDWANGVTPAKPAQSSH

SEQ ID NO: 2736 - protein, 953 aa, Synechocystis sp.
MSDPDVSVSPVKAEAWYSYGIDKTLHRLTTAPHRGLAEKTVMERRRTYGLNEITTIAGRNNWQILLDQFTNVMLLMLIGVAIISGALDLISLRLGEETMEGFPFKDTIAIFAIVILNGLLGYFQESRAEKALAALKKMASPKVQVLRDGDRQEIKAASLVPGDIILLEAGSQLCADGQLIEAANLLIRESALTGEAQPVEKNASNTGLPLDTPLGDRQNMVFSGTEVVQGRGKVVITNTGMATELGKIAEMLQRVAPEPTPLQKRMENLAGVLVSGSLLLVTLVIILGVWQSGWGELRQLVETSLSMAVAVVPEGLPAVITVTLALGTQRMIKRHALIRKLPAVETLGSVNVICSDKTGTLTQNKMVVREVLTHGDRLSIGGEGYQPQGNIIHLSDGEQRATSGPWPPALQLLCLNAILCNDSELNYNPGEMEWQVIGDPTEGALLVLAKKFGFDQAQLRPSFMRRGEFPFSSERKRMGVIVEVPAEGESPLANLLGILENLALTPGPYLIFSKGSPELLLPHCGQIHTADHCVPLNFQHQEQILSDNNLMASRGLRVLGFACKSLAQIPSTPDLIAAEDNLVWLGMVGMLDAPRPEVRLAVEKSLAAGIRTVMITGDHPLTALAIAKDLGINQAGDRFLTGQTLEQLQQSDLEAQVEEVSVFARVSPEHKLRIVKAFQARNRFVAMTGDGVNDAPALKQADIGIAMGITGTDVSKEASDMVLLDDNFATIVAAAEEGRVVYNNIRNFIKYILGSNVGEVITIASAPLLGLSAVPLTPLQILWMNLVTDGLPALALAMEPGEPNIMKRRPFSPQESIFSRGLGAYIIRIGLVFAVVTITLMVWAYHSADLAGAPDSWKTMVFTTLCIAQMGHAIAVRSNHRLTIEMNPLTNPYLWGAVIVTTILQLCLVYFEPLRNFFGTDWLSPQQLLVCFGFSSLMFVWVELEKLLARFIK

SEQ ID NO: 2737 - protein, 531 aa, Synechocystis sp.
MNNQQLWQRYQDWLYYHGGLDFYLDVSRMGFSDALVEDLQPKFAKAFQDMVALEKGAIANPDEQRMVGHYWLRNPALAPNDGIRAEITEPLRQIKAFVADVHQGNIKPPTAPKFTDLLAIGIGGSALGPQFVAQALAPNFPPLAIHFIDNSDPDGIDRVLNCLKAQDKLKSTLVVTTSKSGGTPEPRNGLAETKAVFEAQGLHFADYAVAVTMPGSKLSQQAQTEQWLQAFPMQDWVGGRTSELSAVGLLPAALQGIDIQAMLDGAKTMDEATRVRELRQNPAALLALAWYYAGDGQGKKDMVILPYKDRLLLFSRYLQQLVMESLGKERDLDGNVVHQGIAVYGNKGSTDQHAYVQQLRDGVPNFFATFIEVLHDRQGPSLELEPGVTSGDYLSGFLQGTRQALFENQRDSITVTIPEVDATSVGALIALYERAVSFYGSLVNVNAYHQPGVEAGKKAAASILELQKAILSTLQNESGPIALEALATKVQAPEQVETVYKIVRHLAANDRGVTLQGDRQFPQRLQIQWRS

SEQ ID NO: 2738 - protein, 351 aa, Synechocystis sp.
MTATIPPLTPTVTPSNPDRPIADLKLQDIIKTLPKECFEKKASKAWASVLITLGAIAVGYLGIIYLPWYCLPITWIWTGTALTGAFVVGHDCGHRSFAKKRWVNDLVGHIAFAPLIYPFHSWRLLHDHHHLHTNKIEVDNAWDPWSVEAFQASPAIVRLFYRAIRGPFWWTGSIFHWSLMHFKLSNFAQRDRNKVKLSIAVVFLFAAIAFPALIITTGVWGFVKFWLMPWLVYHFWMSTFTIVHHTIPEIRFRPAADWSAAEAQLNGTVHCDYPRWVEVLCHDINVHIPHHLSVAIPSYNLRLAHGSLKENWGPFLYERTFNWQLMQQISGQCHLYDPEHGYRTFGSLKKV

SEQ ID NO: 2739 - protein, 261 aa, Synechocystis sp.
MTLAKRILPCLDVNAGRVVKGINFVDLQDAGDPVELARAYNEAGADELVFLDITATHEQRDTIIDVVYRTAEEVFIPLTVGGGISTLEHIKNLLRAGADKVSVNSSAVRDPDFISRASDRFGRQCIVVAIDARRRLDADNPGWDVYVRGGRENTGLDAIAWAEEVAKRGAGELLVTSMDGDGTQAGYDLALTAAIAERVEIPVIASGGAGNCQHVYEAFTEGKAEAALLASLLHYGQLTIGELKTFLEARQIPVRHTAVCG

SEQ ID NO: 2740 - protein, 432 aa, Synechocystis sp.
MGQPSDLTESTLRFSSLDPLHPPVISQLTAIAKRIRRNSLHLPTIWQEAVDSIGSTLGVSRCLLLTKDFQSRHLQIEAEFCQPTVTAFAALIVPEESEIWRQLFEQHQPITLYNVQFQGEDLGGLWIFPTLYQDQANGYLCLQQVGPAPGPWHPETEALLQELAEQTGTAIAHATLYQELTQATKAAEEASRLKSEFLASTTHELRTPLNGIIGFLRLILDDMADSEAEKHEFVEEAYQSALLLLNLINDILDLAKIEAGRVGIELEVVDFSEVLQATENFALPQAQNKGLSFNLTAPNQGPLLVYGNQRWLLQVMLNIVGNAIKFTHEGGITVAVEVMPRTVLWEGVQKPGLLKVSVGDTGIGVSLEQQSKLFKKFVQIDGSHSKAYGGTGLGLVISQKLVETMGGKVAFFSMGEGLGSTVTFTVLLEELP

SEQ ID NO: 2741 - protein, 419 aa, Synechocystis sp.
MWQAFPMADWQVIEGNITAPKGFKAAGITAGLKPSGSPDLSLIYSETEAIAAGVFTTSQVRAACVDYCRQRLQAKASARAILVNSGQANAGTGKQGWDDAVESAQLLAQGLNISPESILLASTGVIGQRIKMEQLRQGITPLIQSLAPNGGDKAARAIMTTDLVPKTIALETEIDGRPVRMGGIAKGSGMIHPNMATMLAFVTCDAAVSTALWQQMLSRATQKTFNQVTVDGDTSTNDSLFALANGESRTAAITEMGPNAEKLEAMLTAVCQHLAKAIARDGEGATCLMEIQVTGAPDDQSARAVARTIAGSSLVKSAVFGRDPNWGRIAGAAGRAGVKFDQNNLLIKLGNYVLMDQGQPLEFDRPGASNYLKQAASGAYLEQDTVLIQVDLGTGSGQGTAWGCDLSYDYVRINADYTT

SEQ ID NO: 2742 - protein, 368 aa, Synechocystis sp.
MTVAQFSPVARLSIEDSVLTVQDLGKSFRGQSTPVLQKINFNLAPGEILGLLGPSGCGKTTLLRIIAGFETPTSGTVHLEGDCVSGENGLTPPEQRQTGMVFQDYALFPHLTITDNIAFGLRHKSQKLNRQQIQGRVAEVLHLVGLTGLEKRYPHELSGGQQQRIALARALAPKPNLILLDEPLSNLDVQVRQRLRHEIRHILKATGTAAIFVTHDQEEAMAISDRIGVMYRGNLEQIGTPEEIYRSPASRFVAEFVTQANFVPAQRQGTLWATEFGQWPLTFQGIQPELPSVGELMLREEEIELSPASDGPVVIRDRQFLGREYRYCLETPAGRQIHARTSLQTVIPVGSRVNLTPTNPCPPLFAQG

SEQ ID NO: 2743 - protein, 331 aa, Synechocystis sp.
MTMVASWTRNHILDLTDWRGEELDIVLQTATTFQQVLSGQTKKVPALQGQVVTNLFFEPSTRTRSSFELAAKRLSADVMNFSPGTSSLTKGETILDTAKTYLAMGSDIFVIRHQQAGVPHFIASQMDRLQTGVKVLNAGDGQHEHPSQGLLDLFTICSQFAPDNPAIQCLQGKKIAVVGDILHSRVARSNLWSLTTAGADVHLAGPPTLLPKEFQQLTLAPGSGKLHCHWQLQPALEGADIVMTLRLQKERMTAHLLPSLREYHHYFGITHDRLKVCQPGVKVLHPGPVNRGVEISSELMDDPDISLIQDQVTSGVAIRMALLYLLGTVQE

SEQ ID NO: 2744 - protein, 1011 aa, Synechocystis sp.
MSLTIADYQSFLREIEPFAQLPAPAIAEIAAKLRPLRFRMGQIILARGKLANNVYFLVSGQARLLGYDPGTGYPATMALLQNGAVIGDNNAIRNVPCETAIASTETICASLTRDEFLALVDKYPELARVYRHQCGRVELFDLLGEQLQRTAQGNVDLRQLTLEMLPQSQVYELQPGSHSLPSDLPDPERLWLVSSGELEQCPRGSALPDPDSALVLKAQTLVRLIGLPPLPRFFPGSSGSKTNGNGNGHGEVPLATVTRLAPEDSPWDDIPYADPNQLGEPLPEPTVVKSGRKSYPVVRGQNPTDAGVACFQMISQYFGMPFRRDIIQRIVTEEIKRSEALSLPICGAIVELMGLTSQLVRIPKGVFGQMQVPFLIRWQDSLALVYEAGDREVKIAVPELGLVKRDTSEFLETWGEEGQGEVLMMYPSKDTPQQRFGLSWFWPALVKYRYILLLVFVASFFVQLFGLANPLMIQIIIDKVIVQNSKDTLQVLGIALVSIAIFEALLSTLRTYLFVDTTNRIDMSLGSEIIDHLLRLPLRYFENRPVGEISTRVNELENIRQFLTGTALTVVLDSVFSVVYIVVMIIYSPLLTAVALGIVPIFVILTLVFSPLIRRQLRLKAERNAQTQSYLVEVMSGIQTVKAQNIELRSRWQWQDKYSRYVGAGFNTVITSTLASSSSHFLNQLSGLLVLWVGASLVLDGDLTLGQLIAFRIIAGYVTSPILRLTQLWQNFQETALSLERLADIVDTPQESERDRQNIPMPEIAGEVKFENVSFRFKKQGPLQLNNINLSFPPGTFVALVGQSGAGKSTLTKLLSRLYEPEGGRILVDGLDIGKVELYSLRRQVGVVPQETLLFEGTVQENIALTNPDATTEQIISAAKVASAHEFIMTLPNGYNTRVGERGATLSGGQRQRIAIARSVLQRPRILVLDEATSALDYITEQQVCINLGDAFKDHTVFFITHRLSSVRSADVIVMMDQGSVVEQGSHDELMALKGRYYYLYQQQGAGGDDV

SEQ ID NO: 2745 - protein, 359 aa, Synechocystis sp.
MRLEISSPQTKLPYPKTEELPFTLQELRNAIPADCFEPSVVRSLGYFFLDVGLIAGFYALAAYLDSWFFYPIFWLIQGTLFWSLFVVGHDCGHGSFSKSKTLNNWIGHLSHTPILVPYHGWRISHRTHHANTGNIDTDESWYPVSEQKYNQMAWYEKLLRFYLPLIAYPIYLFRRSPNRQGSHFMPGSPLFRPGEKAAVLTSTFALAAFVGFLGFLTWQFGWLFLLKFYVAPYLVFVVWLDLVTFLHHTEDNIPWYRGDDWYFLKGALSTIDRDYGFINPIHHDIGTHVAHHIFSNMPHYKLRRATEAIKPILGEYYRYSDEPIWQAFFKSYWACHFVPNQGSGVYYQSPSNGGYQKKP

SEQ ID NO: 2746 - protein, 767 aa, Synechocystis sp.
MHPTLISAPISSSANDAHAGTSQGSHQGHRIQVIRRDGSSTPLNIGKIRAVVDWACLGLEVNSIALEAGLTTRLREGISTREIQDNLISCALEMCSPNEPDWRYVAGRLHVWSLWKDTLVRRGYQYGQYLRTVQTKVTNGEYDSRILTYSEGELQEAGCWINSDWDTDYDYAGAVLLTSRYLLPNELPQEALLTCALLLASVEAPDRRLQWARRFYESIAARRISLATPILANLRVPGGSLTSCFIVAMEDNLESIFGEITNAARISKNGGGVGVNVSRIRATGSWVMGKPNASGGVIPWTKLLNDTAIAVNQGGRRAGAVTVGLDVWHLDVPEFLEMQAENGDQRRKAYDIFPQLILPDEFMRRVINKEDWTLVDPYEVREKMGIELAELWGEQFEGAYREIESNLDTTITLYKRINARELFKQIMRTQVETGMPYLSFKDTINKANPNKHLGYIPGTNLCCESFSNVTPGQDAHCCNLVSLNLANLDLQDIAGVSQIAVRMLDNTIELTAPPFADAKSHNNKYRTIGVGAMGLADWLAKRRLNYDELADINRLFEEIGYWCTQSSMELAKERGAYPAFPGSDWQKGLLIGSKPVSWFQANAAKPERWEKLSNDIQTHGIRNSHITAIAPNTSSSLVQGCTASILPVYSRFFYDKWAKGTVPIAPPFIGNCFWFYPENKTMDQRKVVKAVAAIQQWTDTGISMELLFNLNAGIYFPEEPERSLNAKDIFDTLVMAWEAGCKAIYYIRTVQKDDFKDSSDGCVACAN

SEQ ID NO: 2747 - protein, 390 aa, Synechocystis sp.
MTTSLAAIAPHGGQLINRLAPEAERQEFLAIADKLPRVQLDERATSDLVMIAIGGFSPLKGFMEQDDYELVVEEMKLSNGLPWSVPVTLSVTEEVAAPLEVGSWVRLDNSAGKFIGVLELTQKYHYNKAHEAKNVYRTDDQAHPGVKVIYDQGPVNLAGPIWLLEREPHPLFPKYQIDPAASRQLFAERGWKTIVGFQTRNPIHRAHEYIQKCALEVVDGLFLHPLVGATKSDDIPADVRMRCYEIMVDNYFPKERVILGINPSAMRYAGPREAIFHALIRKNYGCTHFIVGRDHAGVGDYYGTYDAQEIFDEFAPEALGIVPMKFEHAFYCKKTLQMATTKTSPSGPEDRIHLSGTKVRALLRDGQLPPPEFSRPEVAQELIRAMQGES

SEQ ID NO: 2748 - protein, 359 aa, Synechocystis sp.
MVDEFDLPPEIIDRRVRKMKMISPSNIEVNIGQTLKDDEYIGMCRREVLDGFLRERAEKLGTKVINGTVYKLDIPSKDSDPYTLHYADHSVGGTTGEMKILKVDVVIGADGANSRIAKAIDAGDYNYAIAFQERIRLPEDKMAYYDELAEMYVGDDVSPDFYAWVFPKYDHVAVGTGTMKVNKARIKDLQAGIRTRAAKKLEGGEIIKVEAHPIPEHPRPRRVVGRVALVGDAAGTVTKSSGEGIYFAAKSARMCAETIVATSNNGQRVPTEADLKQYIKQWDKRYGATYLVLDILQRVFYRTDATREAFVEMCSDIDVQKLTFDSYLYKTVVPANPLVQMKITAKTIGSLLRGNALAP

SEQ ID NO: 2749 - protein, 385 aa, Synechocystis sp.
MAPSISPVTQPLVSMAIAPTVVIRSALAKAGEHLQKLGSKGLVVTGSHSAELGEKSLQTLQKNYGLTLPLASYLPDCAESSLEQLRRRVHQEQPDFILGIGGGKALDTAKLLAHQTQLAIATVPTSAATCAGWTALANVYSETGAFRYDVALDRCPDLLIVDYELIQRAEPRLLVAGIGDAIAKWYEASVSSGQSSDTFTVAAVQQARILRDILFQKSAEALAQPGSETWREVVDASLLMAGVIGGLGGANCRTVAAHAVHNGLTQLPQAHHALHGEKVAYGILVQLRLEELVSGNQLAATARRQLLSFYDEIGLPKTLQDLGLGRISLEELRQTAEFTCLPNSDIHRLPFTVTPETLMAAMVSTLVEEQGTRQLFAQIQDNSGL

SEQ ID NO: 2750 - protein, 553 aa, Synechocystis sp.
MRNFPEIQNTAYDLIVIGGGINGVGTARDGALRGLKTLLIEKDDFASGTSSWSTRLIHGGLRYLEYFEFNLVRESLREREVLLHTAPHLVQPLQLTIPVYDWSSRAYWEIQAGMILYDILSFDKTLPSHRMLSPQQFQQLFRAAEKKGLKGGAQYFDGQVEYAERLDLEVTLSAQKAGAAMLNYVAVKGLEKGENNLITAIHCQDQLSGEKFTVNSAQAIVINTTGPWVDEVCGLAHRGGEPVAIVQERKIGGTKGSHIVVDPFPGAPASALYVEAFVDKRPYFIIPWLGKYLIGTTDHRYDGSLDRVKASDDEIDYLIAETNRVMPAAQLTRQDVRFTYSGVRPLPYTDGKKAGSITRNHILYDHSQDGVNNLISLIGGKLTTYRQVGEEMVDKVYGKLRRSAPPCPTLTQPLPGAEAYPLSLETAMDKYGNHLERHSIQHLFCLYGARAGDILALVHGAPELGERIIPSLPDIKAQVVFAVQAEMAHTLVDICRRRTAIAMVTNDYGFSALAGICQTLTDHCGWTQEQCDKQIQKYHEYMEQNCIPDYCLH

SEQ ID NO: 2751 - protein, 499 aa, Synechocystis sp.
MNSSLVILYHREPYDEVRENGKTVYREKKSPNGILPTLKSFFADAEQSTWVAWKQVSPKQKDDFQADMSIEGLGDRCTVRRVPLTAEQVKNFYHITSKEAFWPILHSFPWQFTYDSSDWDNFQHINRLFAEAACADADDNALFWVHDYNLWLAPLYIRQLKPNAKIAFFHHTPFPSVDIFNILPWREAIVESLLACDLCGFHIPRYVENFVAVARSLKPVEITRRVVVDQAFTPYGTALAEPELTTQLRYGDRLINLDAFPVGTNPANIRAIVAKESVQQKVAEIKQDLGGKRLIVSAGRVDYVKGTKEMLMCYERLLERRPELQGEISLVVPVAKAAEGMRIYRNAQNEIERLAGKINGRFAKLSWTPVMLFTSPLAYEELIALFCAADIAWITPLRDGLNLVAKEYVVAKNGEEGVLILSEFAGCAVELPDAVLTNPYASSRMDESIDQALAMDKDEQKKRMGRMYAAIKRYDVQQWANHLLREAYADVVLGEPPQM

SEQ ID NO: 2752 - protein, 495 aa, Synechocystis sp.
MTAKHNQYVMALDLGTTGNRAILFDYEGNIVGQAYKELTQFYPKAGWVEHDALEIWRDTKTVMQEVVQKTAIQPQQIVAIGLTVQRETCLLWDKTTGQPLHPAIVWQDRRTAHFCGELTAAGYVDEIYERTGLVLDAYFSGTKLHWLLDWVKQSKSVDPANLLAGTIDSWALWNLTGGKVHRTDHSNASRTMVLNLDSLIWDEKLLDLFTIPAQIMPEVQPSLSYFGVTDPEILGVEIPITAIFGDQQAALYAHGCDRPGLLKCTYGTGAFLVANTGQTVTRSQHRLLSTVAWTQTNRDKSLTRDYALEGSMFTAGSCVQWLRDKLGLIESAAASESLARSVDSNGGVYFVPALSGLGAPHWDMNACGAFLGLTAGVTKAHLVRSVLEAIAFQAREVVEAINQDSPAPIQQLKVDGGACNNDFLMQCQADVLGIPVERPAVLDATAQGAAFGAGLKIGWNQLQIRFFRTFHHGTISLICLQFLPMRIQEGVSVDQ

SEQ ID NO: 2753 - protein, 247 aa, Synechocystis sp.
MSFDTPLKPYLAIPIQDCGEPLAPINLEGVKSLKPHPYAQVGADYQGRSPYVLRTGVLKRLDQARLTLADIEPSWEILVFDAYRPIAVQQFMVDHTFAEIVARDGLQGQVLTPEQKENIYHQVYQIWAVPNNNPLTPPPHSTGAALDITLLDDLGQPVDMGGEIDELSARSLPNYYQTVEPNSDRQRKEFEQYQRRRELLNTIMESAGFLRHPGEWWHFSQGDQLWAWQYNQRHPDHQKIAYYGRVE

SEQ ID NO: 2754 - protein, 990 aa, Synechocystis sp.
MVAQIDSQQQYEQATQAIAKELLAQTREKRSLWDKIGDNLRLDDKLLDWTMGHPGLRVQLFKFIDCLPALQSNSEIANHLQQYMSEEEVELPEALKKLLNFADAHSTPAQIAAGTVSKATEQLAFKYIAGETIAQVIKTVERLRKEKMGFTIDLLGEAVITESEAAEYWQNYLDLMAQLSQQAKSWSKVPQIDQADGEILPQVQVSVKLTAFYSQFDPLDPAGSKAKVCERIRELLRRAQELGVAVHFDMEQYHYKDLILNILKELLVEEEFRSRTDVGITMQAYLRDSTEDLEALIPWAKHRGYPVTVRLVKGAYWDQETIKAQQNHWQIPVYVEKAQTDANYERMTRLLLENHEYLYAAIGSHNVRSQALACAIAEELNIPKRRYEMQILYGMGEPLARAIVKRGHRVRVYAPYGRLLPGMAYLIRRLLENTANSSFLRQNLEERPIEELIAPPQVKGINDLPTKGYGNAPDTDYADADLRQQAFQALTRVKQQLGKTYLPYINGEYVETANYIDSVNPCRPSQAIGKVGLISVEQADHALEIAKAAFPAWKKTPVRERCGILRKAADIMEERRHELNAWICLEVGKIIPQADAEVSEAIDFCRYYADEMERLDQGVNLDIPGETNRYFYQPRGIALVISPWNFPMAIAVGMTVAALVTGNCTLLKPAETSTVIAAKIAEILIAAGVPPGVFQYVPGKGSVVGSHMVNHPDVHLIAFTGSREVGCRIYADAALVQPGQKHLKRVIAEMGGKNAIIVDESADLDQAVAGAVYSAFGYTGQKCSACSRVVVLSPVHDAFVERFVEATRSLNVGPTDDPSTQVGPVIDAKAQARIQEYIEQGKAECELAIACDAPSEGYFVGPTVFKNVDRHATIAQEEIFGPVVTIIRAANFDEALEIANGTDYALTGGLYSRTPDHINRAAAEFEVGNLYINRTITGAIVSRQPFGGFKMSGVGSKAGGPDYLLQFLEPRHVTENIQRQGFAPIEGADQ

SEQ ID NO: 2755 - protein, 302 aa, Synechocystis sp.
MKWHKESKVLLQGVHHPLGLTYLEQMRSCGTKLVAGVSPGHGGELIGDLPVFDLVDLAVKTVGPVDISLILNPPYRVLDAALEAIAAGIRQLVIVSAGVPPLDMITLLREAQATHTLILGSGSQGIMIPQQFSVGTLDPNCYLPGPIGIISHCDRLTDDIAQTLSAAGLGQSMVISLGTDGLNGSNFEQWLQVLEEDEQTATILLLGQPNSNGEMRAADYVASAIEKPVVAYLAGRGAKIKRHFGDSLTIVANQLSHKRPLLTSVEQTVQAFENANIPVAEAPWELPIFLPLAMESRHLGTD

SEQ ID NO: 2756 - protein, 1034 aa, Synechocystis sp.
MNLAVPAFGLSTNWSGNGNGSNSEEESVLYQRLKMVEELWERVLQSECGQELVDLLTELRLQGTHEAITSEISEEVIMGITQRIEHLELNDAIRAARAFALYFQLINIVEQHYEQNEQQRNRWEASQETNFYEQAGNEEEMVPPSRLGASTEPLPVGIDQNELQASVGTFHWLMRELKRLNVPPQHIQNLLDHLDIRLVITAHPTEIVRHTIRRKQRRVDRILRKLDQLQGSVTGRDWLNTWDAKTAIAQLTEEIRFWWRTDELHQFKPTVLDEVDYSLHYFDEVLFDAVPELSKRLGQAIKETFPHLRAPRANFCYFGSWVGGDRDGNPSVTPEVTWQTACYQRGLVLGKYLFSLGELVAILSPSLHWCKVSQELLDSLERDRIQLPEIYEELSLRYRQEPYRMKLAYVTKRLENTLRRNNRLANPEERQTMITMPAENHYRTGEELLEELRLIQRNLTETGLTCLELENLITQLEVYGFNLAQLDFRQESSRHAEAIAEIAEYMGVLTTPYEEMAEEDKLAWLGVELQTRRPLIPQEMPFSERTRETIETLRTLRHLQMEFGVDICQTYIISMTNDASDVLEVLLLAKEAGLYDPATASNSLRIVPLFETVEDLKNAPGIMDSLFSLPFYRATLAGSYHSLKELQNQPPDYYQIPTTTALLNPGNLQEIMVGYSDSNKDSGFLSSNWEIHKAQKSLQAVAQSHRVILRLFHGRGGSVGRGGGPAYKAILAQPAGTVDGRIKITEQGEVLASKYSLPELALYNLETLTTAVIQASLLKSSFDFIEPWNRIMEELACTARRAYRSLIYEEPDFLDFFLTVTPIPEISELQISSRPARRKGGKADLSSLRAIPWVFSWTQTRFLLPAWYGVGTALKSFVDQDPVKNMKLLRYFYFKWPFFNMVISKVEMTLSKVDLTIASHYVQELSKPEDRERFDRLFQQIKQEYQLTRDFAMEITAHPHLLDGDRSLQRSVLLRNRTIVPLGLLQISLLKRLRQVTQEAETSGVRYRRYSKEELLRGALLTINGIAAGMRNTG

SEQ ID NO: 2757 - protein, 524 aa, Synechocystis sp.
MPLLVFRSLSRCLLVTALILVLHGPGLWSHPAIAADLAPTNNRNSQTLTPYLNRAIQRITEFQLDNGLKFIVMENNEAPVVSFYTYFDVGGVDEPVGKTGVAHFLEHMAFKGTERIGTKDFTQEQQLLDQLDQVFAQITTARAKGDKTGEQKLQEQFKQIQQQAQDLIKQNEFGQIIQMAGGVGLNAATSADATFYFYSLPSNKLELWMSLESERFLEPVFREFYQEQEVILEERRMRTENNPVGQMVEEFLDTAFTKHPYRRPVIGYDEDIRNLSRQDVTDFYEKYYIPGNMTIAVVGDVKVDQVKSLAQKYFGRFPQRPPTPQVTVVEPPQTQQKEINLTLPSQPWYFEGYHSPAFDDPDSAVFDVMTTILSSGRTSRLYQSLVEEKQLALMAQGFNGFPADKFPNLLMFYAQSAPGRSLDDLSEALHGEIERLKMEPVTPEELERAQNLLQTSALQSLNSNMGMAQLLVKYNVRTGDWRNLFARLEAIAAVTPEDIQRVAQETFRPENSTIGRILPESNRQ

SEQ ID NO: 2758 - protein, 489 aa, Synechocystis sp.
MRVAIVGAGLAGMATAVELVDAGHEVELYEARSFIGGKVGSWVDGDGNHIEMGLHVFFGCYYNLFNLMEKVGAKQNLRLKEHTHTFVNQGGRIGELDFRFLTGAPFNGLKAFFTTSQLDTKDKIANSIALATSPIVRGLVDFDGAMKTIRDLDRISFAEWFLSKGGNEGSLKKMWDPIAYALGFIDTENISARCMLTIFQLFAARTEASVLRMLEGSPQEYLHKPIQEYLEQRGTKFYTRHKVKEIKTKVTDGETRVTGLIINDGVETKTVTADAYVAACDVPGIKNLLPENWRTQWDFFNKIYYLDTVPVATVQLRFDGWVTEMNDPAKRKQLEQAFGLDNLLYTSDAEFSCFADLALTSPADYYRPGEGSLLQLVLTPGDPFMKESNEAIAYRVLKQVKALFPSAADLNMTWYSVIKLAQSLYREAPGMDLFRPSQATPIANFFLAGSYTQQDYIDSMEGATLSGRQAAQAILANQARLQTAVLASQ

SEQ ID NO: 2759 - protein, 327 aa, Synechocystis sp.
MQSFNRINSMKYFPLSNGEQIPALGLGTWKSSPQVVGQAVEQALDLGYRHLDCAAIYGNEAEIGATLANAFTKGVVKREELWITSKLWSNAHHPDAVLPALEKTLQDLGLDYLDLYLIHWPVVIQPDVGFPESGDQLLPFTPASLEGTWQALEKAVDLGLCHHIGVSNFSLKKLEMVLSMARIPPAVNQVELHPYLQQSDLLTFANSQNILLTAYSPLGSGDRPAAFQQAAEPKLLTDPVINGIAAEQGCSAAQVLLAWAIQRGTVTIPKSVNPERLEQNLRAADITLTDSEMAKIALLDRHYRYVSGDFWTMPGSPYTLQNLWDEI

SEQ ID NO: 2760 - protein, 300 aa, Synechocystis sp.
MMTLEPNQEQLKKMKSHPGFIAALDQSGGSTPGALADYGIEPNTYSGDDQMFALVHQMRTRIMTSPGFTGDRILAAILFEDTMNREVDGEPTANYLWQNKQIVPILKVDKGLAQEKDGSQLMKPIPQLDSLLMKAKKKGIFGTKMRSFIKHANPAGIEAIVDQQFELAQQIIAAGLVPIIEPEVDIHCSEKAQAEALLKQAMLKHLNQLPKGQWVMLKLTLPEQDNLYSNCIEHANVLRVVALSGGYSQAEANERLSRNHGVIASFSRALTEGLTAQQTDAEFNTMLDESIEKIYQASIT

SEQ ID NO: 2761 - protein, 347 aa, Synechocystis sp.
MTVSEIHIPNSLLDRDCTTLSRHVLQQLNSFGADAQDLSAIMNRIALAGKLIARRLSRAGLMADVLGFTGETNVQGESVKKMDVFANDVFISVFKQSGLVCRLASEEMEKPYYIPENCPIGRYTLLYDPIDGSSNVDINLNVGSIFAIRQQEGDDLDGSASDLLANGDKQIAAGYILYGPSTILVYSLGSGVHSFILDPSLGEFILAQENIRIPNHGPIYSTNEGNFWQWDEALRDYTRYVHRHEGYTARYSGALVGDIHRILMQGGVFLYPGTEKNPDGKLRLLYETAPLAFLVEQAGGRASDGQKRLLDLIPSKLHQRTPAIIGSAEDVKLVESFISDHKQRQGN

SEQ ID NO: 2762 - protein, 872 aa, Synechocystis sp.
MQPTDPNKFTEKAWEAIAKTPEIAKQHRQQQIETEHLLSALLEQNGLATSIFNKAGASIPRVNDQVNSFIAQQPKLSNPSESIYLGRSLDKLLDNAEIAKSKYGDDYISIEHLMAAYGQDDRLGKNLYREIGLTENKLAEIIKQIRGTQKVTDQNPEGKYESLEKYGRDLTELAREGKLDPVIGRDEEVRRTIQILSRRTKNNPVLIGEPGVGKTAIAEGLAQRIINHDVPESLRDRKLISLDMGALIAGAKYRGEFEERLKAVLKEVTDSQGQIILFIDEIHTVVGAGATQGAMDAGNLLKPMLARGALRCIGATTLDEYRKYIEKDAALERRFQEVLVDEPNVLDTISILRGLKERYEVHHGVKIADSALVAAAMLSNRYISDRFLPDKAIDLVDEAAAKLKMEITSKPEELDEVDRKILQLEMERLSLQRENDSASKERLEKLEKELADFKEEQSKLNGQWQSEKTVIDQIRTVKETIDQVNLEIQQAQRDYDYNKAAELQYGKLTDLQRQVEALETQLAEQQTSGKSLLREEVLESDIAEIISKWTGIPISKLVESEKEKLLHLEDELHSRVIGQDEAVTAVAEAIQRSRAGLSDPNRPTASFIFLGPTGVGKTELAKALAKNLFDTEEALVRIDMSEYMEKHAVSRLMGAPPGYVGYEEGGQLTEAIRRRPYSVILFDEIEKAHGDVFNVMLQILDDGRLTDAQGHVVDFKNTIIIMTSNLGSQYILDVAGDDSRYEEMRSRVMDVMRENFRPEFLNRVDETIIFHGLQKSELRSIVQIQIQSLATRLEEQKLTLKLTDKALDFLAAVGYDPVYGARPLKRAVQKYLETAIAKGILRGDYKPGETIVVDETDERLSFTSLRGDLVIV

SEQ ID NO: 2763 - protein, 584 aa, Synechocystis sp.
MLLSLRINNFALIDCLEINFGQGLNVLTGETGAGKSILLDAIDLLLGGKAGARVLRQGCSSGVIEGIFSTSTELNDWLATQAIEPLEDNTIACTREFSKKGSSLNSRSRLNGVLVNRQILAELRSQLVEITAQGQTQQLLDPGQQRQLLDLFGGQNLLEKRQAVEITYKEFTQAKQALTARQQSEQNRLQRLDFLTYQLQELTEAELTDGDEWELLIQEQEKLSHVVELQQLSYQATQLLYQSERDTPAIADLLGDAEGQLQTMAEFDSSLNPLLELVQTALTQVIEAGRQVQRYGDNLEADPERLGEVEARLQVLKRICRKYGPSLTEAIAYQEKIQAEYDQLTDGEQSLAQLQESLTKAEQELIKHCGQLTLIRQKTAQKLEKRLVQELKPLAMEKVIFVCQLESSAPSSFGAEQVVFYFSPNTGEKIQPLAATASGGEMSRFLLALKACFSELAPPSQTLIFDEIDVGVSGKVAQAIADKLAQLSQRQQLLCVTHQPLVAALADAHFHVDKVVINENIADPTNPQLDEDLRTVIRITPLQSDGDRQQELAQLTGGHSAKEALAFAQSLLEKSAARRQASQV

SEQ ID NO: 2764 - protein, 447 aa, Synechocystis sp.
MALLSLNNHQSHQRLTVNPPAQGVALTGRLRVPGDKSISHRALMLGAIATGETIIEGLLLGEDPRSTAHCFRAMGAEISELNSEKIIVQGRGLGQLQEPSTVLDAGNSGTTMRLMLGLLAGQKDCLFTVTGDDSLRHRPMSRVIQPLQQMGAKIWARSNGKFAPLAVQGSQLKPIHYHSPIASAQVKSCLLLAGLTTEGDTTVTEPALSRDHSERMLQAFGAKLTIDPVTHSVTVHGPAHLTGQRVVVPGDISSAAFWLVAASILPGSELLVENVGINPTRTGVLEVLAQMGADITPENERLVTGEPVADLRVRASHLQGCTFGGEIIPRLIDEIPILAVAAAFAEGTTRIEDAAELRVKESDRLAAIASELGKMGAKVTEFDDGLEIQGGSPLQGAEVDSLTDHRIAMALAIAALGSGGQTIINRAEAAAISYPEFFGTLGQVAQG

SEQ ID NO: 2765 - protein, 431 aa, Synechocystis sp.
MIERYTLPEMGKIWTDTYKLQTWLDVEIAVCEAQAELGYIPQAAVDEIKAKAKFDPQRVLEIEAEVRHDVIAFLTNVNEYVGDAGRYIHLGLTSSDVLDTALALQLVASLDLILEQLEKLIQAIRYQAQQHRYTVMVGRSHGIHAEPITFGFKLAGWLAEVLRNRDRLVRVAQSIAVGKISGAVGTYANIDPKVEAIACQKLGLEPDTASTQVISRDRHAEYVQQLALLAASLERFAVEIRNLQRTDVLEVEEYFSKGQKGSSAMPHKRNPIRSERLTGMARLVRGHAVAALENVALWHERDISHSSVERVAFPDCCILTHFMLKETTDLVKNLLVYPENMKRNMNVYGGVIFSQKVLLALVEKGMNREDAYRVVQGSAHQAWNTEGGNFEELVRADAQVTALLSAEEIDQCFDPQQHLTNLAEIYSRLDI

SEQ ID NO: 2766 - protein, 359 aa, Synechocystis sp.
MLTAERIKFTQKRGFRRVLNQRVDAYFAEHGLTQRDNPSMYLKTLIIVLWLFSAWAFVLFAPVIFPVRLLGCMVLAIALAAFSFNVGHDANHNAYSSNPHINRVLGMTYDFVGLSSFLWRYRHNYLHHTYTNILGHDVEIHGDGAVRMSPEQEHVGIYRFQQFYIWGLYLFIPFYWFLYDVYLVLNKGKYHDHKIPPFQPLELASLLGIKLLWLGYVFGLPLALGFSIPEVLIGASVTYMTYGIVVCTIFMLAHVLESTEFLTPDGESGAIDDEWAICQIRTTANFATNNPFWNWFCGGLNHQVTHHLFPNICHIHYPQLENIIKDVCQEFGVEYKVYPTFKAAIASNYRWLEAMGKAS

SEQ ID NO: 2767 - protein, 374 aa, Synechocystis sp.
MPLDNGSITDDTRIRAALPTIKDLLSKGAKVILGSHFGRPKGKVVDSMRLTPVGDRLGELLGQPVVKCDDCIGAEVTAKIASLPNGGVALLENLRFHAGEEGNDAEFAKALAANADLYVNDAFGTAHRAHASTEGVTHFLSPNVAGYLIEKELQFLQGAIEAPKRPLVAIVGGSKVSSKIGVIETLLDKCDKLIIGGGMIFTFYKAQGLNTGKSLVEEDKLDLAKSLMAKAKEKGVEFLLPTDVVVADNFAPDANAQTVGVDAIPDGWMGLDIGPDSVKTFQDALAGCGTVIWNGPMGVFEFDKFAVGTEAIACSLAELTASGTVTIIGGGDSVAAVEKVGVAEKMSHISTGGGASLELLEGKVLPGIAALDDR

SEQ ID NO: 2768 - protein, 218 aa, Synechocystis sp.
MAMEVKICGLRHPAQAQAIAALGFTTLGFICVEASSRYVSSREIELVLQSLTAHNKRSAIGVFANVSLPKLGEFLAQTSLNGIQLHGDESPDFCRQVKQAFPQHRLIKALRLRRSADLERAEAYYNAVDVLLLDAYHPEQLGGTGQTLPWQKLQQFRPPLPWWLAGGLTPSNVQEALNLLQPDGIDLSSGVEQGPADKDVAKVAQLRAQLDALAILQH

SEQ ID NO: 2769 - protein, 898 aa, Synechocystis sp.
MQPTDPTKFTEQAWDAIVKSQEVARRYKNTNLEVEHILLALLEQDMGLAARIFQRAAVDGEGLRQQLEIFTNRQPKQAYVEQLYLGRSLDVMLDRADAARSSWEDKFISVEHLLVGFAEDDRVGRKTLRAFNLDPQDLELAIKAIRGSQKVTEPNQEEKYEALDKYGRDLTEQARQGKLDPVIGRDEEIRRVIQVLSRRSKNNPVLIGEPGVGKTAIAEGLAQRIINGDVPESLKNRQLISLDMGSLIAGAKYRGEFEERLRSVMKEVTNSDGQIILFIDEVHTVVGAGGREGSGSMDAGNLLKPMLARGELRCIGATTLDEYRKNIEKDPALERRFQQVYVKQPSVDDTISILRGLKEKYEVHHGVKITDSALVAAATLSHRYIQDRFLPDKAIDLVDEAAARLKMEITSKPVELEDIDRRLMQLQMEKLSLEGEEKRPGLGADKSSKERLEKIQQEITELEGQQQELSGQWLSEKQMLEEINTLKEKEQELRLQVEKAERATDWEKAAKIKYGELEVLQHDIEEKESKLLEIQGSGNTLLREQVTESDIAEIVAGWTGIPMNRLMETERQKLLQLEGHLHQRVIGQKEAVAAVSAAIRRARAGMKDPSRPIGSFLFMGPTGVGKTELARALAGFLFDSEEAMVRIDMSEYMEKHAVSRLIGAPPGYVGYEEGGQLSEAVRRRPYSVVLLDEVEKAHLDVFNILLQVLDDGRITDSQGRVVDFRNTIIVMTSNIGSDHILSLSADDADYDKMQKQVLQSLRKHFRPEFLNRIDDLIIFHTLKRDELRRIVVLQIKRIEKLLDEQKITLSLSDAALDHIVSAGYDPTYGARPLKRAIQRQLENPIATKILENTFVAGDKILIDCVDGQLIFDKEIEPTTLPEEPEENITAVEVEVLSS

SEQ ID NO: 2770 - protein, 441 aa, Synechocystis sp.
MHPVVSSAEYRQRRDRLMAKLGQGTAIFASAPQAVMHNDVEYVFRQDSDFYYLTGFNEPEAIAVFAPHHEEHQFILFVQPKDPAKETWTGIRYGVEGVQSSFGSDIAYPIGELDEHLPKYLEKADKIHYHLGRDEALNQTILKHWQKQLAAYPRQGYGPQALVNSHPLVHPLRQVKSETELALLRRACDLSAIAHQRAMEFARPGHYEYQVQAELEIIFRREGGLGPAYPSIVAAGKNACILHYINNDCPLQDGDLLLIDAGCAYGYYNGDITRTFPINGKFSPEQRTLYEIVLTAQEAAIAKVQAGNPYHEYHDAAVSVIVDGLMDLGLLVGNKEEIIKEEKYKPFYMHRTGHWLGLDVHDAGNYKQDKETWTVLEPGQVLTVEPGIYIAPDIKPAEGQPEVPEQWRGIGIRIEDDVLVTAQGPDVLTSAVPKAIADLEH

SEQ ID NO: 2771 - protein, 342 aa, Synechocystis sp.
MVSERILPELNTAEISLDRETALVLYEDMVLGRFFEDKCAEMYYRGKMFGFVHLYNGQEAVSSGIIKAMRQDEDYVCSTYRDHVHALSAGVPAREVMAELFGKETGCSRGRGGSMHLFSSAHNLLGGFAFIGEGIPVALGAAFQTKYRREVLKDDGYDQVTACFFGDGTSNNGQFFECLNMAALWKLPILFVVENNKWAIGMAHERATSQPEIYKKASVFNMVGVEVDGMDVVAMHKVATEAVARARAGEGPTLIEALTYRFRGHSLADPDELRSAEEKQFWAARDPIKKFAAFMTEHELASNEELKAIDKRIQEVIDDALAFAESSPEPNPEDLRKYIFAD

SEQ ID NO: 2772 - protein, 275 aa, Synechocystis sp.
MANLFFLGFPMDIASWNVNSVRSRQQHILDWLGTNPVDVLCLQETKVVDEDFPRQPFEEAGYHCHISGQKSYNGVAIFSREPLQDVKIGFAALVEPALTGDLDEQKRVISGVYDGVRIVNLYVPNGSALDSEKYLYKLRWLNLLQTYLEQLRRSDTPEFLVCGDFNIAPEDRDIHDPVGRENHIMATAMEREALTEVLAIANLQDAFRKFTEETGHYSWWDYRTRGFSRNRGWRIDHHYLTPQLYDQAQKCWIDREPRGWEKPSDHAPVVVTINN

SEQ ID NO: 2773 - protein, 149 aa, Synechocystis sp.
MERTFIMIKPDGVQRQLIGEIVGRFEKKGFKLVAMKVMTVSQELAEKHYEALNDKPFFSGLVNFICSSPVVAMVWEGNSIVSTSRQMIGATDPHAAAPGTIRGDYGVSVGRNIIHGSDAIETAKREISLWFKDEEVNEWDATLNPWLYE

SEQ ID NO: 2774 - protein, 532 aa, Synechocystis sp.
MAEAPIAPVVLVILDGWGYRPDTRANAIAQANTPIMDSLIAAYPNTLVNTSGKDVGLPKGQMGNSEVGHLNLGAGRVVPQELVRISDAIEDGTFFDNQALIEVCQRVRDRRGKLHLIGLCSDGGVHSHIDHLLGLIDLAKLQGISQLCIHAITDGRDTPTNEGAHFVQQIQAHLEKIGLGRIVSVSGRYYALDRDRRWDRVEKAYRVMTEDGVGDGRSAAQVIKDYYASDITDEFIPPTRIGAGAIASGDGVIFYNFRPDRARQLCYALVNPSFDGFPRERIQPLDFVTFTQYDPALPVVVAFEPQNLNNILGEIISRQGMKQFRTAETEKYPHVTYFFNGGLEQPFAGEDRELIQSPMVSTYDKAPQMSAKAVTDAVCRAMEKGIYSLVVVNYANPDMVGHTGKLKEAIQAIETVDLNLGRLLASAAKVGGTVLITADHGNAEYMSDESGNPWTAHTTNPVPFILVEGEGRKIPGHGGEVKLREGGKLADIAPTILDILQLPVPAEMTGKTLIDQPLVEIKANRTPVNLSR

SEQ ID NO: 2775 - protein, 433 aa, Synechocystis sp.
MIYDIFMPALSSTMTEGKIVSWTKSPGDKVEKGETVLVVESDKADMDVESFNEGYLAAILVPAGEEAPVGATLGLVVETEAEIAEAQAKAGSGGGSSAAPTATPAPQQPEPVAIASATAIETTPAPSSNGNGKGSGRIIASPRAKKLAKELKVDLATIAGTGPHGRIVAADIESAAGKPVTASIAAPSAPAPKTSPAPTPRVTSTPSVPVGQTVPLTTFQKALVQNMVAAMAAPTFRVGYTITTDGLDQLYKQIKGKGVTMTALLAKAVALALKKHPIVNASYTDQGIIYHKDVNIALAVAMPDGGLITPVLQNADQVDIYSLSRRWKELVERARAKQLQPEEYSTGTFTISNLGMFGVDRFDAILPPGQGGILAVGASRPQVVANEEGLIGTKRQMAVNVTCDHRVIYGAHAAAFLKDLAVIIEENAQSLTM

SEQ ID NO: 2776 - protein, 780 aa, Synechocystis sp.
MVQLSPTPASTLTYKDANGQNRTASLTLDVGGMKCAGCVAAVERQLDQLTGVTDSCVNLVTAVAVVRYEPEKIQPQAIAEHLSQRGFPSQIRHGHGAIPATIGEKETRENVNWGLTIALVLLLLSGLGHLSHFGGPMIPFFHHPIFHWSLATLAIAIPGREIFLDGWRGLRFGHANMNTLVALGTGSAYLTSCIAWAWPGLGWECFFDEPVMLLGMLLLGRTLESKARQKAKSALTELLALQPSLARLVGRGEDQGETGIEIPVEQVRVGEWVQVLPGEKIPVDGILVAGKTLVDESLLTGESLPVAKNVDDAVIAGAWNQSGAIIIAATHIGAETTLARIIQLVETAQTQKAPMQRLADQVAGWFAYGVLAIALVTLGFWAMVGQSLFPEMVADTGLSPLLLALKLSVSVLVVACPCALGLATPTAILVGTSLGAEQGILIKGGNILEILQRTTVMAFDKTGTLTQGNLQLTDAVPVADITGIELLTLAASVEQGTRHPLAQGLISSAQGLELLPVENIETEAGQGVQGWYQGDRLLVGNQQWLMEQGVMGEPQWQTAVDQLLDQGKTVIFVARNQQLQGFLALRDTLRPEAKATIAQLKQWGIAPLLLTGDHPAIAQAIAMEVGIEEFQAQMTPQAKVAKIKAMQGFNPVSVIAMVGDGINDAPALAQADVGISLSGATAVAMETADVVLMRSHLSDVLKALTLSRSTVAKIKQNLLWALGYNLLAIPLAAGAFLPSFAIVLTPAIAAAMMASSSIVVVLNALALRYQFSRSLGQDPG

SEQ ID NO: 2777 - protein, 477 aa, Synechocystis sp.
MKILFVAAEVSPLAKVGGMGDVVGSLPKVLHQLGHDVRVFMPYYGFIGDKIDVPKEPVWKGEAMFQQFAVYQSYLPDTKIPLYLFGHPAFDSRRIYGGDDEAWRFTFFSNGAAEFAWNHWKPEIIHCHDWHTGMIPVWMHQSPDIATVFTIHNLAYQGPWRGLLETMTWCPWYMQGDNVMAAAIQFANRVTTVSPTYAQQIQTPAYGEKLEGLLSYLSGNLVGILNGIDTEIYNPAEDRFISNVFDADSLDKRVKNKIAIQEETGLEINRNAMVVGIVARLVEQKGIDLVIQILDRFMSYTDSQLIILGTGDRHYETQLWQMASRFPGRMAVQLLHNDALSRRVYAGADVFLMPSRFEPCGLSQLMAMRYGCIPIVRRTGGLVDTVSFYDPINEAGTGYCFDRYEPLDCFTAMVRAWEGFRFKADWQKLQQRAMRADFSWYRSAGEYIKVYKGVVGKPEELSPMEEEKIAELTASYR

SEQ ID NO: 2778 - protein, 1042 aa, Synechocystis sp.
MTESLSPLLPEISIALVLEQLRRLCRQNCQSHWYCLPGAPWEISDWQTYPLGKVNEKGYLIWEKGEKTQWFAQTFTVPKALADYPLDGLTLRLALTWWAKDAQIFVNGELVQAGDLFDSKARVLLTDNSQIGRTFTVALKLTSSGHDIGGLMQSQLIFERKYPDLDPGFIADEIEVLSLYLAQFESERLAQLSKTLEAITWNKISDQEQFDQSLLQLRQRLLLLTEGLKQQQINLLGHAHLDMAWLWQLEETWEVGERTFQSVINLQTEFADLVFGHTSPVLYQWIEEHLPALFEQIQVAIKKGNWELLGGMWVEPEVNIISGESLARQFLYGQRYFEAKFGQISKVAWLPDSFGFCGQLPQIFHQSGIDYFVTGKLHWNDTNSFPHGAFHWRSPDGTEIFTVMSPPNLAGVMDNQPLPMANYANRWQEQTGLKECLWLPGVGDHGGGPSRDMWEMKERWQNSEFFPTINTAKAEHFLAGIKQKLQSDQSFPIWERELYLELHRGCFTVHADQKLYNRQCEHLLYEAELWSSFANWLGGYSYPKEKLELAWKKVLLNQFHDILPGTSIPEVFVTANQAWQEVYQTTNKIINQALKHLSDQINYPSYHHDSTERETPLLVFNPLHWSQSQLVEIPIQEGKHYQVYDGQTKTLVNSQITAEGSLIFLVDSPPLTCKYYWLKTKEPLSNSQQLESFSQDPILNNGLLKVEISLDNGEIASIYDLANQRQVLAGHGNQLQFFRDQGQYWDAWNIDPNYEQYPLSSAKLINYQWLEQGPLHWRLRVVKKFQQSVFTQDYCLTKDSPLLEIKTEVDWQETHVMVKAAFPIALQSEFFTTEAPCAVVDRPTNPQTETEKAQWEVPHQHWFSLTDQTENYGVSLLNNCKYGCDVKDNLMRLTLLRSSVWPDPSADRGKHKFSYYFYPHQGNWQSAKTVAVGYGIHRPLRTYFPENFNPLSSQKLLSPGEPWLNLGSDNLCLMALKLREDYPDQWVLRCYEMSGESAQLEVITAFDHRVKTRLNLLEEAQPEENNNHVNPWQIVSVCLAYD

SEQ ID NO: 2779 - protein, 636 aa, Synechocystis sp.
MGKVVGIDLGTTNSCVAVMEGGKPTVIANAEGFRTTPSVVGYAKNGDRLVGQIAKRQAVMNPGNTFYSVKRFIGRKFDEITNEATEVAYSVVKDGNGNVKLDCPAQGKQFAPEEISAQVLRKLVDDASKYLGETVTQAVITVPAYFNDSQRQATKDAGKIAGIEVLRIINEPTAASLAYGLDKKDNETILVFDLGGGTFDVSILEVGEGVFEVLATSGDTHLGGDDFDKKIVDFLAGEFQKAEGIDLRKDKQALQRLTEAAEKAKIELSGVSQTEINLPFITATQDGPKHLDTTLSRAKFEEICSDLIDRCGIPVENAIRDAKIDKSALDEIVLVGGSTRIPAVQEVVKKILGKDPNQGVNPDEVVAVGAAIQGGVLSGEVKDILLLDVSPLSLGVETLGGVMTKIIPRNTTIPTKKSETFSTAVDGQSNVEIHVLQGEREMANDNKSLGTFRLDGIPPAPRGVPQIEVTFDIDANGILNVTAKDRGTGKEQSISITGASTLPDTEVDRMVKEAESNAAADKERREKIDRKNQADSLVYQAEKQITELGDKVPAADKIKAEGLIKDLKEAVAQEDDAKIQTVMPELQQVLYSIGSNMYQQAGAEAGVGAPGAGPEAGTSSGGGDDVIDAEFSEPEK

SEQ ID NO: 2780 - protein, 770 aa, Synechocystis sp.
MTYTINADQVHQIVHNLHHDPFEVLGCHPLGDHGKVNQWVIRAYLPTAEAVTVLLPTDRREVIMTTVHHPNFFECVLELEEPKNYQLRITENGHERVIYDPYGFKTPKLTDFDLHVFGEGNHHRIYEKLGAHLMTVDGVKGVYFAVWAPNARNVSILGDFNNWDGRLHQMRKRNNMVWELFIPELGVGTSYKYEIKNWEGHIYEKTDPYGFYQEVRPKTASIVADLDGYQWHDEDWLEARRTSDPLSKPVSVYELHLGSWLHTAYDEPVKTLHGEGVPVEVSEWNTGARFLTYYELVDKLIPYVKELGYTHIELLPIAEHPFDGSWGYQVTGYYAPTSRFGSPEDFMYFVDQCHLNGIGVIIDWVPGHFPKDGHGLAFFDGTHLYEHGDPRKGEHKEWGTLIFNYGRNEVRNFLVANALFWFDKYHIDGMRVDAVASMLYLDYCREEGEWVANEYGGRENLEAADFLRQVNSVVYSYFPGILSIAEESTSWPMVSWPTYVGGLGFNLKWNMGWMHDMLDYFSMDPWFRQFHQNSITFSMWYNHSENYMLALSHDEVVHGKSNMLGKMPGDEWQKYANVRALFTYMFTHPGKKTMFMSMEFGQWSEWNVWGDLEWHLLNFPPHQQLKQFFTELNHLYKNEPALYSNDFDESGFQWIDCSDNRHSVVSFIRRAKNSAEFVVTICNFTPQPHSHYRVGVPVPGFYTELFNSDARQYGGSNMGNLGGKWTEEWSFHEQPYSLDLCLPPLSVLVLKLSQNAEENTVPAEEASNIA

SEQ ID NO: 2781 - protein, 454 aa, Synechocystis sp.
MAIATINPATGQTVQTFIAHSQVEVNAKLDLAQETFQSFRHLPFAQRGQWLRKAADILEQRRDEWAALMTLEMGKSIPQAIAEVNKCALVCRFYADKAEEYLADEVVTTDASQSFIAYQPLGVILAVMPWNFPFWQVFRFAAPALMAGNVGLLKHASNVPQCALAIAEIFQTAGFPEGAFQTLLIGGKVASELMADDRIQAGTLTGSEPAGASFASAAAGQIKKTVLELGGSDPFIVLEDADLDQALKVAVPARMQNNGQSCIAAKRFIVQASVAEEFFQRLTKAFQALKVGDPSLSTTDIGPLATPDILADIVAQVEQTIAAGAHCRCGGQALDQPGNYYPPTLLTDVPPNAPTYRQEFFGPVALGFTVDNLEEAIALANDIPFGLGASAWTTNPENQQKLIRGIEAGAVFINGMTKSDPRIPFGGIKRSGFGRELGRMGILEFVNAKTVWIA

SEQ ID NO: 2782 - protein, 409 aa, Synechocystis sp.
MKFCCEGRSPGAALDSAFYFVDVDLIYPHLAMRVALFTETFLPKIDGIVTRLKHTVENLQRQGHQVLVFCPEGGLKEYKGAKIHGVKGMPLPLYPELKLAFPSPQIKQALLKFQPDLIHVVNPAVLGLGGIYYAKNLHIPLVASYHTHLPQYLQHYGLGALEGVLWELLKLAHNQAELNLCTSSAMVQELVNHGIERVDLWQRGVDTELFQPHLKSAQMRQKLSQGHPDDPLFLYVGRVSAEKQIDEIKPVLEAIPQARLAIVGDGPNRKNLEAHFAGTNTYFAGYMQGLELAAAFASADAFIFPSRTETLGLVLLEAMAAGCPVVAAASGGILDIVTDGENGYLFDPAVAGGVVQATQRLMSAPGDRELLRQNARQEAERWGWPAATRQLVDYYQLVAYGENDAPLAA

SEQ ID NO: 2783 - protein, 482 aa, Synechocystis sp.
MQFNVAIMTKRTFGVIGLAVMGENLALNVESRGFPIAVFNRSPNKTEKFMAERAVGKDIKAAYTVEEFVQLLERPRKILVMVKAGGPVDAVINELKPLLEEGDMIIDGGNSLYEDTERRTKDLEATGLGFVGMGVSGGEEGALLGPSLMPGGTPAAYKELEPILTKIAAQVEDPDNPACVTFIGPGGAGHYVKMVHNGIEYGDMQLIAEAYDILKNGLGLSNEQLHEVFGQWNQTDELNSFLIEISTDIFAKKDPETGGHLIDYILDAAGQKGTGRWTVMSGLELGVPIPTIYAAVNARVMSSLKEERVAASGQLSGPSKTFSGDVEAWIPKVRDALYCSKMCSYAQGMALIAKASQEFGYDVNLPEIARIWKGGCIIRAGFLDKIKKAFKDNPQLPNLLLAPEFKQSILDRQGPWREVLMLANEMGIAVPAFSSSLDYFDSYRRAVLPQNLTQAQRDYFGAHTYERTDKPRGEFFHTEWLD

SEQ ID NO: 2784 - protein, 508 aa, Synechocystis sp.
MKLAYWMYAGPAHIGTLRIASSFKNVHAIMHAPLGDDYFNVMRSMLEREQNFTPVTTSVVDRQVLSRGSQEKVVDNIVRKDGEETPDLIVLTPTCTSSILQEDLANFVDRAQMDAHCDVLLADVNHYRYNELQAGDRTLKQIVEFYIKKARKQGNLATEKTAKPSVNLIGFTTLGFHNQHDCTELKRLMADLGIEVNLILPEKATVDQLAKIPQAWFNLCPYREIGLMTAEYLQEEFAQPYVDITPMGVVETARCIRKMQQVLNQQGFDVNYEDFIQQQTRHVSQAAWFSRSIDCQNLTGKKAVVFGDNTHAAAMTKILAREMGIHVVLAGTYCKYDADWFRAEVSEYCDEVLISEDNGAIADAIARIEPAAIFGTQMERHVGKRLDIPCGVIAAPIHIQNFPLGYKPFLGYEGTNQIADLVYNSFTLGMEDHLLEIFGGHDTKEVITKGISSDSDLGWHSTAQAELNKVPGFVRGKVKRNTEKFARERGLSEITLEVMYAAKEAVGA

SEQ ID NO: 2785 - protein, 468 aa, Synechocystis sp.
MNPSSSPSQSTANVKFVLLISGVAALGGFLFGFDTAVINGAVAALQKHFQTDSLLTGLSVSLALLGSALGAFGAGPIADRHGRIKTMILAAVLFTLSSIGSGLPFTIWDFIFWRVLGGIGVGAASVIAPAYIAEVSPAHLRGRLGSLQQLAIVSGIFIALLSNWFIALMAGGSAQNPWLFGAAAWRWMFWTELIPALLYGVCAFLIPESPRYLVAQGQGEKAAAILWKVEGGDVPSRIEEIQATVSLDHKPRFSDLLSRRGGLLPIVWIGMGLSALQQFVGINVIFYYSSVLWRSVGFTEEKSLLITVITGFINILTTLVAIAFVDKFGRKPLLLMGSIGMTITLGILSVVFGGATVVNGQPTLTGAAGIIALVTANLYVFSFGFSWGPIVWVLLGEMFNNKIRAAALSVAAGVQWIANFIISTTFPPLLDTVGLGPAYGLYATSAAISIFFIWFFVKETKGKTLEQM

SEQ ID NO: 2786 - protein, 347 aa, Synechocystis sp.
MGKSYLMGVAVQVKQLRKKYGAIPAVKDISFAVPRGEIFGLLGPNGAGKTTTIRCLCTLAKPDGGELWIDGVNVLSDPRQARRRLGYVAQEVAIDKILTGRELLQLQASLYHLDAISSQKRIDQLLDILGLTAYADQKTGTYSGGLKKRLDLAAGLLHQPTVLVLDEPSVGLDIESRFILWEFLRQLRDAGTTVVITSHYLEEIDALADRLAIIDQGTVIATGTPTELKDRVGGDRVTLRIKEFTADQEAEKASQILRSLAFVQEVIVNQAQGNSLNLVVTPQSNPLSQIEKALLADGLPIFSLAQSRPSLDDVYLAATGKTLMDADLAAAAQRDLKAEKKQAMKAS

SEQ ID NO: 2787 - protein, 200 aa, Synechocystis sp.
MTEVLRVGQPAPDFTATAIVDQSFQTVKLSTYRGKYLVLFFYPLDFTFVCPTEIIAFSDRHSEFTALDTEVVGISVDSEFSHLAWIQTERKMGGIGNINYPLVSDLKKEISQAYNVLEPDAGIALRGLFIIDREGILQYATVNNLSFGRSVDETLRVLKAIRHVQSHPNEVCPVDWQEGDKTMIPDPEKAKTYFETVAEP

SEQ ID NO: 2788 - protein, 294 aa, Synechocystis sp.
MTAVPPSCQILDGKALAQKMQGELQRDIAQLVAQGHRSPGLAVLMVGDNPASAVYVRNKEKACEKLGMVSFGKHFSADTDQETLTAAIASLNEDERVDGILVQLPLPDHLDAVKLLHTIDPSKDADGLHPVNLGHLVRGEEGLRSCTPAGVMALLAEYNLDLTGKNAVVLGRSILVGKPLALMLLEKNCTVTIAHSRTQNLADITRQADILVAAIGKPEFVTADMVKPGAIVVDVGINRLDLGEGKSTLVGDVDFAGVAPVASYLTPVPGGIGPMTVTLLLANTVASYRQRLGI

SEQ ID NO: 2789 - protein, 471 aa, Synechocystis sp.
MVIRSGKTNLNPPCALMAPSSSCDCIIVGSGLSGLIAARNLSRVNYSVLVIEAQERLGGRMYGEYLPSGQWIDRGGQWVGPTQDRFLALLNEYNIERFPSPADGLKVLLFDGKRYEFDGFFQGVFQGEAPKISSDEWNDAMVAWEKFNTLAQSLDEQHPEATPENKKLDSQTFADWIKENTHTAFGHWYFSYMCRAVGFLGPAEPSQVSLLHILWGHKSASQGENPEAELLHGGAGQIPQKIAAELGNSILLGEPVIHIAQDDKGVEVTTTTGKYQGKFAIVATPPHLAGRITYSPPMPPLRQQLTQRVPMGTCCKLLISYDRPFWREKGLAGIGLGNTTWIELCADSSDPTTGVGVIASFVVGDRYGKWIAMGEAERRQGVLSDLALYFGEEALSPETYDEVDWPSEQWVGGGYAAFMPPGVWTSFGQALSAPVGRIHWAGTEIAPRWAGFFDGAIRTGEAAAKAIIGLL

SEQ ID NO: 2790 - protein, 242 aa, Synechocystis sp.
MRKIIIAGNWKMHKTQAEAQAFLQGFKPLIEDAAESREVVLCVPFTDLSGMSQQLHGGRVRLGAQNVHWEASGAYTGEISAAMLTEIGIHYVVIGHSERRQYFGETDETANLRVLAAQKAGLIPILCVGESKAQRDAGETEQVIVDQVKKGLVNVDQSNLVIAYEPIWAIGTGDTCAATEANRVIGLIREQLTNSQVTIQYGGSVNANNVDEIMAQPEIDGALVGGASLEPQSFARIVNFQP

SEQ ID NO: 2791 - protein, 821 aa, Synechocystis sp.
MFERFTEKAIKVIMLAQEEARRLGHNFVGTEQILLGLIGEGTGVAAKVLKSMGVNLKDARIEVEKIIGRGSGFVAVEIPFTPRAKRVLELSLEEARQLGHNYIGTEHLLLGLIREGEGVAARVLENLGVDLSKVRTQVIRMLGETAEVAAGGGSGGRTKTPTLDEFGSNLTQMAAEGKLDPVVGRQKEIERVIQILGRRTKNNPVLIGEPGVGKTAIAEGLAQRIANKDIPDILEEKRVVTLDIGLLVAGTKYRGEFEERLKKIMDEIRQAGNIILVIDEVHTLIGAGAAEGAIDAANILKPALARGELQCIGATTLDEYRKHIERDAALERRFQPVMVGEPSVEETIEILYGLRERYEQHHKLKILDEALEAAAKLSDRYISDRFLPDKAIDLIDEAGSRVRLINSQLPPAAKELDKELRQILKEKDDAVRNQDFEQAGELKDREDEIKKQIRAIASSKKAEGDNGEPEVTSEEIAHIVASWTGVPVNKLTESESEKLLHMEDTLHQRLIGQEDAVKAVSRAIRRARVGLKNPNRPIASFIFSGPTGVGKTELTKALAAYFFGSEEAMIRLDMSEFMERHTVSKLIGSPPGYVGYNEGGQLTEAVRRRPYTVVLFDEIEKAHPDIFNMLLQILEDGRLTDAKGRTVDFKNTLLIMTSNIGSKVIEKGGGGLGFDFADDQAESQYNRIRSLVNEELKNYFRPEFLNRLDEIIVFRQLNKEEVKEISEILLRDVFARLVEKEISLQVTDKFKERIVEEGFNPAYGARPLRRAIMRLLEDVLAEEILSGRLKEGSQALVDIGEDNQVVVIPGETRELIAPGVE

SEQ ID NO: 2792 - protein, 359 aa, Synechocystis sp.
MALVPMRLLLDHAAENGYGIPAFNVNNMEQIISIMQAADETDSPVILQASRGARSYAGENFLRHLVLGAVETYPHIPIAMHQDHGNSPATCYSAIRNGFTSVMMDGSLEADAKTPASFEYNVNVTAEVVKVAHSVGASVEGELGCLGSLETGQGEAEDGHGFEGKLDHSQLLTDPEEAVEFVNKTQVDALAVAIGTSHGAYKFTRKPTGEVLAISRIEEIHRLLPNTHLVMHGSSSVPQEWIDMINEFGGAIPETYGVPVEEIQKGIKSGVRKVNIDTDNRLAITAAFREAAAKDPKNFDPRHFLKPSIKYMKQVCADRYQQFWTAGNASKIKQLTLDDYAAKYAKGELTATSRTSVAV

SEQ ID NO: 2793 - protein, 411 aa, Synechocystis sp.
MPGGVSSPVRAFKSVGGQPIVFDRVEGAQIWDVDGNQYIDYVGTWGPAICGHAHPDVISALKQALDKGTSFGAPCAQENVLAEMVIDAVPSIEMVRFVNSGTEACMSVLRLMRAFTGREKIIKFEGCYHGHADMFLVKAGSGVATLGLPDSPGVPSNTTKATLTAPYNDLEAVKALFVENPDSIAGVILEPVVGNAGFILPDAGFLEGLRELTKEYGALLVFDEVMTGFRVSYGGAQARFGITPDLTTLGKVIGGGLPVGAYGGREEIMAMVAPAGPMYQAGTLSGNPLAMTAGIKTLEILQKPGSYEYLDKITKRLVDGLLAAAQDAGHEVCGGSISAMFGIFFAPGPVRNYEDAKLADTNKFARFHRGMLERGIYLAPSQYEAGFPSLAHTQEQIDQTIAVAKEVFATL

SEQ ID NO: 2794 - protein, 438 aa, Synechocystis sp.
MLQVATPTATEETQTVIEIEGRASLKGEVRISGAKNSALAIMAGTILCSDDCRLSNLPALADIDKMCQILAAIGVNLERDGDRLVVDSSNVGHGPAPYELVSQLRASFFVIGPLLSRLGMTKVPLPGGCAIGTRPVDLHVRGLQAMGADVHIEHGVVNASIKGHSRRLTGAKIYLDYPSVGATETILMAATLAEGETVIDNAAREPEIVDLANFCRSMGAQIRGDGSSRIIINGVEKLHSTDFPIIPDRIEAATFLCAGAITHSEISLFPVVPDHLASAIAKLREIGPEVAIDAPDRVRLIPRDLRGTDIETLPYPGFPTDMQAQFMALLAVSEGNSVVTETVFENRLQHVAELQRMGANIKLKGNAAFIQGVPFLSGAPVMSTDLRASAALVIAGLAAEGKTIVQGLRHLDRGYEDIEGKLRKLGAKLTRIEQPVTL

SEQ ID NO: 2795 - protein, 466 aa, Synechocystis sp.
MVNSHRLETDSMGSLEVQADRLWGAQTQRSLMFFDIGSDVMPPDLIRAFAILKKAAAITNQDLGKLPADKAELIITAADEIIAGQWLDHFPLRIWQTGSGTQTNMNVNEVIANRAIAICGGELGSKNPIHPNDHVNMSQSSNDTFPTAMHIAAVAGLQTKLIPSLQALRDSLNEKAECFAGITKIGRTHLMDAVPLTLGQEFSGYVAQLDQGLTQINYCLPGLLELALGGTAVGTGLNSHPQFAKKVAEEIAQLTGYTFISAPNKFAALAGHEAIAFASGVLKSIAASLMKIANDLRWMGSGPRCGLGELALPANEPGSSIMPGKVNPTQCEAMTMVCVQVMGNDATIGFAASQGNFELNVFKPVIIHNFLHSLHLLSDACASFRQHLVVGLQVNESKVKDFLDTSLMLVTALNPHIGYDNAALVAKTAFAQGITLKQAAVDLGLLTPAQFDAWVVPEQMIAPIAD

SEQ ID NO: 2796 - protein, 394 aa, Synechocystis sp.
MSLNWISRADRLQALPPYVFARLDELKAKAREQGLDLIDLGMGNPDGKAPQPIIEAAIAELENPESHGYPPFEGTQSFRQSITRWYARQYGVDLDPDSEALPLIGSKEGLGHLALAYVNPGDLVLVPTPSYPAHFRGPLIAGAEIYPIMLSAKDDWLIQLDQIPEAIAQRAKILYFNYPNNPTTATAPREFYEAITDWARHYQIMLVHDLCYAELAFDGYQPTSLLEIPGAKDFSVEFHTLSKTYNMAGWRVGFVVGNQEIIQGLRTLKTNLDYGIFRVVQKAAETALSLPESYIEVVRKRYQERRDFVINGLSKLGWSITPSQATMYLWVPCPVGMSSTDFALTVLEKTGVVMTPGNAFGEGGERYVRLSLIADGDRLGEALQRIEQAGIRYS

SEQ ID NO: 2797 - protein, 393 aa, Synechocystis sp.
MVSVDRFLLTDNCSLNPRPNNITAIKIFMKALILSGGKGTRLRPLTYTGAKQLVPVANKPILWYGIEAIAKAGITDIGIIISPETGEEIKTITGNGEKFGIQITYILQSEPLGLAHAVKTAADFLQDSPFVMYLGDNLIQDHLEQFLAHFQAKSLDSLILLRRVSNPSAFGVATVNDQGKVLALVEKPEHPPSNLALVGLYFFAPTIHQAIANIEPSARGELEITDAIQYLISHDYRVESLQLKGWWLDTGKKDDLLAANQIILDTLVEKNIQGTVDDQSKISGRVTIGPHSQIINSVIRGPVAIGPNCHLENCFIGPYSSIAEGVKIRDADLEHSVVLQGASIVAIQQRIVDSVIGKNAKIFPAPRRPQALRFLIGNDSQVELIGPSSYPQD

SEQ ID NO: 2798 - protein, 627 aa, Synechocystis sp.
MKFSWRTALLWSLPLLVVGFFFWQGSFGGADANLGSNTANTRMTYGRFLEYVDAGRITSVDLYENGRTAIVQVSDPEVDRTLRSRVDLPTNAPELIARLRDSNIRLDSHPVRNNGMVWGFVGNLIFPVLLIASLFFLFRRSSNMPGGPGQAMNFGKSKARFQMDAKTGVMFDDVAGIDEAKEELQEVVTFLKQPERFTAVGAKIPKGVLLVGPPGTGKTLLAKAIAGEAGVPFFSISGSEFVEMFVGVGASRVRDLFKKAKENAPCLIFIDEIDAVGRQRGAGIGGGNDEREQTLNQLLTEMDGFEGNTGIIIIAATNRPDVLDSALMRPGRFDRQVMVDAPDYSGRKEILEVHARNKKLAPEVSIDSIARRTPGFSGADLANLLNEAAILTARRRKSAITLLEIDDAVDRVVAGMEGTPLVDSKSKRLIAYHEVGHAIVGTLLKDHDPVQKVTLIPRGQAQGLTWFTPNEEQGLTTKAQLMARIAGAMGGRAAEEEVFGDDEVTTGAGGDLQQVTEMARQMVTRFGMSNLGPISLESSGGEVFLGGGLMNRSEYSEEVATRIDAQVRQLAEQGHQMARKIVQEQREVVDRLVDLLIEKETIDGEEFRQIVAEYAEVPVKEQLIPQL

SEQ ID NO: 2799 - protein, 552 aa, Synechocystis sp.
MSKLISFKDESRRSLEAGINALADAVRITLGPKGRNVLLEKQYGAPQIVNDGITVAKEIELSNPEENAGAKLIQEVASKTKEIAGDGTTTATIIAQALVREGLRNVAAGANPVALRRGIEKVTTFLVQEIEAVAKPVEGSAIAQVATVSSGNDPEVGAMIADAMDKVTKDGVITVEESKSLNTELEVVEGMQIDRGYISPYFITDSDRQLVEFDNPLILITDKKISAIAELVPVLEAVARAGRPLLIIAEDIEGEALATLVVNKARGVLNVAAIKAPAFGDRRKAVLQDIAILTGGSVISEDIGLSLDTVSLDQLGQAVKATLEKDNTILVAGADKRASAGVKERIEQLRKEYAASDSDYDKEKIQERIAKLAGGVAVIKVGAATETELKDRKLRIEDALNATKAAVEEGIVPGGGTTLIRLAGKIESFKAQLSNDEERVAADIIAKALEAPLHQLASNAGVEGSVIVEKVKEATGNQGYNVITGKIEDLIAAGIIDPAKVVRSALQNAASIAGMVLTTEALVVEKPEPAAPAMPDMGGMGGMGGMGGMGMM

SEQ ID NO: 2800 - protein, 354 aa, Synechocystis sp.
MRFRCYLIFSIFSDSLLGAGFFQGGKRAMVVSTPIAAEEKPPIQANVVETWEISKIYRTGFWMNQKVESLKPLSIAVQQGETFGLLGPNGAGKTTLLKILLGVIRASGGRGTLLGKPIGDRQTKQRVGYLPENAYFYDFLTAWEFLDYIGSLFQIGKQERQRRILAMCDLVGLAQKTAKKKQLRQYSKGMLQRVGMAQALINDPEVVFLDEPMSGLDPLGRYQVREIILSLKEQGKTIFFNSHILADVEQICDRIAILARGELLCSGSLAEVLGNDEGYEVVLKGGEEEALGKYLANLSQEQDVWHGHYQGDVQALVDALPSLNARLISMNLARPSLEDYFIRQLRERGITTSQ

SEQ ID NO: 2801 - protein, 492 aa, Synechocystis sp.
MAIFSPVNAVTDIIPQLEKIVGQDGVIKRKDELFTYECDGLTGYRQRPALVVLPRTTEQVATIVKLCHDRQIPWIARGAGTGLSGGALPGADSLLIVTTRMRQILAVDYDNQTIVVQPGVVNNWVTQTVSGAGFYYAPDPSSQIVCSIGGNIAENSGGVHCLKYGTTTNHVLGLKLVIPDGSIVEVGGQVPETPGYDLTGLFVGSEGTLGIATEITLKILKTPESICVVLADFLSLEATAQSVADIIAAGIVPAGMEIMDNFSINAVEDVVATNCYPRDAAAILLVELDGLPIEVELNQAKVEEICRNNGARNTAIAYDQETRLKMWKGRKAAFAAAGKLSPSYFVQDGVVPRTQLVQILSDINDLSKKYGFAIANVFHAGDGNLHPLILYDQKVPGAWEKVEELGGEILKRCVELGGSLSGEHGIGIDKNCFMPNMFNEVDLETMQWVRQCFNPDNLANPGKLFPTPRSCGEVANAQRLNLGQDKKMEEIY

SEQ ID NO: 2802 - protein, 389 aa, Synechocystis sp.
MRLTQRVSQVVPSITLEITAKAKAMRTEGIDVLSFTAGEPDFTTPPHIVEAAKLALDEGKTRYGPAAGEPALRQAIAKKLREKNNLPYEAANILVTNGGKHSLFNLMLAMIEQGDEVIIPAPYWLSYPEMVRLAEGTPVIVNTTAATDYKITPEQLRQAITSKSKLFVLNSPSNPTGAVYTPAEIRALAAVILEYEDLYVVSDEIYERILYDGTEHLSIGAVNDEIFQRTIISNGFAKSYSMTGWRVGYLAGELPLIQACSTIQGHSTSNVCTFAQYGAIAALENPQTCVETMVKAFTERRQVIVEGINQIAGLSCPNPKGAFYVFVDIAKTGLNSLEFSARLLESHQVAVIPGAAFGADDCVRFSYATDMDTIKQGLAELERFVSTLA

SEQ ID NO: 2803 - protein, 397 aa, Synechocystis sp.
MNYMMTDNEVFKEGLAGVPAAKSRVSHVDGTDGILEYRGIRIEELAKSSSFIEVAYLLIWGKLPTQAEIEEFEYEIRTHRRIKYHIRDMMKCFPETGHPMDALQTSAAALGLFYARRALDDPKYIRAAVVRLLAKIPTMVAAFHMIREGNDPIQPNDKLDYASNFLYMLTEKEPDPFAAKVFDVCLTLHAEHTMNASTFSARVTASTLTDPYAVVASAVGTLAGPLHGGANEEVLNMLEEIGSVENVRPYVEKCLANKQRIMGFGHRVYKVKDPRAIILQDLAEQLFAKMGHDEYYEIAVELEKVVEEYVGQKGIYPNVDFYSGLVYRKLDIPADLFTPLFAIARVAGWLAHWKEQLSVNKIYRPTQIYIGDHNLSYVPMTERVVSVARNEDPNAII

SEQ ID NO: 2804 - protein, 324 aa, Synechocystis sp.
MSDTQNTGQNQAKARQLLGMKGAAPGESSIWKIRLQLMKPITWIPLIWGVVCGAASSGGYIWSVEDFLKALTCMLLSGPLMTGYTQTLNDFYDRDIDAINEPYRPIPSGAISVPQVVTQILILLVAGIGVAYGLDVWAQHDFPIMMVLTLGGAFVAYIYSAPPLKLKQNGWLGNYALGASYIALPWWAGHALFGTLNPTIMVLTLIYSLAGLGIAVVNDFKSVEGDRQLGLKSLPVMFGIGTAAWICVIMIDVFQAGIAGYLIYVHQQLYATIVLLLLIPQITFQDMYFLRNPLENDVKYQASAQPFLVFGMLATGLALGHAGI

SEQ ID NO: 2805 - protein, 692 aa, Synechocystis sp.
MGKVIGIDLGTTNSCASVLEGGKPIVITNTEGGRTTPSIVGFTKGSQRLVGQLAKRQSVTNAENTVYSIKRFIGRRWDDTVEERSRVPYNCVKGRDDTVSVSIRGQSYTPQEISAMILQKLKADSEAFLGEPVTQAVITVPAYFTDAQRQATKDAGTIAGLEVLRIINEPTAAALAYGLDKQETEELILVFDLGGGTFDVSLLQLGNGVFEVLSTSGNNHLGGDDFDNCVVQWMAESFKQKENIDLSTDKMAIQRLREAAEKAKIELSSMLNTTINLPFITADESGPKHLEMELARSQFEELTKQLLEDTRVPLTQALDDGEIRASDVHRVILVGGSTRIPAIQRVIQEFFPDSQLERSVNPDEAVALGAAIQAGVIGGEVEDVLLLDVTPLSLGLETLGEVTTKIIERNTTIPTSRSEVFSTAVDGQTSVEIHVIQGERAMARDNKSLGKFLLAGIPPAPRGMPQIEVSFEIDVNGILKVSAQDQGTGKEQSIVISHTGGLSGGEIEKMRQEAQQYAAQDQLRLRMMELQNQADSLFHTYETTLQESGELVREELKSSGKQKKDQLAIALRTPNTPVEKLQTLVEEFRQIILLIGTEVYQQGKGAASNEFANFVQGTSSGTSQMIESLETNLNPIQASSGITMTPGTMINGTVNPGGMDYVETAPVYGLDDGEEFDFDADETVYSDYEAID

SEQ ID NO: 2806 - protein, 428 aa, Synechocystis sp.
MTPSLLPPRLNLPHVEVLPNGLTIIAEQMPVEAISFQLWLRVGSRWEGDEINGTAHFLEHMVFKGTPRLAMGEFERAIESRGAGTNAATSQDYTQFYFTSAPQDFEHLAPLQLDVVLNPTIADGPFERERLVVLEEIRRSQDDPQRRIFQQVVQLAFPGTPYARPVLGRREIIENLQAQQMRDFHAHWYQPPAMTVTVVGNQSVGNLVETVARSFADCYRVKSPSQTLMPPLVNIPPPFTKVETTTVVDDSLQQARLILLWRSPGLDQFEKTLPLGVLAVILGRGRVSRLFRELREEKGLVTAIGASNSTQATQGMFYISAQLPAENIPMVEQYILDHIERLQNEPIPEKDLERIRTQVANRFIFGNERPGDRANLYGYYYAQIGDLEPALTYPVQIQALTAADLQKSAQTYLSPTAYGKVIALPAED

SEQ ID NO: 2807 - protein, 448 aa, Synechocystis sp.
MQFAKILIANRGEIALRIIHSCEELGIPTVAVHSTIDRHALHVQLANESVCIGPPPSNKSYLNIPNIIAAALTRNATAIHPGYGFLAENARFAEICADHQITFIGPSPEAITAMGDKSTAKKTMQKSGVPCVPGSPGLIESEATALKIAAEIGYPVIIKATAGGGGRGMRLVQEEKDFLKLFHAAQGEAGAAFGNPGVYLEKFIEKPRHIEFQILADSHGNVVHLGERDCSIQRRHQKLLEEAPSPFLTPHLRKKMGEAAVKAAKSINYVGAGTVEFLVDGNGNFYFMEMNTRIQVEHPVTEMITGYDLISEQIRIAMGEKLRFRQSDVEIRGHAIECRINAEDPKQNFRPHPGKISAYLPPGGPGVRIDSHVYTDYEIPPYYDSLIGKLIVWAGDRPSAIKRMQRALRECAITGVPTTLEFHQRILQTPAFLAGDVYTNFIEEHLTP

SEQ ID NO: 2808 - protein, 420 aa, Synechocystis sp. [sequence omitted]

SEQ ID NO: 2809 - protein, 748 aa, Synechocystis sp.
MATTVQLSDQSLRQLETLAIHTAHLIQPHGLVVVLQEPDLTISQISANCTGILGRSPEDLLGRTLGEVFDSFQIDPIQSRLTAGQISSLNPSKLWARVMGDDFVIFDGVFHRNSDGLLVCELEPAYTSDNLPFLGFYHMANAALNRLRQQANLRDFYDVIVEEVRRMTGFDRVMLYRFDENNHGDVIAEDKRDDMEPYLGLHYPESDIPQPARRLFIHNPIRVIPDVYGVAVPLTPAVNPSTNRAVDLTESILRSAYHCHLTYLKNMGVGASLTISLIKDGHLWGLIACHHQTPKVIPFELRKACEFFGRVVFSNISAQEDTETFDYRVQLAEHEAVLLDKMTTAADFVEGLTNHPDRLLGLTGSQGAAICFGEKLILVGETPDEKAVQYLLQWLENREVQDVFFTSSLSQIYPDAVNFKSVASGLLAIPIARHNFLLWFRPEVLQTVNWGGDPNHAYEATQEDGKIELHPRQSFDLWKEIVRLQSLPWQSVEIQSALALKKAIVNLILRQAEELAQLARNLERSNADLKKFAYIASHDLQEPLNQVSNYVQLLEMRYSEALDEDAKDFIDFAVTGVSLMQTLIDDILTYAKVDTQYAQLTFTDVQEVVDKALANLKQRIEESGAEIEVGSMPAVMADQIQLMQVFQNLIANGIKFAGDKSPKIKIWGDRQEDAWVFAVQDNGIGIDPQFFERIFVIFQRLHTRDEYKGTGMGLAICKKIIEGHQGQIWLESNPGEGSTFYFSIPIGN

SEQ ID NO: 2810 - protein, 675 aa, Synechocystis sp.
MSNSPSVLTELLQALPNLRAQTYFKSSLTALSHAMEDQVLAESTAGNPLIIAAFQRERFYRQEAHRYRRIADKSSQVYVLSAPETEFKHNSGIYETIAFTPEDSLAQEWHLIVIGDRYASCLICRERPTQDKWDSNRRFEGVWTFDRQVSRVAAQLLLQRILAYRPELQAKIEEATQTWLQPSCTVPPRGIDDNPDPFVQRLITYLQAGQYKLIKANRNLQDKEERERLLNSITGAVRRSLDPEEIMQVAVEKLGQGLGICRCVIYRCSADDTVATINHEFLGSGVGSIKGYPWPLKDNPLFQEVVVLKEAIAIDNIDRDPRLGEPEPSTGEVKTLVKSCAILSWMLVPIFYRERLLGMMEFHHCGPAPTEWEDDALTLVEGVATQIGVALIQAESYANLQELNEQLAALDRTRSNLVAITGHELRTPLSTIQVCLESLATEPDMPQELRQVMLNTALEDAERMRKLVQDFLTLSQLESGRVEWNAEPISLEECVELSLSHIRAHNRGQEVPVIVNQVNGETPMVEADGEWLVELLTKLLDNAIKFTPTNGRISIAVDRPNPSQLEVTITDTGRGIEPNRLETVFDRFYQEEGALRRSRGGTGIGLAICRQIVSGWGGEIWAASDGKNHGTQFHFTVPIVMPENPNLGVEEVAPKKRKATSPRIASRSKKKQKFS

SEQ ID NO: 2811 - protein, 433 aa, Synechocystis sp.
MTVKIGLLGLGTVGSGTVEILQDPQGRSPLLKAIEVKAVGVRSLDKPRQVNLPPEVLTTDLEAIVTDPDIAIVVELMGGLEPARSLILQAIAHKKHIVTANKAVIARYGPEIYEAANQHGVYVLLEAAVGGGIPIIKPLKQSLGGNRIQSIVGILNGTTNYILSRMTSEGADFDEVLTAAQQLGYAEADPSADVDGLDAADKIAILASLGFGGRVKREDVACEGIRSVSAVDIAYADRLGFVIKLLAIADGNAGEDSEALQLRVHPTLIAKDHPLASVNGVYNGVLVTGDPLGQVMFYGRGAGAGPTASAVVSDVINIVGIITSSDENPALDPLLSCTHQHYCQVSPIEDLVTRFYCRFLCADVPGVIGHLGMGFGNHGVSLESLVQIGFTDGCAEIVVVTHDVREGDYRAALEEISQLEAVKEIPSVIRVLS

SEQ ID NO: 2812 - protein, 331 aa, Synechocystis sp.
MTISLEADLKSLQQSAQAAISGCDDLDGLDKLRVQYLGKKGELSLILKGMGKLSAEERPKFGAIANEVKEALQHDLESRKANLQNAAIEAQLAAETLDVTMAGSYRPQGRRHPLNSTVDRVLDIFVGLGYTVATGPQVETDYYNFEALNIPADHPARDMQDTFFLKDGRLLRTHTSPVQIRYMEKHDPPIRIVAPGRVYRRDTVDATHSAVFHQVELLAIDKGLAFTHLKGTIQAFIKQMFGEALPIRFRASYFPFTEPSAEVDVQWQGKWLEVMGCGMVDPNVMEAVGYDPEVYTGFAAGFGVERFAMVLHQIDDIRRLYNSDLRFLRQF

SEQ ID NO: 2813 - protein, 269 aa, Synechocystis sp.
MNESPAQPLTETIPVFTTQNLDIYYGSHRAVRDVSLTIPKNKITAFIGPSGCGKSTILRCFNRLNDLIESFRLEGKVLYHSQDLYSPNIDVTAVRKYIGMVFQKPNPFPKTIFDNVVYGARVNGYKGNLEELAEDSLRRAALWDEVKDKLKASGFSLSGGQQQRLCIARAIAMQPEVLLMDEPCSALDPISTLKVEELMNELKENYTIIIVTHNMQQATRVADYTAFYNAEATDKGNKVGYLVEFDRTGKVFGDPQEQETKDYVSGRFG

SEQ ID NO: 2814 - protein, 284 aa, Synechocystis sp.
MFNGFRFNGNRIGDRRWFCGGGGEPVTGTNVRAMDRSQEKEAIKSPIPPAIRVRELSFAYGGQTPVLNNLAWQVAPGERLGIIGHNGCGKTTLFLLLCGLLKASAGTIQLLGQALEAGKFLPEVGFLFQNPTDQLFATSVWDDIAFGPQNMGLSPAQVTERVNQAAELTGITSLLDRLPQHLSGGEKQMVAIAGLLAMAPKILLCDEPTASLDIKARRQLINFLGQFQQTLLISSHDLEFVLEVCNRVIIIDQGQIVADGPAQEIMADQTLMESHGLEKPYSLR

SEQ ID NO: 2815 - protein, 433 aa, Synechocystis sp. [sequence omitted]

SEQ ID NO: 2816 - protein, 1105 aa, Synechocystis sp.
MAIADKAYTMIGIEIPITSRTVLPMPRRNDLNKIMILGAGPIVIGQACEFDYSGTQACKALKEEGYEVVLVNSNPASIMTDPELADRTYIEPLIPEIVEKIIEKERPDAVLPTMGGQTALNLAVSLSKSGVLEKYGVELIGAKLPAIEMGEDRELFKEAMARIGVPVCPSGIASSIEEARQVAHEIGSYPLIIRPAFTLAGTGGGIAYNQEEYEEMVQYGLDQSPMSQILVEKSLLGWKEYELEVMRDLADNVVIICSIENFDPMGVHTGDSITVAPAQTLTDKEYQRLRDYSIAIIREIGVETGGSNIQFSVNPANGDVIVIEMNPRVSRSSALASKATGFPIAKFAAKLAVGYTLNEISNDITKKTPASFEPTIDYVVTKIPRFAFEKFPGAEPILNTQMKSVGEAMAIGRTFQESFQKALRSLETGRFGFGCDRHETLPTLSHLRSQLRTPNPERVFSLHHAFNLGMTVEEIHELTAIDPWFLDKLEDLVKTEKYMKQRSLKDLTAADLRYIKQQGFGDRQIAFATKTTEDEVRAYRKSLGITPVYKVVDTCAAEFEAFTPYYYSTYEPEECEVLPSDKPKVMILGGGPNRIGQGIEFDYCCCHAAFSLSDAGYETIMVNSNPETVSTDYDTSDRLYFEPLTKEDVLNIIEAENPVGIIIQFGGQTPLKLAVPLQKYLNSPDCPVQTKIWGTSPDSIDTAEDRERFEKILHELEISQPPNGIARDYEESRVVANRISYPVVVRPSYVLGGRAMEIVYSDEELERYMTYAVQIEPDHPILIDKFLENAIEVDVDSLTDSTGKVVIGSIMEHIEEAGIHSGDSACSIPYTSLSDNVLTTIRQWTEQLARALNVVGLMNIQYAVQGDQVYILEANPRASRTVPYVSKATGRPLAKIASLVMSGKTLEELGVTEEFIPQHVAVKEAVLPFSKFPGADTLLGPEMRSTGEVMGIDSDFGKAFAKAELGAGVILATTGTVFVSMSDRTKEAAVPVVRELIDLGFKVVATSGTQKVLREHGIEGVEVVLKLHEGRPHVIDWIKNGQIQFIINTPSGEESQLDGRTIRRAALDYKLPIITTIAGGKATVAALRSLQDHPLDVKALQDYLG

SEQ ID NO: 2817 - protein, 178 aa, Synechocystis sp.
MAAQIIEILSPEEIRRTLTRLASQVIEKNSDLSELVLLGIYTRGVPLAHQLAQQIEMLEQVKVPVGAIDVTLYRDDLKRIKTRTPAKTKIPLSLTGKRVVLVDDVIYKGRTIRAALNAVTEYGRPQVIRLLTLVDRGHRELPIHPDFVGKILPTAAEEQVKVYLQDPDGRDTVELIKG

SEQ ID NO: 2818 - protein, 234 aa, Synechocystis sp.
MTIASSHSINNGMNTGKLVNQLSSLPDRNTHNGQEVKYHPENVELNKEKMMDAVRVMLESVGEDPEREGLLKTPKRVAEAMQFLTQGYDQSLEKLVNGAIFDEGHNEMVLVRDIDFFSLCEHHMLPFMGKAHLAYIPNQKVVGLSKLARIVEMFSRRLQVQERLTRQIAEAVQEILDPQGVAVVMEATHMCMVMRGVQKPGSWTVTSAMIGSFQNEQKTREEFLNLIRHQPNFY

SEQ ID NO: 2819 - protein, 483 aa, Synechocystis sp.
MTVRVRIAPSPTGNLHIGTARTAVFNWLFARHTGGTFILRVEDTDLERSKAEYTENIQSGLQWLGLNWDEGPFFQTQRLDHYRKAIQQLLDQGLAYRCYCTSEELEQMREAQKAKNQAPRYDNRHRNLTPDQEQALRAEGRQPVIRFRIDDDRQIVWQDQIRGQVVWQGSDLGGDMVIARASENPEEAFGQPLYNLAVVVDDIDMAITHVIRGEDHIANTAKQILLYEALGGAVPTFAHTPLILNQEGKKLSKRDGVTSIDDFRAMGFLPQAIANYMCLLGWTPPDSTQEIFTLAEAAEQFSLERVNKAGAKFDWQKLDWINSQYLHALPAAELVPLLIPHLEAGGHQVDPDRDQAWLVGLATLIGPSLTRLTDAATESQLLFGDRLELKEDGQKQLAVEGAKAVLEAALTFSQNTPELTLDEAKGEINRLTKELGLKKGVVMKSLRAGLMGTVQGPDLLQSWLLLQQKGWATTRLTQAIAAE

SEQ ID NO: 2820 - protein, 502 aa, Synechocystis sp.
MANKFETVKATKDGLAVRAELEHFAQIGWENIPEEDRDLRLKWLGIFFRPVTPGEFMLRFRIPHGLLTSQQLQVIGDIINRYGDRGNGDITTRQNLQVRGIKIEDIPDIFSKLESCGLTSVQSGMDNVRNITGSPVAGLEKDELIDTRDLVQGVQDMITNGGRGNPEFTNLPRKFNIAIEGSRDNSVHAEINDVAFVPAYREGILGFNVVVGGFFSSRRCEAAIPLDAWVQPDQQVVDLCRSILEIYRDHGLRANRQKSRLMWLIDEWGVAKFREEVAAKLPFPLLTAAPKDELDWDKRDHLGVHPQKQAGLNYVGLHVPVGRLYANDFFELSRLADTYGSGEVRLTVEQNLILVNVPDEKLEALLAEPLLTKFRVDPHNLQRSVVSCTGAQFCKFALIETKNRALAMVAALEKELTVPKPVRIHWTGCPNSCGQPQVADIGLMGTKVRKDGKTVDGADVYLGGKVGKDAHLGTCVHKSIPCDELQPLLAQILIEQFGAVRR

SEQ ID NO: 2821 - protein, 437 aa, Synechocystis sp.
MKTVVGKHNPKVGGSNPPPAIKKKEKNSPRRIMVGGFVLFNLKFMATGSTAYTWLDDALETIQRAHWHRHPQIITQGPGPEIKLEGQRLVNFASNDYLGLASHPHLKTAAIKAIAEWGTGSTGSRLLSGHRQLHQDLEQAIARWKGTEAALVFSSGYLANLGTITALVGKRDLILADEYNHSSLKRGAQLSGAKVINYDHGCPEVLTDLLMKHRDNHRRCLILSDGVFSMDGDLCPLPQLVAIAEEFQSMLLVDDAHGTGTMGKMGTGCREHFQLPVGDWIQVGTLSKALGSLGGYVAGSASLIDFLRNRAATWIYTTGLSPADTAAALAAIQLIQREPERIVQLQLNVDYLATGLESLTKLNFRRSPINSPILWVGAANPAMALEMAKHLREQGIFAPAIRPPTVPHSRIRFSVMATHSPGHIDQLLEVLDHYYPN

SEQ ID NO: 2822 - protein, 324 aa, Synechocystis sp.
MNILEYAPIACQSWQVTVVGAGNVGRTLAQRLVQQNVANVVLLDIVPGLPQGIALDLMAAQSVEEYDSKIIGTNEYEATAGSDVVVITAGLPRRPGMSRDDLLGKNANIVAQGAREALRYSPNAILIVVTNPLDVMTYLAWKVTGLPSQRVMGMAGVLDSARLKAFIAMKLGACPSDINTLVLGGHGDLMLPLPRYCTVSGVPITELIPPQTIEELVERTRNGGAEIAALLQTGTAYYAPASSAAVMVESILRNQSRILPAATYLDGAYGLKDIFLGVPCRLGCRGVEDILEVQLTPEEKAALHLSAEAVRLNIDVALAMVSDG

SEQ ID NO: 2823 - protein, 653 aa, Synechocystis sp. [sequence omitted]

SEQ ID NO: 2824 - protein, 318 aa, Synechocystis sp.
MLNPLNIEYLYLSKLFDNSLIVFNKRQLFRFFVRFFFMTAALPNDSKPKLTPAWTVIFFFTSIHLVALLAFLPQFFSWKAVGMAFLLYVITGGIGITLGFHRCISHRSFNVPKWLEYIFVICGTLACQGGVFEWVGLHRMHHKFSDTTPDPHDSNKGFWWSHIGWMMFEIPAKADIPRYTKDIQDDKFYQFCQNNLILIQVALGLILFALGGWPFVIWGIFVRLVFVFHFTWFVNSATHKFGYVSHESNDYSRNCWWVALLTFGEGWHNNHHAYQYSARHGLQWWEVDLTWMTIKFLSLLGLAKDIKLPPETAMANKA

SEQ ID NO: 2825 - protein, 342 aa, Synechocystis sp.
MAKTPILVTGGAGFIGANFVYHCVQTCGDRRIVVLDALTYAGNRATLAPLEKLPNFRFVQGDIGDRHLVDQLLREEQIETIAHFAAESHVDRSILGPGAFVQTNVVGTFTLLEAFREHWQRRGNPAQFRFLHVSTDEVYGSLTPNEPGFSETTPYSPNSPYSASKAGSDHLVRAYFHTYGLPTLITNCSNNYGPYQFPEKLIPLMCLNILRGEKLPVYGDGQNVRDWLYVTDHCQALDLVLHQALPGATYNIGGNNEVKNIELVEILCDLMDELAPDLPVKPARQLISYVTDRPGHDRRYAIDASKIKRELGWEPKVTVERGLRQTVQWYLDHEAWWRPLLG

SEQ ID NO: 2826 - protein, 212 aa, Synechocystis sp.
MATIFRTWSYQYPWVYALVSRLATLNVGGEERFHQLPLENLAISPGQKVLDLCCGGGQATVYLAQSGATVVGLDASPKALGRAKINVPQATYVQGLAEDLPFGEGEFDLVHTSVALHEMTPAQLQSIISGVHRVLKPGGIFALVDLHRPSNWLFWPPLAIFMGLFETETAWQLINTDLGSLLDQAGFTVVRKHLYAGGSLQVIQARANKTVN

SEQ ID NO: 2827 - protein, 387 aa, Synechocystis sp.
MGRVGVLLLNLGGPEKLEDVRPFLFNLFADPEIIRLPFPWLQKPLAWLISTLRAKKSQANYAEIGGGSPLLQITEAQASALTTRLERLGQDAKVYIGMRYWHPFTEEAVEKIKGDRLQRLVILPLYPHFSISTSGSSFRVLEEMWHNDPSLRQLDYSLIPSWYDHPGYLQAMADLIAQELKKFPNPDQAHIFFSAHGVPQSYVDEAGDPYQAEIEACTRLIMRTLDRPNQYTLAYQSRVGPVEWLKPYTEEALQKLGAEGIDDLLVVPISFVSEHIETLQEIDIEYREIAEEAGIDNFQRVPALNTHPVFIDALAQMVMDSLNDPPCTFETVPHPKKNMKMYPQERWEWGLTTAAEVWNGRLAMLGFIALLVELISGQGPLHFVGLL

SEQ ID NO: 2828 - protein, 245 aa, Synechocystis sp.
MEIVCKIQRQLTDGDRHWQNYYLDVDPQTSILNCLNQIKWQQDGSLAFRKNCRNAICGSCAVRVNDRPVLACKESIKSLGQWLAESNQENTGVFTISPLGNLPVIKDLVVDMEKFFAGLDAVYPYLINKHQGEKGAEFSQSPEQRAALNDVSNCVLCGVCYSDCDAKKKNENFVGPHALAKANRLILDNRDMATKARLEALGKDKQGVWGCNNCRMCSDSCPTGVAPLSQIEALKIRLFDLMDPL

SEQ ID NO: 2829 - protein, 492 aa, Synechocystis sp.
MTNTLTSTFADLGLSEKRCQLLADIGFEAPTQIQTEAIPLLLSGRDMLAQSQTGTGKTAAFALPLMDRIDPEGDLQALILTPTRELAQQVAEAMKDFSHERRLFILNVYGGQSIERQIRSLERGVQIVVGTPGRVIDLIDRKKLKLETIQWVVLDEADEMLSMGFIDDVKTILRKTPPTRQTACFSATMPREIKELVNQFLNDPALVTVKQTQSTPTRIEQQLYHVPRGWSKAKALQPILEMEDPESAIIFVRTKQTAADLTSRLQEAGHSVDEYHGNLSQSQRERLVHRFRDGKIKLVVATDIAARGLDVNNLSHVVNFDLPDNAETYIHRIGRTGRAGKTGKAIALVEPIDRRLLRSIENRLKQQIEVCTIPNRSQVEAKRIEKLQEQLKEALTGERMASFLPLVRELSDEYDAQAIAAAALQMIYDQSCPHWMKSDWEVPEVDFNKPVLRRGRNAGGGQNKSGGGYQGKPGKPRRSSGGRRPAYSDRQQ

SEQ ID NO: 2830 - protein, 351 aa, Synechocystis sp.
MGNEKARVGIIGASGYGGIQLVRLLLEHPQVELTYLAGHSSAGKPYSDLYPHLTHRVNLTIEPIDLEAIASRCDAVFLGLPNGLACDMAPALLAKGCKVLDLSADYRFRNLNTYTEWYKKDRQDQATNNQAVYGLPELYRDAIRDAQLIGCPGCYPTASLLALSPLLKQGFIVPETAIIDAKSGTSGGGREAKVNMLLAEAEGSLGAYGVAKHRHTPEIEQIASDLAGTELRVQFTPHLIPMVRGILATVYATLRDPGLVRDDLITIYSAFYRASPFVKILPHGVYPQTKWAWGTNLCYIGIEVDPRTGRVIVLSAIDNLVKGQAGQAVQCLNLMMGWEESLGLPQLAFYP

SEQ ID NO: 2831 - protein, 542 aa, Synechocystis sp.
MITTDVVIIGAGHNGLVCAAYLLQRGLGVTLLEKREVPGGAATTEALMPELSPQFRFNRCAIDHEFIFLGPVLQELNLAQYGLEYLFCDPSVFCPGLDGQAFMSYRSLEKTCAHIATYSPRDAEKYRQFVNYWTDLLNAVQPAFNAPPQALLDLALNYGWENLKSVLAIAGSKTKALDFIRTMIGSPEDVLNEWFDSERVKAPLARLCSEIGAPPSQKGSSSGMMMVAMRHLEGIARPKGGTGALTEALVKLVQAQGGKILTDQTVKRVLVENNQAIGVEVANGEQYRAKKGVISNIDARRLFLQLVEPGALAKVNQNLGERLERRTVNNNEAILKIDCALSGLPHFTAMAGPEDLTGTILIADSVRHVEEAHALIALGQIPDANPSLYLDIPTVLDPTMAPPGQHTLWIEFFAPYRIAGLEGTGLMGTGWTDELKEKVADRVIDKLTDYAPNLKSLIIGRRVESPAELAQRLGSYNGNVYHLDMSLDQMMFLRPLPEIANYQTPIKNLYLTGAGTHPGGSISGMPGRNCARVFLKQQRRFW

SEQ ID NO: 2832 - protein, 339 aa, Synechocystis sp.
MEFDYLHLYVDDYQSAHRCYQRQWGFTCVNKIITDQGITGIYQQGQILLLISASESSLSRYADYLQKHPPGVGEVAWQVANWQKIQHQLSELQIETTPVIHPLTKAEGLTFLLWGDVHHSIYPVRSELNQNKTLHGVGLTTIDHVVLNIAADQFTQASQWYQQVFGWSVQQSFTVNTPHSGLYSEALASANGKVQFNLNCPTNNSSQIQTFLANNHGAGIQHVAFSTTSITRTVAHLRERGVNFLKIPTGYYQQQRNSSYFNYASLDWDTLQCLEILLDDQDNTGERLLLQIFSQPCYGVGTLFWEIIERRHRAKGFGQGNFQALYEAVETLEKQLEVP

SEQ ID NO: 2833 - protein, 456 aa, Synechocystis sp.
MNTAKTVVAEQRDFFRQGKTKSVQDRLTALAKLKTQIQAQEEEIIKALKQDFGKPTFESYVNEILGVIREINYYQKHLQQWSKPQRVGTNLMVFPASAQLRPEPLGVVLIISPWNYPFYLCLMPLIGAIAAGNCVVVKPSEYTPAISGVITRLIQNVFSPAWATVVEGDETISQQLLQEKFDHIFFTGSPRVGRLIMAAAAEQLTPVTLELGGKSPCVVDREINLQETAKRIMWGKLVNAGQTCVAPDYLLVEQSCLEQLLPALQQAIQMLFGENPAHSPDYTRIVNQQQWSRLVSLLSHGKVITRGDHNEGDRYIAPTLIIDPDLNSPLMQEEIFGPILPILTYQSLSEAIDFINIKPKPLALYFFSNNRQKQEEILQSTSSGSVCLNDILLHLTVTDLPFGGVGESGMGRYHGKATFDTLSNYKSILRRPFWGETNLRYSPYGKKMNLIKKLFS

(The sequence listing continues in the following parts.)

What is claimed is:

1. A transformed plant comprising a recombinant DNA construct comprising a promoter functional in a plant cell positioned to provide for expression of a polynucleotide encoding a S-adenosyl-L-homocysteine hydrolase having an amino acid sequence which has at least 50% sequence identity to SEQ ID NO:1740.

2. The transformed plant according to claim 1, wherein said polynucleotide comprises a nucleic acid sequence with at least 90% identity to SEQ ID NO:25427.

3. The transformed plant according to claim 2 wherein said plant is maize.

4. The transformed plant according to claim 2 wherein said plant is soybean.

5. A method of producing a transformed plant having an improved property, wherein said method comprises transforming a plant with a recombinant construct comprising a promoter functional in a plant cell positioned to provide for expression of a polynucleotide encoding a polypeptide useful for improving plant cold tolerance or yield improvement by providing improved plant growth and development under at least one stress condition wherein said polypeptide has an amino acid sequence which has at least 50% sequence identity to SEQ ID NO:1740.

6. The method according to claim 5, wherein said transformed plant is a crop plant.

7. The transformed plant according to claim 6 wherein said plant is maize.

8. The transformed plant according to claim 6 wherein said plant is soybean.

* * * * *